United States Patent 7,834,146 (RECOMBINANT POLYPEPTIDES ASSOCIATED WITH PLANTS) - sequence listing, part 8

SEQ ID NO: 27205 - DNA, 260 bp, Sorghum bicolor
  Clone ID: 6674900
gagcaaaatccgagcaagataaaccccgggatttgctttattttttttgggacccctacaggagcgttacggttaaaggacttttgatttcagggtgtatttttttttgaaaagtgggcattttggataatggataatggatattgcgatttaagtcagatcatggatagcaaacatcaggaggggtggccccaaaaaggaaagtgtggaaaagagttttttcatatcataacatgacgcaatgaaaacatttgtgtttt

SEQ ID NO: 27206 - DNA, 413 bp, Sorghum bicolor
  Clone ID: 6674906
cccgccgagcagtgccggagcaccaccagcaacggaggaggcggcgacggctgacgagctgaggcctgagcctgagatgtgacaggacaggtggggcgcgcacgctcgcggcacggcaccccggcacgtccacgtccacgggcggcggtggttggcgtcctcgtcttgtcctggggacggacactcacaccagcaccaggctggctctcgcgtcgcgtcgctcctttgtccgcttgttttcgctggaaggaaaggagtaacctgtagtaactgtaggtcgtccgtcgtgtgattgggattaattttgggtttgggtttgtttcaagtttcaacgcggacggatttgtcgtcccgcgcccgcgccaacggtcacaggggaacgcttcttgtgtgctactagtgctactccctcc

SEQ ID NO: 27207 - DNA, 533 bp, Sorghum bicolor
  Clone ID: 6674914
tccgaagggatagagaatgctaggaatagtcagaaggtgttcgtcttcttctcagtatctgcacgtacactgggtggtctgttgcctatattagtgagcaccatattccaaaaacttaatgtagacaatatagagtatcgataacttactgcgaaccttcattacctgcgctgctagcttctgtctttctacgtttgctaggtaaactttcggctaatgcagattctaatctacgttctgctacaatatcagcatacgttcctgcttttaggaccgccatatcactaaccgttaccactgcgcattgtttgtccaaccggctgcgtcatcttcatttgtgctggcggaatgactgacagcacttctttggcataagatgcagctgttccagcggcgtatgcttgccaatccttgtttttatgagagtctgcgtagtcggaaatgccacggataacgagacacggaaacgtgtccatcagccctgctgcctccatctcaaagcataagataccaccaagccgtttactttccta

SEQ ID NO: 27208 - DNA, 141 bp, Sorghum bicolor
  Clone ID: 6674915
ctgtaacaaattccctaaaatgggccctgagtttagttttttgcttgtgaaaaaaataaacagtggggttgcaattttcctgggctggtttggttgcaaaaataagctggtctttgggaaaaaaagttttttgtttcgtcc

SEQ ID NO: 27209 - DNA, 421 bp, Sorghum bicolor
  Clone ID: 6674934
caagagcgtcgatctcccctctgccattcctccgggaacctacaacgtccttgccgacgtctactccgccgatgacgagaagatcacctgcttgaaggcgactgttaacttccctcgaccaagcctgggctccttcgagaacactgaggaattgtaatttctgctttatgctacgagaatgattacgggcaactggcaacggtggagatgattcggattctgtttttttctttttcttttgactgctgggtgttttttattttcctaaatggcattgctacggctgcgttggcttcttctgggcgagattgctgtactccttgggtgatattccgatacggttcataggcacatcattgcgacgctcttgttgctcctactagaggaaagcacgcgtaataatcctgatcaaccagtatcc

SEQ ID NO: 27210 - DNA, 539 bp, Sorghum bicolor
  Clone ID: 6674937
agtttggacgagaacatttgtgaatgtcgcttcctattttaaggcgtcttctatgtatctcttcctcagtcgccccacctagctggttgttgattgcaggtgaaaacctttccgatggtggattggcgacatcattgtcttgggcgttgttacctttcacctttcgtgaaggcattgctaggcaatttcacttctgtttattgggtctcactgtcactgctcttgttttgatgcatttgtacagtttgccattaactcttaggtccgtgtcttctctcatctcttgactgaatgtataaacgttgatgactgaaagagagaactatttgtggatgagacgatagatgaagtagacgccaaaggtcctccctgtggagcatcgatatgttgcattgagtgttgctatcttcactaaaagaatacagttgcttgaagttgacgacaaaaaatctggatttgtttagcaagttgcataataaggtaggaataagactggttttgtgagttatatctaaataaaataaagtattcatcttcct

SEQ ID NO: 27211 - DNA, 514 bp, Sorghum bicolor
  Clone ID: 6674941
tctaagccgaacagggccagtggaaggagcctataagcctaagaagctctctctagatgatgaactgaaggtatgctgcattcatatgtacaaaatgcacgtctgctttgagtctaagttagccatctgcgcatttacaggctttgcagcaaaaggttgacataaacagttacgactacaagcccatcccaagacccagtgagaaataagtgaagctgaacatcatttaccagtgcgttgagtggatgtttgtttcttgatactttcgccgtctcatcttgctacaagttttgtatgaatgtatggagctgattcaagtttggaattagaaaagaggaatgctccatcataatcattataactttatgctccgtgagacatgagctgtagagaattggcaccaggaaccttgaactgtaggaatcagtgtttgtagcaacagcaattacgccttcatggcatgcctgtattgttactcagatgcttggatactaacgcgaattaataaattgtt

SEQ ID NO: 27212 - DNA, 444 bp, Sorghum bicolor
  Clone ID: 6674942
ttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaactggcaatcgtaccatgtctgatgccccgtcaactgctggtcttaaatttctccttcagaacgatactcctatatgaacaagattcgttgattctttgccgtctgttctagtatgttctattgctgtaattcttttgtactactgtgtactcctatgcctgttcaaccaaaaatgttataaatgccaaagcaaatatatattgcttttgttgcc

SEQ ID NO: 27213 - DNA, 530 bp, Sorghum bicolor
  Clone ID: 6674944
gttcctcctcatcgatctcaagggcgagggcgcgggcaagatcgtcggcatcaagtggaacggctccgggcagacgaacggcatggagcaggacgaggtcaaatacatggtctccacggcctgcgccttcgtcatgggcgtcaatttggagagcggcttgctgtgaagctgcttggacgggtgacgatggtttaacgtgcccaatgcctgtctggccttgggtggggaatgggtaatgcgaataatgcggatacgcggctacggatcatggacgttttgatttcctttcttgtatcatgactaggagcttttctttacggattctttcagttttggagttctgtagggtaggctctcgggaagggcttttcttttcttgccttctcttttcttttctctgattacattctgtgtagatatatggtgcgagcgatcgagaggatggaattgggttctagtagcaattcgtctgagagatgcaatggacctggaagaaagcgcggcgtcagggcgcttatggttgacctttg

SEQ ID NO: 27214 - DNA, 489 bp, Sorghum bicolor
  Clone ID: 6674946
agggtttgatcgataatgagaaacttgactctttctacataccaatatacgggccgtcagagaaggaggtgcgagagataatagaagctgagggttcattttcaatcgacaagatggctgtccatgaatctcttgatggcattgacgcgccgaagacagcggcgcgcgctctgagagctgtaatggaggcgatcatagcgcagcatttcgggccatctgcagatgctatggacgagttcttaaagatcacggagaagttcatcgagatggcgcctctagatgcgttctctccaaacaaatccagcgctttcgttgctgcgtccctcaccaggaggacatgatggacgcaacgtgtgtttcatatatgtatgtttggcaaatcacaagatttacatgcgtgtaataataaactataacaatgatatgttttgtggaacaatttttaattataatatccggtggtgatcgacttagcttacgtgctaagtg

SEQ ID NO: 27215 - DNA, 503 bp, Sorghum bicolor
  Clone ID: 6674947
cgcccgccgacttgagcaagatctcgatcgacgccggcaactacgtgcagatcatcaacatcaagggcactggcgatatcaacttcaccaacttcgccatctcctcgcagctcgacccctcgcaggtcatcttcaacgtggtcggcaacaacaaggtcaccatcagcggcttcgagctcaacggtcacctgctcgccctccagtcggatgtggtgctcgaaaacggccacgtcacgggcaacgtgtactccaagtcgctcgtcggctccggcagcggccaggtcaacctcgctccctgcccctagagctaagttccgtcgtcatcgcgctgtcggtccgactcgactccataaacaagggtaccgagtcaacgacgacgcgcagacatgggaagggcaagcaagctcgccttcctcgttcctaccccctcttccaattgttgttcgtacaccgaactctcccctcttctctcattttttctaaatacacgatcattagacttg

SEQ ID NO: 27216 - DNA, 558 bp, Sorghum bicolor
  Clone ID: 6674955
tcctgttggcagtgcttatttttatcctaatattcctactactattgtggttgtttcattcgtacattgctctaacaaatcaaacaacctacgaagttgccagaagaaagcgaatattctacctaaggggagtacctgaaagagttcatccattcagtagaggcatatgcagaaatctctacgacttctgctgttctagccagaagggatatattctggaagctgtgcccccaagtgaggagctggaagctagagctgctcgttacacgtgccgagatgtcatttgctgccgttgctgctgataggctttacaatagcattctgcccatatagccagttccgctgttctttgtccaacctttcgctaatggaagcaaattttagtgacctgcgaccgttagatactctagagttcattatttgtgcatagtcatttgtacatttcactcagaaaatgtgtgccctgagatcaagttgttgacagtttgtctgtaaaattctgtatggccctgcattcaaataggttttaaggacagataggattgatctgtacttttc

SEQ ID NO: 27217 - DNA, 546 bp, Sorghum bicolor
  Clone ID: 6674972
ttagccacctgctcatgaacatggttcccctctttctcgttggatccgcactacatgaggatattggccgagccaatttgcttaccctctatgtgggctgcggtgcggtcggctttgtgggcagtgtggctacatatgctatgcgaggcatgctaggcgttaccactttgggcgcctcggcagcaacgctgggtgtttgcgccgcatacttctgggagcatcgtcttgatggctacagattctttggtctaccccaagacggtgtgccgggcatcattttcctggcgctcatatgcgttcctcaacttgctgcctttggtaagacggtcaagttgaagattgacatcgcttcgcatttgtgcggaattttgaacggtattctcggcatggagctgatcaaccgaacaagaagtgagcgggagaaaaggacgatcgatgtggctggtactcccgtccgtgcggcacgattgcctcgacctgatgagtcaattgagggatctaactaagatgagatgaattgtacgttaatgtactatattgtttttg

SEQ ID NO: 27218 - DNA, 478 bp, Sorghum bicolor
  Clone ID: 6674975
ggccggcccgggtgcgtccgctacgtggcctccctggcgccgggcaccaccacgggggagatcggcatctgggcgacggagaagctgctggagatcgaccacgacgcccggcggctcgcgtacgccgtcgtcggcagcagcttggggttcggcagatacgtcgctactatgagcatcgtcgctgctgacgacgaggacgacgcggggtgcaggctggtgtgggcgttcgagtgcgaccccgtgcaggggtggagccgggatgggatgctcgcctacctcgacgccggcgtcaagggcatcgccgcgcggatcgaggaagcccatgccgccgccgccagcgccagtgccggaggagacggcggcgtcgctgcttgacaactccatctgcgggcgggtggaatctcaacagtcgccagatgcatttctatattgaattgttattacgtcgtcaaactaattaatgcattgttaattgcta

SEQ ID NO: 27219 - DNA, 551 bp, Sorghum bicolor
  Clone ID: 6674978
actggtggatacgtttcaaacttggctgtgtccctagatgggcggccaaacgaggttcggccgcttgagcggtgcgacacctatacgtttattctcgacgcgatcgaaagtgcttcgtcgcgtggctacgatacatactgggccgggtacggtaactggtcggagactttcccaggagaggaaaaagaggagtcggttgcaatttttattagtacattttctatcctgtacatgacaaaggatgagtgagcttccgagcatggcgttttcatcgggaattgctagcgctcagcgttgcgttcttgggtacttagaagggttgggaaatggtgttcagggagatatatctagctattattggggtttttgtggtatctgaagggcatgctgggaaatgccggacttgtcgttccgttcggttggaacattactgagcggttggatgagattagtaccgtttgcctacggataggagaacctcggctggcttcaaggcgtaggagtcggagtcagtaatagaccgtgctggaaatgcacgcatttatccctgg

SEQ ID NO: 27220 - DNA, 560 bp, Sorghum bicolor
  Clone ID: 6674988
gtcgtttcctacgctcaaggttacgttttgatgcgcgctcaagccaaggagctcagctggcacttgaactacggaggtatcgctttgatgtggagaggcggttgcatcatccgatccaagttcttgggtaacatcaaggaagctttcgataagaacgccaacttggagaacttgctcttcgatccctacttcgtcaacaagatgcaagccactcactctggttggagacgcgttgctgccctcgccgttactcgcggtatccccatccctgccatctccactgctttggcttacttcgacggtttgagaactgctcgcttgcccgccaacttgactcaagctcaacgtgactacttcggtgcccacacttacgaacgtgttgacaagaagcgtggtgaattcttccacaccaactggaccggccacggtggtaacactgcctccactgcttacatcgtctaagcttggacatccggatcttgtttaattcgtctgtattaatcttttgttttttggcaacttcatagcgagttgcgttataaataaactgtctaaaccct

SEQ ID NO: 27221 - DNA, 432 bp, Sorghum bicolor
  Clone ID: 6674997
gggagtcctgaggagtacgaggcgatcgcgcacgccgtgcggcgcgggacggccgtcccggacgtggccgtgctcgcgcggcagggcctcgcgttcattgttcgcgagggccggagcggagctgcgcggtcgcgttcgggtgggctttgtggctgcgggaacacgcctagctacgcgtggcacgccaccgtcggcgtggccgcagccgtgtccatcgcggcgttcgcgtactggtatggctggaaggcgccctacctggcgaagcgcgactcgtgaacaaggcagcagcctggttcgtggaccaagaagacaacaactgtacatcaatcaatcgattagatctattatcatcacatttagatgtataaaagttacttataagattaactgcaacaataaaaaaaacgtacgccgagcatctccaagatttcc

SEQ ID NO: 27222 - DNA, 207 bp, Sorghum bicolor
  Clone ID: 6675023
ggcctatcttgagactgagatttcggttaggtcaaacatacaattcagagctcctcaaaatgctctagattcatcatcatcagttattgatctatctaattttctgtttttatgttggaaacatgcggaaacagtaagttcaccgaacgagcactattgtttgggtaatttggaacccacataataaagcccaaattatatactttg

SEQ ID NO: 27223 - DNA, 528 bp, Sorghum bicolor
  Clone ID: 6675037
actgcaaacctgcttatttggacaatgctattaattccccgactccaaagttcggtgcagagtcagcacaaagtcatgattctatggacaaaaagggacagaatgatgctgaggagcttgaggagagtatgacaccgccagcctatagtgaacctcccagaaatatacaacttagcttacgaagtgcttccgctaagatgaagccttctacattaccaagacgatcagcaaggcttcttcctaagtaaccgcactaaatgatacagatgagatccagtgtgagaatagcctcactaccggcttagtcagattccatgaggatggagtgatagaaaacagttgttaacaagcttagattctaattttgtctgttcttgttaattctttttgttccagcaactgagtagcccttggtttccaaagcttaggctgtcagactttttttccttgtctccatcagcatctgtaacagttacactcgtactgtcgagctttcatacaccattgtacaaacgactcatttttaca

SEQ ID NO: 27224 - DNA, 543 bp, Sorghum bicolor
  Clone ID: 6675050
cgcacattcaagattaaggactttggcgactccattcctggacatggtggcatgacagaccgcatggactgccagttcatcatgggatccatcgctttcttctactactcaagttttattgctgttcatcacaccaccgtcggcggcgtgattgaggctgccattaccggccttacccacgaggagcagattgaagttgtcaagaaattgagcaagcacttggtcaaccaaggaataatatcaccaaaggtgctcgaacttctctcagagcagatggtacggagatgagaagcaagtgaaagacgttttggtcctttagagtatttcttagtccaatagggggtttaggggaggaattggggtactgcgcagtagacgcaactggcattcgggaaagcatggcaaacggcattcgccgcggacgggcggtattggtaatcggacgcatataccctttctatagtctggcgcgcacctgatgatgggtttcttaatggtgtgcttcatcgtatagcatataagtaatatcctttacattcgctg

SEQ ID NO: 27225 - DNA, 326 bp, Sorghum bicolor
  Clone ID: 6675120
gacatcaggtcatcagaaggttgctttggcgatcttctggcatagtctttttgctagaccctgtcttgtagagtaccttattttcttaggagagttgctcgttacaaaattctcattgtacttgatttaagttaagtgcttgtagttgtcataagattagaggctgaaaagattgatttgtaggtcatatagctcaagtggacagtaatcctcaaacatctttaatttagttatagatgtagcgacaccccccagggctggccctgtatcctatgggtatgatttgagatctgataaatgagatccctgcttctattcctctgctc

SEQ ID NO: 27226 - DNA, 243 bp, Sorghum bicolor
  Clone ID: 6675147
cgcccactacggacagtgcggtggtatcggctggactggcccgaccacctgcgctggcggcttcacctgcaaggtttccaacccttactactcgcagtgcttgtaagcgtcggtgattggttgcttcagtttcaacttgcatcatgatatccccttatgtaccattatccgctttgtagatatgtcataaagacatgcagaagcttgtagagtatccttgcaatccatcatcatttctatctt

SEQ ID NO: 27227 - DNA, 130 bp, Sorghum bicolor
  Clone ID: 6675164
gcgaagcatgcgatcctcctttttgcgtcggcggcatgggtggttatgtaggtgatggggtccctgtttcccttcagcagtgatgagccccgggtataaatgtaattcctttgcccatggatgggttggg

SEQ ID NO: 27228 - DNA, 220 bp, Sorghum bicolor
  Clone ID: 6675178
cgaagcaaaacatgtcagagcttgggttcaaaaatatggacgaaggggatacatctcatgacatgaacaggcaactggagagccctcctaatgagcaaaaggagaccaaaatacccgtttgattttgaggaagcttttgtatgtttctgcatccaggagatctgtatgagaacgaataaataatgaaaccggtactaattagtaactaatgctgagcctt

SEQ ID NO: 27229 - DNA, 497 bp, Sorghum bicolor
  Clone ID: 6675179
gatggcaatgcgtgatgtggtaatgaggctgaagaagatcctagcacagtgcaacaaatcggttgcagctgcgctcaacacagcagcacagtgatcatgcatgatcgatcaacatagtatatctatgttcctgttctgcttataatctaaactgagaaaaacatcagctgtagcaacatctactttgccacctagttttcgcctgtgcgcgaaacgacttctggacaatgtaaactgagggtgaattaatgtgctgcttcgatttgcttatattgaactaaattcctaaaagctagcttgcaacaaaatgcaagacgccgattaacaatgatgctccctatggagagtcgatcctagagtgtgtgtagcttgtttactttgtacctgtcaaataacctgacggatttgtgagcgtgagacccttaagtactgtctgaatttagcaagttgtctctaataaagtgcagccaaggagcactctcgggcctctttatttt

SEQ ID NO: 27230 - DNA, 357 bp, Sorghum bicolor
  Clone ID: 6675183
tactggtcaggatcaagaagacggtcagttaaggcgtgaaaacagctctgctttgtgtgctggattttaccgcgcctctattcgtatcacggcgtgccgagccgggatttggacctggtctctgtttcaccctttatcctgggttaaggggacaaatactgatctataaactgcagtttttccctgtcggtcttcgggtacatcggggagcaagtttgggacatgggcacagatatcagcagcacaaccttccagtgcgttacccaagtcagcgacgctccagtaaatatgggccgagccggagtggtagcagtaaagggcatggtaaatcttaacaatcaaattcaagattcggtc

SEQ ID NO: 27231 - DNA, 426 bp, Sorghum bicolor
  Clone ID: 6675186
ctcggcaccctgccgctgctctcgccgcagtcgccccatccggcgttgggctttccccagcttaccgttacctgattaattacagccgtgtttggataagccaggatttcacccaaaccttttggatcgccatggaaatagtcggttcattttccattccaatccaaggggatcgggcctaccatcatcaacatccgaaacaagccaaatgtgaatgcccagcgtcatactggtgcagagcgtaaacgaagaaactactagctagatttaatttatttacggagaggtgcatacgtgtacatagttcgatgcttgttaagagtatgagcaaaggatttggcatttttaataggttcgacattgtaagttaattcgagttaatttgcattgtttaatgtagttcttggattctgctactctgtagtc

SEQ ID NO: 27232 - DNA, 405 bp, Sorghum bicolor
  Clone ID: 6675196
atttgataccgagatatccccgaattcgcactgtgctctatcaaataccgtgctgtcagcagagaagtaagcatgagcagaaccgtgatggcaagcttctttgtcatccacatgttttgatcgccttttccctggtgccgcagttgtcacaatgtcagcacatacccggcgccggcttggatggaaatttagcagccctctctggtctttttctcttcgcccctggtcaaagtcctggccggacgcacctgccagtgcaatagacgttagtcaaatatgcatatcctatccagtttgaatacatgtctgcatgctgtaatagaattctactaatatattatgaggcgatgacttcgcagagaacatgtaagcatgttcatttggcagaaagtcattgttgaaagt

SEQ ID NO: 27233 - DNA, 467 bp, Sorghum bicolor
  Clone ID: 6675200
ttgggggcaagacggcctacccggtcgacacgaatatggtctggttagacatcgatgccagcggggtagaactcaaccagttcatcgaactcggcgagcaatatggtgtaagagtgaaaggaggcagactagtcgtccactatcagataggcgaggatgctattgctcggttgaagcaattgtttactgaagtcctgaaaggtgagccgggagatctgaaggaggccaaggctgaccacgacccggaagccctgaaactcaagggcaaacccgtagagtagagtctagcgtatcccatcatttcgtactcgagtacggctcgtccgtaccttaactccacatctattgggccgacgaagtctactacattcgtccgatcttatatgctggaagtacgttcggacaaagaacatgagctgtgggctattagctacaaccaatctcgtgcgcatcttgtgcaattctcc

SEQ ID NO: 27234 - DNA, 444 bp, Sorghum bicolor
  Clone ID: 6675202
tcttcgggctcgggcagtggttccggcagcggcagcggcagcggtagcgacaagggcaagaatgctgctgctggcaaccagctcaatattgccatgcttggccttaccctcattggtgcttttgcccagctgttgtaagcggttgaacattatgatgttaagggaggaataatagtcgatgcggtttacggcttttcaggccatctagggagggggcgcgttcatttttcccaactctgtgcataatcctctactacttggtctgattcgcccgctacggtcagcaaacatgggacgggtgtcctcaagaggccacctttctttgtttgctgttatgggagccaaaatgaggtggtggcgagcagagcccatgggcgcgaacgtttgactcatggctcttcaagtatctcttattgtccgaaatgaagatgcgctgttattctc

SEQ ID NO: 27235 - DNA, 510 bp, Sorghum bicolor
  Clone ID: 6675208
ttctacatcacgacttcttgcttcacatcaccactccggatcgagtttgcggcactcagagctagctgacgagacgtcgtcacaagcacctagtgaaggaagtacagttgtgagtcagctcgaggcggaggaaaaggagcttcgcgagcgactcgttgtcttggaagagcagcgtttcatggttgaagctatggtcaagaccgcccagggttcaagacgatttgaggaagtcagcgctctgtcaaggaacgtagacgagcttgatgctgagatcaaggtcctgaggaacaaagttgggggtgttgaggagagatgggaaggggtttaccgcaatggcgttgcatgaacatgccatcggattatcggcaagatcaccctgggtattggagctgaaccaaagaattcatctgcttggttgtatatatcacatggcattgcatggcgtttggagttttgaattgggcgacacaggagtttaactgatatatcaagtctgcccagtctcctttc

SEQ ID NO: 27236 - DNA, 475 bp, Sorghum bicolor
  Clone ID: 6675222
agcgcgtggagctgagctcgcgaacggtgagccaggcgaagctgctgctgaagatgaagagcggcggcggcggcgggttccgggtcatgatggagggcgaaggtggcagcagcgccatgtcgctggggtggagagatagcgtgcagctgatcaccgcgactgggtggcggcgccggcgccgatcgaccaacaagccggcgttcagctagtacatacgtacatacgtacagtggggatgaagccgaaatcagcccagttcatcgataaattatacttggacgatctcgtcgacttcttggtttgttcaattggttcattgtggagagaagaaggtttggtttgttagtttctcttgtgcttttctttcgttgattgatacacatatatacatatatacatgtaaagtatagatgccaaaagagttactacacacgattggtacgtacagaaatagacttgtagacaaattaaagca

SEQ ID NO: 27237 - DNA, 471 bp, Sorghum bicolor
  Clone ID: 6675225
acatcaacatgggcaacgtgctggagcggctgcagacggcgcacctgtaccagctgcccaggctcaagggcggctgccttaggttcctggtggacttcaggaaggtgtacgagatgcacgacgacctcaacgcgttcctgcagacggccgacagggacctcgtggccgaggtgttccatggcgtccttgctgcgtggagcggccggtgatccatgggtgcatccgtgcatggcattgcagtctgcaggtgtgtacatctggttggtttagttcatacagattgtttggaggattcttgctggaaaagcgtgtaaatatatttgcaaacagtacatgcgtgccagtagttggcctaaaacatactgtgcacgccttgattggattttgttcttatcatgtggaaatctaattcttgtaacctattgctggacttgtaatacatcagctgatatgctgcttattgcaaaagtt

SEQ ID NO: 27238 - DNA, 530 bp, Sorghum bicolor
  Clone ID: 6675229
gaaacaatggatgctgttgtgtgacttttttttctagtcaatggtttgcactcttaggaaagccagttcagcaataaatggtttcattcttcctatgtctcctggatctcaaaaaaaataggctctccttctagaaaagttgtcttgcacgacggtggcgcagacgatgtggtcgtcgtcgttcccgacggacgcggacttcggcttcgccggcgtccctggtcctaccggtggacaccgcgttcgggaggatgtgctcggacttgctctctgcattgccacgcgccctggagacggcggcgaggaagacgacgaggtgcggggctcgagaggaagacgacgagcgcatcttcaagccattcacggacgagtacctcggtctctcccgcaccaactatctgcgcctcgtctgtgatctgtatatgtacacacctgctgctgttgctcgatcgtcgatccccattccccattcgttttataataatgactactctttccgccgttaaatataacgtatttttctttattct

SEQ ID NO: 27239 - DNA, 523 bp, Sorghum bicolor
  Clone ID: 6675232
aggttgtcctgcagctgtggcttctaattgaattcaattgtgtcaagtgatactacttgtgatcatgtgggttgtatttgggttgggttgggcgagcacacatgctaattgcgagcatttgctttgttggatgtttcatgcttatatagcaacgtgatccaagtgctgggcccgttgccttagttgtgcctctccaggcgttgttgatcaatgtgaatgcctatgcattcttgttgaacgttcccatgccaaatgagcacgcgtgagtttgcatggtcattgcgacttgtatccatagcgtctgaggcacaagccacttttgtaggtcccttgcctgtggcttagttcttaaaaattccgagggctggtccagcgccgatgcgcttcacgatgcatgcttgaatgcagagttgttattgaattgtcttgtgaacatccaccaggtctgggtttttggctgagcaagcatcttccagaaccatggatgaatgcctttcgtagcaagctgtaaatgcttactgtc

SEQ ID NO: 27240 - DNA, 329 bp, Sorghum bicolor
  Clone ID: 6675236
gtctttggctttggaggacagacaacatgtgccggatttagtgcagcaatcatccacctgacattgtccattcgttcgcccttgtaggctgcaatccagtttgcattagtagttgtcactttttatagctgcttttttcctctgtggaaactgctgttgcgctctatatatgacaagttaatttatgagccatcaggcataaggtccgtgatggatgatgtgttgatgtaaggatgaacattgcccttggcctgtttaaaatgccactggatttacccaagtgctccatgtcacgaatgggttaacaaagtactgaaggctattatctt

SEQ ID NO: 27241 - DNA, 426 bp, Sorghum bicolor
  Clone ID: 6675237
ggccgtcccagagcttccaaagcctgaggtgccgccgcacccagtggcgccagagctgccaaagcctgaactccctcctcacccgaccgtgccagagctgccgcacccagacgttccggaggtgccaaaccacgagttgccgcctctgccgaaagctgagctgccaccgaagccggagggccactacccggagccggaggcaaaaccatgagcggacgtacagtcccaccccagttatccacacattttaccacatctgcatattgtttagcttatgcacagttacagtacctatatatgagttgtgatattgtgttctcgcgtacagcttgcttgtgatgagctagctatcagtttggatccacaaatatgtgtaaatgaagaataaagatttctagttactatatatttacactgttgagagct

SEQ ID NO: 27242 - DNA, 468 bp, Sorghum bicolor
  Clone ID: 6675238
acgggtccgtcaggcgcacacttgttccgcgctattttcggcgccaattacacgctttctgttgacgagttcaaggcgcttgtggtggagaaagttaacgaggtggttgaggaaggagggttggcgaattccactactgccgtgaactgcagtgtggatttcaaggcggcgtcggatcactcgcggccgtggtggccgcaggaggcggaggtgctgcggagaggctttgtgcagcaggtgtatgggcttcagggatataggaagatgtggtttacgggttatgcgtggggtgcgccgtatagctctacagtttgggcttttaccgataccgtattggagcgcatgatgaaggattttggggcgtgagtgaagttggttccccagtgttttttttttaaaaaaaaatacgtgggtgatacttgatagttagcaaaatgtatctgctgatggttgtcagctgtagaagct

SEQ ID NO: 27243 - DNA, 346 bp, Sorghum bicolor
  Clone ID: 6675252
cactggtactatcgatgccaaggacgaaggtattctggatcttctcatctctaagcagtgggccatcaaacttgctacagaagccgcccgcaccgtcttgtctgttgaccagatcatcgtggcacgacaagctggaggacccaagccccccggacccaaccctaactgggacgaggactaaatggataaaactaaaaagttcagaatgggtaatggattgatatgtgtgacaatcacctggtgtcgtgattgattagatatcctttcagataacagggtcaaagcatggggcatatatttattcagattgtccagtatcccgatgcaaattctgctctgtctactt

SEQ ID NO: 27244 - DNA, 283 bp, Sorghum bicolor
  Clone ID: 6675259
atgcaagtgaaagtgctaacatcggagactggagcctcaactgcttctggtcccctgacctaagtcagagaaaaactctgcagttgagcaaagccgtttaaaaagtttcgatgtaatatttatgacatatttccagttctttttccagagtttttctttttagagagcatgcgattggctctttgctttttgaactatctcagacctatgataatttggttgaatgttcttgtaccaacgtgcattgctatttcttctctcaagaaagggcattgtttttttt

SEQ ID NO: 27245 - DNA, 361 bp, Sorghum bicolor
  Clone ID: 6675260
cgattcgaggcagcaactggagaaagcaaaagcgctgataagatcggttctcactgatgtctgattgatgtacataccagttgtaagcaagaaattggtgacttgcaactggatagtattacttaggcatatgcatctctttaagcctgtatattcattgctgtaatggtacagcccaggggctgatttgcattccgctgtgtcctttttttgggggggttgataacggtgtcattgttcaaccaaaggcactgcagtgaccatgtgattggatagaagagcatttccagttttccactgacaagtagatacagaaataagttgtctgaatcaagatagagatataactgctgttgcattc

SEQ ID NO: 27246 - DNA, 516 bp, Sorghum bicolor
  Clone ID: 6675263
gtcaatgtgcacgccatgcacagggacccgcgcgtgtgggaggaaccagaaaggttctcgcccgagaggttcgagggcgggaagagcgacgggaaatggatgcttccgttcggcatgggccggcggcggtgccccggcgaaggcctcgccgtgaaaatggtcggtctcgcgcttggcacgcttgtgcagggcttcgagtggaggaggacgaccggagatgaggaggtcgacatgacggaagcgtccgggctgaccatgccaaagtccgtgccgttggaggcgttctactggccgcggatggagatgctatcaccgctaacggcacttcacagctgatcacaagcatttggatttggatttttcattcttcaactccgtggtgaacaagttcgggctcaaagctcatgttacctgtccgcccattctttttttttaaaaacttgggtaatttttattgcactagtgttgacaaatcatcaacaacaattacattgacacaatatgggatattgcccc

SEQ ID NO: 27247 - DNA, 396 bp, Sorghum bicolor
  Clone ID: 6675264
ggcacatagcatatggacccacccatgatccagcagccagaccataattccttccagcttgaagtaaattgtgaatagagaaagcacaagcttcagaatcaccaaataggtgtaagaccctctatataatctgggttgtatggcttctccgggggctttctccaagatcttccaagatggtgaaaaatcagtgcctgagcaaccagcatctgactgcttctaaccatgcatccccagttcacatcactagtcagcttggaatcagatattgcatcaaagcctttccggtaggtgatccatatcttggaagagaaatcttccagaaacgcagcatggccgtcgccagactcctcttcctcaggtgacaccttgtagcatttaaaagggggggcccgg

SEQ ID NO: 27248 - DNA, 480 bp, Sorghum bicolor
  Clone ID: 6675281
cgacaagcccaccgactccgacgagtggggtgtctggaaggctggcgctgcgtgctcatcgaagcgctccgttgtcgactcccaggccgcaaacgccgttctccaggctgccgcggcacgcaagatggtgcgggctcacaagcgcatgcaccactgatgtgcttgttcatgccccacctcgccgccccacgctcattcccagggcacaccttgattggtcatgtccccatgcctgaacccatgcacaaatcgcgtgcacaaattcaaatgtaattttctctttgtctacgatctcatatcatttctcctggatctcgcaacgctaagcgttgctcatagcatgtgccatggtgcactaaacccgttgccttccctagcggcagggacgatcacatatccacatcctagtgccgtggctggtatatgtaagtagaatgtatatgtaggcttgcctgaaattaaatgaatgtttggctgtgt

SEQ ID NO: 27249 - DNA, 478 bp, Sorghum bicolor
  Clone ID: 6675282
ctggtgctctggtcgccatgggtctcgtcgctgcttacctgctgtaagcgagacaagggtcagctttataacatctttacataaagcttccgttctagagtcgagcagtgtaacgcttttaacgatggggattttcggagcattttttacgaagcgtctgggacacacgaagggataacgatcattacaattaatctggggcgacattggaaacgtcagcaaacgtgtttttgttttattttgccatgctttcttcttttctctgcgaaatgttgtataaataacgcggtagcaagaaagaaaagcactgagccggggggaaaagaatgacgagagaggattatataccttgggacgattaattttgggagtttgagattatttttacacttagatactaaagtaccatatacccctcctttgcatggaaatcatgcactttaatggaaacttatctttacttttaaaaaaaaaaaaa

SEQ ID NO: 27250 - DNA, 520 bp, Sorghum bicolor
  Clone ID: 6675285
actcaataaaaggaggtatggctccaggagttttaagcaatttacaggggaattattctcagactgtgagtaaattgtcaatggctgcaggtggaaagaataaatctgataacacaggcggatattcaagaaataaaggaggtgaagtatctagtcaaatggcagcgatatttgggaagactcctcccctttcaaaagaaaaagagaataacgtgagtggctttggagatcccaagaagtatgcaagaaatattactggaattttcgaaagtcataaatagatttgtaatatatttttgaggaagagaagatttattttgatataaaattttgctgactgattatggatataaaacattatcgtgtatataaatttaaaggtgacttacaagcaatacataatttcttaaaatatgaaaaaactctcttccacttgaataaggtttatttattcattgtaaactgtaatcttgatgtcaacagcattaagagcatcatgaacccattgaggaaaaaaaaa

SEQ ID NO: 27251 - DNA, 451 bp, Sorghum bicolor
  Clone ID: 6675296
gacggtggacctcagccctggtacggacgtcgaggagatcgccggagctgatcacatggccatgctctccaaaccgacggaggtctgtgaagttctggtcaggattgccgacaggtgccactgagtggaaatattattcgctgattgatcgtgagagaaaaacacttttggttggtagtaagacaaacacttacagtttcaagtgttagtgacgatttcatcaaaaaagtgttagaggtgctaattgaatttatctgtaatccgagtgattgcccgcccgtcgacaattatactgtgatttgttttcttatcccgtcgctgatggatgtgccatgtggagttgttttggccgatgtgagcgacgggacatgcacgttttctttaatcccaacattttctttgtcgcgtttgactgttaaaaaaaaaaaaaacaaagtaggggggggcccgg

SEQ ID NO: 27252 - DNA, 264 bp, Sorghum bicolor
  Clone ID: 6675305
tctctttgtcatcgtgttcgacaaggcacgcgggagtccagagtcgctggggcatggacgcgagggtttctactttggcgaaaacggcgagcaccagcttctgcagattggagaggctataggctaggccctcgtgaagaccggcaaagcctctgacccgagcgtcacgcccttcaccgacgaggaatgaaaaaagttctttggagggaaataccttggcagcaattcgcgtgctcgtgctgaacgctcgaagtccattggttg

SEQ ID NO: 27253 - DNA, 468 bp, Sorghum bicolor
  Clone ID: 6675316
tcgccaccaagctctccttcatcgagtacgccgacggccgcacgcgcgatgtcatgaaataccccaagaccgacgcggacaagatctctctgcccggagcgctcaaggtcgtccgcaacgcgcagggcgtgcccatcatctacccggccgaggccgacgttgccggcgaggaccttctccgcgtggtctacgaccatggtcccgtcgagggcgccttccctgaggatttctccaccctgaagaagcgcgtgcagagcgagtggaccgcgctaccccgccagtttgaccccatctcgcctgagcttcgtctcaagatggatgcctgggtgctcagcatgcgcgacgtcctcgcccagaaccgggccgcttgatgaaccgaaggggatccctttttctcgccgctcgtgcaggaaagcagcccgttttgtataattaaatgtaacggccgagctgccaattcgcatcgtg

SEQ ID NO: 27254 - DNA, 506 bp, Sorghum bicolor
  Clone ID: 6675337
tactgtatcgaagttaatggcactgggagctgagttggatgggccaatcaaatatgagatccatggaaaagttgcagcattgcgatgcatcgatgggcacatgctaggcctttatgagccagcttgaagaactcatgccacaatgaaagtaacgaaaacctccattaatcgctcactgaagactgatgtgtatgtccatttgttcccagcaaaagatgttttggcataagtcaactcactgggcctggtttgcctgaaccctgaagtggtagaattcctttttgttagcaaaatcatgagacactgtaggtggtttccagcagctgaacatttatatatcattctctgcctcatgctgctggttatgctgcacattttctctaactgaatgcgcctagcaggtcagtatggtaggttttgaagccaaatttgagtggtcctgcttagtcatggccttgtctcattacattgtgtcagtatatctagttcaactttcatttctagtt

SEQ ID NO: 27255 - DNA, 411 bp, Sorghum bicolor
  Clone ID: 6675348
gccgagcgaggaggctaaggtgagcactttggaggaggattaaatcaactggtgtcgtatggattagtccaaactggaaatcggaggaaaaaggaaaaaaaagaaagaaaagataggggtgagtttgttgatttcgaggtatcacaacccccaaagcctatgcgggctgcggctggctttatccttggccgaatcaaggtttaaaggagtgcgttcaagtggaatgcacaaaattggcgcatcgaaggaaccatcaaaagtatatgtcatcttcagccatagttgcaatggcttacaaaagcctttttagaatattagcattgatttacagacaacattggcgcgtcggcagcctgaatgcgtcgagtttgctgctcataatgaataactaaatattcatgattcttttgc

SEQ ID NO: 27256 - DNA, 437 bp, Sorghum bicolor
  Clone ID: 6675349
tgttcatttattctgtacagcataaatgaaccctaatatagtatcaggttgctttgttctttgactgatggtttatttgtgaacggaagtaaataatccgatttgctttagttactatctctttcaatttagagacgttggacaagcaatcagctatattgtttgactagatatttaacaagatttctcatgaattgtaaaattttcttttcttgttttggctgtaggttgtggaaatgaatggatcagctatatgccctgtattgctaagggcttgtaggaagtagtgattactaaacttctatctattttctatatgttagttgcatgaactagcattgtaacttgggtctgcaatattttgcgaggcctttacagtgtagcttaagatttgttgcccattgaactatctaatgtatgagcaatttggatgatga

SEQ ID NO: 27257 - DNA, 410 bp, Sorghum bicolor
  Clone ID: 6675366
agaaacccacctttgttactggtggacgatcctagcaagaaattacaagcctccagcacaacactcttctccgctttgtttactttacagcaggctatcttctttatcttgtttcccgaagcgacaagacaaaagcatgcatgttccaagcgccgcttgtctcggctgtcactaatggagcacaccacagctcgcgaagagtttgagttagcgctgattacataatttgcttttattgcagtagtcagtaatcaggatagtttccgactcgaatgcctctttgctgctgatctgagcgcgattaaaagattcctgcgctttgcggcttgtcaaaaacttcaggacagagatgattcgagcttaaacattctcgcaagtacggatctcccagaaatacatatccaaattct

SEQ ID NO: 27258 - DNA, 542 bp, Sorghum bicolor
  Clone ID: 6675378
aacacagctgatgttagaatcttacttaccagcataaggatgcaagaaacagaagcagttagcagtgccatagcatctccaagattttgcacaaatggaagatccgaccgaagttgctaaactgtggataaactaagtctatgcaagattgggaaatttaggaataagattttcataatgtactgccatcaaaccagttttgtggagtcataaacggttcttacattgctagaacgcaaagtggtttcagtcagttcatgtctggaaatgtttcaatgtttggggaaagccctgcatgcctggatgagggtatttttttattagttctcatgagtcttgtatcatccaaatacgtggcctaatccagtaagtcggctttgtaaaatcgtagcaactcttattgtaactagatttgatttcgaatcaattcattttgatttgaaatgtgtcttagggggctacgcaatggatataatcttgtctgtaaggaacatctctctttctggagaactgtttctttaactgtccggctatcggcctct

SEQ ID NO: 27259 - DNA, 441 bp, Sorghum bicolor
  Clone ID: 6675384
taatcgatcggttgcgtggaatatgtgaagtttgtaatctgttcctaataacaaagctttgtttctccaaaaaaaaaaaaaaaaaaaaaaaaactcgagactagttctctccctcgtgccgaattcggcacgaggaatcttttgagtctgtaattctagttctctaaacttgttaagcaatgcatcatgtattacttttgcttttatttggtaattattgtctaattatagactaactaggctcaaaagatttatctcggatttacaggtaaactgtgcaattaatttttattttcctctatatttgatatttcatgtcgtaaaattcgatgtgacggagaattttaaaaagactaaacaaggcaggcctaaacttgtaaaatgatgcaccgttggcccattatatttctctgcagtgcaccacttatcgagcatcacaca

SEQ ID NO: 27260 - DNA, 452 bp, Sorghum bicolor
  Clone ID: 6675462
ggaatcacaagagggttccacttgccttcgagaagacatccattgaagagttatttaagagattctcagatgctactgggattaagatcacttatcagcacacttccaaggaacttgacccaaataatctttttgatattgtgattggggttataaatgatggaatctactttaattgggattgtaaggtgccagaggaggcgagagagctgaatcctaactggcatagccttgaagacttcgctaagaataagtggaagaagcctgaagcttaagcagcggaaactacttaatatttagactaataaactctctaatagttaatttgaaagaagaattataactgcgataatcttctatcaatatatttgatattaataatatatagaaaattcgagtttattggatctatttgattagaaaatgttataaggttactaccttaaaaacct

SEQ ID NO: 27261 - DNA, 485 bp, Sorghum bicolor
  Clone ID: 6675472
aatatgggagagctttttgaatcaataactggtgaacatttgatgcctaagaagagaagggttgagataaggtctccgaacatatcaggaggctcgaggcatggaggacgcttctggagaatacctgctcttgatatggtggacgaggactaacgagacagatcctgtgacttcagatgagtctgatagaaagagttccaatatgtctaaatgggaaagctttctgaatcaataaccggtggacattcgatacctaagaagaggaagagaacgaggatggaaaggatgctgtatttagcgtagatctggatatactgtgcttgtagttatcttaatgtattttttgtcagttgacaaattttcagaacaatgacctagtatgaccaaatgcttcatcgaagctggcacctttgcagcgatagtctctgtagtgagatgaccctataatcaatcaagagagctgcgatgctcaagtaaatagccgt

SEQ ID NO: 27262 - DNA, 282 bp, Sorghum bicolor
  Clone ID: 6675482
gccaaactggcaaaaaaaaaagttcaaagcaacctggggatgcattccaggtttttttttttccacaagcctggaaacaaaaaggtgttaccccatcatttaaggcccaaaaaacaaaaaaagttttatggccaaataagcaagtttgaggggaaaaaggcccaagaaactaaccggcccttttaggactatggaaataattccctctaataaaaatgctaataggctataagcattggccaaaatttaatttattaaaaatcaaaaggtctatttatatcc

SEQ ID NO: 27263 - DNA, 135 bp, Sorghum bicolor
  Clone ID: 6675510
tcaagtgcacaatatgtgactagcatatattaacttgacccaaggtaattacagaaactttctcagatagaccctttaagttttgccagaacaggaagttctatattagatcagcaacttccattctgtagtatg

SEQ ID NO: 27264 - DNA, 154 bp, Sorghum bicolor
  Clone ID: 6675515
gatgaaaagctcaaaagggcatcggcaccctgaaacccttttaggtcataatagttcaataataaaaatggcttagtgccctccctgtattttaaatcattgtttaaaaacagcctatgggaggatgttaatccagtccagtgtgttggattcc

SEQ ID NO: 27265 - DNA, 264 bp, Sorghum bicolor
  Clone ID: 6675517
cccgagcagtttttggtttcgggaaccaaccagtagcggcgtacatgcgagaggatgcagtgctaggagggcccaaaggtggtaaggggttgacgagaataatctttgggagatacccgaaaagcgaacggaggcgatagcatatacggatatggatacttgataggtgatatccaccaaagtgagattggatggcagtgggcatccaagtaccggttatcagtccagcgttgaatgcagaaaataaatcaacttcgatattcc

SEQ ID NO: 27266 - DNA, 408 bp, Sorghum bicolor
  Clone ID: 6675523
tacaccttcgcaatacttggtgcccacctctcagtacagcttctacggactcagctctggaaagtactacgcttggattaacgacggtggcagctcgggtgtcaacaccattattggccagaagttcctggaaaactactactccgtttttgatactaccaacggccgcatcggctttgctaccgccgcttaaatgaatacatgttcatttttctcctgctcaagaacacaagcacagcatactcttcacgggcaatttatcactatcgtcctacatgatgaatatggtgattcattggagggctgcgaggcaactggagataaacacctcttttagcactagcaagtagtatcagtcttagttagcttctaggtctaattgtagtgggaatagatgcgttaaactgt

SEQ ID NO: 27267 - DNA, 518 bp, Sorghum bicolor
  Clone ID: 6675524
gccctaatgtgtgatatactggagacggagagtctacgaatgctacaaagcattactgtgtaaatttcactctgaacagcctgttttggctgtttccaagtacttgtattgctatagtgtattcttttatgaaactaaagccttgtagcagtaacagagtttcctatagctgtttcgtccatcacagatctaatctctggtagttgatgtttgtatgtttcagtttcagaaatggagtgctaattggttaggtacccacgaggttgcggtgtcttataaaaatcagagatgtatttgtctgttataaaaaattattatgctataattctgtaattcaaaattatgagattttggttatgactggacaaatctgagccaattctgtaattcataattcatagtttgagaaagcattctacacattctgtacagattattttgacgaaggaaatgttgtacactatggatttgataaaaggttgatgctttctaagctatagtttgttttggattgtcct

SEQ ID NO: 27268 - DNA, 493 bp, Sorghum bicolor
  Clone ID: 6675535
cccgcagctaaagcgcgtcaacgactggctcggcgagatcgggaagcggagcgagactccgtcgctgccgccggccgacgcagacggtgaggcgaccaccgcgagcaccgcccctgtccccgcgaacggcggctgcggcgtacccgaggagacaatagagcggctaagaaaaaagatctacgagtatctactcaccaatgtcgactctgccgccgcaatgctcggcggtggcggaggcggcggggcggccgcgccgacgaacgggaagaaggggtgacgcgtggatgggaggtcccaattgggccgttaatagtgtggaatttgattgggccagaaatgggctgggttagctaatgtaggcttcgtttctgttgtttctttgttgggctttgagcctttcagcttctcttatttcttatcatggtcacaaaagaaagaaaaggtggtgaaaatttgacctgtatttatcactgacgtcgactgggtggctctg

SEQ ID NO: 27269 - DNA, 497 bp, Sorghum bicolor
  Clone ID: 6675548
tgatctcatatgtccagaaatggcgctctcaaggcattcccattgatggaatcggcagccagtcgcatattggccctggtggagggcctaagaacgcagctgctcttaaggcgctgagtgctgcggctccggaggttgctattactgaactcgatatcaccaatgctccctcctctgattacgtcgccgtcactcagggatgccttgcagtgtcgaattgcgtgggtattacaagctggggtgttcgcgacgttgatagctggaaagcttcttcaaaccccctcctttttgatgcaaattaccagccaaaagctgcatataacgctgttataagtgcattgtagatgctgaatggcttaagggctgttatttttagcctagggtcctgacttgttaaggaaggttaggttccttataatagctttttccctctacttctgcctccggaggtagattaattctacctctactgctaaatataaactaactttacttct

SEQ ID NO: 27270 - DNA, 396 bp, Sorghum bicolor
  Clone ID: 6675553
cagagggacatcaagcgtgcggtggactatcgcatcaagcgctcggaggagctttctcagggcaggatcaagtccaaggcggtcgacgtcaaggtcatctcgcaccacatgcagcgcttcgccgtgtggttcggcggctccatgcttgcctccactcccgagttctacaaggtgtgccacaccaagcagcagtacgacgaagtgggtccctccatctgcaggcacaaccccgtgtttggtgccatgaccatgtaaacaacagcagtgtccccccacaagcccaccaccctccccgccgcagcggcagcagcacgcgcagcgtgcgaccattcttggtggtggcggcggcggagaggaagaggaggacaggatgcaaaaaataaaaagaataactta

SEQ ID NO: 27271 - DNA, 330 bp, Sorghum bicolor
  Clone ID: 6675561
tcctagcaacaggatttggggcatcattgtatttcctggcaaagaaaaatatgaacttaggtaaggctgcattgatccctgtcgggggacttgcagctggtgcaactgtgggatttgcagtggagaatttcctgcaggaaaaagcttgtatggattgcaaaatgtggaatgtaaattttttggattaaaattaaaactttgaagtttggaatttactgattcctggctggagactttagccaatgggcagcccctttacatgaactttgtaaacagttgccgttttgttgtatttcatattaaggggagtttatcaggtttgctgccctc

SEQ ID NO: 27272 - DNA, 514 bp, Sorghum bicolor
  Clone ID: 6675573
aaagtagttattctagcttatggaaatgtagtctgcatcctagatatttttttatgcagatgcatatgtaaatatgatggctgctattttgctctttaattattcatcaagcactctgtaacagggatgtagcgtgaaatattccactaatattgtactcctctcaaaccatgtaacctacatttgtattagtcttcaggttgtttggaggcgagcaaatgatcgagatggctcaaggattgtctgaagatggtggccgggtttgcagtacacggcatggaactggagcttgtaggtgactactagctggtgcttctttttttttatgaaaaccaaattttcatttatgaacagcaagaagctgtaagtaaccgtacagagggtaaggttacaatgttcagagcttgaagaacagggcagggtcatgtgttacatttgagcagaaagcctggaaaggctgcaaaatgtctgaagtaagggtcagagcctgtctagctaatagatccgcttcttc

SEQ ID NO: 27273 - DNA, 494 bp, Sorghum bicolor
  Clone ID: 6675579
ggtaatggagagtttgtgcttgcggattcgttcgctgggaatacgcgcctgccgtgtattgatatcacggacacggggaagtgggtgggagcgattttggcggcgccagacaagtacgagggcaagttttttgcggcggcagaggcgttttatacgccggatgaagtggcggagattatgagtcgcgtgacgggcaagaaggtgaggcatgtgcagttgccggatcaggtggtcaagggattctttccggaggcgatcagcgatcagatgttggagatgtttgtgttgttgagagactatggatattatggagaagaccaggaggagttggtgaagtgggcgagggagcaggtcgatggtgaagtgacgggtttggaggacttcttgcggaggatcgagtacaagctcgagtaagacagtgacctggaaggcttggatagcgggcagcatgaacgacctgttttcatcaagagtaatattatttcatttcatcc

SEQ ID NO: 27274 - DNA, 108 bp, Sorghum bicolor
  Clone ID: 6675676
catatatcggaataccgaaattactgagtgccatatatttatctttatgtaaaacccctgtcaagtttgctactctaatgtatttctttctaggtcagatctacaagt

SEQ ID NO: 27275 - DNA, 148 bp, Sorghum bicolor
  Clone ID: 6675718
tcgccactatctccccatcaccctgcatcccaacaatttttttacctctcgccatttgccgtcagtaccactactatcccagccaatacccataccacttgctccaaactgtacaacagcgagctggacgaccaaacaattcagacgc

SEQ ID NO: 27276 - DNA, 445 bp, Sorghum bicolor
  Clone ID: 6675993
ttttgatttttcaaaggatcgcggttgtccacaatagaataatcagaatgcacaaatttagagagaaacaaataataacgcaggcataaattcagagagataaataaaaattaatgcaggtagagagtcgatgttttcgaaatgtgtaaatttcagttgaagccaagtattatttataatatatattttctttgcagtagtagaagtataatatatattttttttgcagtagtagaagaagcacattggaatgcacaagtggacctggttcttcacgaggcgtccagagacgaaggaggtcgacggtgatgacgaagccgacgtgatgcagtcgatgccttgaaatcccaagcgcggcgatcgttggagccctttctgcactgtattatcttgtatgtatgtattcactggtttatgaatttactaacggctcaatcgttcagca

SEQ ID NO: 27277 - DNA, 603 bp, Sorghum bicolor
  Clone ID: 6676020
atttgtgcttagagtggatcatgagatgtgcacgtatttgacgtcaggaaagaagacaaaactaggactcctgagtagctcccttaaagtgtggattttgttgaagattgccagaggtttctcccgtggtgcttttgaactactaccatactcagagaaagaaaattgtgcagagaaagaaacgtcatcagaattgccccagaaagaggggaggcccaagctatctgtttttcctatcaagaagtggatgagccgggcaaagcgtgctaagtgattctctttcaaaagcgtcaattttattagcatggggtcttccttgctattcacagcttagaacgagcaaagattcaggaagagggtcatgcttttcattcacggagatcccagcgtcggatatctagatatctcccgactagcttttgtttacagtattcttaagtttgtgatgcaaaatacctaggatttaggatggaagaaagagtagaaaacattttaggaaggaaactagacagatttatgtaggacgctgtcagggtagatgttgctcttatgctttagagcagttgaacttgggagaccgagtaattccccagtgattttttt

SEQ ID NO: 27278 - DNA, 505 bp, Sorghum bicolor
  Clone ID: 6676022
caactctaggactcattccagacgaccttcccgttcggtcacttgagtcttacttccgaggccgcattcggtcggcaaatagtctggtcaacgaggcaagaatcgtcgctggtctgcgacaggctgaaggcatatctatcgcggcgaggctgcaccttggtgacgatatacagggagggcaaggtgggcgtaacaggcacgttgccatcacagacgagcgacactgcgtcgtgtgtcacaagaaacttgggggaggtatgcgtattggcgggagcgttgtggctgtcctgccggataacacggtggtgcactacggctgtttgaaccgggcaacagggaacaaagtaaacgcatcccaagcgccaagttggggtcgaggattttagacgagtcgtttatgctggattggggcatcgtttcggagagtatttgcatgtattggatcggtggtggccagtatgatatttctcaaatacccttcatattcaaacacatcttgtcgctg

SEQ ID NO: 27279 - DNA, 449 bp, Sorghum bicolor
  Clone ID: 6676023
aatctcaagtcccaagactcaatttcctatatgcaattcctctccaacatcactgcaccccttaatctggcactcgggctcaagaacgcgggcgacatcatccccgcagtgctgcccattgtgcacttttccgtcaacgaacagtgcgttcagtacgaggaatgctcgacctttgcccccttcatccaggctggcaagccagtattccacatcgaataccctaatggcgcgggcgccgagcaaggactccaagagaacgtactcggcgactcttgctccaaaagcggaaagggcgcagggagtgatggtttcagcaccgtattgaagaagatggagctggacgggtgggtagagtattgtgatggcaaagtcgacgttacgaatatcaatgagtcactagggggacacgatgagggcagctcctagtttagtagattctttttttactg

SEQ ID NO: 27280 - DNA, 436 bp, Sorghum bicolor
  Clone ID: 6676030
gggagccaaacttcatatcgccgctcacccgcagagaatttctgacaagccaaaacttctgagaactcaatagctccagaggaagtgagagcccgaatctctactctgatatccagatacgccgtttctgttgtttcgtttgctgtcccggacgcattggaagcattgatcatcaaccaactggtcttcaggtggacaatcagcccgctactatgcctcagaaaggcctggaccgtagttcatagaaaggatctactgggctaccgcattcaattgttcacctggctttttggtagcttgactagtagtaagctgactaccggactttggacaacgcaaattgtccggcgcttatagaatggacttagaaggacttaacttatagaatatttgccattataaatcactattaataataaaccataggtttaaaccg

SEQ ID NO: 27281 - DNA, 594 bp, Sorghum bicolor
  Clone ID: 6676042
gctaacctatttttacaaatatctatttcagactaacaagatatgtgtggttttgtttcccagttgatctgacataactgtgtatgaattactcccttcattacaaattataagtcgctctaacttgtttggcacatcaatttttctaagtatctagatatattgttaatctgttatatctagatactctctccgtccataaaagaatacaattatgggatatgtcccgatcaaaaaagttaaagtttgatcgagtatatagtaaatattattaacatttatgtctctaagttaatttattataaaaatataatctgcaaataatccaatgatgcttattattttgtagctttcattgcaggcaaagctccaaggtttacgcaataaggctatggagaaggaattacaaattgtttatttggagtctgagttgctgaagattgagctgcattatagctgtactaaccaatctgacaagtcggtcgatgatattgttgcccaaaatgcaattattagatgaaatagcttgtgatgagtaaatatgtaacttttaaataacattcatctctttcaagaatcctaaaagtgatactt

SEQ ID NO: 27282 - DNA, 530 bp, Sorghum bicolor
  Clone ID: 6676063
agcccccaagccatgggcgtcagcagtagcaatactggagagaagagcatgggaagcgccatcaagagacgcatcggtagcatccgtcgtcgtaagcacgaagctgatgcttaaagtgcttggttttcctcatgcctaacgcacttcaatgcaattcctcacgcattgaattttccgcacactgagcgagtgttcatccaaaagaaattgcaacagaccaaaaagcacaggctagaatcgccagagtttgtgtctacgttttcccagtctcatttcatttctttccaggtccagcatagaggtctagttgtcagcgacgcaatgtgtcagcaaaacatactcctcaatacgatttcctcatttttcttttcggatagttttggcgcatttttcagggcttctcacgatcaaatgtatcgtttggtcaaataatcagtgtgtacgataagttgggagtttgaaaagaaacaaaattgttagaatggcaggaaagacgaagtaacgcagcaatatcattttcaatcgtgttt

SEQ ID NO: 27283 - DNA, 265 bp, Sorghum bicolor
  Clone ID: 6676083
gtcttttccctcggtgactttgccgtcggcgcctacatggccgtcgctggtatcgtcggccccggtatggtccttctgtaaaaaggaggttctttggatgggccgatcttggtatgattaaagtttcttgcggtggctttttagaacgtgcgctttttactagttgggttttttcctttttgtgtatctagcatcgccggtgttgcatggcttgtgattagaacgagatagatgtctaatgccatcttgcgcgattgctatgccc

SEQ ID NO: 27284 - DNA, 515 bp, Sorghum bicolor
  Clone ID: 6676092
cggcggcaatgtgtctggcgagtatctcgagctcgaggagcctaagaagatcacacaaagctggcgactgaaccagtggcctgccggtcacttctccaagctgcacatcgagtttgaccagaacgacgtcgaccacgttaccgttatgcgagtcaagtgggagggtgttcctatcggccaggaggacgttaccaagcgcaactggcttgagtactacgtcaagagcatcaagcagactttcggcttcggcaccattttgtaagcatactacaagactaaggagtcgtggagttggagcaaatacaagggtaatacgctctctagatgagggtagtgacggggggttgcatggtcgctgctttggtggaggagggcgagggtcgtcttgggtgatctacacaagacctagaagcgtgtggttacgatatcatgagagacgtaaagtaaagcaaaatgaaataatgcatcaatggtcgatagccatattgtgtcataagttatatgaagaatgtctg

SEQ ID NO: 27285 - DNA, 503 bp, Sorghum bicolor
  Clone ID: 6676093
catttacaaatacccagcctccgcacgcctcgtccgcgaaggcaacaaggcctggttcaccggcatctcctgcagcatcatctcctcgctctaccaactttaccgcctgcgtgagcgaagcgccaagctatcgagctcgaaatccgcagaggccgagcccgtcgtcgaggcgaagaagattgctcgtgaggtcgacgccgtgaggctccagctcctgagcgacctgtgcgatctcacgatcccagcatcggcgctgggatgggccaagttggacgacggcatagtcggaattgcgggtacggttagttcgctgctggggctctactcgcagtggaagaaggtggcgtgagtggacgtcatgtttaaaagcgggatgcggggaggaaaggatatccactgtcgctagatttttgggtcggcgaacggcgaaggccgccgatttatatgcttgcaagactgcgcgcttgttcatattgttgtagtatccgattcagctttcttga

SEQ ID NO: 27286 - DNA, 537 bp, Sorghum bicolor
  Clone ID: 6676101
tcctttgcaaaaacatcgcccctcacctgcttgaaagactccccaaggaagggagaacggcttacactctctccgagtggtacactggctgctataactgattcacttgggcggatactactgctggacacccaggcccttgtggctgtacggttatggaagggctatcgtgacgcttcatgtctattcgtggaaatgcttctgaacaaagacaaggctttgttaaggtcgatgcacatagaatacacaaagagtgactattgtttgtgtttagcaattcatgccccgcggaaaggaataatagaggtttggaagatgcggaccggatcacgcgtcctaaccatcccatgccccaaaggaagcagaatcttgcaaccctcagcgaggctctcaacacagtcattctcatcttcctattccccgctggaggtttacttgttcaatggagactctgggcaattgtcagttttgaatagacacattggatgaattgtttgtttcttttgttgtattaaattgttactgccaagtgctgta

SEQ ID NO: 27287 - DNA, 587 bp, Sorghum bicolor
  Clone ID: 6676109
tagcttcaaaaggtgcgattgcccgcgcaagtggcaatcatcgttcgctaaataactttgttgagaacacgttcggttgggagggcggtttctttgctccccttttctggaatcttggtgttcaaagcaagaataatgcggctgaagcaccagcaggagtgaatgtcgatggtgtgaatgaagaagccagacatatggcaccgccttctgaagaaacgctccgactccgtagtctcgtcggtcgagcgtatatgatggatctagccgttctatcggagtcgagcgataagattgtttgcacggtgagtgcttcagggtgccgcctactggccgtgatgatgggatgggaggatagcatggaaaatgggggctggcacaacgttgatggaacctatggttgggcagggatcgactggtgagctagagacaaattttcattctttcattgaatgctttttcttgtgtgaaaagcccaaaagggcatgaggataactgtaagacgcactggatgtcacaagcataggatggtgttggttggcgttgattttggatagcgatgagataccaatctttcctgttttattcga

SEQ ID NO: 27288 - DNA, 214 bp, Sorghum bicolor
  Clone ID: 6676110
aggatgttactcatgaatcaagagaaattacgaatagacacaagagaaacccactttcgggttcattgacgagcacacaaaccaccacagtctcgctcttcagacgatgtttttcacggggattttgacgaaaacattgagggcctcgcaagaagagggccagaattatgtatcattaatgtagtgcgggcactcgccaactcgcggttccgcc

SEQ ID NO: 27289 - DNA, 178 bp, Sorghum bicolor
  Clone ID: 6676118
gtgatacccgcgactggaaaatgttgttgctgttaaagaatcctgttgacgctggtaaatagacgacatgttcccttttcaagttgacgcttttaggcccaagattggagaaaatcaagaaattgctcgtgctttggattcatagctgaaaaacgataagcccccatctttgcccccc

SEQ ID NO: 27290 - DNA, 616 bp, Sorghum bicolor
  Clone ID: 6676127
gtaaatcggatcgatataagctggagcaagcatttggttgcgttgctttttcattgctttctttttctgttaccgctttttggttgtctgatgttctgatgagtgcaaatttacgggagtcttatcattgcttcatctacgggccgcaatctttttttgtacacggactgctcgcattgagtgtgtttgcacatatcttggctttattccaagtctcggaactccactctgctttcattctacggcgctagatcgcgtccttggtgtttttcttgccaagttttgggatttcttcaaatctacatacagcaccatgagaaaagatgggggaaaatgacagccccgggaggctttttcagaacgggattttgcttggtttgcttcggcattacgggtttctttttgggctttggatacaatttacgaaatggataaaatgggaagacttcaattatctggacaaggcatttgcttacggatcgagtattgttatacatctcggacaagattggacattcagagcgtgcctctggcttttgctctttctttcttcttttttccctttttaacgaagacatgagaaacgctgcacagccctgggggcgcaacgcaggcc

SEQ ID NO: 27291 - DNA, 495 bp, Sorghum bicolor
  Clone ID: 6676133
cgaggtggacgctgcgtacgcttacgctttcaccacatcggtcaagaacaacttgaaccagatgggcgacaagctgagcctgggacactgggcgggcgtcacgaggagcaactgcttccaagccaagactgtttgggggcttgcgattgccatgtgcattctgttcacgacctcgtgcgcgttgctcccgacgctgtggtacaagaacaagaaagcgacggcggtgcccaagtcggttgacgcttagatctatggtgacggaccggtgtgaagttcgattcgttcggggggagtctcgctgtcagcgaagagactaggaggtgtcatgcgcacgggcgatctgtcgaacagggtgttcggccatctccttcatccaactacaaacacgctcttacaaaaaactgcattgggaggcgttgttctgcggcgtcggtgtttctgctttgttgggcattgaatgtccctaatcataatggtcgataacacaatcaatcg

SEQ ID NO: 27292 - DNA, 536 bp, Sorghum bicolor
  Clone ID: 6676143
gagatctataagactctctcccctatctccccatacttctctattgccgctggtttcggtaacgtgcacggtgtctacaagcccggaaacgtcaagctccagcccggcctcctcaagaagcaccaagcctacgtcaaggagcagatcaagtcgagcgaggagaagcccgtcttcttggtgttccacggtggctctggcagctccgttgacgacttccgtgaggccatttcatatggtgtggtcaaggtcaacctcgacactgatctgcagtgggcctacctcaccggtatccgcgactacgtccagaacaagaaggactacatccaaacccaagtcggcaaccccgacggcgaggacaagcccaacaagaagtactacgaccctagggtgtgggtacgtgagggagagaagaccatgtctgcccgtatcaagactgctctcgaggatttctacactgctggaaagttgtagatgtgagtactaggtgctggttcctttcttcgtggagtagaaaaataaataaattaattcaagtc

SEQ ID NO: 27293 - DNA, 554 bp, Sorghum bicolor
  Clone ID: 6676162
ggaccgaagtctctgactgtatgggtgactaatagctagctgaaagaaatcagttttctgtcccatttttacttactcgttattttaggaactctcttgcccttatctgattcttctctatttagtgcaaatggctgacattaatatgtctcaattgcagttaagctagctgacatatctaattctgatacaacgctttggaagaacctcaatgtcaccgatttatttggagctctcctaggtttatgtttggaaaatggtttaaagtttgcttttgacaaacaagccatttaatcactttgagatcttcagttcagaaaaggtggtgcattccagcgacataataggggtactaattttaagaatctcctagcattgtcaaacaaacttgtgctcatgaccacctagccaaaatatctgtatcttagttttgattaaacttgagccgcattgtactcatgatgggtaatttgatgttaatctacaggacatattatctcataaaatattttggcatctcgttgcaatgcatggtctatacagtagagtttgtg

SEQ ID NO: 27294 - DNA, 496 bp, Sorghum bicolor
  Clone ID: 6676164
cccgtcgcagtccagatgcctgccggcatgacttgccagggcactgttggtggagtgagcaatgtttgcgttgcccgcctggccaacaccgctatcgctggtccttttggtggctcggttctcttcacccagtccaacgctgccaagaagcgggccatcgagttcaacctggccaagaggcgcttcgctcgtgctctccagagcgacgagtaagatgtttgacaacagcagaatcaagagcaggtagagtcctgctgggaacagaatcatgtatatagggcgtcccgggaggacgcaaggcgccacataacacggtcggtgcaagggagcatggcttagagggacgcttttctcaggtttgacgattttacgcataggctcttgagccgtttttctcacactggttgacgaagtacactctttaaacggctgcatagggacttgggagcgttggtttattagcagaaagctagtcaaagataatagactgtgatgg

SEQ ID NO: 27295 - DNA, 495 bp, Sorghum bicolor
  Clone ID: 6676167
attgcggaacaagaacaggctcaagcacaaggggcacagcctccaaaagaagacaagaagcgtagcatgtttggctttggcgctgcaaagaagacatcttctcctgcttcccttggcaagcgagagtcgtcattgggccaaggaggtagccagcagagtctgacacaaaacccccagggcggctcaaatggcgcaaaagacgagtctgtaccacctcgtgtgcgtatggcggtcggactcgccgtgcagattcgcggcaagaccgttttaatcaaggctccggtttacagcacatgagattgctagcggcgattgttgtgaaggcgctggatgatgtgtcttttgaattgagcgatctagcaagcaagcaagcaagcgatttagcattttcgttgtcatcatctcccacgtacaagttttgtatgcgcgatcggattttcggattggatatgcctaagcctcaatggctatacccagggcaaacaaactttgtca

SEQ ID NO: 27296 - DNA, 619 bp, Sorghum bicolor
  Clone ID: 6676170
gagtggatcacttcagtttttcatctcttgctctgtttttcctcacactatcatgcttcatcgccattggggtcaatctgagccaattcatctgcatcgggcggttttctgctgtatccttccaagtcctgggccacatgaagaccgtgcttgttctgtcccttgggtttctcttctttggcaaggaaggcctgaatcttcaggtcgtcattgggatggtcctcgctgttcttggaatgatatggtatggaaacgcatctgctaaaccaggtggcaaagagcggcgcagcgtgctgccggtgaggtccgcgagcctcaagggaagttcagaagaaaaggacggtgcggagaaataatcttgctaatctcactgtgactgagatgagaaactaaatttctggtgacggacaaaagtggaattgccgcagcagctgaactcttcccgtttagaaacatagcattgttacagttacaggtataccggtgtgactacattttttggctctctgaatctgaaatatttgtagcgagggggatgacagatgttacaagatttgaagactgttttttttatcaaatacatactgtaattgtttaatcgcatagtgcaattgtttgc

SEQ ID NO: 27297 - DNA, 455 bp, Sorghum bicolor
  Clone ID: 6676174
caattgcagaggcgatgatccgtggcttaccaattattgtaaatggttatattgctggacaggaagctggcaatgtcccgtacgttgttgaaaatggatgtggaaagttctcgaaatctccagaacagatcgcgaagatagttgccgactggttcggcccaaggtcagacgaactcagagtaatgtcccagaatgccctcaaactagcacgaccggatgctgtgttcaaaatcgtccacgatctgcacgagctcgttaggcaaaaatgttttgtaccccaatatgcatgcgcaacatagaaggtcgtatcctctattttgtgtttacttcatttttttttaccccgatgcggcactagttgtagctgattgtgaggattgcaaatattgattgatttcgaacgtctccataagagaaatgaaaaatgtatttgagtgctctagtttaattttccg

SEQ ID NO: 27298 - DNA, 221 bp, Sorghum bicolor
  Clone ID: 6676180
tcgagaaggcctgcatcgacacggtcgatgtagacaagatcatgcccaaggatctagcgctagcatgtggaaaaaaggacagggccagctgggttacccccaacgagtacttggatgctgtaaaaaggaggctcaagtcgagtttgaagggaaagctatgagtgcagggacgaggctgaagtttaaaaaaaacaccaaatatcatggttgagtgttcgccc

SEQ ID NO: 27299 - DNA, 530 bp, Sorghum bicolor
  Clone ID: 6676186
agggcaaggactcggacgatgatgcgtccagcgatggagatatggagaagacagtcccagcgccaaggcgaaagaccaaggacgaagacgttgtcatgcgtgtatcttcaaccagcaaccagggacgggctgtcaaggacacggtgcttggctcgagacaacagaagtcggggcgcactcaccaggccagaggagaagttgttggcgagcgccaagtgtccttcattccagagtcaaggagaaagcaaaagaagagagaggaggaactgcctgctgaaccccgggacaagcgaacgggagcagctcgacgcagcgccagtggcaacacgtttagacggatctaagaaacgagaaggacaaaacagccgcttggatttgattatcaaaatagcaaaggcgttaatgctcagttcgtggagtaaagatgagagaccccatgcgtggaaggttactatttatacatggatgatacccggatcctgtccgttggaaacaccaatctgagaccacaaccatcgaatacctggctg

SEQ ID NO: 27300 - DNA, 543 bp, Sorghum bicolor
  Clone ID: 6676194
agcttcgcattgttgctggtagtggggcagaaggttggtcgtcagtcactttgaatgataagttgattgatcagtcatcggggttgaagactaaaggtgctatcattgttcaagtatactcctcgcatcatctgagcgttgttttcaatgagttctcattgttcatcgagaacagtgacggctttgtgaacctcgcttctgtggtcgttgatcgcaagcaatggtcggctatgacagctcatggtttgatcggtcaatcatggcatcgtcctcgtgttcatggtcgcaacaagcactttgaaggcgaagttgatgattatctgatcaatgagaatgacttgttcggtgttgatttcatgtacaatcgcttcaacatggcttaaagcacagctttaagcaaggtgagtatggaatgtcagacattttcaatgtgcgatcccacttgtttgttcaagatgggatgttattttattcttttatcattgagttgttgatcaattcaatgctgtcacaatttattttactccatagatctatcgttga

SEQ ID NO: 27301 - DNA, 571 bp, Sorghum bicolor
  Clone ID: 6676198
tcgtcgccgagatgtacccttctcagtaccgatctcgctgcatggctatcgccactgccaccaactggcttttcaacttcctcattggtttcttcactcgcttcatcactgatgccattgactacttctacggtctcgtctacgccggatgttgtgctgccctcgtcttcattgtcttcttcttcgtcatcgagtccaaggaccgcaccctcgaggagattgacacaatgtaccgccagaaggtcaaccccattacctcctccaagtgggttcccagcaacaacaactccaaggtcgcccgcgagggtgtcaccgatgaggaggcttcttcttaaacaaccatcaaccacctaccaccacctatacacaacacacatcacgctatagacataccactatagaagaagccggactggaatgccggcgagtaacgattagacggacgttgcatttaaaaattatattcatgaggtgaaggggaatgaggaggtacataaagatgaaaccagtattatatatccttgtatttagcagccatattgcgatataatatcatttcgctacgtttttg

SEQ ID NO: 27302 - DNA, 511 bp, Sorghum bicolor
  Clone ID: 6676209
tctggcgcagcgccgtgttccacacgtatgtgacggttgagtggacggacaagtggatggagcgagacatgcgcggcttcatcgcaaaggtgaagcaggcgctgcggccgctgtcggtgtcgggcgtggcgtcgtttgtcaacttcccggaccgcgatgtcactgaggcggtgcatgagcgcgcgtacttcggtgataactacgaggagttgcgcaagatcaagaagatctgggacccggacaacttcttcgactgggtccagggcgtgcgtctcccgggcgcgccgatcgataggggcgagctgacggttgatccggatgaagaagaggacaagacagacaagattgcgggagagcagtggaagaagtggtcggaatggaagacgtacaaacctgatgattggcagaaggatatggacatgttggctgatatgggctactgagttggtattatgctacgctcgttaagcttttcatatgatacaacttcaatttgagtctacatgcattg

SEQ ID NO: 27303 - DNA, 565 bp, Sorghum bicolor
  Clone ID: 6676212
ttcgtcgccaagatgaagcgaatcactccgcgacaatgataatttcatgttcctcatttttccttggttactggactatgccttgagacaaacagcatcaaggaatgtcgccgagtatggatcacccttgtttgcttttttcatgtcggcagtcgctctctcattttaattcaatttcatcccatcccgtcttttccagacgaataagaggctgcgctgtttcatctacagtatcttcccatattcttaccctcttttcatctgaacatatgtgcgatgatgcagagtaataccgaaatgttttatgtcccccgcgctcattcttttttgtgtttcccaaggctttgtctcgaactaaactaaacccccggcgatatgttgatagttgctcgtttcaaagagtcaaagacacagccacaaagagatggaatgtttgctggtgcaaggggccttgcctcagatcagatcagatcagtcactgtagatcaaagatcagatcggtcacaccggaagagatagtcaaagagacgaaaaagcgaaaagcgaaaaacttgcaaacttgttc

SEQ ID NO: 27304 - DNA, 351 bp, Sorghum bicolor
  Clone ID: 6676215
catacagaacaaatgggcagccaattgatgactaaagctttgaaaaaatacagcttgattatttgtcagtcataaaacagatgatgctggtgctcgtttaatcaacttgattcagagatatatcagctctgggttatctgaatcatggacgctttctccctctacttctttatctacatcttttgttgcactacttccatttgcatcatttaagattggggacctacacaaaaggacttgggaatatcatttgaagatagatatttgattatttttctaccttattgattgtgtttggtacaaatataactctgtatgccagaaagatttaaatgattggattgtgctgtt

SEQ ID NO: 27305 - DNA, 525 bp, Sorghum bicolor
  Clone ID: 6676219
tgccgcagaggatgatgacgacacacctcaacaaggggcttccaacacgcacaagcgcgtcatgagcgacgcgcagaagctgatcagcgaacttcgcgctatgagggcggagatggaagaaggggcttcctggttccacgatcaaaacgagagattacagagcgagatgattagccgcggctcgacgccgtgggatcaaggttcatgacatgttatagggggaaaagaggaacaaaagaatgtgtttgacgacgaaggccgataatgtagcccagccttgacagtgtcgagctcgtggagatacccgtggcattggatgggggggagggatgataaaggttaagcatgtggatttgttttctggcatctgtattcttgactagcgactcatttgcagcatcgcattgtctttttttgttgaaggggatgaatgaagggatggcatgattacataggttttggatgggggtctcacggcaggggaaaatggttaagcaaatatacacaactggcattgaagccaga

SEQ ID NO: 27306 - DNA, 480 bp, Sorghum bicolor
  Clone ID: 6676220
caacaatcatcttcacaaccgcagatggcttcccttaccccctccgccacgtctctcccaccgatggcttcgaccctggccaccctggccgcatctggacgaaccagacatcttcgtcgcacaagcccgtggctatcacgctgccagccacgttgcgtattgagacggacgtggtgaatggcagtcgagtgtggattgatgatgcgtttgccggccgctttgaggtgtttgtgtacgggggacgtaatacgttgttcagctggagtcagatggcgcttgtggcgccgctggagaggatgagtgggggtgtggatagcttggtattggaaagtgaggtgagcttagggaaagattgatagagggtagtatagagctagaggtgtaggagggttgatgcatttgtggtgggagcttatatctgccagagtgtgacatggttctaatgtcaatatctctttatgaaagtagtagtatatgttt

SEQ ID NO: 27307 - DNA, 514 bp, Sorghum bicolor
  Clone ID: 6676221
caagaaggacgccaaggcagtcagcctcaccgccaagactgcgggcgacgaggagaaaagcaaatgttgtaagatctgagcagtgttgtattgcccgctgaatgtgtctctgtcactgcaccgttggcttgtctgtgtgtggcgatgtatgtgcgactggctgtgggatgtcaatgtgtgtggccgtgtgggttgttgcggtatatgtgtgtgtgtgcggggttgtgctgtgcgctgtgtgttgtggatgcggtatttaaagtggagatgcgatccgctacatgtgtcaactgttcgtcgagtgtccttctctctgtcctctcctctgcctccctctctctctctgtcgatccgcctggtcttctctctccgctctctgtctccgccctgacacttctcgttccttcccttccaagcgttgtgtgtggtgtcgagctgtgcatgctactgtttgattgctcactgttgtgcagactgcagcaacagtaaaccggtagaagtgatcgcgattctg

SEQ ID NO: 27308 - DNA, 534 bp, Sorghum bicolor
  Clone ID: 6676240
gcccggctaaggtgcccgccatggaggacctcaactacccgtccatcgtggtgccgtcgctgcgcggcacgcagacggtgacgcggcgggtcaagaacgtcggccgcccggccaagtacctggcgtcctggcgcgccccggtcgggatcaccatggaggtcaagccgacggtgctcgagttcagcaagggggtcggcgaggaggaggagttcaaggtgacggtcacgtcgcacaaggacaagatcgggctgggctacgtctttgggaggctcgtctggacagacgggacccactatgccagaagccccgtcgtcgtcaacgcactcgcgtgattccattccattatcagtcctgctaactacctaggatccatgcaatccaagcaacggccttgtgaatttttgtgacacataagtaagggtttaaaatatgttttatttttctttccttcttctagtagtgacgaagtgagataggcttatttattattggacatattatctatataaataaaattttggctcttcgcatgcg

SEQ ID NO: 27309 - DNA, 259 bp, Sorghum bicolor
  Clone ID: 6676255
gaggttccaccatgttcccaggtattgttgaacgcatgaacaaagaattagttgctcttgctccatcccccatgaagatcaagatcatcgctccaccagaacgtaaatactctgtttggatcggtggatccattttggcttccctctccaccttccaacaaatgtggatttccaaagaagagtatgacgaatttggtccatccatcgtacacagaaaatgcttttaaattaattgtaaaactaccaataaaatattgtt

SEQ ID NO: 27310 - DNA, 444 bp, Sorghum bicolor
  Clone ID: 6676256
caactacggcaacatgcccctcgacgtggcctctggtgcgcaggctcctgccacaccggctgagcccagcaaggtcgagcagcaaggaaagaagtttggaaagaaattgggcaatgccgctattttcggtgcaggtgcgacgattggcggtaatattgtgaattccatcttctagaggggtggatggagactatgtggttgcgccacggtaatgtatgtctgatttccagagggatcttttttccattgggccaagtaaggagcctgttttccgatatgggcgttttgggatgctattattatcacgagtctcttttgattccttgttgatcgggttatctggcatctctctcatgggttgactgtgtgtggttttggggggctgaaaagaagaaaacgcagatattacacatgctatgtatctgaatgatgattcccttgttc

SEQ ID NO: 27311 - DNA, 516 bp, Sorghum bicolor
  Clone ID: 6676268
gccaccaagaaaatgtcccgaatgtttggacgcggtggtcgcagccattctcacagtcgccgtcgcggtggcggcgctggttttaccggtaaacttttcggcctgcgctccgccaatggccccacgtacgaacgcgtcctcgaggacggtccgtcggccgtcaacgccagcgacttcgagttcggtccttactcggataactcggacaacgaacactcggattcatcgtcagatggcacgcgcttcggccgcacgtctggctgggcgactccgcaaatcaaaggcggcggtggtgcagctgctgagactggccattctcaggatatcatgacgcaaggggcaagtttgggcctgggcgggttcatggcgcggacggatagtagggagaggttggccgtcaggagtcgagccaacagtccgaggagaaagagccccatgggcaaattctcgtgatttttttccctcgttatgttttttgtccgttttcatagcgaatcgcacatttgttcactgttc

SEQ ID NO: 27312 - DNA, 192 bp, Sorghum bicolor
  Clone ID: 6676287
aactccgtcgtacgagtctgcaattgcgcatacatgcttccaaagcaaaacgtatgacactgcctcatcggtggctcgccccgaggtcaaagtcgtgcgggacaaagtaggtgcatcaaatgccatctcgtcagtgttggctgctgatttatcttactcgaatggacatctctccaattatttcgcccctcc

SEQ ID NO: 27313 - DNA, 525 bp, Sorghum bicolor
  Clone ID: 6676290
cgggccgaatctgtcatggtggatcaaaacgtacattctgcgccacaagggactggcaaagccgcagttgtacaagtttggggaccagagaccgcctgtcagcgtcacggcgcagatcggatatgcgtggaatacttatgtgctgcgtaagaagggactaactaagcctggagcatatgttcagcctccgcctcgcgacgagaagcaggtgtaatggtttgtggagggttggtcgggccgaagtgtgctcatactcgatttgtcgattcttgcgaattgggacataaagtaagtagtgattcggctggctaaacggcgctcggtatgtggatgtttgcgatatgagattacgagtaacgacctggcggtttaatggagacgaacggagcagtcgggaggacaggttcaagtcgttcttttagctatataccctttgctagcggccgttagcatacatactttccttgaacacggcaagctgcatcttctcattagcttactttgtaatcggaggaaatgcgcttg

SEQ ID NO: 27314 - DNA, 528 bp, Sorghum bicolor
  Clone ID: 6676295
tgaaccagcggtaatgaccattcttatcaccgactttcaccgctgagggccgccaaaacggaaaacccatggtagtgagggtatggaaccggcagtggtgaagattttatggtagttaaaatttcactttttagtattatattagaactaaaaattgtgtctatgcgttacaacggaatcctatgaatcagattctttattgtatttcatatcattgctagacgtgggctattctaacttgtatgagcataagtcatgagtttaaggcacataggagatatatattagaattggaccctgtatttattaaatgcaaattgttgtaactcgtaagtcaacaaaaaagtgtgatagaagaaactcaacacaatagaggtagttcggaggggaccggatgaaaaaaagatgaaattttgatacgttcatgcgttgagaaaaagataattaaatattcacagagaactaatgcacatataattttttagcatgtaggcatagctctcgctacatgttctcagtggtttcgcc

SEQ ID NO: 27315 - DNA, 186 bp, Sorghum bicolor
  Clone ID: 6676297
gatgccaatttgttgggtgttttaatgaagcaaggaaatgaaaggaagtaaaaatacccaaattaagggagattgtcggaggggatgacaacggttttgttttcatcgggtccagttccctactaaacaattgattttagtaaaaccgtgggcagaaaaaacaaataaatagatccatccctcttg

SEQ ID NO: 27316 - DNA, 435 bp, Sorghum bicolor
  Clone ID: 6676309
tggaaattgcctactttgccctgttgatcagactccacataagtggccacatcagataccccgaagagtaaacatgctgcctcaggagacacgcgtggccgctcgatccgagttagctgtctcctagatcttgcttcaatgggacaaacaaacgctcaaggctggtatcgtacttcaactaccgatcccaagccatttttcattctttttatttttcatttcctctgaaccagggggagttgtacaacacattcggtgaccatgctgaggacatttcagcaagccgcctttgtcttaatacgtatacctcatgcagcgtgttattcaatttacgaatttatgggatccacggccttgtcacaggtgaaacggagtttatcggggtttctggcggtacagatatacattttacttggtgttttcatctcttttgtc

SEQ ID NO: 27317 - DNA, 322 bp, Sorghum bicolor
  Clone ID: 6676321
ccgacgccaaggagcccatccaagaggccaacccttaaatgcaatcaagcatgggcgagttagccaattgtcgaaaggcggtggcctttactccgacatatctcccgatttgtaatgtcccagtcgattattccttacagaaagactgctttcgaaaggcgtgggtcgcaaatgaacgcatttattgcttgaaaaaggagggtattgcaaacccatttcaaagttgggggagctcaggaatagcttgtcccttttttacatggtagattcccccccatatagtcagtatgtaaaattgaggaagggttgggttcccccaccc

SEQ ID NO: 27318 - DNA, 549 bp, Sorghum bicolor
  Clone ID: 6676339
tgtcgatggcatatgctggcgctcggttcgcattgtcgttggttcgagcgatcaaaggtgaaaagaatatcattgaatgcgcctacgtcaaatcgaacgtgactgaggcgacatatttctcgacaccattgagactcggcccgaatggcatcgaacagaacttgggtctgccgaaattgaacgctttcgaagagggtctgttgaaggccgctattccagagctgaagacaaacatcaagaagggcgaggattttgttaagaacaattaaagtgaaacaaattcatcgcagttcaacgatcccccatcgctcattattggtcccattgtcattttatctacaaagtaattttcttttcattctattccgatttgtccgagacaatgattttcttataattggttggcactttagaaaagtgaaatcgaattatttttttctttgtaaattctgtgagtcaccgtctcacataggaacgatattattttaaggcagtcaacccttgttataaacgattgtacattaaataaactgtaaaccaaatttactg

SEQ ID NO: 27319 - DNA, 387 bp, Sorghum bicolor
  Clone ID: 6676368
cttttctgtgaagctgtgaacttcagcatcgagaatagctagccaggtaggttgacgttgtattggtaatcggcatttttggggggcccgatgctgcagttgtacataggcaaatattgggtttcatgcttgcaatgcaattatttgatgtctcctctggattgtcaagtcacattcaagaatatggtccacaacccatggcaattgatcacagtactgtttcaacatcagcaatatttcggctacctccttattctgttgctttggatgtagaaaagttagaatgacttacaatttaggacagatggagtatatcattagaacagtccccttgagaaatgtaagccagaaatattgtttcatatatgcagattttggagacagtgc

SEQ ID NO: 27320 - DNA, 505 bp, Sorghum bicolor
  Clone ID: 6676391
acaatggttgctgctattgacttattaatcgagcgcggagttaccagcaagcagattaaagttgtatctgctgttgcatcacctcctgcactgcaaaagctcaataacaagttccctgggctccatgtgtacacaggaataattgatccggaagtaaatgagaaaggttttatagttccaggactgggggatgctggcgacagaagctttgccacataatcagactgctcaatttgattgggccagtgctcgacctgcgagaatctttgcttgagtttcacaggaatggagcaactgcgagtagaagtgttcattgctgtagattaccttcattgagattttgttccttctcagtgttacaaccagctgcctaccattttgtagctacccattctgtatgattgcgtagaatatatggctagttcaaatgtctccagatggtgaaatcttcttgagagaacaatgttccgttcaaaatgatggattattgaagttagtggtctct

SEQ ID NO: 27321 - DNA, 541 bp, Sorghum bicolor
  Clone ID: 6676425
ccgcgcggatgcgctacacagtgccactgccgaggagaggggcacgtgggtacccgacaacatcatgggcaacaatgctccatccatggagccgatgccacttgaatggactgtttgatgtaacctactgcacacatcgttcgaagtttgttttctttggattcgagcattttgaagcgaccgcatttgcgcaatgctttgggaattcccaaagggcacacaaagcaaacaaaaaaggttacatggcaggtttcatggttgacccgtacacagagacggctgatgacatgcaatgactacgagaatcgtttgctgtattatcaaggtttttcttatttttttctttctctctctctattaccgatcgataccactgggagcttgttggcgttggtaagggaaggactaatgagtgaatatgaatgggaacaacatgtatatctggacgtggctggccgcaggatgtagtgttctatctcttctgatttttcactcaatccatactctgctacatttagcaacatcaatctgaacatatttc

SEQ ID NO: 27322 - DNA, 468 bp, Sorghum bicolor
  Clone ID: 6676432
gactttgtcctcttttttgaatcttcttgtacggcctctttccatttcctctcagtcgtggatttctctctccctcgggtttcttgcgtgcttcttttagcgactggtctgggcattgggatggatgggggcaatgggacacaaagccgggacaattgagctcaccaacgtcgggcacaactggccttatcttttctcgaaccacggggaatttggagagagcaaagggccttttatttctatagatacccccccaaaaaccaactaaccatcatccacgagtgtttccaccagattcacaccgaccactacaaccaacatttggcaaagagggggcgacccgacgacgagaaacagatatacacacgccatatatatatttatgtaacacactcgctttttctttccatgagcagcggcaaagcaggactagcacagcaaagcaagagcaaattgcactggttcttt

SEQ ID NO: 27323 - DNA, 579 bp, Sorghum bicolor
  Clone ID: 6676443
gccagtttgcttttctcggcaatgcatccatactccactgcaacgtatgcccaagtatcataatcaataccttggcccaatgacccgcgagatcgcagcctcgccagcttttccgtttgtcctatggcactagatatgggcgcccgagtaacaacacaccgtgccctgcgccagggatccaatcctttttcgccccatgaaagactgcgcatggggaacattatgggaaagggtcaagagaccctgttacgatcgtcgcaaggaaagcggcctcatgcattatgacttctcctagaacatatttcttattctttggaaggaatcgtatggacttatgacgaccaacatgatacaatgttgatgacgtttctttgtctccggtgctccggaggtggataatgaagctaaggtaagggaagggctgggattagatacgggcatgccgcagcataggccctggaggctgcttcgggcgatgattctattatatataatatgacttcactgttatacgagtgacgaaaagcccagcgagcttgctacccccaagatatatcttttgaaccataaatatccgcc

SEQ ID NO: 27324 - DNA, 490 bp, Sorghum bicolor
  Clone ID: 6676449
cgagttcctgctcaagcccatcgccggcgtagacactgtcaacaggaccatcaacgcgccgggctccttcgacacgaagctgacggtagcgtcgctggccgacattgctcaccagaccgtcgacgccatcgtgacgggccgaggacgcaaccaggccattcacttgggctcggcgacgctgtcgtgggccgacatccgccggatcctcgagcagacgacggcgagcgagtggacggccaagaccatcagcgtgaaggagctcgagcaggccgtccaagccaaccccaacgactacgtggcgcggttcggagcgagctttgccctgggcaagggcagcaactggccactgagccagacctacgccgtcaagcacggcctcaagtctcgccagacactcgaggaggttgtcgagcaagagcttggtcgtggccagtagcgcagtagacattgtgctcatgtttgtacatggtgagtaaagagtcacttgccc

SEQ ID NO: 27325 - DNA, 488 bp, Sorghum bicolor
  Clone ID: 6676489
cccatcaactcaaaagatcgcgattccgactgtttgtgcaggttgtgtgattggtaagaatggcagtgtaattcgtgatttacgcgctcaaagccagacaaatatttcgatcagtgatccagaacctgatgcaccaaatgaacgagttgtcacgttaactggcacagctcaaggcattcaacatgccgtttatctcattcgtcaactcgttgaacaatatcaaccacatcaacatcaatcacaatcaccacaagctgctcaatattaattgactgattgatcaatagctgattatctatcgattgaattcaattcgtcgttcattcattcattgactgtctatcatgcgttgatttgtgtcatacaatcactcaacgaataatcaatcaatcatttattcgctcaatcaattcgtttcgtcaatcgtcgtgttgatgatgacgttgatcatgtgtatttaagcatcagttctatacaaacagtaagtg

SEQ ID NO: 27326 - DNA, 549 bp, Sorghum bicolor
  Clone ID: 6676492
gatgaatctgcagatgagaagccgatgcctaaaaggcgaggcatcaaggagagctgacgcccaaaagtgaagctgccgatgagaagcctaaaaggcgaggtcacccagtaggttctcgaaattgtggcgattgatttgtcaagtttgggctgggggtgatgcattttggaaggagctgagcttgtaggttgtatcgatggtcaggcattaaggtgtctgagcttttgttcatgtatggtgacagccggccgacgccgatggatggagaaccattggttggttagttggtgcgtggagacccagtcatgtagcaggcgggtaggcaggcactagagagaactagggtgagaaacagtagggcatatgtatgctgctgatattttgcgacttagcatccgagcctccctatgcaatggtggtgctgtttcgttacttgtagtcaaatttaggtatgaatttgaccaagcatttgtctagatttatataaaaaaattgcattcatctaaaattgcattcttttttgggaccgagggagtatatgcagttact

SEQ ID NO: 27327 - DNA, 526 bp, Sorghum bicolor
  Clone ID: 6676505
cagtggaaattcaagctctaggatcaaagaaaaatttaagaatttcaacttggcctttgaggagatatacaggagccaaacactttggaaggtgccagatcctcaactccgagaagaactcaagatttctatatctgaaaatgtgattccagcttatcgtgcttttactggaagatatggcagtctagttgatagtggaaggaatactggaaaatacataaagtacactccagaggatttggagaatcacctgtctgatctatttgaagggtcactagggtctgccaaccattccaggagaagatgataatttcttatgatgggatttggctacaggtatgcttttggtacaagggacaccatatcaccaaactgctgtagtgaacgtattgaattggtgttggtaccatttcgcaatgtaattcaaaataggacccctttgttttgcaatcaatatatgtgtaatactaaatgatgtacatgttctttttttttttctcagtatattcttatatttgcttgtttg

SEQ ID NO: 27328 - DNA, 583 bp, Sorghum bicolor
  Clone ID: 6676506
tcttcctttgcgccaagatccaggatttgttctgaattcaaatgtctcttcacctgaatctcttgatgacatattccaaaggttgaaacggcggcctgcaaatgtacctgtggattaccttgacgatgacgatgatgacaacacaggagatatggatctgcatttccaggatcaatgaaataggttgttattcttttaggtttagaatatgcatacacagaaaaactaaaagaattgttagcattagatgctcgaaggaagatataggatgtatagatctgatgatttggtgtgcttcctggaagccaagacgcctgcccgtctggagaactacaaaatggaagtacgatatgatgacagccttgcagaaaggctttaaattttcccagcaagaaggtttgggacttctctcaccttatttgagtctgtattggagttgctgatatgcgatccaagccgaagaatgtaaatgtgcacctacgattccatttgaagattaacgtgcctgggttgtaaccagtaaaaatgtactatcaaatatatacttgatggggagaatgctcccaagtggtttttgtgttgc

SEQ ID NO: 27329 - DNA, 491 bp, Sorghum bicolor
  Clone ID: 6676508
gcaatgctggtactgcccgttacttttctgagggtgatagcgtcctggttgctcagggtgtctctggcgctgttgctcaccgaggttcgatcaacaagtttgttccctatcttgctgctggactcaagcactctctccaggacagtggtatgaccagccttaagactatgcacgagagtgccgaggccggtgagttgcgcttcgagcttcgcacagccagcgcccagttggagggcaacgtcaacatggagtcttatgagaagaagctttatgcgtaatgatatatttttgggggaaaatgagggatgatggaaagggataccgaaaaagggactcgtttgtttatatgcattcaattgcattggggaattggggaactgggcacaagattcagaagggtttgatttgggttgagagtaaagagcctctgtgaccgtagatctgaataggcgtttgtccaacccctataaaggtgcggcgtgggcgttttg

SEQ ID NO: 27330 - DNA, 398 bp, Sorghum bicolor
  Clone ID: 6676513
agaggaggcagggtgttgtgccaagtgtgtcatcatgtaatgctcatctgcaggcaatccctcctctatcttggtttttcctttccattcacctttcactctgtgaaatatatcagggctcgcttccctgtcacactccttctttatctctatcttctttgcattcactcgatttctcatctttatcactgcatccttccttttccctccccaatttcggaattttggttcgctatacccactttgagtaagtactgtttcgctcgcatgtccgtgggctgtctgtgggttattttctagcagcatgtaggtttatcgtttgttctttccccagtacttcttttttcctcctagcttagttttataatgaatggcgcgggcgaaagctctgttaactc

SEQ ID NO: 27331 - DNA, 543 bp, Sorghum bicolor
  Clone ID: 6676516
ctttgggaagagttagcagcaattggcgaggaattcgtagaatttctggaaaatgaactgaagattgatgactccagccctgaggacgtcactggaaatgacccatacacccagtttggacagcaggcaaaaaatcctaaagacgacaagacatcaacaaacagctttgatgacggtctttctgaaatagaagctgctctcgagaagctgaagaaggaacttggactgggctaaaccattgatgtagcaactaaaggtgttgctgtagctgctgacttcgtgttcgtacaaagagggatatgcggcacctgtgtagtccatgacgcttccatttaccatttagattgtaccaatatctggaacaccgttgttggtgcatggacaaattcagagactgtcatgaagatatataggtcacatctattctttcatgaggatgatcttcagggagaacaccttgattcttgatgtatgttggaatactcctcgcaaaagagttggttacatacaattttacatataaaaagagcaatccttttcgcc

SEQ ID NO: 27332 - DNA, 251 bp, Sorghum bicolor
  Clone ID: 6676535
agcgtcgtgccacgacccctcgtgggtttagatcaggcccaaatcgcgagccgcgctcgcacgcctagcgcgatggcgcacccgatgtacggctccgggccgctccgatccaggaacgcggcaaactcggacgaaatccagctgcggatcgacccggtgcacggggacctcgacgaggagatcgatgggctgcactccagggtccgcatgctcaaaggggtggcccaggagataaattctgaagccaagtt

SEQ ID NO: 27333 - DNA, 262 bp, Sorghum bicolor
  Clone ID: 6676559
tatcgacgagaagttccccgtcgtccagaagcccaccgatgaactctaccaagatacccgtgctctcatcctcttcccaattcagaagggtcttgagggtaaggaccacgtcttccaggtctacaactctgagatcaagaaggtcgagcaaggaggcctcgtcgcgcacggaaaagctgacgttaccaccgtcctcgtcgttagcaacgagactctctcttggttgagctctttcctgcatcagaagaaggccgagaccacc

SEQ ID NO: 27334 - DNA, 269 bp, Sorghum bicolor
  Clone ID: 6676970
gtgacgtccccccaccctctcttcttcttcttccacgccttcctcgcccaccatccctcagatcccgtctcgtctgagtaccctcttgctcgtcgccaaatcgaggccgctccttgtctcgtcgcctctccgttggttgcttccgtaccgatctggccatggtggctcgggctcgggctcgggcgggctcaatcgaaatgcttcctctccggtgcgccgacgcgagctgagatccggtctgtgcgggtgcggtgcgttttttggatctt

SEQ ID NO: 27335 - DNA, 303 bp, Sorghum bicolor
  Clone ID: 6857830
gggtcgtcaaggtcatgtgccccccggccaaccagtgcatgaaggagacccccatgcccatggggccctggaggaagcccaagtacatgcaggcgaagtggctcggcacgcccgagcggacggccccggcgcccgtggcggcaacgcccgtggtggttccgtcggtgacggtcgtcggctccccggagaagcagaccaagttcagggggtccatgctccccttcgactttggccggaacccggtggaggtcgcgtgatggagtataaatatatactgccgagctgcattagtagttctacttc

SEQ ID NO: 27336 - DNA, 200 bp, Sorghum bicolor
  Clone ID: 6857832
aggtgaaggagatcaagaacggccggctccccatgttttccatgttcgcctttttcatccaggcctaggtcaccggggaaggccccgttgagaaccttgccaagcccctaagggaccccttgggcaacaacctgttccccgtcatttccggggcccccgagaggacgcccaccctgtgaggacgcacggaccccccgctg

SEQ ID NO: 27337 - DNA, 102 bp, Sorghum bicolor
  Clone ID: 6857836
actgacaatggttcattaagctggtagcttggtggatttcctgcggccagaactgttcacaacattttgaaggccgtggaatatagcattttgctatgtgtc

SEQ ID NO: 27338 - DNA, 164 bp, Sorghum bicolor
  Clone ID: 6857845
tttctctctcgggcttgattctgttgcttccattgctcttttctcagtatcttcaagcattattacagttcaggcctgtgatacccccgttccgtgttattgggggaaaggggcaatcttcctttcttgcttacaaaagggaggtaggcatttctcaattctct

SEQ ID NO: 27339 - DNA, 135 bp, Sorghum bicolor
  Clone ID: 6857846
aatttatgctttcaaaaaaaacgaaatcggtcaggggctcagtgcttttggaaaaatgtttttttccctgcccaaaaatcggcatatgaaaagaattatttgggcttggattacaattggtttagttaccccaac

SEQ ID NO: 27340 - DNA, 123 bp, Sorghum bicolor
  Clone ID: 6857853
tcgtgcatgaagttgttggcgggggtttaaaactcaaaattgcttgcttgggttgacccttcctcccttccccggggatggccaagtttgtgaatgacatgaaaaaatggtttggagcgatta

SEQ ID NO: 27341 - DNA, 227 bp, Sorghum bicolor
  Clone ID: 6857854
tgaaaattcccggatgggaatgcatccaaggcatgccacccatgatgcaagttgtagcatcatctatcagatcctgtaccatttgttgtattttccccattgcaaaaacccttgtttcatttcattcagttgtttaaataaatggagatatgtagtcatgaattggtagccccccatcttgctctggatggaaaacgtcaatgtatgttgtatttgttgtgaatcgt

SEQ ID NO: 27342 - DNA, 489 bp, Sorghum bicolor
  Clone ID: 6857859
gggagaagtggtagatgacacttacgatcgacaagaagcaagtaggattcttaaactgtctacctgtcaaaggtgttagaaaaccaagacaagcaacagaagaaaagaagattctatctgcccgactccttgctggttaacacgaagcaccaaatcagcaactagatcaacaaaaagttgctgcatatttaaaatttcaagtacttcgtgcttgctattgtagcttgctcatttactactgcctccctgttggtcagtgcctcacactcaggtgctctccagatctggccgccgccgaacacaggcacctagggttttgttgtttcgtcgagcccatgagcacacatggactataaggaggaagccgcgttgggtggcatccacagcggcggccacctacggggctcgccagcgcccgcgcaccgccaccgtctcaccgaagccgttcgccggttggtgcctcgtcctatccagttggttgcgccgtcg

SEQ ID NO: 27343 - DNA, 482 bp, Sorghum bicolor
  Clone ID: 6857861
cctccaagcttctgatgccgagaagtccgtgttggagtttgtcctttctgacgatgccttcaagggcaaggaccaagccaagattattgagacccttcactctgtaggtttcgatgaggagaagcgtgcattgcccgttgctgctctctctggaggatggaagatgaagctcgagcttgctcgtgctatgcttatggaggctgatatccttcttcttgatgagcccaccaaccatttggatgtgtccaacgttgcttggcttaccaagtacctcacttccctcaagaacgtgacctccatcattgtgtctcacgattctagcttcctcgatgatgtttgctctcacatcatccactacgagtaccgcaagctcaagacctacaagggaaatctttccgagttcgttaaggttaagcctgaagccaagtcctactacactctttccgactctgtcatcaacttcaagctccctgagcctggtt

SEQ ID NO: 27344 - DNA, 200 bp, Sorghum bicolor
  Clone ID: 6857863
ccccacggaggtggtcgtggtaaatcaaagggtaacgtgcaccccgtcagtccatggggaactcctgcaaagggaggctacaagacaaggcccaagaggaacaagcaccccttccttgtacaagatcgaccgcgcaaccaaggcaagcgcaggtcaaagtagacggacggctgtatccatacgctcgagctcattctgta

SEQ ID NO: 27345 - DNA, 319 bp, Sorghum bicolor
  Clone ID: 6857875
gggctcgacaaggtctaccccggcggcgcgttcgacccgctagggctcgccgatgaccccgacacctccgcggagctcaaggtgaaggagctcaagaacggccgcctcgccatgttctccatgcttgggttcttcgtccaggccatcgtcaccggcaagggacccatcgagaacctcttcgaccatgtcgctgaccccgtcgccagcaacgcctgggcttacgccaccaacttcgtccccggcaactaaagctgatcgagcgagcgagctgaacctgagcagagcatccatgcgtgcatgtcgagcgaggtctcctgta

SEQ ID NO: 27346 - DNA, 637 bp, Sorghum bicolor
  Clone ID: 6857942
ctctattatcagttactgacatatctgctcccctttcaagcagcaacttgactatctcgagatgcccacgacccgctgcctctctgagtggcgtccagccattattgccgtgtaccgtcatgtctgctcccttctcaagcagtagccttactatattgagatgaccattgcacgctgctgagtaaagcggcgtccagccctcattgctgcgctttgtcatgtctgctcctttctcaagcatcagcttcacaatctgcctgtgacctccgcatgaagctgcttgaagcgcgttaccatactctccgccgtgcgcatcgacgtcaacgccctcttcgagcagcagcttcgctatcttttcatgtcccatctccgccgccacacagagtggtgttccatagtcgcatttaacttgatgatttcttccttcttctattaagttcgcagccgttctctcttgaccgtgctgtgcagcccacaacaatgcagagcttcctgactgttgtatgttgtgtcggtaaagataaggattcagtatacaataaatgcggcggttcgcctgtacgaaggcgttgatatctttctcggaactcaagacttctgcgatgcaggaaagtagttcgttgggtaaatcatgaag

SEQ ID NO: 27347 - DNA, 111 bp, Sorghum bicolor
  Clone ID: 6857945
tggtagatgtgggtttgcgcagaaggatggaggtgttttcaccgcacatttgttatctcatgttcaccaagtttcaagatttgtcccgcaagacccatttgtcagaaagac

SEQ ID NO: 27348 - DNA, 169 bp, Sorghum bicolor
  Clone ID: 6857965
aaaactgcattaccatgaaatgacaaggtcattttgctaataaaatggtaaatgatctatcagctggcactacacaatgaactgacaactgtgtgcttctatttgttgtattcttgctcttctttgtctgctgtagtttctccaaggctgtactgcttgactttacttg

SEQ ID NO: 27349 - DNA, 531 bp, Sorghum bicolor
  Clone ID: 6857966
gaagaagggacttgcgaccaagaagagctcccagaagtacgactacgagaagatagcagaatccctggagaagctcgaggaagaggatctgctgcgcgtgattcagattatcaacgaaaacaaggggccagacacgtacattagaagtgatgtcgatgccggggagttctcgattgatctctacactatgccggatggcttgacgtcgaagctttgggaacacctttccaagaagggccttgtcggctagatgttcatgtagttgtatccgattgttaatacttctaatgttattccgtcgacaaatcggtctacagtttgtgcttgggagttgctgaagcatctggatttaggaaaatgacgagttaatgagcacggaggggacggaccagaaagggaaagggaaccaaaaagatgtatctgacctttttttttttttgctttaaccatgtgttccaacggagtaaccgcctgcagtatcacctcattgaaagttttgtatcatatgctatcttgtttgttttgaaaaaa

SEQ ID NO: 27350 - DNA, 246 bp, Sorghum bicolor
  Clone ID: 6857968
ccggcgccgacgtgctggcgtcgcaggccgtcacggatattgggaaatggaagtgcttgctggtgaccgtggcgtggggcttctttttcagggcgctcttttacgtcgtcttgctcgttggaagcaagaacaagaggaagtagtagtagtaacaaattagtaggggttgatgaaacttaattatatataaattcggtgatactgtgatctagtgatgatgaacccaaaatgtatagctcgagaagg

SEQ ID NO: 27351 - DNA, 107 bp, Sorghum bicolor
  Clone ID: 6858004
ctgccccaaggctggatcggtttgggttgcagactacatcgggtatttgattaaaaaccaaatgcccgttagaaacaactgatgttcatttggcaaatgtatcatac

SEQ ID NO: 27352 - DNA, 455 bp, Sorghum bicolor
  Clone ID: 6858025
ccccacgctgtcatcctggtcgctgttaacgagaagccattccaacaggctgctgaatacgtccgatcccgcggcaccgtcatctgtattggcctccctgctggcgcctacctcaaggctcccgtgtttgaatctgtcatcaagatgatcaggattcagggctcctatgtcggcaaccgcaaggacagcgcggaggcgatcgagttcttcgctcgtggtcttatcaaagcacctttcaaggttgttggtctttcggaacttcaaatggtttacgacaagatgcatgccggagcaattgccggacgatacgttcttgatacctccagataaacgtactgtagtgtttcgcggcgaagggcgccaatcctgataggagcgaccggagagataccacgatgggtagatagctagctctgctgtacatacttttttaaccaattcctaacccttgttga

SEQ ID NO: 27353 - DNA, 380 bp, Sorghum bicolor
  Clone ID: 6858026
acttgagtggtccaatgccaaaaacgtctgcaagaacgttcaacatagtcgggaatcctcttatctgtgctgcagaacaggactgtgacaggaccaagctgaaaccgatgttctatccctatatcactgttgaacaatagaagccccaagttgggagtcgcttaccttattaaggaggatatatacctgatgaagctcagtattaaggtctagcaacaacaccaaggttgaataagccatcgctgttctggcaaaatagcagtaaattaatcgaattatcaaaaattattaggcagacctgttgtatcttcttgccggctagtatgctgtaaacgaactctccacacttcgcataatgattattacgcagttctcctctt

SEQ ID NO: 27354 - DNA, 212 bp, Sorghum bicolor
  Clone ID: 6858037
ctatcccacccgcagggcattttggggtatcatttttccccacccagcgccgccgtttcatgaagatagcaaaaaaagggaggctgaccccaactcccccccgagaagaagagccggagtgatcaaggagaaagaagaagcagaagcaagtggattggggataagaatcctgtgtacattttcctaaaaaatcacccttttttttcggttgc

SEQ ID NO: 27355 - DNA, 192 bp, Sorghum bicolor
  Clone ID: 6858038
actggcagcccgggaggccccgattcacaaaaacggcggtgacttgcgactttgtggacaaacggcgacgggcgacgaaaattcccgcgcaaaggaaaaatttcgcccgaagggcgccaaaaaaaaaagatcccagacaaaaaaagttgggttccctattttgggaaatgccaagttaaaaaagccaaaccc

SEQ ID NO: 27356 - DNA, 465 bp, Sorghum bicolor
  Clone ID: 6858070
gccccaggaaaggatggcgccgaagagcaaagagaggttgacaaggtgcgagcagatcatcccggcgccaacatacgtcaggctgaagtcgaagaaaaacgtctgtttaaaagcttggagcccgaaagtagggaactgagcgaatccgcagttgtcgccggcagtgtagaaccactggaagaagctccagaggaagctgatcccgaagtacttgaggaacccacggacctggttttttgcattcttatctccttgaggcgtgtggaacccgtttatgagaaccgcagtggcagtcccacttggataagtgagtttgtagtcaatgacgagcacctttctgagtggaagcaaggtgaggagccccacgaagctgacggcgaggaggaatcccgtcatccagccgatggcgggctccttgtagctccccggcacgttgcccggcgtgttcaccccggagagcctagt

SEQ ID NO: 27357 - DNA, 149 bp, Sorghum bicolor
  Clone ID: 6858072
gcacattaactatgggggatacacggtctggagaacagggtattcgatggctggtggaggttacacgctaggtgccttggttcacgccttcttcatgtgggacttcagccagcgtggtgttcccgctttgagtgagtattgcgagaagc

SEQ ID NO: 27358 - DNA, 399 bp, Sorghum bicolor
  Clone ID: 6858085
ttcaccattgacgagcccgctggtttcgccgaccgcatccacaagcttgtccagctcggcctcaacattgaggaggatgattctgcccctgctgaggctgatgccgccgccgatgcccctgccgccgccactggtgacagcgccatggaggaggttgactaaatgaccacgcatgctaaacgggataccacaaaaagtcaatggagttgaagggtttcggtttttatgagcaacaaggtcttttttctgtcttctggtttttacgcgggcttctcggatttgagcagccgcttattctgccataattccccagtccttttgagaggaggacgaggtgtaactctagttagctctatgattacgagagagatgaagtagacgcgaaatggaaatggtata

SEQ ID NO: 27359 - DNA, 558 bp, Sorghum bicolor
  Clone ID: 6858087
tggtgagcgcatcaagcccgtcatcatcatcaacaaggtcgaccgtgctcttctcgagcttcaggtctccaaggaggatctgtaccagtccttctcccgaaccatcgagtccgtcaacgtcatcatttctacctaccttgacaagtctattggtgacatccaggtctaccccgacaagggtaccgttgccttcggttccggtctgcacggctgggctttcaccgtccgacagttcgctgtccgatacgccaagaagttcggtgttgacaagaacaagatgatggagcgtctctggggcgacaactacttcaaccccaagaccaagaagtggaccaagaacggcacctacgagggtaagcagctcgagcgtgccttcaaccagttcatcctcgaccccatcttcaagatcttctccgctgttatgaacttcaagaaggatgagatcgccactctcctcgagaagctcaacctgaagcttaccgccgaggaccgtgataaggagggcaagcagctccttaaggctgtcatgcgaactttccttcccgctgccgactctct

SEQ ID NO: 27360 - DNA, 149 bp, Sorghum bicolor
  Clone ID: 6858096
aaacttggcttttaatggagcacggcaaaaaaaaaattcagctcggcgtcgggaggatcattatcggagcgggtcatgtattttagccgcactatgaagactggaacgtagctactcccatcaaaggtcaatgtgaaaaaggaaattgg

SEQ ID NO: 27361 - DNA, 270 bp, Sorghum bicolor
  Clone ID: 6858109
gcagatgaagtggtctgataaaatgtgatatgctcagttaatgattgttccattcagcttatctctttgttgagtcaggatatgcttcgctctctcatgccaatgtttatcttccactggatactttgtgctttgctctctaatcttccactctcttgagccaatatttaacttccactggatattttgtgctttgcatcttcatcaagcataacaaatctctccttcccttccctactcggctactcccaatctatcattcactcaaac

SEQ ID NO: 27362 - DNA, 229 bp, Sorghum bicolor
  Clone ID: 6858112
ccaagtacaggggctccaagaccaacaagcctagccaaaggaaggctaaggccgcggaaaaggctccgtagattttgtttttgagacattggcatatgaactttttgaattcagcataaggagcacatgattgtccagtcccaacaaaagaagaaaaccaagcattagtattcgattatttgggaatcttcgggttgcgatatggttgtttaatcttatcaggggggcg

SEQ ID NO: 27363 - DNA, 417 bp, Sorghum bicolor
  Clone ID: 6858113
cgtaccggtaaggtcctcgaggccggccccaagttcatcaagtccggcgacgcttgcatcgtcaagctcatcccctcgaagccactgtgcgttgagtcctacaacgagtaccctcctctcggtcgcttcgccgtccgtgacatgcgtcagaccgtcgccgtcggtgtcatcaagtccgttgagaagaccgacaagtcgggtggcaaggtcaccaagtcggcggagaaggccgccaagaagaaataagcgcttcgaccgtgtgctttccttttcttcatctggttcacgttctcttgcgcatttttttatcttctttcttcatcatttctcccttctcttcccttgttgtactgccacgtctcttgtacgactgatccacctcaacggtgtcgggggcctacctcgacacacaaagta

SEQ ID NO: 27364 - DNA, 532 bp, Sorghum bicolor
  Clone ID: 6858126
tattggacttgtgctagcctggcatggcaagccgggcatccgcatcggagtttgggagccatttttacctgcgagtcttgatttcctcgtttgctctcgcggaatatcacccgcttctgttttactcttgttttttaatcggaactttctggccatcgtcaccgctcaaccctaatgcttgcttctcgccgttgaacggacagagacatgctttaatgcgggctttgcgagtgacgtgacagaccattgtgttttatctttacgtctgcggatggttgagcgaagcctggttttacgcgtgtcacgaatgtctccgaggcgtatgcctgaacgatgacttgattgaatgcgaagactgtataatggcgaatggacaggacagctgggaacggattaaaaaaagtttgccttccgatgaaaggaatgcaatgcgaaggattgtgcttggaagggaggaaaggagttgggtcagaacagagataaattatactatacactatagagctgccagaatgcaatgcaggtacagctc

SEQ ID NO: 27365 - DNA, 545 bp, Sorghum bicolor
  Clone ID: 6858141
cttggccacatgtgagatttctctagcaatgtcaattccgctggctcccaatcctacaattacaacactctgatcttgaaatggttctggagtgcgataattgtggctgtgcatttgcttcccctgccactcgttaattcctgtaacacacaacacaagcatcgctcggatcttgggcagcagaggcaccgagcaatggccgctgcagacgacgacggcgtcgaatgcctcctccgcgacaccgccgtcttccccgcgccacgccaccgcccactgctccccttgctgcccccgacagagcggccgcacccgcagcacctcggctccgagcctgacgtgcgcggcgacgccggaatccacggcgaaggcgtcgaggaaggcgagcacctcccggtggcccgggaacgtgcgcgggtcgccggcgaacacccgccccgccagcgggaagcccgagaagcccataagctcgcgcggcaggttggtgcgcagcgacgcgtagaggctgctgtgcacggcgccgggggcgcccgggtcgcgccccagag

SEQ ID NO: 27366 - DNA, 141 bp, Sorghum bicolor
  Clone ID: 6858143
aggcacagtttggttggcaggggttgttcggtgcacagcagcaggggttcaggtggaaaaaagatatggatcgggtcgacggggaatacattatgatttgaggcacatgcgtgcaataattggcaatgggctatgaatagg

SEQ ID NO: 27367 - DNA, 218 bp, Sorghum bicolor
  Clone ID: 6858147
tgagttgtactttccaatgctatcaacgttgattcgtggtccgggtcaaataatatgtggctgtaaaagtactcaactcaattgtttcccctaatgtgaatgatttatcccaaactcaaaaggtactagctagttaacataaacgaatgtgatggtgtaaagtttatattttggggcatgactcctgtatagtccccaatatcatgtttactctgtaa

SEQ ID NO: 27368 - DNA, 310 bp, Sorghum bicolor
  Clone ID: 6858150
agattttgagggcggggaaaccacatacttcctcccagctgcacgtgaaggaattttgaatgcataccccgttcgtccagtcatgggcggcgcagctattttccctcatggcgagatcaacgcgccattacatgaaggtaccggtgtgcgaaagggagccaaatacgtgatccgaaccgagatcgagtacgatgtcgaaccgacggaagaagtcaagatttgaacggagcgcaaggtcgggtacaaacaaattggatacatgaacggctggaccggggaaaagcattgttacgctatttacgcctaatga

SEQ ID NO: 27369 - DNA, 125 bp, Sorghum bicolor
  Clone ID: 6858173
ctttttttaatgttcgcccccattgaggtaacaaccctaatccctgtgggcccaatccctcatgaaaaactggcagcatcagttacgcgaacttgagtttacggggttaaaaaacccaaccgatt

SEQ ID NO: 27370 - DNA, 511 bp, Sorghum bicolor
  Clone ID: 6858182
ctcggcactaatgacttcggctacctggcatacgatgcgtcgggaacggcatacgatgcccgtccacctctgaatgctacaacatacacagacgctatggttagctttgtgcgaagcattcagactcattataaaaacgctcagttcttcttaatgacttctccgatgctgagtgactactatccgacaaccgaagacgctcagcatacgaccatgtccaatgctctgaaggacgctatttcgcagattggagagaatgcccatcttgttgactggccaactcaaggttctgaggttggctgcgattatcatccaaatgcagccacacacgcaaatgaagcggaagttctggcctcggctattagctcagtgctcgggtggtgaagtattgacactactttctgctttctgctttcaaggtaaatgggatccacgagtttacatgtacgtacaatcaaccgttacgggacaggcccagagatcgaaattaaagtaatcgacgtctctttcc

SEQ ID NO: 27371 - DNA, 145 bp, Sorghum bicolor
  Clone ID: 6858187
cacttgaaaggttcacttcaatgggcatgcaaagggtaagtttgagggcgaaaaagttccaacaaagaggactccgattcaggagtcttattacttgcttcacaagacaaaggatgagattttggggaaataggcttaagttctg

SEQ ID NO: 27372 - DNA, 259 bp, Sorghum bicolor
  Clone ID: 6858188
ggataagatggggtgggttgataatgcgctcaaggatccgtctattaagaaaacgtggagcaagttgaagatatgacacatcattgtgtggagttgcccttaatttggaagccgatggcgttttggcgtggttttatttttgatgcatgtcgttttgctcaacggacaacgaccggggtttatggcatttaagtcaagtacagtacataagttacagctcagaatgagttctctgttccttgtatcaattatcatgata

SEQ ID NO: 27373 - DNA, 550 bp, Sorghum bicolor
  Clone ID: 6858192
gggagatataaaattgctctgggtaagtactttgagaagcaaggaaagactgcagtctactttgagtgggtttcaccgcgctcccaccatgcaaacctgcaggttgttcctgtaccattgcctaaagcagacgctgttaataagatatttcatctagcagcaaaaaaagtgggatttgaattctctatggtgaatccagatggtgcaaaaacagctagagaatcattgatgtctcagtgcgaaagcaaatcaggcatgttttatgttgagctcctggaaggtagaattctcctgcacatgatcgacagtaatgagaagttccctgtgcagtttggacgcgaggtgttagcaggactgctaagcatggcggattgtgcagattggaggaactgcaagatttcaaagtaagaagagattaaaatggtggatgatttcaaacaaggtttccacgaatttgatcccgcagagtgaaaaccatgctgtgtgtcttttttttttctttttcttttttccttcgagtgttccttactgagaggtcacatttgtaagc

SEQ ID NO: 27374 - DNA, 139 bp, Sorghum bicolor
  Clone ID: 6858205
aagcaccagtgaaagcccagaataactaaatttatagcagcccaaaacgttattatcccatttgtttcaggtttggaaactgaactttttccaagcccaaaagaaaacaattttttcccctagggaaggggttttacaa

SEQ ID NO: 27375 - DNA, 236 bp, Sorghum bicolor
  Clone ID: 6858207
gtgtgtacggctcgttcaattgcattatgttcgatcatgctcatcctgagccgattccagcttatcgatttatgaaagatcgaatcagcttagatcgacgtcagaagacaacttatcacccaatctcattgaatggtagtgcaatcaatttgggtcaatcagctgagttatcgtacatgtctgctcgtggtatgcattctggttcagctcgtgatcaaaattgtgtggcgactgtg

SEQ ID NO: 27376 - DNA, 447 bp, Sorghum bicolor
  unsure (1)..(447): unsure at all n locations
  Clone ID: 6858230
gcacgaggcttgaacagctgaacccaatcctaagagcaactactagccgcattccccatggccgccgccgccgccgccatctctttgctccgttctccccctctacttcaacccacgcgtcgccgaccagcgccaccagcctgcacgcactccgagcgcggcgtctccttcgaccccggctccgccttctaccgcagcgacagcgccgcaggccgcgacctcgccgtcctcgcggccacgctcaaccgccgccgtggccgcgctgacccttccgccccatttctctgcctcgatgcgatgtgcggctgcggcgtccgcgcgctccgctacctcgcgcaggccggcgccgacttcgtctgggccaacgatgcctccgaggcgcttcgccccgtcatcctcgccaacctctctcgctntgagtggggctcgccggcagcggaggcgggg

SEQ ID NO: 27377 - DNA, 488 bp, Sorghum bicolor
  Clone ID: 6858234
gcacgaggatccttcctccccactctccaactcctgcaccaacaaccaagacctatccccaaatccaggtcgatggaggtggcggcggcatggtgccacaggcagcccaacgacggcgagagaaaggagacagcagcaactgctgctccatagactacgtcgctacagaccatgacttcctcaactcctgctacaccctcgctcatggctgccactaggtgtgctaaccccttctcttccctttcctgttgtgcaaaaccgagcacccaaccctaacttaatttgtttggctatttgtattctgatctgatctaattatagtatacatatattgtgcctgctaacttcgatccattcaaaagattatcatgtgtatatgtgcacacccatgtttactggatctgctcctgcagttctatgtgctttgcactgaacgttcctagcccttctgctcttcatcctccccatcttggactgatgttgaaatt

SEQ ID NO: 27378 - DNA, 429 bp, Sorghum bicolor
  Clone ID: 6858238
gcacgaggtgatatttgagcacctctcggcgtacaacaatccagaggaacagaaatttgttcttggtgttatcttaatggtcccttgctacgctattgaatcatatgtttcattggtaaatccagacactagtgtctattgtggcatcttgcgtgatgcctatgaagcatttgctatgtattgctttggaagatatataactgcttgtttaggtggtgaggataggacaatcgcatttttgaagagggagggtggcgaagattccggggaacctctgctgcatcatatctctgaaaagggagtcattcatcatcattttcctattaattacatattgaaaccatggagactcggtgtgcggttttaccagattatcaaatttggttattataaagacactcacagctagcctgtctcttattcttcaac

SEQ ID NO: 27379 - DNA, 572 bp, Sorghum bicolor
  Clone ID: 6858242
gcacgaggaaggctacttagcagtgtgtgttcaaaacttggggtgcttcaatcttctcatgcttgcgaagtccaagagctaatcgatactttgagagaatacctgtgtgataagaggtacctcattgtacttgatgatttgtgggaagtgaaacattgggatatcattagttgtgcttttccaaagaatagtcaacaaagcaggcttattgtgactacaagaattgaaggtgtggctcaggcatgttgcaaggaccatgggcgcattcattatatgaaaccactaagtgacgcggactcaagaaagttattctttagaaggatttttggcactgaagatacttgccctcctcagttcacagaagtttcatctgaaattctaaagaagtgcggtggtttgccacttgcaattgtcactatggctagctctttagcagaccaacccaaagagcactgggactacatacaacgttctatagtcactgaatctgcagcaaactccttggctgacatgatgcagatcttagacctgagctataagcaccttcctcatcatctaagagcatgcttttt

SEQ ID NO: 27380 - DNA, 465 bp, Sorghum bicolor
  Clone ID: 6858250
gcacgaggccggcacctcgacaccgcccgccgccgcgccagtgagctcagctgccagctcgatcgcccgccagcggacaccgtcgaggatccagaaaactccatgggtatcccgtcgaggcacccggaccacgaggaggaggaggagtacgacgatgccttgttctacgaggacatccaggcgcccaagttcgtcgacctcaccgcgcccgacgccggccgccccgacgacgaccccgcctggttctgcatccgagtcggttgcgaccagaaccatgagcaggtcgatccggaggccctggacaggagcttctttatgcgggtcatggcggcgagaagccccaacgtgcggctacagaaggctatcagcaggaagaaccagagctcgatgatgaaatgcccgcaatctgcgccgccgaagcctccgagggctcggttcgcgaggctgagcgcggacacggaggct

SEQ ID NO: 27381 - DNA, 425 bp, Sorghum bicolor
  Clone ID: 6858263
gcacgagggctgcaggtgaggtgacaccatgcatttcccctacttcttctccatggtaaataaatggtctaagttgaaacgaaaaatgtaacttcactttttatctagtgccattaattaagtaatcctaatgtatcattgggtttgatggaactttcccttctccaagatatttgtctgcacaagcacaaaaaacctgcttctctgctaaaatagccacgacacatccatgcatgatctcctcttaaatctactcgatcgatcgttttccacaaaggcttgcatgtagataataacacaagggctagctagcttgtgcttcttcatcctgctaggtcagcttcatcggtggccatttaattaatttggcgagatgggtatggtcacttccatatgtatggagccgatcaagcgccgacgagtgg

SEQ ID NO: 27382 - DNA, 506 bp, Sorghum bicolor
  Clone ID: 6858267
gcacgaggcttcacttcaatcacggtcgtcgccctccgcccgtgagttgacttgaattgatctcgaatatccatatccatatccacgctttcgagtcgacccgtgacccttgaactcgggcgtctcacattgagggcttcattctcacatcgaattctccaaaaccgttcctttacgcgcgcacatacgcgctccgataaccgacaccatggctactccttccgcaatccccctcaacgcccggcgcgacaccatcgctcgcctccaccgtgtcaccagaggaaaccgcagcctctggtatcagatgacggttctgcaacaaccagagcgtgcccgtgcttgcggttctggaatgaaggccaacagcgaccgacgacctgttgatcctcctcccgttgtcgagctccgaatcattgagggccccacagttgaggagggcaaggatatcactttcgactacaacgccaacttcttcctctacgccagtctcgagcatgcccgtccga

SEQ ID NO: 27383 - DNA, 449 bp, Sorghum bicolor
  Clone ID: 6858284
gcacgaggctttgtctcacccattgatgcacttgaacccccactgagctgcctcactacactgcacctcacctcaccattccataccatacctcgctacactacaccttactgcactgcacctgactgtctccaacactcgtctttggtccctggcttggcccctctggtttccctacatgacttcacaacgatcaagttcgatggagacgtcacaagataacatccgcaagcgggtgtgtaaggcatgcgacagatgtcgtcttaaaaagtcaaagtgtgacggcgctagcccatgtagtcgatgcaaagcagataatgccatttgcgtttttggagagaggaagaagtcgcaggacaaggtatatcccaagggctacgtggaaatgcttgaacagcaacaatcacagctggtagcgggactccgtgagctttacaccagactacgac

SEQ ID NO: 27384 - DNA, 490 bp, Sorghum bicolor
  Clone ID: 6858297
cctgaacctcactcacatatccattgtcttcctcgatcaagacttcatacccaaaaatgttccctcgcgctgctctcctcgctctctccaccctcgcggtggtctctgctcagcaagtcggcaccaacaccgctgagtcgcaccccaagctccaggttgcccagtgcaccaagtctggtggttgcaccaccgccacccagtccgtcaccctcgacgccaactggcgctggctccactccgctgcctctggcagctacaccaactgctacactggtaacacctgagacccgacgctctgccctgccagcagccctaccacctgtgcccaaaactgtgctctcgatggcgctgactaccctggcacttacggtatctcgtcgtccggcaacgctctgaccctcaagttcgtgactaacaacgccaacggcaagaacgtcggctcgcgtacctaccttatggactcgtccgacagcaaataccagatgttcaa

SEQ ID NO: 27385 - DNA, 485 bp, Sorghum bicolor
  Clone ID: 6858302
tggcacgagggaaaattgaaaactgagaagcgtataattttatctggaactccttttcagaacaattttcttgagctttacaacattctttgtctggtaaggcctaggtttggtgaaatgtttttgacgaaaggaagagtgggtcgaaggcactatgtctcaaagaagcaaaaagataagttttctgataaatatgaaaaaggagtttgggcttcactaactagcaatgtaactgatgataatgcagagaaagtgagatcaatattgaaaccatttgttcatatacataatggtaatattcttcgaactcttccagggctcagagagagtgtgattattctgaagcctcttccccttcaaaagagtattattagaaaggtggaaaacattggttctggtaacaactttgaacatgaatatgtcatttctttagcttctacacacccttcccttgtaaccgccattaacatgtctgaggaggaagc

SEQ ID NO: 27386 - DNA, 532 bp, Sorghum bicolor
  Clone ID: 6858314
gcacgaggctccatctgaaatccaacgcctttttctggattaacttccttttttctttccttttttataccaacgtctttgtttgttgtgatacccaatctcatttgatacccccaaaaatctttcaaaatggccgaggaacagaagaacatcgaggtccctcaggagaccaagcctgagatcgttgcccctgccgctggcatctctgcccctgctgttgaggctcccgtcgagacaaagcctgtcgaagagactcccgttgtcgccgccgaaaccgctcccgcgacagaggagaagcccgccgaggagacaaagcctgccgaggaggttgctaaggctgaggagaagaaggaggaggaggttaagcccgttgaggagggtcacttgaaccacaaggctcaaggcctgagctttcccaaaaacctcatccccagcaaggagttctttttcttcggcaccgaggctgtcgagcccaaggctctgtccaactacctgaagagcgagaagtccactgagactgctcactctaata

SEQ ID NO: 27387 - DNA, 324 bp, Sorghum bicolor
  Clone ID: 6858324
gcacgaggggcactcctcttatctcgccgcgccgccaccgctccatttccgctctcccccaaaacctcgaaaccctactcgcgggattccgcggggccgccgcttgcttagggttcatccaccccgcggcgtcagctccgggtccgcatccatggccgtggaggaggcgagcagcagcggcggtggcggcgaggaggggtgcggggcgtggacccgcgagcaggagaaggcgttcgagaacgcggtggcgacgacgatgggcggcgaggaggacggggacgcgaggtgggagaagctagcggaggccgtcgaggggaagacgcc

SEQ ID NO: 27388 - DNA, 424 bp, Sorghum bicolor
  Clone ID: 6858325
gcacgagggagttatagctttacattacacacgtggttaatcttcagttgcacaataatgcacgttaacaagggcatgccaaccatgcccgccggcgtctcggttgccgccgccggatgctgtcccaccgctacgccggcgaacgaggtcgtcgaggacatcttcggcctcgtgcgcgtcctaagcgatggcaccgtcgtccggtcgccggccggcccggtgttctgcccgaccaccttccctgagaaccacccgtccgtggaatggaaggaggccgtctacggcaaggccaacaacctcctcgtccgcatgtacaagccgtcagcgtcgcccgccggcgggaagaaggcgccggtgctcgtccacttccacggcggcgggttctgcatcgggtcgtgcacgtggggcaacgtgcacgcgttct

SEQ ID NO: 27389 - DNA, 408 bp, Sorghum bicolor
  Clone ID: 6858330
gcacgaggattatctccaaggttacatatgcaaaatcaattatctcctagacctacctcgcaactttctcctagacctccacatatgcaacctcaagctcccccatcccctctccctctccagccttatcaacagcttatcgctgaaataatgaagttacatgtcacccagaaagaacaactggagaagatgaaattgatccagaaacaagtaatgatgcacccccagaaagacacctttgccatgttggacaacgagcaaaacagcttaaagaaacagattgacgctgagctcacttcattgcaacagattgatagctcttacctcttgtcccccaccgagattcgccatgtaatttatttgatccatgaattgactattcagagcatccagctcgagttgttccat

SEQ ID NO: 27390 - DNA, 431 bp, Sorghum bicolor
  Clone ID: 6858332
gcacgaggcaaatgcgaagttaaggttggtccttaaaattgctgtttctgagggtgcccgggctgcccttcttagtatatctccagttgttttatctgatgatctatctgtgctgcatgaggaatgcatggatatagttatgaatgctgctaggatttcaaagcaagaagaatatcaggaaacagtgctggaggcacataagttgatagttctgggtaactggtctgatgagctgtttgaagcattgactaatactctgcaatctaaagcctctgattttgctaatatctatggagttgaacctcctccatgccctgttgcatcttcaaggaggaagaaaggcaaggcacttaagataataccgctacgtgacactgttgttggaaaggggtcatccaaatcaaaagtcagtaatgaagagcttgctgctg

SEQ ID NO: 27391 - DNA, 499 bp, Sorghum bicolor
  Clone ID: 6858334
gcacgaggcgatgcagggagcatccaacgtgcaggacttcgtgccggtgctcgcgctgctggacatcggcggcgtgaacaagcgcgcgataaggctgtccaaggcgcggaacgagtgggcgcagcggcttatcgacgagcaccgggcggccgccgcggcggggacggagctggggaagacgatggtcggcgacttgctggagatgcaggcatctgaccctgaggcgtacagcgacaaggtcatcagagcgctatgcttgtccatcttgcaaaccggaactgataccacgtcggccaccatcgagtggggcatggcgcagctactgaatcatccagccgccatggccaaggcccaagccgagatcgacgaggtcgtcggcacagcgcgcatcctggaggaagccgacctgccgaaccttccgtacctcatgtgcatcgtcacggaaaccctgcgcctccaccccgtcgcgccgctcctagcaccgcacgagtcggcctcc

SEQ ID NO: 27392 - DNA, 401 bp, Sorghum bicolor
  Clone ID: 6858338
gcacgagggcgggcggacggcgcggagggaggaaatcagccagcggcccacacacacacggccgcaacccgcaatcgccccccacggccccaccacctcacctatcctcttctccccaagaataggcgagcgagcgagcggctggtcgtcgaatctaggagcccccgacctgcgcgtccgtccgtcctccctaaatccggccacgcccgccggtgaggagaggaggaggcgacgattgattgatcagtcactcccgaatggaagattgatcagtccctgtccaagtttctcgggggttgccttccccttgcttccccccctcgttgttgcttagtccggctcgatctgggtcggttccagaagctcgcttgacggctgttcgtccgtcgccggaaccgcca

SEQ ID NO: 27393 - DNA, 444 bp, Sorghum bicolor
  Clone ID: 6858353
tttggctggtagtgaaagagctgcggctactgagaatcgtggaataagaatgttggaaggagcgaatatcaacagaagtttgttggcattggggaattgtattaacgtgctgagtgattcgtcaaagaaaggagcatttgtaccatatagagattcgaaattgacacgtttattgaaggattctttgggaggaaacacgaagacgattatgatagcatgtatttctccaagttttctctgttatgaagagactgttaatacgttgaaatatgcgacaagagcgaagaatatcaagagaaagctgacgagaaatgtgaaggaggtggagttgcatgtgtcacaatataaagagattattgagaatttgaagagcgaagtggagtctttgaagaaacaattgaaagcaaaaggacatcatagtcagtctcaggacaatcttgacgg

SEQ ID NO: 27394 - DNA, 441 bp, Sorghum bicolor
  Clone ID: 6858369
gcacgaggggacatcttgcagttcctcctcccaaagcctttcagacttgaacctgctgcttgcacctgtgcatacctcgctcaagctcgtccactcgactacctattcacttacacgggaccgcctctaccgccgtcctcaacaacaacaccacaactctcaagcttcacagctttctacatcctcacaatgcctgcccagcgaccttctcaccttcctccctgcccgggcccccctcccagccgacctcttcctcctctgcctaaatgagtgccgcttctctgaggaccatcattcgacttcagaataagaatggctacactgtcatgggctatccggaactccacacacatatatacaaggttttcaacttttctttttatattttgagatgcggaaccccaatggcctctactccccttcttcgtgggggacgtgacg

SEQ ID NO: 27395 - DNA, 390 bp, Sorghum bicolor
  Clone ID: 6858373
gcacgaggagatgaggtaaactgcgaactctcaaaaagcagcaacatgtgctactgaaatattgaggacattgatgtgattgattgttttgcttatttgctttaactgaacccccccccccccgcccccaaattgctgaccaatgaaggtgacataaaaaactggttctctgcaagtttctcaaaattgagctagttaacactaaattttctcgaaccaatctaggaaggggcactggatgagaattttttgttgcaacttttgcatatattccagagttgctgagagaactaagatgacaccaggcatctcagttagctgaaagcatcatcatcacctaaacctaaacgtgcaacagaatatcagagttgctgagtgaactaagatgac

SEQ ID NO: 27396 - DNA, 446 bp, Sorghum bicolor
  Clone ID: 6858397
gcacgaggcggaaggcgtacggcgagtcgtggttccccgccacggtgagggtcgtcgtcgacgacctcagctacgtcgtcgagtacttcgatctggaggaggagggggaaggcgggccggagaaggctaccgagtacctgcattggcgtttcatcaggccggctgtcgagcattcgccaagggagagcgagttccagctccggcccggcgctgccgtggaggcctactgtgatggggcatggtcaccgggagtggtgcgccgggtccttggggagggtgagtatgagatcggtattgttgttgctaagaagtcggaaatgctggtgaccaaggtggtgccattgctcaagccgcagtataagtggaatggcaagcaatggaggattgcgacccctaagaggcaggctaactcgaggcggcggtctgtttctggtaaaagtccaagg

SEQ ID NO: 27397 - DNA, 458 bp, Sorghum bicolor
  Clone ID: 6858402
gcacgagggttgagctcaacctggagcagacagtagatgcggagatggacaggtggctggagaagactacgacttccttgcagagagtgtcctgaccaagaaaccgcggtggccaaagactggagagtgaaggggtggtagcgattcatggagaatgggggcagaggaagacttggaatgcagcgacagcgatggcggacagtgcgtgttcagtatgatttgaaatttggggcagcggagaattgctttggggataggaaaggacaggttgttttttcaattaccatggggccaatgcacgcgagacaaggccccaaattttcattctcctgctgaaaggctgccgttgcctgaacttttccggctgccatcgcctaaacgtcctgctactcgcttaagtcacccgcacaaaactgagttactaccgaaccgtgtcgactgtgtatgaccgtttttgc

SEQ ID NO: 27398 - DNA, 460 bp, Sorghum bicolor
  Clone ID: 6858415
tgcttcatcctgaagctttgtgctgatcctgagacgctgagagcacgcagtgaggggcttgcggagatcatccggcatgtcctctttgggtacttcagccagaagactgggcttcttgttcatcttgaggactcacacctcacccgaatccagtcaacaaccggcggagatgcagtttactgggagactaccatcaattcattcatcgaggactaccgtccggtggagggtattatgattgcacattctgggcgctcagctgtgaccctcttccggttcggggaggcggccatgagccacaccaagacccgaatggaggaggcatggagcatcgaggaggtcgcgttcaatgtccctggcctctccatggattgtttcatcccgcccactgatatcaagtctggatctatcagtgagaccgttgagcttccacagggtgagaagagcaaggtcggtcttc

SEQ ID NO: 27399 - DNA, 475 bp, Sorghum bicolor
  Clone ID: 6858431
gcacgaggagaggcagagagaatctatagccgactgtcagcttttcatgagcgtctccagttcaacccgactacactccctcacaatcttcgcatatgtccaccatggcgggatatttcagtcaaattgatatagacagagagttctctatagattacctcaggcacctagtgaacaatcctgagtgggaaatcccagacaactcaggaagttattcttcctctggttcttacttccaagaggtccagaaccaccctcattatccttcccaagatctcgattatatgggatctcctgtttctaccaactatgagctcaatgccggataccagtcccaagcttacaccaacaacccttcagccatcactcccaggcctcagctttagtctgggattcatgcaagtagttctgagccggatcaccaatacagtgaaccggccgacctacaagcgggactgtcgatggatagcagcgg

SEQ ID NO: 27400 - DNA, 529 bp, Sorghum bicolor
  unsure (1)..(529): unsure at all n locations
  Clone ID: 6858435
gcacgagggtttgagagcacacgggtgttttagctagtatataagaaaatgggagtgtcttcagtgtctcttctcgtcatcagaagtgactgtttatccaacgccaacttgtattctattacgacgacatagcaagcagcgaacatcagcagtcaatactgacatcaagttcccataattttcacaccggggcacatagtggcaaagccaagcaggccccccaaagacgagaatcatctcctatcatggcggcaacactgacagtcgaacaaacgaagatcgtaaaatccacggtaccagtgctcgcccagcatggagaaagcatcaccgcanaattctaccatgacatgctcgaagacaagcctgagctcaaaaacgtcttcaacagcacacaccaagcaaccggtcatcaagcacgcgccctcgccggtgctctgtatgcatacgctgccaaccttgacgatctcggtaaattagcacctgcagtggaattgatctgccacaaacacgcaagcttgggtatcacagc

SEQ ID NO: 27401 - DNA, 496 bp, Sorghum bicolor
  Clone ID: 6858448
gcacgaggctcaactctcctcttgagcgaactcatcatcaccgcgtgtcccggagactatacgctatagatggtttgtgacaacgctgactactaaccttgcaaacactcccagtttcccatcacagatcagaacaggacagaacagaatacgcttttcaaaatgtcgtacttcagctctcagttctcttcctctcccgtcctcaccatgtctccccaacatgcccaccagtctatgggtatggcaagcttcggacaccacacaccaccccgatttgcacctatgccaagccagtttgctgctcagcctgttcgaccttctgcagctggtagaaagcgttcccgggacgaggcctctgaaaaccttgagcctgacatgaagtccctgcccgttgaagagcccgaagaggaatggatctacggtcccggcatgaccctcatcaagaagagcactcgctacgtcacagacgccagcagtcaatccggcacctgggttg

SEQ ID NO: 27402 - DNA, 431 bp, Sorghum bicolor
  Clone ID: 6858453
gcacgaggaacggtcgacattctccctgtcctctcatcaccggcaactgtcactcaggtcaaatcgtcatcgtggtctctgcttccaatttcggccccatcataactcttttgcggcatcggcatcggcatcgcaagctttctcgtctctgcgccattgtcagatatttctatttccgactggaacgcctcttgacactctatctcgactgttactattctgtaaatatctctcgtcaccttcgcttggtgtcaactttctccgcttttggtgctgcttccacgacaagttccatcttgtgcagccttgactggcgcaattcacgactcgcccggctgatgaaataaactaacttgtaattgcctctatttgatcaacacccgccgcaacccggctatgatgagttcgacggcatggaacgggcaggacca

SEQ ID NO: 27403 - DNA, 378 bp, Sorghum bicolor
  Clone ID: 6858526
gcacgaggaacgtcaagcactagcaaggctgtttatatcagatgagcacgggaaccaatcggcatccctaagtaaggattgtctcgatctctctgaggaagatatattccccttttccgtatttgaaacaagttttttccaatctctgtacaagaacatcgattctcactctcctatgatgtcctgttccgactgctttcgtgggggggtgtcagaaaaccatcccaagggtaaggaggttacgatgaatggcgtcagaacttatgttgctgagcccgaagctggagttacgcctatggggatcattgtcgtcatcaccgatgcatttggctggaacttcgtgaacaatcgagtcttgtccgacaattatgccaaaag

SEQ ID NO: 27404 - DNA, 425 bp, Sorghum bicolor
  Clone ID: 6858527
gcacgaggatccgccagctctgcgtcgagggcaagcgcgtgctcctctcccagcccaacctcctccgaatccacgcccccgtcaagatctgcggtgatatccacggccagtttgttgaccttctgaggttgttcgatttgggcggttatcctccagcttcgacttacgtattcctcggagactatgtcgatagaggcaaacagagcttggaaactatatgcttgctgctggcatacaaaatccggtaccccgagaagattttcctgttgagggggaaccatgaggatgccaagatcaacagagtctacggtttctatgacgaatgtaagaggaggttcaatgttcggctgtggaagatattctccgattgcttcaactgccttcctattgcagcgctcattgatgacaaaatactgtgcatgcat

SEQ ID NO: 27405 - DNA, 187 bp, Sorghum bicolor
  Clone ID: 6858532
gcacgaggagattattgtgtatactgtatagtatatatagaggtatactatatagtaggtgtatatataggtgtactatatagattattgtgaatgcttgctttattgtgtatactatatagtgtgtcctgatatacatggacgatcacggtcgattaattggcctggtcggccccatggtgaccag

SEQ ID NO: 27406 - DNA, 405 bp, Sorghum bicolor
  unsure (1)..(405): unsure at all n locations
  Clone ID: 6858533
gcacgaggagctccagcttagtcactacaatgagttacggatacggtggccaaaatccatacgactcccctgaccagggctatggtggtaacaatggctacggtaatggcggtggctacaacagcccacccgctcagggttatggaggtagcgttgagatggctccccttgcccacaacgccggcggctttggccaaggcgaccccaacgccattctcaatgagtgccgcgacatcgaccgtggaatcgacactgttgagcagaacttggaacagctccgcatgatccaacagcgaactcttgacgacgccnatagctcaggttccagtgccgccagccgccagctcgactcgctttccacggataccatctctctctaccgcgagcttaccgagcgagtccgca

SEQ ID NO: 27407 - DNA, 435 bp, Sorghum bicolor
  Clone ID: 6858549
gcacgagggcagctcacgctttcacattccaactatatcgtcatggatccccgacttgctacgaaggaccagacggctatattctgcgctttgaacagagtcagcccggatggaaagacaggacactactatttcattcttctttgggtggaccaggatgctcctaaagatgcaagcaagaagcgttggactgagctggcgtcgcaagaagagttggccgcatttgcacgagaaaggactagaggctaccctgaaaaccttcgcaaattggtcgaccaaatccccacagagagatataatacacctgggtttcaacttcaaggtgtagaattagagccagaacagctcccagctggacgtgtgttgctgattggcgacgcagcgcactccatggccccattccgtgcgcttgccgcaaacacggctttcgttgat

SEQ ID NO: 27408 - DNA, 539 bp, Sorghum bicolor
  Clone ID: 6858557
gcacgaggcagcactccgctctgatctcccaccattgatccactcattccgggcccccttgaaatggtttgatgcctgcagccatgcccagtttctccagacgccgcttgctctgcctcttcttggtcgcatgcctcgccgctcttctcttctcgatcgccgaccgcgccgggaggaccaaggaaactgataatggcgaagcgaggttcagagtgctgcgtggtcttgacactctcggcctgaggcagaagcagcagcgtcacgctcacggccatggaatctctccggccccggctccggcgcgtgcccgcctacctctgctccacaaggacgcgcggctaccggtccccggaaaagtcgcccacaacgacaaccatacgagaggaggaaatgccacggcagcgaggcagagcccgccgcgcggcgggggaggcgaacaaggaagcaagaagaaaagcacgccgctggtggtcgtcgccgcggcggccgctctgtcgggggcggcgctagtgctcctcgcagtcctggtggtgttcctg

SEQ ID NO: 27409 - DNA, 517 bp, Sorghum bicolor
  Clone ID: 6858576
aatattacaatagccaaatccaaaaactttttgaactaaacaaggcctttggaagatgtaccgaatggccaatgatttcacaatatgatagatgactggtcacgatgccaatgtgtgtgtgccgctttaatgacctagactttctctctgccgtgatggaccaaagaagcttgcagagaatttaaaattatcggttaggatatgctgatgtatgtaacaagtacagttggcttattcgctctgaataggcaagtaaatttgacttattactcaattgttttctctattcaattgcattttgaatttcaatgtatgggtaattatgatttcaaatttatttgttacatacatcaggatatcataaccgatacttttaatagtacaactgtattctctatatagtttttatcaccaaaataagcagggtatatatatcaaaatgaggatgaattcccttttgtcctttgcggatcctttagatatagaaagagcagctaggagaatcacctctttgccc

SEQ ID NO: 27410 - DNA, 463 bp, Sorghum bicolor
  Clone ID: 6858582
ctgaattggcacctgaatcggactgaaccggctgtttgtcattgtcaggctactgttcttctattctttcgaatccatgaagtaagacattgattttgcaacaaggtcaattatgttcattgcataataagttcccttgaaaagcattggcgcacgtgtaaacgagttgctctaccgaactgagctatagcccttgtcagagatatcttaacatatagataatttcttgtcaagatgaatattctctaatgccagaggatatccctttcatccgtttactatataacataaacataccaataacggaataacataacataaacataccaataatggagcggtattgcttataaaaaggattcaatctataatcgatcgaagtaatggggcttcttttgtggtgataaattgcctacttaactcagtggttagagtattgctttcatacggcgggagtcattgg

SEQ ID NO: 27411 - DNA, 502 bp, Sorghum bicolor
  Clone ID: 6858592
gcacgagggcccaaaaaaatggaccattccagggctcggttatgacacacgtggtaacaacaaagttttgttccgaacaaccaatgatatgtacagtctggatgaaatacccataaaaagtaagagaattgctgatacagttgaagccttgactggggcctacctcagtgcttgtggtgaactggcagcagttcatttcatcaaatcactaggaatggatgtagaactgcatagtaaaatgcaagttgaaaggattgtttcaacaaaatctgaggagttcattgacgtggaaagcttgcagacaatcatcggttatgtgtttgatgacagttcactgttaatagaagcattgacacatagttcctacaatactgctggtattacaacttgcaatgagaggcttgaatttcttggagatgctgtattggactacatcttaactgattacttttacagaaagtactaccccaagtgtacaccagcactattgacaaatctacga

SEQ ID NO: 27412 - DNA, 263 bp, Sorghum bicolor
  Clone ID: 6858605
cctcatgagctaaagttgctaaagcagaggaaagaaaattcaataaagcagattcaaatgtgggagcaaagagatttaggggcttagataacgagttttgatccatttgccttttttctttcaatcacaggcacacataaggcctaatttggaatgaagggggaggcaaaccccagggatggaaagcccaccatggagaaatggattattcaaatgacatccccatggattgctccaccctgggaaaagtcagagatttccca

SEQ ID NO: 27413 - DNA, 144 bp, Sorghum bicolor
  Clone ID: 6858608
tgtggatgacactgttgatgctaaaaggcctagcaaaactccccctcataatgttgatagaagctttgatgcgattagatcaattaataaatatttaactgagaaagcccttgctgaattagtattgccatgcattgacagaag

SEQ ID NO: 27414 - DNA, 193 bp, Sorghum bicolor
  Clone ID: 6858616
ggagatcaaaaacggccccctccccatgttttccatgttgggtttttttgtgcaggctattgtccccggcaagggtccccttaaaaaccttgccgacccccttgccgaccctgttaaaaaaaacgcttgggggtacgcccccaattttttccccggcaagtaaacaagggcatgcttgtcccgtaaacaaagg

SEQ ID NO: 27415 - DNA, 265 bp, Sorghum bicolor
  Clone ID: 6858620
gattgctcggttggtcatgagccatactccagcttggatattgactgatgcttaaggtgtatgacccatgctatgcttttcatgcctaggaaaagttgtggcagctcgcaacatttttttttttttttttttggcctcagtttttttgggtatgtgtaaaaatcagtgttatgtggaattttgttagcccagaatttcacccttgtatttgagtgccagtacataaaatgatgtcatagattgtagtgcagtgtttcagctatcc

SEQ ID NO: 27416 - DNA, 350 bp, Sorghum bicolor
  Clone ID: 6858623
ttatctcgacatctcctattttgtatgttgattttatgtttcgggacatagcatgaagcaataattttgttctctcctactaaactgctttattttaattttgcttgtcatcctatttgactacttgtaaagttggagctctcttggcatttgcattcaagctaactttatgttgccatcatacacacatgcagttatgcacgctatcaggtttagtgttatggtttgttacaaaataaatgtttcagattgtgttgtctatgactgacttgcgttttcccaaatgttttcctagacatgcacaggaggaccccccggcaggcttcattttctttattattgtctataca

SEQ ID NO: 27417 - DNA, 427 bp, Sorghum bicolor
  Clone ID: 6858629
gcacgaggtgcctttggtccatgaaatgctcaatccaccagagatggctcctcaacaaggtcaggattctaaagagacaagtgatggaagctgtgctgatggtgctatttctctggaagaggttttgcaggaacctttgtcgaatattagtgtggagaatataggtagacttgaagggcagaatgcaactgatgatagcatcaatgttgatgacttgttatcagcataccccaggaaagataatggctatgtaggccaggataacactatgaatgggagtggtccagcagatggtgatcacacaagctggcctttgagagcatatagtaatcagaactatgtcaatggccctcttgctgatgagttctttgacacagggaatgataccaatggggttgcatattctgggcagcagcaagctgatggc

SEQ ID NO: 27418 - DNA, 429 bp, Sorghum bicolor
  Clone ID: 6858644
gcacgagggaagtcaaatgatgagctcaaaatcatggaatggcgttacaaccaatttctcggcgagaagttaacttacgaacaaataaagagcgacccagataacgagagtttcctagtcaccaatacaaaattttctaaagatgggaagcattgcgtggtcagtgacaaaggaggaagagttatacttttcaaaaagtctgactcaaacaatagatcagtgaagctcgattacttctacgaatttgcggcccaggaaaaagaatttgatgttcataagagtattgaatacagtgaagaaataaaaggtctttcgatccttccaaatttatcccataataagttagacctccttacagcaagtagcagaacaatcaagcttgatcgtgtctataaagataaaataaaatgcttcgagaatacccacaac

SEQ ID NO: 27419 - DNA, 353 bp, Sorghum bicolor
  Clone ID: 6858658
gcacgaggcagcaaacagctaaagactgttgcacaaaccacgccctctcgggacaccctgggatcgaatagaacatattgcggactgtcctttccagtgtaacacaacttcagaatactctgctcttactatcctactctgtgagaaactctcccctctacttatcttttcaatttccctcaagatatttcattagagaccagctgaggtctatgtatgaatactccgtaaacggcacgcgccacttttccgctgcagcattgaacttcctagaacagtatactactagcttcacactctgctcggtaacatttggaggggtggattacaccaacccaccaagacgagaccaa

SEQ ID NO: 27420 - DNA, 322 bp, Sorghum bicolor
  Clone ID: 6858661
gcacgaggaatgaatgcctgcagtgcattttccttaacgacgacagcgctcgctgcattttgggcggatgtgagacattgacctcaagacgcgagctgagctcgccttacccgcctcaacccagccgggccaaccctccctgtcagcattgagtgccagggacgatctttcagctggccgtgtctcagtcgaaatgcgcccacgggtgacgtgacgagacgaggcgtgtggtctcgatcgacgcggcgctattccgcgttgtaaatgatggacaacttcacccaaattctctgaccgatgcttgacgcacggggagcagcgc

SEQ ID NO: 27421 - DNA, 358 bp, Sorghum bicolor
  Clone ID: 6858664
gcacgaggcttcatcaagcatctacgagagatgggcgatgaggtattggtggtgactacacacaagggagctcctgaggagttccatggagcaaaggtcattggctcgtggagttttccatgtcctctgtaccaaaatgttccactctcgctggcattgagccccagaatattttctgaggtgaataaattcaagccggacataatccatgcgacctcacctggaattatggttctcggcgctctggctatggcaaagatgatatcagttccaatggtgatgtcttatcacacacatcttccagcgtacataccaagatataatttaaattggttacttgagcccacgtggagtttta

SEQ ID NO: 27422 - DNA, 426 bp, Sorghum bicolor
  Clone ID: 6858673
cgcaggtgcacgccatggaagagctccgtcgttagcttcgcctttcttcttctgcctttttgcctaccatctccgtccctctgcgtccttgtctctcttgcgtggctgctcctacgactgccaccacatcacccgcctacgcctcgtcatgatggatgcaggcagcctccagccaggccttggggcgagcgacttctcgtctggtggcaccggagcccgcttagaacgtgccatcatcatcgttgcgggtgtctgcgctctcgtagcaagtctggtcacttttgttgctgtctggttacaaacgaagaactaccgaaagccagtgctacagagatatgtcgtccgtatactgctcatggttccgatctactcaggcgcatcatgggccagcttggtctccaccacggcagcgtcctacgtagagcc

SEQ ID NO: 27423 - DNA, 397 bp, Sorghum bicolor
  Clone ID: 6858677
cctgcaggaggccgaggagcaggagcaggccgagagcggcggcgaccagctcggcaacgtgtttggccagatgctgcagggcgacatctggaccaagctgaggcagaacgacctcactagggcctacctcgacgaccccgcctttgtgtcgctgctctcgcgactccagaagaaccccaacgagctccccatgtatcttcagagcgaccctcgcattgccaacgtcttcgcggtgatcctcggcatcagccagaagccaccgggtgccgagagccaggagcccgcgcagccaaaggaggcgcctaagaaggaggagcccaagaaggaggagccgcccaaggctcaggagaagcccaaggagcccgagcccgagctccccgctgagaagaagcaggcc

SEQ ID NO: 27424 - DNA, 320 bp, Sorghum bicolor
  Clone ID: 6858678
gcacgagggttccatgtcgctgggcatggatgcgccacttgcgtcggcaactctggcgacctggatcaatttgtatcagctgctatcatcgaaaatgatatcgttgctgctgcggtgctgtcggccaaccgaaactttgagggccgtgtgaaccctctcactcgggctaactaccttgcctcgccgcctctggttgttgcctatgctcttgccggcactgttgacattgacttcgagaaagagcccgttggagttggaaagggtggcaaggaagttttcttgagggacatatggccttcaaaccaagaaatcgatcaggt

SEQ ID NO: 27425 - DNA, 412 bp, Sorghum bicolor
  Clone ID: 6858689
gcacgaggagcacctcgcccaaaaccctacgccgctcaaccatgctcctccggcgaccgctccaaaccctcactctccccctcctccgccgccacttcgccgccgccgccgccgctgaggcgctcgtgtccccacaccaagccgtcgacccgctctccccgccgtacgactacctcccgggccacccgcggccagacgccaagcacgatgaggtgatcctcgccgtgccgcgcgcctcttcggggcgccacgtggccgccaaggagcgcaaggccgggcgggtccccgccgtcgtcttcgagcaggagaacggacaggagggcggcaacaagcgcctcgtctccgttcagtcaaagcagatccgcaagctcgtcgaccacctcggtcgctctttcttcctctccaggctgtt

SEQ ID NO: 27426 - DNA, 422 bp, Sorghum bicolor
  Clone ID: 6858693
gcacgaggctcccctccgtctccttcacgcggccggcctgactcctcacccctgctcgccgcgaagcacagctccgtctccgccgtctgccgtgggccggcgaagatgatgtccggcggtgggtactccgccctcgacgaccccaaggcctccggatccgtcccggcggccacggggacagatccgccggccatcaggttcgccgactccaacctccagaccttcccgccgtccgaggccaggggcaagatcgctggcgcctaccgcccacccaccgacgccgacgacaccttctcgtcaaagggcggaggagccggaagcggtggcagaggcagcagcgccgggtcagatgatgctgcgcagggcggctggttccgcatgttctccgtggcggcttacaagccctacttcgacgttgacac

SEQ ID NO: 27427 - DNA, 511 bp, Sorghum bicolor
  Clone ID: 6858730
gcacgaggcaactgccaggcgtgctgtgagggattcttctgcccccgtggtcttacttgcatgctcccttgtccactaggctcatactgtccacgggccacggcgaatcagacaactggtctttgcgatccatacaagtatcagataactccaaacacgactaatagttgtggaggtgctgacatgtgggctgatatccagagcactgaagaaatcttctgcccagctggtttccactgtccaagcacaacaaaaaaagataactgtagcagtgggcactattgcagattgggttccacagctgaaaagaagtgcataataaagggttcctgtgatgaaaacacagagaatgaaaacatcaaaattcttggagcttgcatagtgggtgcattgtgcctgctgcttcttatcatatacaacttctcagacaaattcctcagcatccgtgaacggaggaaagcaagatcgagggagaatgccattcagctggctcggcagcagctgaaggcac

SEQ ID NO: 27428 - DNA, 423 bp, Sorghum bicolor
  Clone ID: 6858734
gcacgagggatggccctcgcagcaatcttgatagtgtccgatatgctgagtgcattcactacttgcaagattatgctcggccacaaatgcttgctttcatgttcaggcatggccattacagtgaagcatgctctctgttcttcccattcagtcaaccaaccacagaaggggaaacatctttgtcttcaattccatggagtgatcctttaacaactgattatgggacaattgatgacttgtgtgatctctgtcttggatatggtgctatggctgttttggagaatacaatacggacaataacacaatcgcccacatatcatgaggcacacgtgactcagtacatgaacacagttctcactcgcatttgcaactattgtgaaacacataggcattttaattatctctacaacttcctggttctaa

SEQ ID NO: 27429 - DNA, 224 bp, Sorghum bicolor
  Clone ID: 6858741
gcacgaggcgagcaagccggcgaaagccccccaaaccctcccctcccgaccctagagcagcggcgcacgagatggccgacgaccccaccaccggcggcggcgggggtgagggcggggaccgcgtcgaggacgtcgtccgagccgagggtgagacgcaacctcatgatgatggctcgtcgaaatccaaggatagggagaaagatagagaaaaagacgaggacaga

SEQ ID NO: 27430 - DNA, 416 bp, Sorghum bicolor
  Clone ID: 6858744
gcacgaggcgccctcttctctttttcgcctcttcatttttcttttcctgaaaagtgtctgtgtggttcttgctgaattacctggtctccttacgaatctatggctgagcatgatgagctgctgtgttactggattcttgattcagttctccatttctgttgcttcatttctggcggcggccagggagcgggtagagcaggccatgattagctgttagaattcagttagcttgcctctttcctttagtagttctctgatttgagtgtagacggcgaatctgggttagttgaattttggtaacaaacccatttcttttccggagactttccaagttccaattcactctgctccactccaattgcgtctttcttgatctggaacgcgaatcagcctcttcgttgcataaattccaaccg

SEQ ID NO: 27431 - DNA, 402 bp, Sorghum bicolor
  Clone ID: 6858747
gcacgaggaacaacatgtctcaattagctgatattggtttgatcggtctcgccgttatgggtgagaacttgatcttgaacatggccaatcacggatttaccgtgtgcgcctacaaccgtaccaccgccaaggtcgacgaattccttgctggtcgtgccaagggtaaatccatcattggtgctcactctgttgaagagctctgcagcaagttgaagaagcccagaaagatcatgatgatggtcaaggccggcaagcctgtcgatgacttcattgagcacattcttcctcacttggagaagggtgacatcttgatcgacggtggtaactcaaactacaacgactccactcgccgtgttaagtacctcactgccaagggtatccactttgttggctctggtgttt

SEQ ID NO: 27432 - DNA, 475 bp, Sorghum bicolor
  Clone ID: 6858752
gcacgaggaaaagtcgtaactgttgggcagtacctgatagcaagatctttaaagttcgtagcaagacctttccacatgacaaatcaaaggtaccagcagggaagtatcttatggagctcgtagcgattgactggtttaaggacaccaagcgtatggatcatgttgctaggcggaaaggatctgcggctcaggttgctgctgataagggaatgttcactttcctggtaaacatacaaattcctggaccaagtcattacagcttggtcctttattttgtctcaaattccttggagaaaggatcactgttgcaacgttttgccgatggtgatgatgattttcgaaacagcagactgaagcttatcccatctgttccaaaggggtcttggatagttcgacaaagtgttggaagcacaccttgcttgctggggaaagccgtggactgcagctatttgcgtggccctgactacttagaagt

SEQ ID NO: 27433 - DNA, 323 bp, Sorghum bicolor
  Clone ID: 6858754
gcacgaggaatccctatgtttggttagatctcaacaggaaatgacaacagtcagttactgactattctttaatttgttgatcctcatctgtactttgatccggtaatcaagtcaacttttttatatatctagttcctatttcagcattatggatgatatgcgttaccatttggctaggtattgagcttattcttggaacgaaggtaacttctgttgatgtgcgcgggaaaacattggatacttccactggggaaactatcagctatgcaactcttattgttgcaacgggtgctcaggtatgttgatattctatttgtggttac

SEQ ID NO: 27434 - DNA, 371 bp, Sorghum bicolor
  Clone ID: 6858759
gcacgaggctctctcctcctcacgttctttccctctctctcggcacagccatggcggcggcggccctcctccgcctccctccccttcctcctgcggcagtggcagggcgtcaggcgatggtgcggtgcagcagcggcctcctccctcctccgcctgggtggtcaatggcacccctggggcaaagcaacgcttcccccgacgagcggtgtagcagcggcctcctcccctccgcctggccgtagccatgggccggcgaccactattccctgctgagcccacaaggtcaatggcacgaggaggaggaacaggcagccgtggctaccacacggaccatcgagcaagacgatcgatgccccctcttgaaggaacag

SEQ ID NO: 27435 - DNA, 425 bp, Sorghum bicolor
  Clone ID: 6858790
gcacgaggctcaggtcttgcaagctcaggctgagagtatgggtgatggacgacgacccgaatggggttaccaagactgtgtcatccgggcattattaagatggtttaagcgatcgttctttagctgggtcaacaacccaccctgccccgtctgcttatctcccaccatcgcccgaggcatgactgctccttcgcctgaagagagtgcttgcggcgccctccgtgtcgaattgtatcaatgctcggctcaacattgcggtgctttcgagcgcttccctcgttacggcgatgtctggcgattattacaaacccgacgaggacgtgttggcgaatgggccaactgctttagcatgctttgccgagctgttggaggccgtgttcgctgggtctggaacgctgaggaccatgtctggactgaggtgtact

SEQ ID NO: 27436 - DNA, 516 bp, Sorghum bicolor
  Clone ID: 6858793
gcacgagggacggatgctctggagaaccaagttaagagcaaggttaacatcaaggtatgatatgattttttttccctcttccgtgcactagtggtttatcaagtggttgtcccactgtacacaacttcacatgttccttcctttggattcagagggaataattttgagctatagacttagtaactccttgcaaaaagctcttggcgctttcgcgccatctgatcaagtccagaccggtgcaaggattcacacttgctattttaggttagcatgtgactgaccttgattctgtttactgtagccgtgaactggatttcgtggcacatttgtatgcttcaggattgttttgcagttagtatcaagtagtattttgtctgcttatgtagttatatcctttcaaggcatgattgatattttcaacttgagagctagtccgatttgtgctgtgagcctgtgacacgtggcatgagtagccgtaaatatcatgggattgaatggaaaccatgatttagaaaa

SEQ ID NO: 27437 - DNA, 486 bp, Sorghum bicolor
  Clone ID: 6858794
gcacgaggctcccgccccgcacaatggagacctccttcctccccaccacgctgcccaccgcaaagcccctccccgcgtttcgaacccacgccgcagccgcctcgatccgtccccaacagcgccttcgccgctccacaatacgcgcggcaatcacccggggccgcaaggaggagacagtggccaccgtccgggagcagctggaggggtgctacctcctggcgggtatcaagtacgagggcctgacggtgaagcagctgcagggaatccgcgacgcgctccccgagacctgcagcctgctggtggcgaagaacacgctggtggggaaagccatcgagggcaccccctgggaggcgctcaagccgtgcatgaagggtatgaatgcctggctcttcgtccacaccgaggaggtacccaccgcgctcaagccttaccgcgccttccagaaggaggagcgcgtcgaggagaccaacgacttcgtcggggccg

SEQ ID NO: 27438 - DNA, 535 bp, Sorghum bicolor
  unsure (1)..(535): unsure at all n locations
  Clone ID: 6858799
gcacgaggcatccttttagttccttgcttcgtctctactcccaaacctctgattaatgccttgcctcctttttgtactttcctgctgaagccttttctgaaaccagtatatccccgtttgtttgattctaacgttttggtctttgggggcaaagctcttccagcttgcaggactggagtcttcatggacgcactttcttcaccagggacagcaatggtgccggtgaatggcgatacagccggacctagctccagccaggatgactcagcagtcaccacgaagaagcgcaacaggcctcagtatcatccgtttactcagcaacagctcccagcttgcaagcctatacttgcgcctcagacagttattcctgtacttctgtttgtgggcatagtttttatcctgattggcctgngttgcattgcagcctcaaatagggttgttgaagtggtctatcaatatgaaacttcatgcataccaagatacatgcttgacaacaaagttgcatatatccaaaatccatctatagataagacct

SEQ ID NO: 27439 - DNA, 480 bp, Sorghum bicolor
  unsure (1)..(480): unsure at all n locations
  Clone ID: 6858826
gcacgagggtgaaggttgacaaagactcgaaattgatcgttgcccaaggcggttgcctctgggaagacgtcgacaatgccgcaatcgaaaagggcctggcaacagtaggcggaactgtgaatcatacaggcatcggcggcttaacgttgggtggcggcatgggctggctcacgggcttatacggcactgttgttgataatctcgtcgaagctaaagttgtcgttgctgacggacgcatcctttctgtctcagaaaatgagaatgccgatctattctgggcgatacgcggtgcaggccacaactttggcgttgcagttgaattcacccttcgaggatatgaccaaacgaacgagatttacgccggtggcttggtgtttactcctgaaaagctgacttcgcttgtggagggattcaataccaggatgaagacctcagagccccaagccgcgggcatacttctctntgcaaagcctcctggca

SEQ ID NO: 27440 - DNA, 474 bp, Sorghum bicolor
  Clone ID: 6858831
gcacgaggatcagctccgtcatcgatggcagcagatctaggctcgggggcagcggatccagttggctccatcctcgatggcagtagatctgggctcaggggcagcggatccggttggcctacaccggctgctccgcgacgaggcctcccaaggtacgtgtgtgccgctgctgaagtggttggaccggtggctgcgtgttccgcgccctcatctctctcacgcgcctccacgcccaccctgtcatgcgcccctacgacaacgctccctatttcggttgtctgctccatcgactgctcgatctccatgctcatgagccgcaaagaggccaaagccccatttcgacctgccactcttcattgcctccatgccaacatggacgccccctggtagctagaggttcttcccctgtctttcatcctgtgtttcagatttttttggcagaaaacttcttgattttgcgtgtgactttgaatt

SEQ ID NO: 27441 - DNA, 482 bp, Sorghum bicolor
  Clone ID: 6858835
gcacgagggcgcgacgagttcagcttcgggaacaggggcgcgatggacagggacgcggaggcaggggacgagaaggccgcggcggcgaccgcggttgctggcggggaccccaacgcggtagccgcgccgacggcgatgccgccgacgagcgtgatgacccgtctcatcctgatcatggtgtggcgcaagctcatccgcaacccgaacacctactccagcctcatcggcgtcatctggtcactcgtctgcttcaggtggaacttccagatgccggccatcgtcctgcaatccatctccatcctgtcggacgcggggctcggaatggccatgttcagtctcggtcggtaccagctgcggcctaaacttccctccctagatagaccctacatacacctcgatcggtttcattctgttttttttttgggtcttatgatcaaacagtagaatgaatgagaatcaccggttctcggtgtcgtgcaggg

SEQ ID NO: 27442 - DNA, 539 bp, Sorghum bicolor
  Clone ID: 6858840
gcacgagggtacgataatcgaagtttgacggcttcttgaagtaatccagatgattttgcgcttttcagaaccaaatagagattcttccatcatcccatgttcattgcccgatcgacaatctctatttgaagcagcttcaaagccaaactttctaccaagcatcaagacagcttgaatgtgcatttaaatgggttgtttcccttttaccaaagatcatgacggaaattcaaaaattacattctgtaagttattgatctaatagaaattaatctatcaaaactttcgatgaacattctcatgaacgctttttttgatagacgaactctcacatcaataaattcaatccagatttaagaacacaattcctcgcagcagtccttgtttgaagataaaactcatcgatcatactgtggacagttttgttcctaaaattctatggtctcctgtgcatgacctccaaccacatttcgtttcgctaagatctaaacggtttctttatcagagtgttttttaaatgaaagctactcatgaaaccttgt

SEQ ID NO: 27443 - DNA, 471 bp, Sorghum bicolor
  Clone ID: 6858841
gcacgaggcccattccaccggtgcgatccgtttcctccttacttccctgcccgcccgagggagaagacgaaatcgggaccgaccgccgaggtttcttgatccgggcgcgtgattcgcggcgcccaggcaccagtgagaaatcaaatcaagaacggggcaggggaagcccggggaagtgagacgagggcgcggggagcaatcaagatcgcttcttggagctgtcggttcccccgcgccaatgccggatccggccggcggcgccccccgctcccagtgcgccgggctggcatgccccctctgagcgcccccgcctgccgccgcggctcccgatgctcgtgtggtcctcgggagcaggagagggagcagcggccgtcgtgggcggcggtcaggagcgaggatgcagatccggctgtcgccgagcatgaggagcatcaccatctccactagccatggcctgctagacttgatgag

SEQ ID NO: 27444 - DNA, 452 bp, Sorghum bicolor
  Clone ID: 6858842
gcacgagggccgacgctttcaccgagctacagcagctcaaggcgctctccctctccttcaaccacttcaacggcaccattccggactccttggcagcgctgccggagctcgacgtgctggacctcagctccaactccttctccggcaccatcccttcgtccatctgccaaggccccaactccagcctccgcatgttgtacctccagaacaactacctctccggcgccatcccggagtcaatctccaactgcaccaggctccaatctctcgacctcagcctcaacaacatcaacggcaccctccccgcatccctcggaaagctcggggagctccgggacctcattctgtggcagaacttgctggtgggagagattccggcgtcactggaaagtttggacaagctcgagcatctcatcctcgactacaacgggctcactggtggcatcccgccg

SEQ ID NO: 27445 - DNA, 516 bp, Sorghum bicolor
  Clone ID: 6858847
gcacgaggctcagacacatcaagcttcttaacaaaacaccttcaacccctttaaccctttaaaaccccatatcacctcgactgctgtctaccccgctaccccgcgacaaccaccccgccaaaactaaacaaactcttacaagaggaccaaggcaccgaaccttggtcactacagtcgtcaagacgttttccaatctccttaactcgactcaccacccgttcgcaggagcccgctgctcagccgattccggaggctcagcggactcgacctttgaacagtaaaggtcgaaatcaaaatctgaacccgtccaatctacgcaaatcgcaaacttccacgtcaaaagccactcgctcaccatggctcctcacgcggaagtcggcacgggctcctcgaacggggcttacaccaacggccgaggctcttcggcccaccaggacctcttcaccgtcaactcccccaatgtcacctacactgatgcggagattcgctccaagtacacctaccgcaccaccaaag

SEQ ID NO: 27446 - DNA, 505 bp, Sorghum bicolor
  Clone ID: 6858862
cagaagttggagaagctggctcctcgaatggtagccgctcacttccttcaattaaatcaactaatttctagtttcctttgccgtcaaacaatgctagggtttgccctgaactcggttaacaagggttgtccctgaagtaggaatactagggttttcaatcggataaggagcaggttataaacaagaagggaagtagtgcctcgcatgtcccttttgaaatcattgatgtccggcgagcgccccacttcctttttttctaaagaacatactagggtcataaacaaccagcttgcttcgttgaattgctttccaaacagttcggggtgcgtgcctctactctagtgcttacctaataatgtcctactttcttgaattcaggaagataccgacgaagataccgacatggaactgaacttcactttctatacgatacgatttgattttatttgaaatactagctctagtttgatcaacaggtctagctcgcttgattcattccactagg

SEQ ID NO: 27447 - DNA, 482 bp, Sorghum bicolor
  Clone ID: 6858882
gcacgaggcctcaacaacaccacaattaaacgacccactccattagttttcttttcccagctcatcagctagtagctccaactccagctcgcgctcccatggctgcaggtggtgcagctgcagcctccacaggctactggtcgcttgcgatcggcgcaatgcgtgcggccatggtgtgctgggtctgcttggcctacatgcgcggcgtgtgcgactggttgccgccgccattgccggcggcagcagcagggagcacgagcaccccgcgtgtggggctgctgtcggtgctcttcttggcggccgtggcgctttccctggtggcggggtggttcctgaacgccgtccggccgcctccgccgacgccgtgcgggacgcccggcgggcccccggtgaccgcgcccagggtccggatgcgcgacgggcggtacctggcgtacgccgagtccggcgtgagcaaggacagggcgcgcttcaaggtcgtc

SEQ ID NO: 27448 - DNA, 425 bp, Sorghum bicolor
  Clone ID: 6858887
gcacgaggcccgcacaccggtccatggcgtcgtgcgtagccgtatgacgctcgcggccccgacctgcgtctcagcccctggctccgcggcggccaccaacagtggccgcgcgcagcttagcttccatcgccgcggcgttcgcgctcgagtcatccgcgcctcccaccgacgcccacaccatccctctttttcgcttgaggatgagggggttctggagtggctgaggggcgcggccgcggcgctcgccatcgtagcccagatttccgtgtcgctgccggcgaacgcggttctttactcgcctgacacgaaggtgccgaggactggggagctggccctgaggagggcgatccccgctaacccgaacatgaaggctatacaggaatcgctggaggatatttcctacttgttgaggataccacagagga

SEQ ID NO: 27449 - DNA, 469 bp, Sorghum bicolor
  Clone ID: 6858895
gcacgaggaaaatcctgacacttcagttgcgaacccggtcagtcactctctgtctcgctcacttctcctcaggtaccagcacggcgctctcatcggggcccttgtcctggttcttgtcgctgcggtcggcatagaactcgttcaggtccttgacgacctggcggccttggaagttggtcataatcttcttgctgtgcttgcgaagagcgtcctgccaccagtgcggcatggccgccagcgcacccagcgtgttacccagcgccggcataatgatctgaccgctctcgcccttgagcacctgccggacaatggcctcggcgaccgactcgggctcgagggccggtaccacaaactcggcgtcgttgcggtagcccacaaacagcggcgtcttggtgtatccctggttaacgacaacggtgcgcaccttgggcgcctggtaccgcgtgggtagctccgccgtcaggccctc

SEQ ID NO: 27450 - DNA, 495 bp, Sorghum bicolor
  unsure (1)..(495): unsure at all n locations
  Clone ID: 6858908
gcacgagggctgcagcggccattggatagtgtatatgaatacattgatccggtgccaatagcctctgcctccatagcacaggttcatggggctaggttgaagagctctcagaaggatgtggtgattaaagttctaaagcctggtattgaggatactttggttgctgacctgaattttatctatgttgttgcacgtgttttggagttcttgaaccctgaactacagaggacatcactggtaggcattgtcaaggacataaaggaatcaatgcttggagaagttgaccttagaaaagaggctgcaaatattcaggcatttcagggatacctagatgcaatggggtttgacaggcaggcaaaagccccatttgtgtatcaacactgtagtacaaaacgtgtgttgactatggaaagattgtatggagttccgcttactgatcttgattctataagatctcttgttcctgatcctgagttgactntagtcactgccctt

SEQ ID NO: 27451 - DNA, 520 bp, Sorghum bicolor
  Clone ID: 6858921
gcacgagggcggttcttggcttcctttctccatcgaacaggggtggactgatgacagccatgctcctgctctgggtgttcatggggttgcttgctggctactcttcttcacgtctttacaagttgttcaagggctcagaatggaagaacattgccttgaggacagccttcactttccctggcagtgtgtttgctattttcttcttcttgaatgctcttatctgggggcaaaagtcttcaggtgctgttccattcaccacaatgtttgcccttgtcctcctttggttcggtatctcagtacctttggtttttgttggaagcttccttggcttcaagaaacctaccattgaagatccagtgaagacaaacaagataccaaggcagatccctgagcaggcctggtacatgaacccaatcttctcgattctaattggagggatccttccatttggtgctgtgttcatcgaactcttctttatccttacctccatctggctgcaccagttctactacatctttgg

SEQ ID NO: 27452 - DNA, 458 bp, Sorghum bicolor
  unsure (1)..(458): unsure at all n locations
  Clone ID: 6858924
gcacgaggattacctgcaagctactagcacataccgagctacagtgagctaggttactagagatagaggagagacgatggggagagatcagcaggcaggtgcagcggcgatggctcctgagaagctgaagctgttcatcggagtgctggccctgcagttcctcctggcagggttccacattgtctccagggcggcgctcaacatgggcgtcagcaagatcgtgttcatcgtgtacaggaacgtcatctccctcgccttgctcgctccgttcgcctacttcctcgagaagaaagacagaccaccactcaccttctctttgctggtggagttttttctgctagcgctgtgtgggataacagcaaaccagggcttctacctcctgngtctgtatcacctgtcaccaacctacgcctctgcgatacagaacaccgtccctgcaatcaccttcgtcatggccg

SEQ ID NO: 27453 - DNA, 498 bp, Sorghum bicolor
  Clone ID: 6858927
gcacgaggcaggtggtttggggcaaagttctgggctgccaacgtctccttcaggagctgctgaatcctcaggtcccaaccaagcaaacagtgctgcaagtgggatcaatgccactaactttgtttctaggagtggctactcctgccaacaattgtctgttttgatgattcaagcatgtggtcttttgctggcacaactcccaccagaattccacatgcaactatactcagaagcagctcgggtcataaaagattgctggtggcttgctgatagttcgaggcctgttaaagagcttgactctgctgttggctatgcactgctggatcctacatgggcttcccaagacaatacatcaacagccataggtaacattgtcgcccttctgcattcattttttagcaatcttccacaagaatggctggaatctacccatactgtcatcaaacacctccggccagtcaattcagttgccatgttaagaattgccttccgcatatt

SEQ ID NO: 27454 - DNA, 557 bp, Sorghum bicolor
  Clone ID: 6858938
ctcgagcataccatcagcagtgaacttgtaggaaagaccgacttgccagtgacaatattagcctaagggggatgcagaacaaggtcccaggtgtgattaaccaggagagcatcatgttctccctgcatggcagacctccaattgggatcagtgagagcgccgcgatacatctttgggattttggcgacagagtccttgcatagtagagagcaggaaggtgaaatccatgcttcctgtgtgtggtcatggcatgctggttcaccgtgggagccacataaacagcaccacacggaagcggagcaggagcatgaggctgctgtggaatcagggatgacggcggagcgggttgacggcgagaggatgtaaactgtagtcacactgtgcagcactgcagccagcagagggcatactccattgtggagccggcagtttagccatatcatgttttacaataaacaacctaatccattatgtggtcctaaattctctattctgaaacaaaaatttcaccatttttttgaaacaaaaacttcaccgtttttctatcttgatctctt

SEQ ID NO: 27455 - DNA, 450 bp, Sorghum bicolor
  Clone ID: 6858947
gcacgaggatagctatctatatcctacagcggctgcctgctacagtaccgatcgatcatgctcacctcgctgcggtacctggccggcacggcggggccgagcggcttcggctcgcggacgacggccgaggaggccacggcggccggccgtgacctggcccacatcaccgccatcatcacgggcgccacgtcggggatcggcgcggagacggcgcgcgtgctcgcgagccgcggcgcgcgcctcgtgctgccggcgcggagcctcaaggccgccgaggaggcccgcgcgcgggtccgcgccgactgcccgggcgccgacgtcaccgtgctgccgctcgacctcagctcgctcgcctccgtgcgccgcttcgtcaagcggttcctccacctcggcctccccctcaacctcctcgtcaacaacgccggcaagtacgccgaccgcttcgccgtg

SEQ ID NO: 27456 - DNA, 626 bp, Sorghum bicolor
  Clone ID: 6858949
gcacgaggattcgattgattgattgtttgattgattgatcgaaaaaaataatctattcactgaatgttcgaatcaatcagaaaattagaattttttcactgaaattttctctatttgaaattaattttcgattgttcaatcaattaatcaatcgttcaatcaattaatcaattcaattttgatgctaaattgaaattttcattgaataaatctgaatgaatttgactgaatgtttgttgaattgattgatgaaagtttcgcctatcatttattcaactgccatgtgaaacctgcccttaattaaagacttgcaatcagtcaatcagtcaaaggatcaatttcattcattgttcaatcattcaactatcattttgtttattcaattttcttttacatttgattaatcaaatcggtattttctcatcgtgtaccgatagagctattttgctgctgcgtaaggcaaaatgagcgacgtgcagccaggaatcatgaacgcacctggaaacatgcctcaattccaaccaacaatccatgcagtgggtacaatgcccccaccagctcctgtacatcaatcaagtgcaaatccgtctgcaagtcagctgactcaaatggaaatcgatgccaaa

SEQ ID NO: 27457 - DNA, 522 bp, Sorghum bicolor
  Clone ID: 6858958
gcacgaggctctcgttgtcattcccaacgaggacaagacctccgccgctgtccacttcctcgatcttgctgccaagctcgaccagactgccgacttcgagtgcggtgtcaagtgggccattgctcgatctcctgctgctctcggtcttaccaacattgccccctctgccgatggcaagatcaatattgatgctggccctcctatggagttccccgcccccttcggtcgtgagctgaccaaggaggaggcttacatcgctgatctcgacgctaagactggtgcttccctgaagctgactgttctgaacgccaagggccgtatctggacccttgttgctggtggtggtgcttccgtcgtctacgccgatgccattgcctctgctggtttcgccgacgagctcgccaactacggagagtactcaggtgctcccaccgagtctcagacctaccactacgctcgaactgttcttgaccttctcctccgtgctcctcaaagcgatgagggtaaggttctcttcatcgg

SEQ ID NO: 27458 - DNA, 570 bp, Sorghum bicolor
  Clone ID: 6858967
gcacgaggattattttttttccctttatgagatcgatctatcactgatcctaaccgatttgactttgcagtcaggccagccacactgacatcaactttcctcattgcactcactcgctcacattgtttgcctggcaactgatactgaccttgttctggctcttcttgtttctggagcctcccgtctcatcataaagcaaagctccgacctacctaggccatgccataattttctgtcactcacctttccccccgtttccgaaggttcccatcgaagcttcacttctttttctcttctcttcccttcctccatcctcttctccaaaaactaaaagagagtgaccagtcaacaaacggatgatcggcctagaccagaggtgacgtctttggtttatgtgacttgtatatctccgagtgaccccaagcccaaacccaaacccaaacccaaacgtcacctcactcacgtctctctcttttatcctcttcttcctcttcctttcactctctcctatcctcgtctccattcacctattttggagagttttgtttttgtacagtcgctcaatatgcg

SEQ ID NO: 27459 - DNA, 502 bp, Sorghum bicolor
  Clone ID: 6858968
gcacgaggcacacacacacgtcacagctggattgtgtcgcacaaatcgtaagctgtacaagatgcccgaattcaccgaggcggataccattcgtatcctcgttgcgaccgacaatcatgttggttatgaagagcgagaccccattcgtagagatgacagttggagaactttcgatgaaattctgaaccttgcccggactgaagatgtacgacccatcgacttagtatcaatcatgacttctaacatgaataggttgacatggttctcctcgcgggtgatctctttcacgacaacaaaccctcccgaaagtccctttaccaggtcatgcgtacactccgacaaaactgcttgggcatgaaaccctgtcctctcgaatttctctccgatgctgcatctgtctttgagggtgctttcacgcatgtcaactacgaagatcccgacatcaacatctccatccccgtcttttcgatccatggcaatcatgatgatccttctggtgaag

SEQ ID NO: 27460 - DNA, 531 bp, Sorghum bicolor
  Clone ID: 6858969
gcacgaggctgcggcctccccaactgcggccggccggaactggacaggcaccgggcaccgggcaacagcgggactgcgggagtcacctccatggcctcggctgcaaccctccccaggcttcagttgaggccaagatgcaacagctacttccaggtgactgatcaagttcatgcgcacatcaaaactgcggtgcctgcaagtgcccaacgcatatccacggatggaggaagaagaagatggaggcacacattcctgccggtgtctgcggttggtacaggtcggggctcatcggtcactgaggcagataggaagagtgacttgtctctggagaacgtcaagacgtccatcgtctcccgagacgacgaaaagatcaatgtacgagtgcagttgcctggaaaggcgacacaaaaggtgtttgatgaggctctgacgatcttggctcgcgatgcaccgccagttcctggttttaggaagtccaaaggagggaaaacatcaaattttgcccacaggaaatgcatacagagatggtgc

SEQ ID NO: 27461 - DNA, 457 bp, Sorghum bicolor
  Clone ID: 6858975
gcacgagggtcgctgcagcccctatatctcctgatgatgctacgaacgatacctgtcaacaaaatggctttgggcctgatactcatcttggtgcggaaatcggtaagattgcaacctataagataaggccagttctgaggatgattacaggatcaactatatccgagttcgatttgactggtgatctttttaaagctcttgaagatcagagggatctcatcagggatcttaacgcttcaaccagtgtgcctccaagtagatgtcaagcctttaaggatgggatgaaacaaggaattattaatccaagtgatattgatgttacctttgagaattttccttattatctcagtgagaatacaaagaatgtgctcttatcatgtgcattcatacacttggaaaagaaggaattcatcaagcagtttgctgagatttcatcaataaatcagcgaattttgtt

SEQ ID NO: 27462 - DNA, 486 bp, Sorghum bicolor
  Clone ID: 6858979
gcacgaggcacaactcaggacctcgttcccctctagccttccgtcccgctcgaggtctagacaccaggcaagcacaatgcgcttcgcaattggcgctacttccctcctcgcggccgccgtcgtgcgcgcagacgatgcttcgagctctagctccgaggtccagtcgtccacttccgtcgccaagcccaccttcactcccaccaagctcaaggccccgttgctcgagcaattcaccgatgattgggaatcccgctggaaggtctcttccgccaagaaggatgacaagtctaccgaggaggaatgggcatacatcggcaagtgggctgttgaggagcctacggtgctgaagggcgtcgagggagacaagggtttggttatcaaggacaaggctgcccaccacgccatctccgccaaattccccaagaagctggacaacaagggcaagaccctcgttgttcagtatgaagtcaagcttcaggacggctt

SEQ ID NO: 27463 - DNA, 147 bp, Sorghum bicolor
  Clone ID: 6858980
gcacgaggaatcaacgtgcctgatgtcgtcgtgttcccgagctcgcaagatgaggtacaaaagattgtgatggcctgtaacaagtacaaggttccaattgtaccatatggtggggctacctcaattgagggtcacacactggcacct

SEQ ID NO: 27464 - DNA, 522 bp, Sorghum bicolor
  Clone ID: 6858987
gcacgagggccatcatgtcctctgtggtgattgctcatctctgcgccccctatcgcagcaccattgcatcgaaattgttgctcgccatccatcggcaatgtcttttctaataagtcgctaatacgaacctccctcaggcacatgctgtactagatgatgtgctttacaacgttctgagcgatctattgatgaagacgcaccgcgaagagaagacggcgagagccaccaccgctgccattcgcatcgagaagctggcatccgacgcgtccgacagctcaacgccagactcaaaaccggacgtacggattgagaccgacgccgctatatacgaggatggaaaagtattgttgaaaggcaatcctctcaagacgaccgccgagattctgtgcccccgatgccatctgccccgactcctatacccgacggacggaaaaggcgctcaaaaacccgaccccggtgtcatctactgcaagaaacatccttatattgataagcctgggtgcgacatctatggccagagct

SEQ ID NO: 27465 - DNA, 468 bp, Sorghum bicolor
  Clone ID: 6858991
gcacgaggggaagttgttaaggatgagagttccttagatatggttgctggtgtctctgaaaatcctgctttacctgatgagtgcgttgacgacaaaacagaagaagacacatgcactgctccttcaccttcagaggttgatatctcagaagaacagacactaagttgtggtcagattccctcatctgaagtcgagctgtatgacatacaagaagaacatgcagaaacttatgatgatgatcagatccactcatcaacacaggctgatgcctgttctacatcatcagaagttgacataccagaagaacatgcaaaaacttatgatgatgatcagatccactcatcaacacaggctgatgcatatacttctctatcttcaaaggagttcaccatttcagaagaacacactccaatttctcatgacagccaaatgcactcattccagatttcaaaaccaatagaaggtact

SEQ ID NO: 27466 - DNA, 441 bp, Sorghum bicolor
  Clone ID: 6858998
gcacgaggcctgactttccttatccagctgtaaactggactgtgtctacaacttctgggctgttatgaattgccgtatattatgactctctattgaaaatattgtgttttgctttcctgacctttttgcgacggggaaatcgttgcccaatcttacccaaatcgatgctctcgtgagctagcgcaatttacctcaacatctaacgctcttgttaaggcgccggttgatccggcgcacttaacatacagagtaaccactatgatcatcacctagatcacaatgggcctgacaaccccgatctcgactgggaactcaacatcgttccgtccatagcagcctggctagatgaagagttgcagacctccaaactgcgcgatactttgtgcgatgaatcgtcaggtattgccgaatgcgacgtccctctcggcaatctagaaagct

SEQ ID NO: 27467 - DNA, 467 bp, Sorghum bicolor
  Clone ID: 6859012
gaacgaggatacggaaggaggattttcaatgcgggatataaaaacatatctctctgtagcacccgtgctaagtactctatggtttggggctttagcaggtttattgatagaaatcaatcgtttattcccagatgctttgtcattcccttttttttaattctagttattcctatgcaagagatagaattcttcgtgacatgacgaaaattttccctttttgaattcttttttagtatatgaagcaaaaagaaagaaaagatggataaggattgtattctttaattatttctctatgttttattacttaatttacgatttacgaatttccaattttttttattctattggattggatttgttcgagaattcgaagaattacaacaaaatctttagaaatcacatttttagttaggaacttctatggattttatccttcttcttttcttgggatccaaaataaaagaata

SEQ ID NO: 27468 - DNA, 529 bp, Sorghum bicolor
  Clone ID: 6859016
gcacgaggagccgctatcgaccgtttccatggaggaatatgtccaggccattgagcagatgaagaagatgaggcgggacatcaagcgtttcgaaacgctcgaacaggatctgaagcaagagttgttcaaggagagaatggccagggaggagttgatcagggtcaaccgcgccatcgagttgaaaatgtatgagaacatgaggaatctcaaggtcaccatcgatgaccgtgtggaggctgtcatcgacaagaccacggagttgagcaacgagatcaggacacaaggagaacgcttgattctggtggacgaattcagtatggaactggagaatcgggtcgaccgtgtggagcagcttacgggcatgtcgagagacgttacacccgccgcttccacccccaagggccaccacctgacccccaaggcacaaccggtgccgcaactccctctgctcatgcaatcacagacaaatctcggccaactcccctttcgcacggacaagaagtacccagtctcgtggagtgtccgtgtc

SEQ ID NO: 27469 - DNA, 396 bp, Sorghum bicolor
  Clone ID: 6859025
gcacgaggggaagtgttacttgttttgggctatgcaacacacatatttaaatcgctatctacttattccatgtctgtttcaatagcaggacctttttattctgttagggcttatgtattacgttcagatttcatcaagtgaaagttgcgcaatagtgttatagagggttaaagttatgtagttgctcacatatatgtttttgtccagagatggttttggttccagtacttcaactgtcattttgattgcaaagtttacaaacaacagttgctgttacttgttcttgctgttacatattggaaatctaatgacaagtgtttgtctgtcggaatgtattaatattcgatgggtctatgggatgaatataaatacttttgtgtgcattagtagctgaag

SEQ ID NO: 27470 - DNA, 428 bp, Sorghum bicolor
  unsure (1)..(428): unsure at all n locations
  Clone ID: 6859027
gcacgaggcagagagtgtagaaggcatgtttccgatggcgtcttcctcactatcgccgccgccgctctcacttatcctcctccggccgctcccgtgcagacccgtcctcctctcgaggcaaaggaagccatttccaactgtccgcgtagaagcaaggcctgagcagcggttgcagcggcggccggtgaccggccggtggaggaggggcggaggcttcgcgtgtttctcctacaatgccaataacaagacgcccccgccatcagataagagttcagacaagtgggcgatccttcgccgatgggatgtgccatgggagtggcaaaccgttgtgctcagcatggtaggctgtggagtaaggattggttgagcaatcggctttgcaatacctgngatttaaagctgtggaggcaactatagatgagaaggca

SEQ ID NO: 27471 - DNA, 494 bp, Sorghum bicolor
  Clone ID: 6859053
gcacgaggcttatatctgcacctaatctcacctgtaacatgcttgtttactacacattgtactttatagtgcaggaagctcctaatttcacctgtagcgggtcccctcaatgtaccattttgtagagttactccaaattttgctgcggtgcagaaaatattctttttttgttcaactttccgctgcttgtgcctgcacttacttcctcatgcattttatctggtttattccatgctgcagattccatttgcttgtatttatcattagttttctctcaatgcactttgtagttatgcatatttgtttgttgttcatgtattctgcttatctgagtttggatttgatagttgggtctaaacagtaaaaattaatttcttatattaactattttatcggcagttaatgcctcggaataagatataaaaaataaagaaacgaaatagttgagctaatatgttctacttcatgcctgtggtagtgcatggggataatcc

SEQ ID NO: 27472 - DNA, 512 bp, Sorghum bicolor
  Clone ID: 6859057
gcacgaggctggccgccgccgtcgccgaggggcccgtgcggcccaaggatctgttccctggggaggcggtgcgcgaggtcgtcgaggatctcgggctcaaccgcgccaaggacccagctgccatgggctttcgcccgcctaaggcctccatcgccgataggctcatgcttactaagcgcaagatggaagaagtcaaggaagctccagtgcaatcaacagttagcgcaccgcaaacggtcgtcttaagtggaatgtctgagttccatggtttgaatgggactaccaagtttggtgttggagttcctaggaacccgccagttccatctttagctgctactgccccattaacctctacatccgcagctaccttgaaaccaccaggatcatctcctgtaaaaccagttgccaactcatcagttgttccccaactccatactggtccatcaaaccttaaattggacaaaaatgttagtggtcctcagaatttagcacgcagtggagtaactgttgtc

SEQ ID NO: 27473 - DNA, 434 bp, Sorghum bicolor
  Clone ID: 6859059
gcacgaggcaggcgcagctcctgctcctccgcacctgctgctccagttcagctctgccaacatgctcggcctccggcgcctcctcgttgtctccggccgccacgcgccggaggtcacctccgcctgtgcggcgtcctcccacagcgccgtcttctttcgcgcgctccaaatcctcgcccagccggggcccgtccgcctccacaagctctcggctccggacaccgggatcgtggagctgaggctggagcggccggaggccaagaacgccatagggaaggagatgctccacgggctgcggagcgccatccaggaggtggtggccgacacggctgcaaacgtcgtcttggtggcgagctccgtgcccaaggttttctgcgcgggcgccgatctcaaggaaaggaggttgatgggccctactgaagttcgggactttg

SEQ ID NO: 27474 - DNA, 436 bp, Sorghum bicolor
  Clone ID: 6859075
gcacgaggtcactctttcggtaccttttctctgactccaaactctgcatcggatctccgactgcttagctgctattcacctgctgactgctaccggttgcgcagccctacttcgctacctctcaaccgcgtcctcctgtcctccgccttccgctcgtccgtttgttggattgctcgatgagtgcgctgcccaccattcaggagaagccctctccgctcgaccaacccgttgggtccgagcaacatccgctgcactactcgttcatcatcactaacctcgagcgcgccattgatttctatgaacacgtcctcaacgctcgcgtactgcgacacgaagaacacgacactgactgcccagcaacatgcaatggcaaaccatcagcctcctcttcctctcccgccacagcctcacccacatcttccaactggtccaagac

SEQ ID NO: 27475 - DNA, 460 bp, Sorghum bicolor
  Clone ID: 6859101
gcacgagggtggttcgaggctgattaaaaaaaaagtcgtgaattttatttcgtaaaattgtagagccagaggcatccctaaactactgaaaatgactggattcttgtttaacatcgacggaggatatttggagggattgtgtcgtggatttaagtgtggtgttctgaagcaatcggactatttgaatttggttcaatgtgaaacactagaagatttgaagcttcacttgcaaggtaccgattacggtcaattccttgccaacgaaccatcgcccctgtctgtttccgtcatcgatgataagcttcgcgaaaagttggtgattgaattccaacatatgcgcaaccatgccgtcgaaccattgtccacattcttggacttcatcacctacagctacatgatcgacaacatcattctgctgatcaccgggacattgcatcaacgtcccatttccgaattgatt

SEQ ID NO: 27476 - DNA, 434 bp, Sorghum bicolor
  Clone ID: 6859102
gcacgagggcgacttatgcaaagtcagtaccacacactgtcaagtattgttgacaattaagttggtcctcgaccttcggaaagctctcacaccagcgcattatctgagggagatggaatccagcccaaatgataatgatcagtcatcaacatctgaagcccgccagaagcgctcacgcgttcttctatcatgtgcaccatgtcgcaactcaaagttgagatgtgatagagagcaaccatgtgggcaatgctccaaaaagggacgcgcatctcagtgcacctacgccccaaaacctgaacggaaacggcctgccaagggcatgtccgcgcgtttgaagcgtctggagggcatggtccgggagatgatggattctgaaggtgcagcccctgtaacccaagtaggtaacggaactggggcagcaatggcgaatggta

SEQ ID NO: 27477 - DNA, 273 bp, Sorghum bicolor
  Clone ID: 6859109
gcacgaggctctctccctgcctccctcctcccggggcggcggcgcggcgagcagcagtggcgcagcatgcaggcagcggctgtgcggcggcgcgggcgcgggcgcggcagcgctggtggggtccgaaggccccctctttctccctcatccttcgtgcggacgcctcaaatgcctccttccaccgaggcacatgagtcccttctatcagtgaaaccctaggagccactgttattgattttcatgtcactatgaggaaggggtcattaaatgctg

SEQ ID NO: 27478 - DNA, 510 bp, Sorghum bicolor
  unsure (1)..(510): unsure at all n locations
  Clone ID: 6859111
tttcaccacatctgtcctcccgagcaactgtcgcacaaatagacagggttcagccatggcgattattctttgtgcatcacccgcagcgccgctatggagcttgttgttctgcgcgctcggtgccctggcagtggcggccctgtggggggcatggcgggcgctggaccggttctggctgcggccacggaggctgggccgcgccctgcggtcacagggcttacctggcacggcgtaccgcttcccctccggcgacatgacggagttcctccgcctcgccgccgcggcgtactccgagcccatgcccctcgcgtcgtcgccgcacgccgtcgctcctcgagcgcttcccttcgaccacagcatcaccaggcagcacggtaatctcgccgtgacctggtacgggccggagccgagagtgatcgtgaacgacgccaaactcatgcgggagatcctgngaaacaagcacgccggcgtgtttgggaagcagaagtctgttctttgggtcgagaggct

SEQ ID NO: 27479 - DNA, 464 bp, Sorghum bicolor
  Clone ID: 6859125
gcacgaggaagatccgtatttgtcgaccaacagtagcccaaccttgtaccacctgacctttcggcttgccttctgagtcaaccggtttaaggctgggcatcatactagacaactatcgacttgaccgacctgcgatgagccgtaatcgctcagaccgaaccttgcgtttgaagttttctttcaccctctccatgatgatgcggaaacgctctctggagaaggggtttgggcgcacgttttttttagcgttgacgaagcttgcttctccgcttgcgtgtgtcggtgtttttgatttcacattttggttcttttctgttcaatatacccgaccatatgtatttctttgtgtttatttgtcttgcgttactgctctctcttgcgggttgcgcgttggatttatatcccctcatcgcgaagtttgacagtgaagctctgcagacaactatccctcaaccttccatgta

SEQ ID NO: 27480 - DNA, 487 bp, Sorghum bicolor
  Clone ID: 6859126
gcacgaggttttttttttttgagaggatcaaacaaacaaagcactctccagcatatatgacagaatagtaggcaatgtaatacaagagtcatggccgttgctctcccttccccttcaccactcgacacgtagtcctccatggccattatattttgcttaagttgtcacactatgcccagtcaacattgcaaccctactaccaatcatattgtcaccttcacaaatcatctagaatgtgcagcaagtactagtagtaggttgtagctgctagctcatggggtcacaggcaagcagctgattagctacctttttatttgaacaaacatacattaagacttaagaggaaaaaaaaagggggcttgcgcagctaattgcaagatgatcaggtacttagggtcgttggttggtcttgtttcgtacgttcagccgtacggttagcgccggcgggcggcggtctcgcgctgtgcgttgaagtagacggcggcga

SEQ ID NO: 27481 - DNA, 462 bp, Sorghum bicolor
  Clone ID: 6859129
gcacgagggggcttcggcgggttgccctgcagcgacagcggccgggtgacggcggctatggggtgttagggttgactcgagcggtctactttgatgttagcggatactgcttgtcgcgtgctggtaggcgtagtttcgactcggcttgggtctagatgtctaatggttgggcactatagtgattgtggcgggtggtttaggtggagctgttccgatctcgtgcggaatcgtggtcctgctcggaactataggtgaatttaggagcgcttgttctcattgttccatcgccctctcgaatttagtgttattgagggttaacatatgggatagtactcagtagtttgtacgtgagtttgttgtggaatagaacttctgatttgtattcgctggcgaatttagtggactctattgttcttccatttagttgtcatacacaggttgccatctatgatagcttgagtt

SEQ ID NO: 27482 - DNA, 476 bp, Sorghum bicolor
  Clone ID: 6859135
gcacgaggccaaaatattctacaccatctcactatggccatggctgaaccaaaccagcagtatgaagtcatcatcgcaggaggaggaatcgctggagtcactctagcgctgatgttcgagaaactcggcatcagctattttctcctagagggccgcgatactcttgagtctgatcgaggcgctggtattggtctgcagccaaatggactgcgtatccttgatcagcttggtctcgtggaggatattgaggatgctactattccgcttgagaagtggttctcttatgacagcgaggggaacttgatgaatgactctgacgcaatgggtcaatatcgcgacaagattggttatcctgttgcctttattgagcgccgcaagctgctgcccatcttggttcgtcgcattcagcgcacagaatgtgtcatgacttcagcacgcgttgcctcaattgaggagagtgaggatcatgtcactgt

SEQ ID NO: 27483 - DNA, 466 bp, Sorghum bicolor
  Clone ID: 6859142
gcacgaggctcagttagagccaacataccacgggccacggttctatagcttcacaccgaaaagcacttcccctctcagttttcgtcagttaagctttccccacttatatttgcttacttcactgtccttcaacaaatctgcaatctggttcagcttgtaagggcctcttcttcactctagcaaggaagcgaagaacagggaaacaaggacatggatgctttcagttcagtgatggacaaggtgaagagccacccagaagtgatggaaaaggtcagtgcagtgatggacaaggtgaagagccacccagaagtggtggaaaaggtcaaggacgaggtgaagagccttgctgatgctctccatctgcggagacatggcaaagataaagaacctgagtctgaagagaaggcagaagaaggcgaggtggcgcagagcgtcgatgagagtgcctctgctgacaagactgaag

SEQ ID NO: 27484 - DNA, 394 bp, Sorghum bicolor
  Clone ID: 6859150
gcacgaggcctcgcaggagcaagatctaattagcagaaacaccacatcccagtatcccacaggctgattaatcattcgaaattgaagactaatcagacgagcgcttagctaagtagcgcgcgatccttttttttcttgagcgtgcgagcgaaagagagtactgaggcgcgagaagagagatggcggcgctgaacggcggcaagacgttcgtgcaggacgaggagaagcagcagctgctcctggaggagcacacggagaagcacttcaccgccggcgaggtggtccgggacatcatcatcggcgtctccgatggcctcaccgtgcccttcgcgctcgcagcggggctgtccggcgccaacgcctcctccgcgctcgtgctcaccgcggggctcgc

SEQ ID NO: 27485 - DNA, 528 bp, Sorghum bicolor
  Clone ID: 6859154
gcacgaggaaacaatgaccatgttgcactatgtcacctgtagtcagtaaatgcaccctgttttatgatggttgcctgacagcctttaccacaggtaaagattagaaattgttgttgttattaagattatatctgaagtcccttatagaacctgtcatctaagatctaactagtggcccacaccatcaacaaggatagatgtctggtcatttctaataggtgattatactgccatgccctaattaatcgatatacttgctcacttaaaaactgggaagcactagtgttttactccctccagagtccagaccacatttccaccttgttctcttactgttccatgttgaaatgccaattttgtcaattccagattattgaaattgctattgtcttatagtgaagtccaggttttttcgaattttgacaatacaaagttcttccattggcaaacatggaatttgtagcatgcatgctcgcactgcagagataatatttgatgcatcagtatatcaatatataaaaaggagcc

SEQ ID NO: 27486 - DNA, 423 bp, Sorghum bicolor
  Clone ID: 6859159
gcacgagggaagagttgggtgtgggaaaggaagcaggtaagaaggaggacgtggaaccaaagagtgaagcagctccaggttctgataaagggggctcgcacttagaaactatgagctctgatgaggaaatcaaggtgcttgaaaatatgagtagtgccccctccaggaaggcgtcagttcaatcgaagctaccaactattccatcttgtgttgcatggagaactcgatcctcatgggggataaatcgagatagactatcatacaatacatattttgaggcattatctgatgagccgaaagaggatgacgatgatacagaggtggagcttgatgaagatgaggatggcaacaatgacgacggcagtagtgacgcttatgataaagatgacgaagagaaggaggaagaggaagaggaagaagagg

SEQ ID NO: 27487 - DNA, 458 bp, Sorghum bicolor
  Clone ID: 6859162
ccactctccaacagctcccctcatgaaccaagcactcaccgacctctacaacacagcgattcgtctgacgatgcccatcctccaggcccccgtcaaaccgctgccccagggtatcgaccttagcggtcagacagccattgtcaccggctccagcaatggaataggcacagagatcgtagcgcagctactcgagcgcaagatttccaccgtcatcctcgccgtccgcaacgtggccaagggcgaggctgcacgaaccgaagtgctctcccgcccaagtgtcaagaaggttgcctccaaggctgtggtcaaggtcatgaaactcgacgtcgaggaatactccagcgtgcagagcttcgccaagcagttcctcgccgagcactctgagctccacatcctcatcctgaacgccggcatcggcgtcctcaagcgcgacgtggtcgccagcaccggccacgaga

SEQ ID NO: 27488 - DNA, 473 bp, Sorghum bicolor
  Clone ID: 6859165
gcacgaggacggtaacgggtctgccaacggcgtcgcggatgcttcggacgatgcccctcgcgagaacatcttccttttcatccccaacattattggctacgcgcgcatcgtccttgctatcgcgtcactctactacatgcccctccatcctcgtacttgctcgttcctctacagcgtctcatgtctcctcgatgccctcgatggctacgccgcgcgtatctacgaacagtccactcgcttcggcgctgttctagacatggtcaccgatcgctgtactacagcctgtcttattgtcttcctctcttccgctttccctcgatgggccattgttttccagggtttgattgcccttgaccttgccagccactacatgcatatgtatgctactctggttgtctcaggcaccaacgccagccacaagagcattgatgagagcaagaactggctattgcgcctctactacaccaacaaga

SEQ ID NO: 27489 - DNA, 392 bp, Sorghum bicolor
  Clone ID: 6859166
gcacgaggctcgactctttcggttctcagactttgacattgccagaatgccagaaattccaaaggagcaatgggcacaggtcatcgagaagaccggtgggcccgtcgactacaaaaagattcccgtacagcagcccggcccagatgaggttcttgtcaacatcaagtactctggtgtctgccacactgatctccacgctgtgaacggcgactggcccttgccaaccaagctaccccttgtcggtggccacgagggtgccggtgtagtcgttgcgaagggcgaccttgtcactgatatcgagattggcgaccatgctggtgtcaagtggatcaacggaacctgcctcgcttgtgacttctgtcagcagtcagacgagcccttgtgctccaagg

SEQ ID NO: 27490 - DNA, 489 bp, Sorghum bicolor
  Clone ID: 6859183
gcacgaggcactagcgctgtcgtaccagagctcatttggaacccaccttaacaccccgaagctatataagtatgagtgggaaacagtccattctggttgtcggaggggggcaaggaattggcctcgaagccaccaaacacatcttgaagctctcctctcaggccaatgtcgttgtctttgggttcgacattgcgccagaagtatcatccctggccgatacaggccgtttggtcgcgatcagaggtgacgttacgaaagcgaaggatagagaggaggctgtgaccaagtgtctcgatcacatggggggtgtggatacgttgatttacacggcgggcatcgcgacgccaatacaacgtatcgacaacctgagccttgaggccatcaagaagacatttgatgtgaatgtttttggatgcatcgcaatgtgccagctttgtcttcctttacttcgggcttcgttcggtacaaacatcaccaacgcagcttatg

SEQ ID NO: 27491 - DNA, 473 bp, Sorghum bicolor
  Clone ID: 6859224
gcacgaggcttgtctttgatttcccttcactaagatacccggagagtcttgtctactcctccacccctctgcgagctccaagagagttacgcccacacttgcttctggcattcaaaggccacatagtctccgagagacccattacacacacacacacatacactcacaatggcgcgcagctcacggaatgcgagcaagcgctcgacatggtcaatcgccttctaccttctcctcgtcctcgtcggcggtctgatgctggctaagacagcacacgccgacgacactgaatccgcaaaggacgacaagtctatcaccggccccgtcattggtatcgatctgggaaccacgtactcttgcgttggtgtcatgaagaacggcaatgttgaaatcattgccaacgaccagggtaaccgtatcactccttcttgggtagccttcacagacgaggagcgccttgtcggagacgccgccaa

SEQ ID NO: 27492 - DNA, 312 bp, Sorghum bicolor
  Clone ID: 6859236
cgcgaccgcgcgagaggggccgcgccggcgcatcggctgctctttccttcactccaagagcagagcagtaaacacattccgggggcgtcccgcaatagaatacagcagcgggttgccgtcgccattggcgcggtgcgtgcgagcccgagccgtgcgacgcagcgcaggcagggaccggggagagagagagagagacgagaagcaagcgaagcgaaggaggggagctttttagcgagcgcggccgcggatcgcggaggctgtatatatagtcggagggcgcgcgctccggtccggtaacgtgacgtgctgcag

SEQ ID NO: 27493 - DNA, 525 bp, Sorghum bicolor
  Clone ID: 6859245
gcacgaggcagatacatagtgctcagcatcgactacaagacgcacaccgtcctggtctccgacgccgacatcgccgacgagtacgctgccggcggctgcccgcgcctccacatgaacctcaccatcgacaccgcctggctgtggctcgcgccctccagttccaacatcaccttcctctacagctgcaagaagaacattaccctgtcatctgccgtggagttgagtgggtgccaacaacaacaagatggcaacaataggtcgtacgtgctgccggatggtgggatcacgggtgctgaggcgtacgagttccagtgcgaggaggtggtggtggcgcaggtgctggatgctcacaagaaggcaatcgtgggcgcgcctggcaccccgcctccggggaatggatcgttccgtgaggtgctgcagggcgggttcgagctgaactacgacacccacaaccaccagtgcgaccggtgcgagggctccggcggatggtgcggctaccagcgcgacgacacgcacgccggcggc

SEQ ID NO: 27494 - DNA, 463 bp, Sorghum bicolor
  Clone ID: 6859256
gcacgaggcttacgcgcatattcgcccaacctcattctcgattcgagtcgcaccgacgtttccaacgccttctccttggctacgcgcctttgtgcttcccataaaaatcccctttaggaggcttgcctgtaaccactcacatccgccgcctccatgatgacctcggccattaggccttcgtcacaagtgtctatttcgggcagtggcaccactaccaccatggccgccagccagcttcaaccgttaacgtatgacgggggtgagctacgaatcgtccttgtgccaacatccgaagatggaaacgacgctccagaacatgacattggaggatcagaggtcgaccgccgtttttcgtccgacagttatagatcatatagagcgccgaaccaatccattccgacacatcctatcccgtccttacaggatgccttcgccgaatctctggacgaagtcacatccgaga

SEQ ID NO: 27495 - DNA, 496 bp, Sorghum bicolor
  Clone ID: 6859273
cgctcccgcactggctctggtacgtgctcatggcgcccatcgtgtgcctggagctcaagatctacggccagtggatctccggcgggcagcggcgcctgtcccgggtggccaacccgtccaaccacctctccatcgtcggcaacttcgtcggcgcgctgctgggcggcatcatggggctcaaggagggccccatgttcttcttctccgtcgggctggcgcactacatcgtgctgttcgtgacgctctaccagcggctgccgacgagcgagacgctgccccgggacctgcacccggtcttcttcctcttcgtggcggcgcccagcgtggcgtgcctggcgtgggcgcggatcaccggcgccttcggctacggctcccgcgtcgcctacttcatcgccatgttcctctacgcgtcgctggccgtgcgcatcaacctgttcagagggttcagcttctccctggcgtggtgggcgtacacgttcccgatgaccagcgccgc

SEQ ID NO: 27496 - DNA, 463 bp, Sorghum bicolor
  Clone ID: 6859275
ttcactatcgcttcttttgtacattcacttcgatttagttgaggatctcttgactttctttacttggataaaatacacctttcatttcacaatctattattcactcattagtcggcaatatgctcttctctctcgttcttcctactcttgttttccaagccagcctggcgctcggcgatacatccgttactgtcaacaccaacaagaaactccaggtcatcgatggattcggtgtctcagaggcctatggccacgccaagcaattccaaaatctcggtcccggaccacagaaagagggcctcgaccttctcttcaacactacaaccggcgcaggcttatccatcatccgaaacaagattggctgcgatgcctccaactccatcacgagcaccaacaccgataaccccaaggcgcaggctgtttaccatttcgacggcgatgatgatggacagatatggttcag

SEQ ID NO: 27497 - DNA, 461 bp, Sorghum bicolor
  Clone ID: 6859279
gcacgaggatcaacaccgacacaatgatgctccctactgctcccgttgtccccatggatttgggtgatgacttcaagttcggccctaccgttcttgaccccattcaaccggaggaccaagagaacctggtccccgtcaatggcttccccagtgttgatcccgctggtggtgatgttgccatgtcccagcttgatgttctggcacacttctttggaacctacagtggatttggcttcaacaccattttccggcccaatggaacaactactcctacacctctccctattctacctccatctcaggatcccaatgacaacatcctccagctcaaccttacatctgagtccctagcctttgctaaaggacgtctcgatgatgtacctaaccgtggccttgacacccaggctgatatcatgctcaacggtgtgccatacacccagacaattgctgatatcaccgag

SEQ ID NO: 27498 - DNA, 479 bp, Sorghum bicolor
  Clone ID: 6859280
gcacgagggtttgactctttcttttctggcggcatcagcggccggctgttcttcttgtccggctatccgttccagacttccaggacttcggattcggaggcgacgagatgatgcggcgctgcgtctcggagttggcccgccgccgccggccggatcgcacggttgatactatgaaggcaggattccaatgtttggtcaatgtttcctcttcaataagagccaccgacagccaaaggtgctcaagtacgtgtgctacttcctgtgctacggatccagatgttttatcgagagaaacatcatcatcatcagaaatgcttgttgattcatttgggaggttccacaattacttgaggatctccttgaccgagcgctgtaatctgaggtgccagtactgtatgcctgctgaaggagttgaactaacaccaaagtcggagcttctatcacatgatgagataattcgaatcgctgacctttttgtt

SEQ ID NO: 27499 - DNA, 506 bp, Sorghum bicolor
  Clone ID: 6859284
gcacgaggctcaactgtgtctttccttatccacccaacactccaccgcaacactccaccgtacggaccgaccagctgccggaccgtgagctttgagcatcggcttccaggtgggaggcgcatctagagaccaccatgtcaagttcgatctggaggcacatccggccccagtggagcctggggttctagcagcggaggggctgcgcgaagcgaggcaacgcgcagtggctggtggtgggggcggcgagggaagcgaggcggggacgcggggggtcggtggacgtctccgctgactcagtcggcgggagcgggaggtgcgaggcgcaggggagcttactctccgggcacgcaacggtcggcaccacggcggccgcgacggaggtcaacggcggcaggggcggggaccctggggccgcggcgaggcggcgctgggatctgccgtcggggaagtccatggcgtggttggaccccgtgaacttgccgtcggggaagtccagctgctgcagt

SEQ ID NO: 27500 - DNA, 455 bp, Sorghum bicolor
  Clone ID: 6859285
gcacgaggctgctccgcccgtcggcctctatcgctgctcctccccttcctctcccgcgggctctcccgcacgaatccgaatcagtaagctaatccagtccggcgacctaggtctctcagctcgcccgctggtcagtaatggcgcaggatgatccggttgtttctcctcagtggctgcacgagcacctaggaatgcctgatgtcaaggttttggatgcttcctggtacatgccggtagagaacagggatccatgggaagaatatcaggtggcacacatccctggtgcgctattcttcgacttagatggcatagttgatccgacaactgatttaccacacatgttgccatcagaagaggcttttgcagcagcaatctctgagctggatataaaaaaccaggataaagttattatttatgatggaaagggattcttcagtgcacctcgtgtttggtgg

SEQ ID NO: 27501 - DNA, 490 bp, Sorghum bicolor
  Clone ID: 6859294
ctaatattgcacccacagttgcgaggcaggccctccgcattgcttctcgccgttatccatcctccacattctcgcgcgtctcaccccgcgctgtcactgggttggctcatgctcgacgaagctatgtctccgagaccaagccctccaaggcgacaattaacgtggacacaaccatcaaggctgagcggaaggcgttcctagatcaaacaggtgaaagggcacaagatgcgacgatgccaacgaccggacttggggcagatgcgatgatgagcccgacagctggcatcctcaagcaagccacagtaatggaccagggctcccgtcccatttacttagacatgcaagccacaactccaatggacccccgtgtggtggatgcgatgctgccattcatgaccggcttgtatggcaacccgcattcgcggacacatgcctacgggtgggagaccgacaagggcgtagaagatgcccgagaacacattgccaacct

SEQ ID NO: 27502 - DNA, 414 bp, Sorghum bicolor
  Clone ID: 6859314
gcacgaggtgacacacaagagctttcttttttttcattgatgcttcttgtctgcggcattggaatgtgcgcttcccaactttaccatctttttctaatggggatcgcaatattatttgaatctacttaaaatgttgaattggaattgctcatgaagaatatgtttttatggtctttagctttcaaagtataaatcttttaactaatgttttaagttctatataaatgagcaaaaaatagtatagtatcgcatccaatatgttttaaagagatactttgatggcatcttctgttcatagaaggcttatgtactgtcctaatctccaaacaatgagaagtggcttctccattacatatattgcaaactcctatttagacatcttggatatgtatctgtttcataaaccgtgtgtgt

SEQ ID NO: 27503 - DNA, 445 bp, Sorghum bicolor
  Clone ID: 6859318
gcacgaggcaccctcttcccctcaatgccccatcgcgtcgtgcacgccactcctgccccacgtgcctccctgggttcgaaaccctagctccgtgctccagcggtgcgacgacgatggttgctgctccggcgctccggcaaagactgattgcggtttcattgcaagctctgaaccccttcagtccggtgcacagcggattaggctccaatggggaagtttccagcgaagtggatcaagaccacgctcttctggcggaagaagtcattgtcgaggtccggctccagcaaggccaaggatttattgttagcaggagtccaatgtgctgggaatttagaaacggttactttattctggaggtaatacttggagctgttattttttccctcattcaaattcagtatgtttgattttcaagatggcctgcttcttgtaatcaataacctta

SEQ ID NO: 27504 - DNA, 290 bp, Sorghum bicolor
  Clone ID: 6859325
gcacgaggctcctgtccaccacggcgtcggcggtggccaagcagttgtggtcgctcaaatcggccgccaccaagacggcgacggcggccgtggcggcgcggcccaaggtgcggtacgagggcgggtacgcggtggacacggtgttcgacggcagcaagctggggatcgagccgcacgccgtcgagatcacccccgccggcgacctcctcgtgctcgactccatcaacagcaacatctacagggtccagctgccgctgtcaccatatagcagaccaaagctccttgctggt

SEQ ID NO: 27505 - DNA, 553 bp, Sorghum bicolor
  Clone ID: 6859340
gcacgaggctccttctcatcatcaccctctctgctcccagcaattgctttctcgtgcgagaaggccggcgcgcaacatcggactctccttcacctgagacgccggatcgctgccgacaaggtttgacgagcgagctttctttacttgggccagtttcttcatctctcgactcttgcatccatcgcccgcatacacagtctcacacacatactacatccatccatccaacccactcttcccgactctcctgctccatcacaacaccatcacctacgactccctcctcagtcggcaccatctcttttccgacctctacaccttctgcacgccccaaaactccgttccagctcctggcgacctctcctcctccaccaccaccaatcttcacccgcgctgtcgcgacccccaatccagcccgccctcacagcacgctttctttcacggcccctcgctgtacataaaaaaagtcgcaaagataaatcgagatcaattgaacaaaatctccgcgtttcgtttgcgcgctcgtcgactgtgaagagcgcatatagccgtt

SEQ ID NO: 27506 - DNA, 438 bp, Sorghum bicolor
  Clone ID: 6859348
gcacgaggtataagatcaatatgcagctccaaatcctcagcgtattggcagcgctgccgactgcggcgctcgcggttttaacaaccactgtcacgtttcgggtccccgtatcgcaacgcttgccgaacccgtacgatctccccccttctacgcacgcaacgctctcctcgttccacaagagccaccgagctcccatttcgacggtcaacacattcgtcttccacaatgtgactaccgggtcatatctggttgatgtacactcgcccacgcacatgttcatgcctctgcgcctggacgtgctggctccggtcgaggacggtgtcagcgacgtggaaaacgcgctctcgctcaaggcatgggagacgtaccgtggtaatgactgggataacaagggcgaggctgcgacccttttgaacggcgatgtatttgatgtacggg

SEQ ID NO: 27507 - DNA, 511 bp, Sorghum bicolor
  Clone ID: 6859349
gcacgagggcagccaactccccatctgccttcacccgtcatagtccactttcacctcgaatcaccccttccactgcccatcatggccttccctaccccgcgcactttggcgacctccagcccctggctgaactcattgcccgcgccagcgaccctgtccacacttccttagtggcacaggagctggcggaatccgatggccctgtcacggctgctgctggcggtggtggcggtggtggctcggtcgcggagctatgggaccagttgtcggcggcggccgagggcccggcggccgaggtcgagaaggggcgggtgcccatgccccaggacgtggccattatgccagagaagagcgccgacaaccccacgccagacgatgtccaagtgcgcaaggctctcgaggactttggacacctgcgtgacatcaccgcaattgcagacctgtacatcgccatgtccaacatcaacaagcgcaccaagcgcggccacccggaagaataccgcatcaccga

SEQ ID NO: 27508 - DNA, 490 bp, Sorghum bicolor
  Clone ID: 6859351
gcacgagggcggttcagagctttcgactgggatttgtcgagagcaaaggttcctcctgccggccattcctcgaggatattgactttcttgagctgcgaagcctcttccagaatgtccagagaattgagatccacttctggattctccatgacatactgagggggagagacagctttttggacctttaccaaatgctcggaaagcggaaaactagtacatctcagtcatctgtctacagtgatagggtgtgggcaacttacgtctctcgcatcatcttctgcagggcaaggagggtatgccggctggactcgaagaaggatgaacgcgactcaaccatgatccatttacgtgccgggtcgaattggaattcttcgggtactgcaaagaacaagtcaatctctggtggattggtttcgagagcagaaagaggtcgcgcagccacagtggcaaggaagcactccgacggatctttgaacgcattgtccgctgg

SEQ ID NO: 27509 - DNA, 187 bp, Sorghum bicolor
  Clone ID: 6859369
gtgctgaagggggacgcgcgtgccgaaaagctcgtggtgtttgaaaaggtgctgcaggacgttatcaagtggcttgacataagcagcgggccgtatttcccagatgacgtgccctccaacgccgacgtccatgtgacaggaatgttgttgtgcatgttgcgcatgggcgggaaggagcatgatttga

SEQ ID NO: 27510 - DNA, 452 bp, Sorghum bicolor
  Clone ID: 6859376
tggcgctaagaagggctacaacggccagtacactattgagtgtgacaaacgcgcttctcttcccgatatcactttcaaccttgctggatccaactacagcctccccgccaccgactacatcctcgaggttcagggcagctgtatctctaccttccagggcatggacttccctgagcctgtaggacctcttgttattctcggtgatgctttcctccgacgatactactctgtctatgacctcggcaagaacgccgttggtctggctcgtgccaagtaagatacttgtgaaatattatgtatgaattacaatagcgaatggaacacgcagcatggacatggctttggatattcacatgggactagtttgaattgtatgacagaccatgagcgtgagtgatcgagaagatggcttctcgtacttgttgctcagtaatatgaatccttattaactt

SEQ ID NO: 27511 - DNA, 175 bp, Sorghum bicolor
  Clone ID: 6859384
gaatatgacggaggagaggaggatgttgaacaaaaaagatatttgatggatgtccgaaaatcccccaaaaaaagttgaatgggctttcgactttgacgagtcgagttgcccgcgtcggtgcttcttgttttttttgtttgaaacccgggatggagataattaatatttaataata

SEQ ID NO: 27512 - DNA, 508 bp, Sorghum bicolor
  Clone ID: 6859395
gtcgtacggtgtgaactacccggtctactacgtcattgccgacaccccgctcgagtttggcaagaatgtggatacgccgcttgtagtgaacaacaccctcgctccgaacgcctcgccatacgtcgtctggtcacccatcggcggcaagaatggcaccattgtcgtctcagatgccgacactggaggagtgtacaccaacacatacggtggagcgaccgacaagtgggaggtccacgagactggggccggtgcggtttacagccgtgccatccagatcttcaaaaacaagccagaccacctcatgatctacggcggtgacacatacgatggtctcagcctgaagtataatgtgccattctctgcgactgtggtcgacttgaacaaggtgcttaaggctcctgccttcggctacgcgaagttaacatgatgatgtgggatgatctgatctgaaattcgttgtacttatacgatcagtacattctagcgtacagatcacgttaactagatc

SEQ ID NO: 27513 - DNA, 560 bp, Sorghum bicolor
  Clone ID: 6859401
cggctcccgctattgacgagcctgagcaagctgcgacccctgctaagactcccaagaaggccactggcggtcgtaagcgcaagacagccacacctgctgccgccgctgaggaagccaaacctgcccctgctagccctgacaagaagcgacgacgcacatctaccaaggctgccgctgccgagccccaggaggagcctaagaagtcgggccgcaagaagactaagagctcttgagtgtccttcatcttttcttctctttcttgacaagcacttggtacgcttcagctttctttactctccgttgagctcccgtcgcaaatttactgcggggaagcatgatacctaaggagagtgctatatacatagggttctctaggcgttttgggggtgtctcttaatttgcttgtactcgttttcagacgggatgttggggcttaggggtggttaaaaccagggattcatcgatgatacggctggacatttggaggggttgctgagttgtatgatgtttatgttgtttggacgtgcacagcaatgccgtaatgatagcaatgatttatc

SEQ ID NO: 27514 - DNA, 202 bp, Sorghum bicolor
  Clone ID: 6859424
tcgaggataatttgtatgaacatttcagcatgcaatttggccccttaatgttgtgcttggaaaagcgaaaaaagtaacccaggttaaactgttgtccattgggtcccccatggaggaaatccaatggatggtagtgatggaacttgaaaaccctgtagtccggttcccgacttggtggaaggggctaaattcgattttctgg

SEQ ID NO: 27515 - DNA, 356 bp, Sorghum bicolor
  Clone ID: 6859445
gcacgaggcccactagtcatctacattgtcaattaccctctctcctctcatcagacgagtcctccatttcaccatggccatcctcaagcatgtcctcctcgccgtggccgccaccgcggtcagcgtccttgctggcccgctgtccaccgatggcacctcaacggctatcgtcgatgctcctcagtctgctgtgaccgaggtttcaaagccgcttgaaggaaaggagctcgaggacttcttggccaatgggccacacatccccgagggctccattgacatcaccaacacaacacttgccaccgagttgatgaagttccgcgaggctcatatcaatgagacctccttgaccaagagga

SEQ ID NO: 27516 - DNA, 435 bp, Sorghum bicolor
  Clone ID: 6859447
gcacgaggctcacttgacttttattatcactcgacatccaagaacacgtctgtcaggatacatggttccagccattttaaaggatcatgaaggcctcaaacgccgtaaacgctctttgcaggccccacgtcgtcctccacgaacacgtgcggaggaagaggcgcgtgaggcgcgtcgccgtgttgcagaagaagtgatgcgtgatgtctccttgggttggtacttggttgccgatggtacaaaatatggcttcagcgagactcaagagtatggcgcactcaacactatctatgttcctcctgatgatgatgagatacaccgttggaagaacccaactcgaccgattcgataccctttcattcctcctgtccctgcaactatgtctgtcgttctctcatccgctctcaaagctgtccactacctcaatcgatccaa

SEQ ID NO: 27517 - DNA, 424 bp, Sorghum bicolor
  Clone ID: 6859457
gcacgaggcccgtgtcccgtcccaccgcaccggcctcggcctcggcctccccctccctttctcgcggtcgcggcaccccacagctatcacccgacctcccaccgccgccaccaccgccgccgcgggcctgcttcggatccagaaatccagaaggacgcccgctcgatccgccgcagggcggcgcgcccgccaggctccatccccggatccgatcgcccgctgggtgggtggaatatcgttgtcttaattatactgaccttatcgtatggcattggagccgtgatgcctcatccatctctgaagctgtatagaattcattgcttggatcaatgttctgaagtgctgtctaacagtcagaaatggacggaaccgagcttgaaaatcctacttctaggagctcatcccagaaatctagccgacgttc

SEQ ID NO: 27518 - DNA, 461 bp, Sorghum bicolor
  Clone ID: 6859465
gcacgaggcaacggcaagcggaccctagcggtgaagagctccaccccaagctcctcgtccaccaagaagaagctcaacacaaagctcatacatggcatcatggaggccatgccacagctggcgccggctaccgtgcggtccgggtcgccaacggacatgcttcggaggtcctccatatcatccacacctcagccgctggcgaagctgaaggacatctgcctcgacgacgagatctccatggtgacgccgtccgtcggcaagctgaaggacatcgtcctggacagtgacgacaccacggaggacccctcgtgctccaactcgtccatggacgacggttgtggcaccgggacagcggagagcgcggcccggaagcacgggtgcggcaacgggaggctgatcaacatctgctttggcgcacagggactgaccgtggaggactcggcgagcgggcagcagacgag

SEQ ID NO: 27519 - DNA, 364 bp, Sorghum bicolor
  Clone ID: 6859472
cgcagacatcgcggttcacatggacaattgagaacttcaccaggttcaatgggaagaagcactattcagaggtttttgtcgttggcggattcaaatggcgtgtgctgattttccccaaggggaacaatgtggaccatttctcaatgtacttggatgttgctgactcagccaacctcccgtatggttggagccgctatgctcagtttagtcttgctgttgtaaaccagatccagccgaagtatacgatacgcaaagatacccaacatcaatttaatgctcgtgagagtgattggggtttcacatcttttatgcctttgagtgacctctatgatgcaagtagaggttaccttgtgaatgatactgt

SEQ ID NO: 27520 - DNA, 521 bp, Sorghum bicolor
  Clone ID: 6859486
gcacgaggcccgcggagtactacactgaaacaaacctctccgacctgcaactacaacgtgcagagaggcagagcagcccgggcaccccaccgcctggcggaggctctggcggagctggagcgggcgcgggcgcgcgccgccgagctgcagcggcacctcgagcagacctacggcaaacgagcgagaggacagaggaggcgagatcggcttccaggaacgcgcgaaggaaacagactccaccgcgcgtgaggtatggcgacggaatccgccgcgcggataactgcacgcgcggaacaaagttttagcaagttaaggattttggcaagtgtaaatagcaaattgttggagaacgttttttgcaacttttgccaaattttgtagtataccaaatagaatagcaaactcttggagatgctctagttgctcaattactagtatcagcttttctcgaattttgcttgtaaagagttttttttatcgggtaacacatcctgaattagactttagtctttggcaaatag

SEQ ID NO: 27521 - DNA, 481 bp, Sorghum bicolor
  Clone ID: 6859502
gcacgagggcccgtgctaagatcaaaggtcgcattgggcaaaaccactctgaacttgttgatgatgaagatcgaaggagccccccacctaaaaatgataatttgttaaccgagaatgaaaactctggagtaaaagagaatggaacctttgttgagtatgtgaaagtgaatgataaaatatcaagtgacactgcaatccgcatacctcaagatgattttactgaagagtacacatctgatgaggggtggcaagcggctgttccaaagggacgatccactggaagccgcagaactggtgcaggcacgaggaggccaaatctggcaaaaattaatactaattcactacacagtgagaatggaagatacaaaggaagaggtacatccaacttctcttcccctcgagtttcacctagtgaggctacagttcctatgggttctagtcctcttgcgaagaaattagcgaagagttcaagcttcaattc

SEQ ID NO: 27522 - DNA, 404 bp, Sorghum bicolor
  Clone ID: 6859509
gggaatggctggttgctgactgttgctctgatggagggaaccaacttggcagctaccaaatcatctggttactctgatccatatgttgtatttacatgcaatgggaagacaaagacaagttcgattaagtttcatacccttgagcctcagtggaatgaaatttttgaatttgatgccatggaagatcccccatcagtgatggaaatacatgtgtatgatttcgatggacccttcgacgaagttgcctcccttggtcatgctgaagtgaatttcttgaaatataataatatatccgagcttgctgacatttggattcctctgaaaggaaagctggctcaagcatgtcagtcaaaattgcatctaagaatcttcttaaacaatacaaggggtaatgaagttgtgaa

SEQ ID NO: 27523 - DNA, 429 bp, Sorghum bicolor
  Clone ID: 6859510
gcacgaggatttgcaacggcattgctctgcacagcccaggtctcattccatactgttcaacctatctcgctttctctgattacatgagagctgccatgagagtctcagccttgtctgaagctggagttatctatgttatgacccacgacagtatcggtgtcggagagaatggcccaacccatcagcccatcgagcacttgatgagcttccgaatgatgcccaacatgttggtgctccgtcctgcggatggcaatgagactgctggagcatacagagttgcggtccttaacaggaagaggccatctgttcttgctctctccaggcaaaaccttcctcagctgcctggtacctcgatcgagggtgttgagaagggtgggtacgtcatctccgacaactcaagcagcaacaagccagaccttattgtgttgg

SEQ ID NO: 27524 - DNA, 370 bp, Sorghum bicolor
  Clone ID: 6859517
gcacgaggcttcttccagccgctggacgaggcggaagtgcggctgcagcgcgccatacagcgctacgtggagcagctgcggcatgaccgagcgatggtggaaagggacgagcagtatgtgagcagtatgggcagcaaggacgtgcggcggcagcgaatgatcaacaacatagcgcgggccaggcgcgatattcagcacaaggaaaccgagctggccacgctgcgacggcagctgctcgagtcgagacagaggagagaggcggccgctgacatcgcagagccagtcgctcacagctcgtccatgccatcctaccacacctcacgggcagtgaaggcaaggccgcagacgagcggtgcgggcagtgccagca

SEQ ID NO: 27525 - DNA, 303 bp, Sorghum bicolor
  Clone ID: 6859520
gcacgaggcgacgtcctcggcttcgtccccatccgtcgcccgggctccttggacttacacggcgcatggctgttcaactacggcataggcgtccatctcctgcaagccgaggacccggcgagcatgccccccaagaagacggagatcaatcccaaggacaaccacatctgcttccagtgcgagagcatggaggcggtgcagcggcggctcaaggagctgggcatccggtacgtgcagcggcgcgtggaggagggcggcatctacgtggaccagctcttcttccacgaccccgacggctacatg

SEQ ID NO: 27526 - DNA, 354 bp, Sorghum bicolor
  Clone ID: 6859521
gcacgaggcggacgctgaccccatcgacgcattgaaggagctggagctcgggaacggccgggacgagtcatcggtgtccgatccggcgtccgccagcgcggagatggcgctcaaggggccttccgatggcaatgcaaagaaacgcaaggctagcggaaaggggaaaggcaaggacggccccgggtccaccgccgccaaggatctcgcgaaggaggaatccggtgggaagcggtgcaaatcggcggacgagagcaatggcgcggaggacaactccaccaagggcaaggccgcgcagagcaatagcgagaatggtggaaagaagcaggggaaggacagcacatcgaagcctcccga

SEQ ID NO: 27527 - DNA, 512 bp, Sorghum bicolor
  unsure (1)..(512): unsure at all n locations
  Clone ID: 6859527
gcacgaggatctccactccgccgcgccaaacaattaaacttctgccaagccatcttgatagtcgcccaagtgctcccaagacattgcgacctccaggcgcaccctgccagtctcaaactcgtcttggagccaataaacacggacaccagtcgacggcaggactcaagtcaactcattggaacactctggtgcttgtccatctctcttgccaagctcgctggctccacaaacagcctcagaatccgcgccgatcacacacagaggctcacccagaggctgacgcaacgaaacacgcaagtgtttacagtcttatcagtcacttaagcctccttcaccggaacgccgccggaccaataccaatccatatcaacaagcacagttctcccgccaagaccaagcctgcggacgcacctgcaacaccccgcgctacagccccaggccaatctcttatgctaagccgagtattccatagtcgagatacccgctagctccgcaagcggacactntagaag

SEQ ID NO: 27528 - DNA, 233 bp, Sorghum bicolor
  Clone ID: 6859536
gcacgagggcgccgcagccgtcgctgctgccgcggggtgccgctggcccgcccccgcgcggcggcggcctccctcggggcggggcagctccgggtcgggacggagcacgggtggctctgggactgccgcagcggcggcgcgagggattacgccagggagatggaggtggcggtgcgcatcgtgcaggtcgcctgcaccttgtgccagcgcgtgcaggactcgcttctccgccc

SEQ ID NO: 27529 - DNA, 347 bp, Sorghum bicolor
  Clone ID: 6859545
gcacgaggtctataacctcataaatttgaaactaaattgtaaattatacatagaggagcaaaaaataaaaatctttttaagatgtaaattggaccaattgaaatagttggagagagtgaattggaccaaatgcttgtttaaggggttatttggacatacaccaaacttaaggttagtaattgggacttttttcattcatttttaaatagagattttgtttgcatgaacaatgtgtgcaatattaataggtttcaactaaattatttcaaatttattgattaaaaattgtaaagtgaatagaaaataattggttaagtagggatccttctgtatactaattactgtta

SEQ ID NO: 27530 - DNA, 417 bp, Sorghum bicolor
  Clone ID: 6859555
gcacgaggggctattgttcccaccaagaagaacgacaaccccttcgtcgagagcgagaagcctgccgcccagggtggcctcctcttcatgctcttcctcgttggtgccttcgtcctctcgagccgctcgacccctgctattcctcgcgtttctgaggatgtcagggccgcctcggccactattctcgacaatgttctcaaggacgctggtgtcaactctcagtcggccagtctgcaagctgccccccacccatccggcactgctaattggggcaatgctatctccatgaatgacatggcgatggatggtgttgcaccttcgatgcttggtgagcttggtgaccagctgactcagccgactcaggagcagaccaacgagcagatcttctctctatcagctgctcagtataatggtgtc

SEQ ID NO: 27531 - DNA, 438 bp, Sorghum bicolor
  Clone ID: 6859556
gcacgagggaacagtgggccaacgaggatgagggggctgcggacgctgccgcggccgagacggccccgctgtacgaggcgccgggaggactccggtgcggtgtaaccgagaaccccgggtgggcgcccctcatattttatggcatacaacattacctgtcaatagctggttcacttgtctttgttcctttgatactggtacctacaatgggtggttctgatgaggatactgcaacagtcatctccaccatgttattagtctctggtcttactacaatactacatacttttttgggttctcggcttccattgattcaaggaagctcctttgtatatttggctccggcgttggtaattgcgaactctgaggagttcagaaatcttagtgacaataaattcaagcacataatgagggagctacagggggctatacttgttg

SEQ ID NO: 27532 - DNA, 443 bp, Sorghum bicolor
  Clone ID: 6859561
gcacgagggcgctttcgaatttatcctctcatttgcagaagatcccggtagtacccaggcagacaatcatggtttcctttcgcttgattgggtgcgtcttgagcgcacacatggtagcaaacactgtcggatcttacattccacgagatgttgtcgtcgatagagctgctgccgcatctgctactacggatcctcaaattactaccttcgttacctcgatacccgttccaactcctcaggttgcagctgtctcatcggctcttcaatcggaccccaatgtctcccttctactcaagggtcagccttttgttcaggccgccatcaccactgtggcttgcgaagtgcttaaattgatccttggaagcgctaaggtcgatactaagcctgtcgatacatctctggttgagctgaactggtcccagacctgctggaagactcctagt

SEQ ID NO: 27533 - DNA, 489 bp, Sorghum bicolor
  Clone ID: 6859576
gcacgagggctttcaaagattatattagcagcttaaaccttaatgttgatgtgctgagtgttgatgatgctatcaactttgcatcaaagcttttgttaccatctgaatcggatcttccttcagaaagtgaaaagattttcctgaataacatagaatctgcaaaacaaggcctgttgtctacatcaggctacttgaaatgtgttcagaataatttgcatgtgacagtctcttctttggtggcttctgctgtagtttggatgtcatgtttgcctagcaagttgaaccctgttattttacctttaatggctgccattaaaagagaacaggaggaagtacttcaagataaagctgctgatgcacttgctgagctcatatttagctgtgttggccgcaagcctggccccaatgacaagctaaccaagaatctctgcactctgacatgtactgatgctagtgagacacctcaagctgcaataatcaactcaatgc

SEQ ID NO: 27534 - DNA, 457 bp, Sorghum bicolor
  unsure (1)..(457): unsure at all n locations
  Clone ID: 6859585
ggcaagtgggtccagactctagagagaaacacccaaaattcgctagcaaaccaagtgggcggcgcggcgcggcaaatcagcgtgggcaaattggatgcggccacgcgggcaaacccttgcaccgtcctcgtgctgtcgtgtggttgccgcctgtgaccggcgttgccccggcggatagacgttgcattgttgcgcgtgggataggccacaacggccagcgggagtcagggcgtctggcaacagcagtacagcggtgctgagcattgtccacacaactgttagagatcggactttattcctggaggcatttgtctgaactttttggcaaatgagtgctggtggtgcttttggtggaaataggggggtgaggcctgtacctcctgaaaaaggtgtgttcccattggatcacttacatgagtgtgacttggagaagaaagactatcttgcctgcctgana

SEQ ID NO: 27535 - DNA, 486 bp, Sorghum bicolor
  Clone ID: 6859586
gcacgaggatcagaagcagcaaggtatgacagtttctgctggttccgttgacatgatcagccatcagttggtttcctaccatgagcttgttcgtgccaccaataattttagtgagagcaacttacttggatctgggagctttggaaaagtttacaagggtcaactaagcagtggtttgattgttgccataaaagttctagacatgcaacaagagcaggccataagaagcttcgatgccgagtgcagtgcactacgcatggcacgacaccgcaacctaatcaggatactcaatacatgctccaacttggactttcgggcactagttcttccctacatggcgaatggaagtttagagacacttctgcactgctctcaagagacaacacatcagctgggattccttgagagactaggcgtcatgctcgatgtggcattggcaatggagtatctgcactatgagcactgcaatgtggtcttgcactgtga

SEQ ID NO: 27536 - DNA, 245 bp, Sorghum bicolor
  Clone ID: 6859591
gcacgaggcagaaacacactcgcacaacacaacacgcgcgggtcacctgtagctggagctacaactagaagtgggacatggccttcaccggagacgccgacggtttcgccctcgacttcatccgcgagcacctgctcggcggcggcggcggccctagggatagcaccgtagaccccgacgacctcaccttcccggttccgccacctcaaccagaattcgagcccaccatgccgttcttgccgccg

SEQ ID NO: 27537 - DNA, 368 bp, Sorghum bicolor
  Clone ID: 6859596
gcacgaggaagagtttcaagcaatcgttctttcactttcatccacttattcttctgttaatggcatggagatgcctagccctgatgataacctaaagttcagtgatcatcggcctacaagtcaagaactgacatattcagctgaaaataatgctgataatggcaaagtaacatcgactggtgaaagcaaggttgaatccacttctcagactgagaacaatgttgctgggaatctgaagtccaccttgcaaacgattgtacatggaggtgttggctatcatatggtaaactgtggtttgatactgttgaagatgttatccgaatacgttgacatcagtaaatgtttaccatcactatctttggaggtgg

SEQ ID NO: 27538 - DNA, 452 bp, Sorghum bicolor
  Clone ID: 6859600
gcacgaggctgctgatcaccttgaactcagaatgcagtctatcgcctttttttatttcatcagctacttccttggcaggttcagtgataggatcagtgtgatgctataattcccgagagtcgtatgtgcacttgtgttcttgaccattgcttccaatttctagatgctttaggtacttgctaagatgatgatagaggcgttgactgtagtcactggtaacattagtgctataatatttatttgtatcaatatcaaatcttctttgagttattaatgaagcattatttatttttgagtttgtagtgtgttcaaattatgcattttctatattaatcgtaagattttgtcttaattgtgaatttgtgatgcatccctgttctcctattgctaagcaataacattatgatgttttgtacaggatatgatgcctggtaggacaccgtgcagcctgc

SEQ ID NO: 27539 - DNA, 302 bp, Sorghum bicolor
  Clone ID: 6859604
ttcggcacgaggccgcccgctacccaagctcgcaccatccaaccacctccggcccgccaaacccggaccagatctggtacgtgccgcccctcgatttggcgcgctcgatccggcctcgtgcagtcgtgctggagatatgccagactcgagctcaaatctggtagattccactgacgcgaggttgtagccacgaatcccgggcgccgcgatgcaggcccgtgtggcgtccatggaggacgtgaaggaggcgcggcaggcggcggggcaggggagggtgctgcccacggggatgctcaaggtgt

SEQ ID NO: 27540 - DNA, 405 bp, Sorghum bicolor
  Clone ID: 6859608
ttcgcttcgattcactcgttactgtccatattccacccgtgtgctctggaggaagacaaacggaaagcttgacattggtcacttccctcacagacgctacagaaccaacgatcgagtaaataaaagtgtgcctacgcattcctcgcgcccactcggtttctgtcacaaatccaaaatcaaaacaaaccaacgtgatctgctttagctagatccgttacctcgagaacctttggaatttattaattgaacaaagacgatcacaatgctttccaagaaccttatcccggttctcgcggccgttggccacgctgccgcccagacccccgttacctgcaccacgaccgccaccgtgaacagccccgcggacgccaccaaccttggctcctcttgcaacgctgtcaaggg

SEQ ID NO: 27541 - DNA, 420 bp, Sorghum bicolor
  Clone ID: 6859613
gcacgaggccgcggcgcagctcgagatagagcccgaccagctacggtcgccctctttctctctttggttttggtttctcgtttcaattcttcatcatgtcgggccgcaaattgggcggcggccgtgtcctaggcagcggcaggggccttgctcccccgacacctccgattacgaatgcgcctcgagtaggaagtccattggcagcctccgaaagcagcatctcgatagcttcatcgtcaatatcaccgcctgttagtggtatctcaccagatattccgggccaggacattggaaatagtatcagcgttggtgctcaagggaaaggccctgctgatggcgcacttgtctgcccaatatgcaacgaagaaatgatgacccttcttcaactcaaccgacatatcgacgacaaccaccaagaat

SEQ ID NO: 27542 - DNA, 325 bp, Sorghum bicolor
  Clone ID: 6859624
gcacgagggaagcttccaagtcatgtaactagggatgcaattgcatttgaccctcaagtgccaatggagaaggttgctaatgcaagtaaatcacatgtgaagattgtacatgctaatgatatgtccatggtgactgataagtccaaagatttgagacagccaagttcaatgctggaggcacagaaggcttcatcaggtggtatgtgaaactacttgatttatgagtgataactgttttagtttgtttacttttggcagatatgtttggaaagcagtccttttataccttttttttttgcctatgatggcagtgctttgatccgtg

SEQ ID NO: 27543 - DNA, 462 bp, Sorghum bicolor
  Clone ID: 6859632
gcacgaggcgtcaatgaggtcgtggcggcggtggcggcgacgtgggggcccatgaccgacggcgcgcgcgtcgaggcggcgcccaggctcgcgcaatggcgcgtcgaggcgctcccctgctacacctatcgcaagtcactccccttccgcatcggcctctggaactggtacctgtctgtggagagaaataacaagcaaacttgtgttaagctctttgcagagaatccaaattctcccaagaacggcccctcagccccaatagcttcctttatcaccaaacttctcatatctcttccacctaatcaacagaccatagtccacccagggattttcgacaaacagctgaaacacgacggttttgtgtgggcaatcgatagcactgtgacagggagatttgtgattgagatagagtttcttgacctgaaggtcgctgatccatctggtggcgaaccagcctcaatc

SEQ ID NO: 27544 - DNA, 452 bp, Sorghum bicolor
  Clone ID: 6859638
gtgctgcacacaagatttgcttcgtctcctgtcaaaccttgccgtgaagtaaggactccgaaacaaaaatgggtgccgacggtcatgctcctgcgcctctggcagcccctgcccctgcaccagcacctgcgctggtgcaaatcaatgcttgcctgaccccagctgaggtgtactggaagcttgtggaggccggcacgctgaagatgaagtcaagctggttcaagcttgccgtcggtggtctccttgccggcatgtacgtgtcgtttggcttcaccttctgctgctgcgccatcggtctgcttggcaacactatctatggtgccctcgctttccccactggactgcttctgattatcctttgcggtgctgagctttacaccggcaacacctgctacatgttcgccgcaaacatcgagcgcaaggcagcactgtggcaccacctcaagatcatt

SEQ ID NO: 27545 - DNA, 488 bp, Sorghum bicolor
  Clone ID: 6859642
gcacgaggtgatagaggacctcaactaatctggttcagagtcctggccctcgtattctcctccaatctgccttctgagttttggcttgcaatcttgtggtaccaagtacaacatctgtcctgcccaaaaagtcaaaatcttgtcctaatccaggaacggaagtactgcaagtctgcagctcttgtcgcctgcaggctgcagccctgcactcgtttatttctacttgttcttctcaaggaagcctcttccaaattcgtgttccagttcttgtttgcttcatcctagtttacatatttataggatgagtttggtgaacaaccccacatgatttggtgccgcattttgatttgttcattaaagaggaaagtccactaccggtccctaaacttgtgctgtcgtgtcatcccggtccctaaactcacaaatcgattatttaggtacctaaacggtcattttacgagtttaaggaccgggatgacacatctgaa

SEQ ID NO: 27546 - DNA, 416 bp, Sorghum bicolor
  Clone ID: 6859643
gcacgaggtaagacgaagacaagaaggcaagaagcacaaatagagcacgattgagtgcaaaccatcgtccaatcatggcttcgagttctaggagcacggtgtcttcgtttctcttggtggcactgctgctctgctgcagccgcatgagcagcgcggcgcggttgctggaggaggcgccgcccaaggaggaatacccccaccctgccgtgccggagctgccaaaaccagagctgccgccgcaccctaccgacgtcgtgccgcctgaggtgcctcacccagtgccggagcagccgaagcccgagcttccaccgcacccggccgtccccgagctgccgaagcctgaggtgcctcacacagtgccggagcagccgaaggccgagctgccaccgcacccggccgtccccgagctgccgaag

SEQ ID NO: 27547 - DNA, 481 bp, Sorghum bicolor
  Clone ID: 6859660
ctccggcaagcggcggccgcggccacggccacctgcagctcccccgtcgcagccaccctccacggcaagagttctccaagctccctcgcccatggccggctcagcttcagccacatgtcgctgcagacgacgcccgaccatcgccgacaccgagcagggtgggcggtgcgcgtgcttccgctgacggaggagaacgtggagaaggtgctggacgaggtgcggccgagcctgatggcggacggcggcaacgtggcgctgcacgagatcgacggcctcgtcgtcgtgctcaagctgcagggggcgtgcggctcctgcccgagctccaccatgacgctcaagatgggtatcgagacgcgcctccgcgacaagatccccgacatcctcgaggtcgagcagatcgtcgacaccgagaccggcctcgacctcaacgccgacaacgtcgagaaggtgcttgatgaaatcagaccatacctctccggca

SEQ ID NO: 27548 - DNA, 407 bp, Sorghum bicolor
  Clone ID: 6859665
gtcatcgagaaaggaaactacttcacgtcgagcgattacacggccgtcgaggcgccgtcgatggagcatctctatgagggcggagggttcgtcagcacgctcagcggaagcgcgctgctcctggcaggctcgacggtcggaggcggcacggcggtgaactggtcagcctgcatcaagacccctgacgacgttcgcgaggagtgggcgcgcaaccaggggctcccgttgttcgccaccgacgagtacgccgccgccatggacaaggtgttcgagcggctcggcgtgacggccgggtgcgcggaggaggggctccagaacaaagtcctccgcaagggatgcgagaagctcgggtacaaagtggagtcggtgtcgaggaactcgtcggaggggcactactgcggcagctg

SEQ ID NO: 27549 - DNA, 445 bp, Sorghum bicolor
  Clone ID: 6859678
gcacgaggctcaatcgcccaccagaaacaaaggaacaaagaaagaaaagactctcagaggtatccaatccctctctcttttctctctctcttcgacttttgtttcaggaacaaaagcttgaggatccttcttgtcttcctttcgtgatcttacggaaggttgtatgagaagattctctcgcgccagcgcaagccgtcaacctggactttgaagcccgagttcccgtgccctttagcatcttcccgtccacttataaggacaacgaagcagcacgccctcagactcaaatcaccactcacgaggaggttcaactaaccctccctcaaaagaagccagccggacgggagggtcaactctcttctttccccccaagcaccgacctagctcctcctcgcgtcgaacaacgctttgaagaagaggtccgtatcactcgtgaggaagaacg

SEQ ID NO: 27550 - DNA, 456 bp, Sorghum bicolor
  Clone ID: 6859686
gcacgagggcaggaccgactttccaaatcattactcttcttcttcttttgcctgcccatttcgaaaatccatagataaaaacaacttccctcctccttttgtgcaagaccttttactatcaagaggaacaaaggcgaccgtacgctccagagcccctccatcggaagtttcgcttcttgcagtccgttcgcacttgcggtctacctacgaacctggccttgcatcatcatcgctagagctgccctctggaattgcgtctgctgcaccctcctacacacacattgagaacaatggcggacacaatcgtagtgcccgaggtcgagcagacggctggaaatgtcgagttgaaggataacacggttatcgtggtcctcggagccagcggtgatctcgcgaagaagaagacgttcccagctctcttcggcctctacaggaacaacttcctccccagcgatg

SEQ ID NO: 27551 - DNA, 491 bp, Sorghum bicolor
  unsure (1)..(491): unsure at all n locations
  Clone ID: 6859687
cattggcggttcatcatgaacgcgcaagtttctttccttgatggcacctatacgctgattcacatccctctcaatctctactcgacactgctccagcccatcctccgcgtcctcctcccacagtctcagagcctgggaaacttgcgcgattcaccagagtacgagctacagggtctcacatctgatggtcaacatggctttctcaacatcagcatcaccccctcgagtgttcggtggtctgccactcgtcatgggcacagaatgtgtttgagcccgtcctgaagacgcttccgcgcgatattgccaaatccgtctcagtctccaaagactcgtacatgatcctctccgtcattagtgctggactggatgcgggcggccgtgtaatggagttgacctctccactggcactggctggtatccccatcttcttcattaccacatactactccgactntattctagtaccgaccaaagagcgcgacaacgttgcc

SEQ ID NO: 27552 - DNA, 456 bp, Sorghum bicolor
  Clone ID: 6859695
gcacgagggccagcgccctttcgccgcaagatatcccggccgatctccctgttgcgaacctcttgacaaaggcgcagtcgcatctgtcccgcggcgagaccagcgaagccctcgtgtactacgatgctgccatcgcccgcgacccgacgaactacctttccctctttaagcgggctaccgcatatctctcactcggccgaacctcgcaggcaactgacgatttcaacaaagtcctgtctctcaagcctggctttgagggagcccatcttcaactcgccaggcttcgtgctaaggctggagactgggatgccgcaaaggcccagtacggtcttgctggaaaagctcccaagtcggcggagtttgtcgaattagaagaggccaagctggcagctcatctagctgacatggctagcaagggcgggaagtgggaagagtgtgtcagccatgccggtactg

SEQ ID NO: 27553 - DNA, 463 bp, Sorghum bicolor
  Clone ID: 6859696
gcacgaggggcgcccggacccggagcgagcctgaggcgcgcgacaaagcgatggcctcgccggcggcggtgacgcggcacccttcccccaccgtccttgcctccggccctcgctactgccgccgcggacatccaccctcaaaagttggcttccgaagcttggcgccacggctaaaggtcaatgcactttttgggtggcctaagggagacacgtcaacacgtcaactgatccctcctgctgctgaatcatatacgctctcagggtcagccttagaggtgggtgcaaaaccacgtgaggtgtctatttctgttgcttcttctatcatggacattcctgctgcggattgggatgcctgtgcgtgtgatccagatgatcctgaaaactttaaccctttccttacttatgcattcctctcaagcttagaagaatcacattctgcagtaaaggaaactggctggttacc

SEQ ID NO: 27554 - DNA, 455 bp, Sorghum bicolor
  Clone ID: 6859699
ggccaatgccgcttccacaatcgtatcaccgttctgacgacacaaacaatgcttcatctcgggcattgtctgcgcaataccaagcacgaaacaacaaccaacaatctcatacaccatttataccagaaggcatatattttacaccattggcttccggtgcgcccatggaaaaccattattcacaacagatgccgtcaaattcatctcagctcgaaacctcgcaacccagtcaatatcgtaccactgccgagaccgttgctggtacaagctcagcctccgaacccaaatcagacatacgcccagacaggctccgaatagcgatcaaatggaatgagactcgtttcaaggcatggttgaagccagaggagtcctgccaaaccttttttgagacattccaaagcgaagcttccaagcgtagaaagacattgaatcgatcgacgacacgtatccttctc

SEQ ID NO: 27555 - DNA, 553 bp, Sorghum bicolor
  Clone ID: 6859701
gcacgaggcactgcttctcctcctcatcgcgcagaagctcagcaaagatggttgccgaagacttcgaagctgtgctcaagggcaaataccctggcaagtcgcacgcccgccgcgttgtcgacctcatccgcaagaaagaccccaacgccaacggcgttctctatctcgagggccgccacacgaagctcctcgaggacaacgactctcccgaacccttccgacagcgccgcttcttctactaccttaccggctgcaatctcgccgactgcttctttacctacgacatccaatcctccaagtccactctcttcatccccccgatcgaccctcatgatgtcatctggtccggcctgcccacgaccatcgacgacgccctcaagctatacgacgtggacgaggtgaagctcaccaccgaggtcaatgccacacttgcccacctcgcgggcacaaactccaactcgacaatctacgccatcaaggaccaggtgtcagaccacatcaccttcatcggctttgagaacaaggatttcgagctcctcaagcccgccatcga

SEQ ID NO: 27556 - DNA, 467 bp, Sorghum bicolor
  Clone ID: 6859706
gcacgagggcctgatgtgcggacttatgcgttgcttgtacagcggttggcggccgccctgcgtgttgctgaagcaatcatgataattgattatgtgtctcgcgcaggtgtttcttctatggatgaggttcctttcggagtcattgttcgctgtccaacctgcatgatagcagttgctgttgtgcagcctcaggatggaactcagattgtttcctgttccaagtgtcgatatcaatatgaattattttctggagacattgcaagcattgaatctgaagaagttagcatggatatttcagccctggagaaggccttgagatatattaatatgtggaaagaaggtcttccaactgctgtccactcgattgtgatccgcacaccttcaggaacagcacgtactcacagatttgctacccagactgtaaatcttcctgctcaagaaggagaaagggtaaccatttccttagc

SEQ ID NO: 27557 - DNA, 352 bp, Sorghum bicolor
  Clone ID: 6859710
gcacgagggtcagtctagatggatgattctatgcacctttgttttttatttttatgcgctccgggccatggcgctcatgaggcagtctggtatatatgacacagtccaccacctatgcgcgtgaggtgatagcattccctgctggtgtttgatgaactgatatgcacatattggcttcctttttagtcacttagggttgctacacatattggctttcttttccatatgattgaatgacaaacaagtaaattttctatgcagttttgaattaaactttctatctttgaagaacaacggtgatgcagtttttgatctagttttgatttaaaactttttatgcattgtgtgaata

SEQ ID NO: 27558 - DNA, 424 bp, Sorghum bicolor
  Clone ID: 6859715
gcacgaggctttaagctagcactgctggagctgcttcttgtctctcgcttttgaatttccatcttcttttctcccttctgcccttcccccctttttttgaccgacgcaagtttctctagggaatctcgtcacgtctccggatccctcctaacgtcctccaccaaacaagacctccgccatgtcttcgccgattgcgaacggttctcccgtcgcgtcccgcgactctcccacccccagcggcaaggagtctcctttcgttgagcgcaccaaccccatgggctccggaaacgcccagactgtcagctcgcgcgaccccaaggctgtcgcccaggctgccaacgacatgaagaacgtggtccgccgcaagctgaccggctatgtcggtttcgccaacctgcccaaccagtggcaccgcaagagtgtc

SEQ ID NO: 27559 - DNA, 458 bp, Sorghum bicolor
  Clone ID: 6859726
ttcagatattggtgtggaaaacagttcatacatttatctcaaacatgaatatgaaaaacaaaccaatggcgacctcagtggatatgatcttattttgaaggttgctgagagaagcactggagaaactgaatatatctatgttcacaagtgcttgatttcctccagatccacttactttaaggatttgttggttagtctcaacgatgtagatatggttgatggaaagtcattgattgaactcaaagactatcacttggataccatgaatattttcattagattcctctacactggtgacattattattcctgatactgtcgacactgaatgcttgcaagaattattgaacatttccaagatggatattgatcgttatgaaattattttatctgtctgcgatcaaaagagactctacttggatagctcaactgctgttttgaatcaactcaagcatgatt

SEQ ID NO: 27560 - DNA, 404 bp, Sorghum bicolor
  Clone ID: 6859728
gcacgaggcaccgacgagtgcttcaactgcgtgtaccagcgcgaggacgaggtgggcaaggtgggcgtgtcgctggcgcgggagctcatggcggtggccggcgacgcgctcaagaccaacatcaccacgctggggcccctggtgctgcccctgagcgagcagctcaagttcctcaagtccctcatgatgcgccgcgtgttccgcgtcaagggcgtgcgcccctacatcccggacttccgccgcgcgttcgagcacttctgcgtgcacgccggcggccgggcggtgctggaggaggtgcagcgcagcctgagcctgcaggacacggacatggagcccagcaagtgctccctccaccggttcggcaacaccagcagcagctcgctgtggtacgagctggcgtacgc

SEQ ID NO: 27561 - DNA, 446 bp, Sorghum bicolor
  Clone ID: 6859731
gcacgagggatcgataagcagcccagatgtcgcagcagcagcagaccgtcgttcccgctcccgcggtcgcgcaccccacccccgtcttcgatctgatgtactacgtcaagtccgccgtcgccggcggtctctgctgctccgtcacccacggcgccgtctgccccatcgacgtcgtcaagacccgcatgcagctggacccccagaagtacaacaagggcatgatctcggccttccgtcaggtcgtctcgaccgagggtgccggcgccttggccaccggtctgggtgccaccgcggccggttacttcgtccagggttggttcaagttcggcggtgtggagttcttcaaggtgaacatcgctcaggctgtcggcgagcgcgccgcgtgggagaaccgtaccggcatctacctggcctcgtccgccatggccgagttcatcgccgatctg

SEQ ID NO: 27562 - DNA, 494 bp, Sorghum bicolor
  Clone ID: 6859737
gcacgagggttcggcgagctgctcggcttcggcggcctggcctggcgcgccatggacctcgaccgcgacggcccggccccgttcgacgcgcagccgctgcagcacgcctgcgcctcgctgcacacctgggcgtgctgccgccgaccaactgcctgctgcgcgacgagccgttcacgcccatcggcgagcagtcgctgcgctggttctatcagcgcgagactgaccgcgacaccatgatctgccaccgcttcgaccccagccgcccgtgcaccacccacaactgcgtccgctcgccgcccgagtgggaggcccgcatccgcgagaacgcccaccgcacccagcccggctcggtgtgcccgtacccgctgcactttagccccgaccacgacacacccgcgccggcagcggccagcctgctgagcacctctaaacagctggaagagcgcctgacgcagctgcgccagcgatacgacaacgacaacaatgatgggcag

SEQ ID NO: 27563 - DNA, 690 bp, Sorghum bicolor
  Clone ID: 7217079
catgccccgtttggtaaccttttacgacaaaagtcttcttcctctagttctgcaaagtccgacaggagccaacttgtagacctggttgtggaagatcgccaggccgaagaagttgagcgtgtgcgtgcgcgcaaggaaggcggtccgggatggaatgaggttcctgcaaaacactttgtacacacgtaccccaaagagggcgagaccgaagaggtccgtgaaggattcaaccctgatgagcccgaggcccacaaccccgaatctgagcacaacctcaattatccatttgcagtggaaggacagagccaggaggagcagcgaaagcaagatatcaagccccacatcacgagcgaagccaatcactgggaaacacgcgaggtcagcgaccgtaatggagaagacgaggagcggctcagtccgtcatatggaagtttccgagacgagcggaatgcctggagccaggactgatgacgtagacaccggccgacttgtttcatttttatcgtgcatcaggacatggggaaaggtttatgtcaagtttgttaggttttctgttcgctttatacccgatgttaatttcggtgtacacgatacgcctcgagcggtggatttacggggcgcggcgtctgcaggatggttagttagtttcttgtcatggcatacacacaatactagagcttctgtcatgcc

SEQ ID NO: 27564 - DNA, 581 bp, Sorghum bicolor
  Clone ID: 7217081
accccgacgccatcaagcactacaccgaggccatccgcaggaaccccaccgaccatgtactgtacagcacccgcgccgcctgctacatgaagctcggcgagttcccctacgccaccaaggactgcgacaaggcgatcgagctcagccccaccttcgtcaaggcctacacgcgcaagggccactgccagttcttcatgaagcagtaccacaagtgcctggagacgtacgagcagggtctcaaggtggagcccaacaacgaggagctcaacgagggcctcaggcggacgatggaggccatcaacaagaggcaggagggcaccaacgaggccgacgacaaggaggccatggccgcggcggccaacgaccccgagctccagcgcatcctcggcgaccccatgatgaagaaggtcctctccgagctcggctccaacccggccgccgtgcaggcctacatgaaggaccccgtcatcatgaacaacatccagaagctcatcgccgccggcatcatcaaggtcaagtgagctcaacaccagtcataccaccacaacatcatcatcatccaacaccaaacaataaaaatc

SEQ ID NO: 27565 - DNA, 618 bp, Sorghum bicolor
  Clone ID: 7217087
gtcctaccccgaaaggtacacctgcatgcaggcactgatgaaccactgaatatcacatttatgagagcaccttcttctgcgcttctcaaaatagatgttcctctgatgttcattggagaggatgcctcgcctggtctcaggaaaggagcctacttcaacaccataaaacgaacggtcaagtatctgtgtcccgctgacatagtaccaccgtacattgaagtggatctaagtgagttggatgtaggacagaaattgttgatgcgcgatctgaaagttcatcctgcgttgaagctgcttcagtcaccagatcagcccatctgtaacattatcggatcaagggctccagaacagaagaagggaaaataacttgcttctttgtatgaactgttttgagcacaataaggttctctttttcttttggtttgtttttcatacctgagtgattcaggtgttacttgtcctactggtaggatgaattgtagccagagaaggaatgttttgagcaggcagatgctacagctagacgcacttgcaaaggttcccaaatatggtcttgtagtgttcacagaaacttatggtgcggcgagcattgttgaaaattaagtcatcattgtttgc

SEQ ID NO: 27566 - DNA, 553 bp, Sorghum bicolor
  Clone ID: 7217092
cgaagcacccgaacatgaaggagctgtgcaatgaagtgaaacagctaaaagagaactttgattcctttgagatcacccatgttcgtcgggagtggaatgctgaggcggatcgccaggcgaacattggtatcacgcgtgaaagtacaaaacatacctcatccctcaattctatttttcttttcttgttttcataaaaatcactggctacactacattgcaggtggcgccgtgtatgaggagcgtggtgacatctgatacatcagttaccagccttccacctttgttgagctgctagcctactctacagcaggagctgaggtggtggcttgccgtctagtaggcactatatattccaataaatttagcactagttggacctatttcatcatcaagcttccacggatgtctgatttctgtatccagatgaaggtgatccatgtttagagatggtttagaccttaaatattgagggatgcttactggtgtgagcttcggtccgtaacactatggggcatcagtttaatgtgaaactctgatttggaagcttgccctg

SEQ ID NO: 27567 - DNA, 626 bp, Sorghum bicolor
  Clone ID: 7217095
gggcggcggtgcaggcgctggcatcgcagcacacggtgctcaagagcatcgtcctgcgcgagccaggccaggtgaagcccgtgtcgccgtcccctcccccgtccacggggaagcgccgcgacggcagcggcggctacgaccacgacgacgtcgtcggcgacgagaacgacgggcaggtgatcctgtacgcggggcggctggacctgtcgctggagaaccagaacctgcggtcgctcctggacgggatgcactggcgagtgatggagctggagaaggtgtgcagcaggatgaagacgcagatgagcaagatgaagcaagccaggcgaggcggcggcggcggcggccgcaccgccaggtcgctccccaggatgtgttcttgatccagagctcgccctgccattagcgcttagcggtgatcgcaacactgtaccatagcgatgtacatacggctagaaatcaatcaaatgcggtgcaggtggcactggcagctagcatcccctgcatcttgtcccttttattttgtttttttgcttcagttttgcctagtatcctctgtgtatgatgtgtgtatcagttcttggtgattgcaatttgaaaagaagagctagctagcttcttgttctgcc

SEQ ID NO: 27568 - DNA, 616 bp, Sorghum bicolor
  Clone ID: 7217098
ccgtcttccccttccgcggcacatttaccgagaagacctccgagaaccctgatctgtatgggccattttggacatgcaccaccctgatttttgttgctgcatctattgctacttttgtcacctacctatcccacaaatggcacaagaaggaatggaactatgatatcaacttggttacctggtctgctggcttattctatggctacgtgacgtttgttcctcttcttttatatgttattctcaaatacttctcagcccctgctggtcttgtgcaattgtggtgcctatatggatactccctgttcatcttcattccagcatcgcttctgtctattgtgccaatagaaatattcagatgggtgattgctggcgttgctggtttcatgtctgctaccttcgttgctgtaaatctccgtgcgcacattgtaaattctggcgagcgatggttcctgatcgttgcagggatattcttgttgcagttggggcttgctgttttgctgaaactctatttcttcacgataactgtatagggttatttacatctttatgtgcttgtactagtcaggaatacacccaattttccatgtggaatcgcttccatgttgattgaacattg

SEQ ID NO: 27569 - DNA, 677 bp, Sorghum bicolor
  Clone ID: 7217106
gtactccacccagatgtgttggaaaaactccaggctgagatcgatgaatacaagaacacccacgacgaatatgacctggtttcactaagcaagctgcagtatcttcaggcttgtatcgatgagtctcttcgtctttatcctgttgtcccttcaggtgttccaagaatgactccaccggaaggaatgcagcttgatggtgtttacatacctggagataccattatacataatccttcttacactatgtatagagatgagcgttgctttgagaagccaaatgactttattcctgagcgatggaccactagaccagagctgatcaaggatgcatcggtctatgcaccattttcaactggccgtggcgtttgtgctggaaagcaacttggtttgatggagatgcgctatgttctcatggatattctctcacgatatgatattgctttcgcaccagggactaatccccaggctttcattgatggcttaagagattgttacactctagagctgccaagattagatatggttttcactccaagaactgaaggaaacatcaaagcataggccacagaatacctgttagttgagatcgctttgggagagattgaggaagagatgggtttgatagccatctccataaagccgagtaattgtgtagcattaactatagtatctggctc

SEQ ID NO: 27570 - DNA, 593 bp, Sorghum bicolor
  Clone ID: 7217112
caccccggcgcgccgcacctgccgctccgccgccgtcggggtcggcatcctccgccccgactggctccgccctggctccgtctacctcggccgccgtgacgccggtggattcgactgccacgtctgggccaaggccgactttatcacctactacgaggacgtcaagaccaagcgacctgtcaagtgggtcttctacacaggtaggatcgcgtacgtgatgagctttgaggtgggagcggtgctggaggacgcagcgtggcaggccccagagtactgcttcaccaaggacggtggtgggcttgccgatgccgccgagaccaccaccgagatctctgatggtgggcatcatggcagcagcagcttcatccccaggagcgtgctgtgactgtgaggactcatcttgcggccatgttaatgttatgttcccatcctggtcccccggtagagctttggtggcctttgggcatggaggtgaggtgtaaacagggtgtgtggtggctatgatttacatgccctcatgtaccactgcctcttgtgcggtaatgtttttacttttaaggagattaactctgctttttataaagcaattgtgc

SEQ ID NO: 27571 - DNA, 606 bp, Sorghum bicolor
  Clone ID: 7217114
aatcagggccatcagtcattcgaggagaccaacgggaatctccctcctcttcagaagctaacgaggaactgtcatccgaatctcttaatatggtcaagccacataagtgcgatagatgcccgaggtcttttgaaaagcgacatcaacttaatcgccatatccgatggcatgagaagcctgaaaaatgtcccaagtgcccttacactgctcaatataaaaaaggcattacaagacatgtctgggtccatcactcaaaatgggctgaaaacacgaactatccgtcaatccaagaaacgtgtaagatttgcaaaaccatcctacagagacccgactatgtgaaacgtcacatgaaagaagttcacaggggcattaagaggcagagaggtccaaggggatagattgcttcctgaaaggctgggatgaaagagttgtatcttttcattttattgtttttttttcttctctctttctctctctctttcttttctatgcacttttctctactgtctttttcatgttcattcgtctactttcaacatttgcatttctgaagcctagcatttgttttattttaagcatttctactattttatctcttcacgattc

SEQ ID NO: 27572 - DNA, 606 bp, Sorghum bicolor
  Clone ID: 7217117
ttcggcccggcattatgggtacgtacacatacgatgcaactgaggaatgagagagagggaatgaggctcccggataataggcgcctcgttccccttctcgcccacgaaaataaaaaggaatgtgggaacgtctggcctttttgatcaacttatgcaggaaccgttctctcgaacatgcacgttagcggagccgccaggccacttccaggtggagtgcttccgggaagctcgtagtcatgatgatttccaacaattgctcataccgcccgatgctgccaccggcctttctcctaggcccgattctcggtggcacctcgtcgcgatgtcgagctgcgacggcgcaggacacgaggcttctccagaacctctgtgcagcatcttgttgggaaggttaataatgattgagtgcaaagtcccctgactttgctgcctcatctcctacatgtcaaaacatggacgtgcggtcatactgcttcccacggccgtcctggggcccttacgtggcgatgcagctccgtcacgagaaagagaaatgtagaacgcattaacggcagagttttggtacacagtagaacaggtatatataatgtataacgcttgcgactg

SEQ ID NO: 27573 - DNA, 691 bp, Sorghum bicolor
  Clone ID: 7217120
gtaatatcagactatgcgacatgcgtacatcttcagaccaaaatcagcttctccaaaaactttaatgatgagaattccaacctcaacaagacagtgttcgccaactcactgctttcagtccacgatattaatatgaatctgagcaataactacacaatagctactagacattacttgtcagtccatctctgggatatgcgtaaacaaaatgaaccatcaaacaaattccttgtctatgaacctgtaataaataagctctcatacctctaccaaaataactaccttgaagacaaattttcactctcaattgataaagatggaaaatacatccttacaggagggtataacaacatgttccacgttattgatatcgaacagaagctcaatacgcagatagttattgatgataccaacgaaaagcttatgaacactaatgttattagaaaaatcaattcgaaaggttcatgtttctacaagaaagacgatcctagtttgaacaacatcaattttgacaaaaagattctccatcaagcctactcccccgttgataacttctctttattaatcctctataattgtatctactcttatagcggaaccataaaggaaagtgccagttcatctcaaaaaagagccgctaatagccacaactaagtttatttataatatcgaacttttataaccattattt

SEQ ID NO: 27574 - DNA, 583 bp, Sorghum bicolor
  Clone ID: 7217121
gattttatcaaaataaactgggaacatgaagttgaggactatgtcaagacgttcgaggtgaatactgcaggatattggtatacaagtctcgctttcatgaagcttctacatcttggaaacgagaaaaagaacgtcccacaaagaagccaagtcatagcgacgtgcagcactcttggatttggtcgcctcgcaccgacagctcgatttgcgtacggacaaagtaaggctgctagtactcatatgatgaagcaattggcaacatcattggtcccttatggtatcagagcaaatatccttgctcctggcctgtttatgactgatatgacgtctgtgatgacatcgacttcttatgatgttggcaagttagttcctgaaggacgcgccggtgatgatcaagatatcgctggaatgattctctatattacgtccaaggctggagcatatctaaatggaagcgttctggtatgcgatggaggaaggctaggcgttgtgccatcctcctactaaagcgagacaccaaaatctttgctctttggtcaaaaaatagtgacttctacttagctcgcacaagaaccttgtcttt

SEQ ID NO: 27575 - DNA, 216 bp, Sorghum bicolor
  Clone ID: 7217122
aaggagtggattcccctgtatgcaaacggggcataaaaacctggttttgtttttaatgtaaaaacccgtcaaacttcagtcctaatttattgccatttgcttaaaaaaaacaaactggaaatatttcccatggaaggaagtttttaaatgactccccctttgaattgtttggttgtacaaaaatggtgggttccctttacctttgggcccctttga

SEQ ID NO: 27576 - DNA, 655 bp, Sorghum bicolor
  Clone ID: 7217136
tgatctatgtctatttttataattatgcacttgaatgatcttgtttagccttttctttttggttgactaggaatgaaatcgatccaagtgctaagctgaaatggctgcccctaaatatggataaggacagctatgcattagtagctgtatgctacctaacccctttgttttttctttaagagatgacatatatggagcagtataagcaatattttagtattgctaatctactaagaatggtcattttacttgtatatcatttcaacttacaagccatactttcgtaatgccattaagattacacggtcaattgtatgtagtgctatccagagcctcgacaagattaaacattaagatcctagccgtaccgcctgatgagaaggtcgtgaccaaggggaaggcgaagaagaaaccgacaaaggatgtattcacaaaaaatatcgtatataaggaggttctgactgcataaaagaggatactttcaactataatttcaaccatctacaaatttcagcagcaaagagtcagacgttgtatcttgggcttgaaatatagagttatattttaattatcttttttgaagacttatgtaatattgttgttccaaacaacacgattgcaatatctttttaaactaatagtataacacatgctc

SEQ ID NO: 27577 - DNA, 510 bp, Sorghum bicolor
  Clone ID: 7217137
gtgctcaagaccgaaaatgagtttcggtatggctacaaagttgtggagaaagggaacataaggtctgctctgacgacaagcaatgtgattgaacttccaaagaaagacgagctcaaaactgtggttgacaaggtgaaggacttctttggcgatgtaactgctggcgccaaagaatcctttgcgcagataaccgggtctgctgtcagcaaagaggaagaggaagcagaaaacaaagagaagttccgctccaagaggcgaaagaagcagcggaagtcgaaggagggcctcaagacggagaaatgattcagtcactcagcacattgtcagacaagtaaagcatcgatcggctgtagtttcgctatccatgtcccagagctgctctgtaatttgtccagcttctaaatttttgcaaagagacaacgtgtaacttccttgcgactaacatgtgttttgccttctcactaaatttcacaaaatccggtgaaggggttaaggttactttctcattcc

SEQ ID NO: 27578 - DNA, 448 bp, Sorghum bicolor
  Clone ID: 7217141
actccagggtccgcatgctcaaaggggtggcccaggagataaattctgaagccaagttccagaataattttcttcatgaactgcaaatgacccttgcaaaagctcaggctggagtgaagaacaacatgcggaggttgaacaagagcatcatccagcagggctcaaaccatgttctccatgttgtcctctttgcactgttttgcttgttcgttgtctccctcttgtcaaagttctctagaagatagttcccgtcttcgatgggaaaatataggataccatgacttgtatgtagtctaaagaagaaaaatgctattgtacttctggctggccttgtatcctcagtctttttgtcgaaattggaaccaaaccagaaaaggaaacccaaagattagtctaacctcatccactgacccgtatgattggaactgttgggatttcagtttgccct

SEQ ID NO: 27579 - DNA, 386 bp, Sorghum bicolor
  Clone ID: 7217148
gcgtgcgacggcactaaggccattcccttccagccgtttgattgccccaagtgcaagggcaagggtggcatcggcaagcttgggccgtgcgaaacattcgagattcactacaagcaagcttgcccagtgtgcaatggcaagtgggtggtgcccaacgccaacttgggctcctgtggcaagtgcggcggcaagggcggctggggtctgtttggccctgaagatctcggtagcgtccatcagcgcagcgcttgtgatggatgccccggccaatgctttttttgaaaggtttccgctttgtcgtggccccccaagcattttttgaattttccgtcctgaaccccccatacccccaaaatgcaatgaatcccataaagtggcgatagccc

SEQ ID NO: 27580 - DNA, 685 bp, Sorghum bicolor
  Clone ID: 7217237
acgcccggccagttcgtcacgctgcagtgcgacgtgggcgacaagtacgccgcccgccgccactacaccgtcgtcagccggccgggcgacgaccacctggccatcgctgtgcgcgcggtgccgccggccagcgagggcgtgcccgccggcctggtgtccaacgccatcgccgaccgcgtgcaggtgggcgacgtcatgaagctgatggcgccgttcggcggcttcgagtccaaggccgccagcctggccgccgagggccggcccgtcgtgctgctcagcgccggcatcggcatcacgcccattcagtccttcctgcacgacttcagggaggccggctgcccgctggtcgtcagcgtccaccaggatcgcagcccgtcgtcgcatccgttccgcgactgccacgcgctcgcccaccgctccttcgttcgctacagcaccgtcgactccgacgacttccccatgggccacctgtgcgccgacgatctgcgccacgtgttcgacgagtgccgcatcgaccccaaggccgccgtcgccttctgctgcggccccgcctccttcatgctcgactgcagccgctacctcaagcagctcggcgtcacggccttccacgcggagttcttcggaccgcagctgtccacctcgctggagatctagacttcttcaattaaatatttcctttctcttc

SEQ ID NO: 27581 - DNA, 651 bp, Sorghum bicolor
  Clone ID: 7217239
gccacaagacatgctacaagattgaccgggcctttataggtggctgtggcgtcctcgcagccgccactatcgaccacccggtcggggaggtcgcatgcacttggtagtcgagcaatgtccaaattgcaacaacgatggactttttcttggtgaggaacggtaattaaccgatgaggatgagcaggaggaggatacatccacgggagcaacaacaactgccggggctagtttcgtcgttcaactgtgaggggtgtcggctctagggagactactacgttgatgagatgctgctgctggaaacttggatcgcaggggttatcgctatctggaattagttcttctctgctgtttagcaggtggtattcgtttctaccggcataactttctcacccttctcctgtccctgaaagagatctgatggttttggctggtagtgatatgtgctatacagacagtcaggttgaagacatacgagtccatggggttaaaagaggatcagtcgttgctaccggcttagacagaaacacgtattcttcccggtgcgccagttcagctgttctgggccattgttgacactatataaacaagccatctagcttcggttggtacaatgaagactgaggaataatagacaaacacttttaaaatact

SEQ ID NO: 27582 - DNA, 611 bp, Sorghum bicolor
  Clone ID: 7217258
atcaccgtcttcaaagccctctcggtcacagcaacgaagaagcaagcagatttcgacaaggacattctgtccggtctcaacaaagccggcttcaagaccgacgctggtcctgatgacgccggtctcttgctcaagtacttccagcgcggaggcggctactacatcgacgtcggcgcttcacaactcatcgccgatggcaagatcaaggtcaagcacggacaggagatcgagactgttctgccgcatggcttgagattcgcggatggctcggagcttcaggctgatgagattgtcttcgccacgggatatcagaacatgagaacgcagccgagggtcatgtttggcgatgcgattgcggacaaggtgaatgatgtctggggcttcaatgatgagggcgagatgaggactatttggcagaagagtggacatcctggattctggtaccatggtggtaacctggctatgtgccgatactactcgaagcatgttggcgctgcagatcaagggattggaagagggtctctatggttatgacgatatttgagtcaaggtcacaaacggaaattgtttatagcatttcatatagtcacgcaattgagtttcatcatttc

SEQ ID NO: 27583 - DNA, 442 bp, Sorghum bicolor
  Clone ID: 7217260
cgctaatgcaatttgtgtggcgtgttatgcatgcagggacccgaccggcgttgaggatcccggaggaagggggacgaatccttcggattccgcccgacaaaaaatgcgccgagtacaactaggggcgagccggaattccaaggggaagtagccggatgacatccggcgtttttgtggcgaaggcttcgcggcttccaatgcaagtcgtccgaaggttcaggttccggcagggccaaggccccgattgaaaggcgtgcttagagctcacaatttgaaattactcaagtgaccctatgaactgaaggcttatagtgatagaatatggtagcaatattatatcactgtcacaggtcatttttgtaatatacctagatcagcatcctcgcttttatataaaggggatgtaaatgctcatggcaaaaaaaagttaagatcatttatt

SEQ ID NO: 27584 - DNA, 640 bp, Sorghum bicolor
  Clone ID: 7217265
gtctcaccatcaaagatctatcggccttgcaatgtttacgtggcttggaatatctgaagatggtagagcataacactgatagattttgcaacggtgttttcattgtggagaaaaaggggtttgaaagccttaagagcctgtgcattgacgccccaaagcttccaaaaatgcaattcaaagaaggttccatgagaagcctaacatccctttacctcctttgtccaaattctcagctgccgtcaggaaccatcgagggcatctcacatcttgcaaatctcagtgaggtgatgctacacagttcaatggaaaaagcgtgggaaacagtagcaaatggacaccctaaccgcccgtgtgtgaagaggcaaccagctgaaccaattggcatcacagcagcataacttgtggagcaggttctgaactttacctttggtggacgcagttgtgtgtagttccatttcatttatcgataaggctgcatatatataggcatttatacaatgtaatgtaccataatattgttctctagcaaagctatttggttttgttggattttatgtagtgtacgtattatttgttggattttagctagattgcaaacataattccccataagtgtaatgtacgtatttgtttgattttt

SEQ ID NO: 27585 - DNA, 660 bp, Sorghum bicolor
  Clone ID: 7217270
agtgggtgatgcatccggcggaagaggaggctcaggtctgccaccatatcccatcccaacacccatcatacgccgatcatcaacaccatagccagccatcccagcacccatcgctgcacccattccagcacccatccctgcagccatcccagcacccatcccagcacccatccctgcagccctagtagtgtcattggcaccgacggaggccatcccattgcgtaagtaacgatcataagacgctccaattgcgtcgttatctctaagggaatggtatcctgccctgtcagtttcacgtggataatatccggtcatgtcttgtccaccacacacatctccgaagtcggggcgcgcgcgcttgagcggcggcgcggcggcggcggcctgctgcgccatggcggcggcgacggcctgctggttcatggcagcagccgcgctaccgaccgtctgggccgcggcgacggtcgccgcggggggcatccccgccgcggccgccgcggcggccaccatcgcctgctgctgctgccgcgcgtcggcgtacctccagtagttctcggcggccatggcgtctgcccgtgccgcgcggcgggcgtggtgaggtgagaggcgaggggagagctgcgtgcggctagggtttcggggcgcgcggctgcgttttgg

SEQ ID NO: 27586 - DNA, 678 bp, Sorghum bicolor
  Clone ID: 7217280
cgacgctgacagcaaggctgagatcagagaagaatgcccgccgccgctgaagttcaagccagggccttcgtcgtcagacccggaccatgacatccgcatgtccatcgccgacgttctgcaggccagcatggaagacgagctcttcgcagccagggagagcggcatccttgcaggtggcgccggcacatcaagacggtgtcccggcgagaacagcaaggggggacgcaacagccggcgcgcaccgcaggacgccatggacaccgcaccggcgatgaagcggttgccgcctgctgggcggtcgtgcttcagcagcaagagtgggaggggaagggattcagatcttccgatgtgagctcatcagagttgtttcagatttttacctaggatgcttagcttactgggcaggctttcttgtttgcttgcaagacggaatgtcgaatggaaaaaaagcagggaccgacatcatagtctgtgtgtcgtctggtgacaatgttcatcccaacatgtgatgccagggtccaatagttcgtctgcattgctcggtgaggcctcttcttctgcttctagttggtaggccttggatcatgttttttttgctcttccatcctacgtattacgaaggttacgaagacccacatccattatttcagttaacatgttgttactgtgaattcattc

SEQ ID NO: 27587 - DNA, 213 bp, Sorghum bicolor
  Clone ID: 7217282
ttcaggacctttcccagtgttagaaggctattctctactagtgagtccaagactcaggacccccacatcttcctattttccactgttcttcttgatcgcgtcatcaaagccttcgtggcactgtttgtccctgtatggttggttcttccaacaattatccttcaggcttcctccggaagtcttcccagatctatagttttcgccttcttcatt

SEQ ID NO: 27588 - DNA, 145 bp, Sorghum bicolor
  Clone ID: 7217283
aaataaatttcccatgatcaagaagtttaagccatttcaaaggcgctgaattgtaataagaaattgataatgcatcggaactaatttgatgcaagtactaaacttttttttaatacggtaaatagtattccagtcttttcaaatt

SEQ ID NO: 27589 - DNA, 183 bp, Sorghum bicolor
  Clone ID: 7217285
ctgttttttttggtaaagcatatgcatcccaaaaaaaaatatttccgaactaacatttttttaagggcaatgattaaccccaagctcattggggggcccttaactctaaaaatgaaaaaattgaatcacccttggcatctggttttgctaaaaaaaaaaacttcccttgttgattccactaaa

SEQ ID NO: 27590 - DNA, 679 bp, Sorghum bicolor
  Clone ID: 7217305
aggcaccgagttctatgttcaccataaagaactcgaatccgatggtttcaatagtcatgcactcatctatgccccggtcgtggttttctttcgtgatgataatggtcgaactgtggctccttcgaaagcctcagtcgttacctcggctgctgtcaatcgtggcgttgtctaccaacattttgagccctcatcgaatctagaacaacgaatcgaagatgtcatgcgagagcgaatgggtcgaatccttcgtctcttcgaggaatgtggtgatcgacatcttgttttaggtagttttggaacgggtgtgtttcaaaactcggtcaagacaatagcaaccatatgggccgacctgctagtcggtgattcagcacggttccagaaatcattcgaacaggtcatatttgccatcaaagaccaagcaaccttcgaagaattcaaagaggagtttggaaagcgcgtgcagacggtgtcagcagtgcctgtaaatagtccgcttggaactttggacatagactccgatccagatcaagattaagaatgtcatgcgttcatcatgttctgtcgtgtttgtgtatatctgtctttctatcgatttttaattgttgctacctgttctttcagttcttatgtttgttcttgcttgctgtccaatccaatgctgttgctagctgttcatcgc

SEQ ID NO: 27591 - DNA, 172 bp, Sorghum bicolor
  Clone ID: 7217319
gcacgaggctccaagctaccccgtgcagctcctccactccaccaccccgcgacgctaattaattccagctgcagcacctgggttggaggctagagcttgcaagcaccaccagcgaacaagtcgtggcgcgcatgtgggcggcctcttcatcccgcgtcccacagccaccggt

SEQ ID NO: 27592 - DNA, 403 bp, Sorghum bicolor
  Clone ID: 7217325
tgagggtcgctggcagactgtcatggtcctcgatcccgaggaccccgagcacaagcgacttattgagaagaagattcataaggaggagtatgagggccaagacctctggaaggatatggtcgctgctgaggagcgccgattggccgccaagaagcaagctgagagcaaggcttaaaaccaacatgttatctttttatgacgacaaaaagatctcatacagacaattactcgatacaaaataaccttcaaattcatcattaatcctacaccgagctcaagtcgccaaacgcaggaggaaagaaattgtatatctgtcactaacaaaccgatgtttcatgacccaatgatgtcgagatggaaaggaagtggctattatcaacagggacagtctttggaacaaaac

SEQ ID NO: 27593 - DNA, 475 bp, Sorghum bicolor
  Clone ID: 7217330
gcacgaggatttatcttctttaagtatatctattggagtagtagcgagttcagtcatggatacaaacctcttcaagttccttatggggatcattggtactattggcacttgcttcataatcaacagaattttgaaccgagtggtactttacaaatcatctaccgcacaaccttggggctggagtaaggaaatcgtgctcgtcactggtggtagtggcggtatcggctctgcaatggtccacaaattctcccgccgaaacatcagggttgtatcctttgacatacacccaccaagaagcactctctctacaaatgcacatttctacaaagtcgatgttacttcgccacacagcatacatgaagcaatggaccaagtccgtcgggacattggagatccgacggtcctgatcaataatgctggcatcgccttgggcaaagacattcttgcttgcactgcagaccagatacagcagatg

SEQ ID NO: 27594 - DNA, 547 bp, Sorghum bicolor
  Clone ID: 7217333
gcacgaggcacgccctgcccaccaccccgccgtcgcatcaccaccaccacactgccgtcacgacgacgactatcactacagctagcaaccagtattcaaacaaacgcatcctcgcctgccccacgccgcgactgctcactcagccccccgtctgcccgcgctcgtcatggcgcgtcccagaaaggacgtcaagttccagcaccaggtgcgcagtgccagcaatggacgcacccgcaggccttcacagagcatgtccgagttcagcgacccaggaagccctaccatcaaggaggaacctgcgcccccggcctccgaacaaccgcctcaatccgagtatgagaagaagaaggcaaacttcattacccgcaccatatggactctcgtcatgattgctgccttcttctgggccctcggcgcaggccacctctttataatcatcatggttaccgccgtacaatgcatatccttcaaggaggtcattgcaatcgcaaacgtgcccagcaaggcccgcagcttgcgcttcacaaagtctctaaactggtacttc

SEQ ID NO: 27595 - DNA, 483 bp, Sorghum bicolor
  Clone ID: 7217334
gaaatggaagaggtggtcatgaagaggtgttggttagcccgttattggggcttggctgtccaatatggcatctatccagatatctcaatgtcaaaacatgaatactggtcttcacttgcacctcttccgtttgagtatgtaacatcagctggacagagagctaagaatggttctgaaacagaaagtaatggtttggaagacgtagacaagcttgttcatgatttgactgttacagcaggggaaggcaacgtagaaaccatgcttgctgttgataaaggacttcaagaactagctttcctgaaggttgaggatgcggtactttttgcccttgcccaacaccatcgttctaatgttgctggagcagctgatccagatattaaatcatctggtgatgaaaaattcactgaagcatttgacttaagcaaggaggaagaagaagatgtacagttcaagcaggcttggctgatctatttctggaggagg

SEQ ID NO: 27596 - DNA, 380 bp, Sorghum bicolor
  Clone ID: 7217337
gcacgagggcggtgcataaaggatttggaggagagattttcaaaggtcaaattggtggtctcagaccccctagtttccttcaaagagacaattgaatgggaaggtgtcagtttagtggagagcttgaagaacccacatgagtttgttgagaggactactccaaatgggatgcgtactgtgcgagttcaggtcctgaggcttcccaatgctctgactaaggtccttgaggaaagtgagcacttgcttggtcaaataattgatgggaaaacagcaaaaagggatggtgttctcgatcctcgcctttctcaggaagatggtgattctgctgcaactctcagacagcggatgatcgatgccatagacagtgaattagacacaat

SEQ ID NO: 27597 - DNA, 483 bp, Sorghum bicolor
  Clone ID: 7217349
gcacgagggtcagaccaacccgcactagccatccccggtacatccttcgccatccggagcccgctgcacatgaagctcccagtgacgaccaagctctccttcaacgacgccggccgcatcacacaccaccgtgacctatgggatgccgcggacttgatcgccctcctcccaggtgtgcccctcgcgcagtggctcggcacccggctcgcgtcgcatgcaatctcagccgcctggcgcaccagccgggtcctgactgcgccgctggcgagattcctgccacacaccgcgggcgatgtcgagagcagtacgaacgcaaacgcaaacgcaaacgcgaagtaattgagggccaagaccgctgctaggaatgctgaggacactgctcagtgaatcatctcaactcagaacggcaaacgttaacgttatctggtgcatgcatgacgcaaccgcttctactgccccgttttctcgcaacgccccgcaatg

SEQ ID NO: 27598 - DNA, 531 bp, Sorghum bicolor
  Clone ID: 7217352
gcacgagggccattttcacctggcacggcgcgacggtggaactggatggggtgagcgagagcgagtactcgtctgacgagactccaatggtaatttacgtcaacacgcacgccattctggatgcccgtagggcaagggcgagggctgctgcagctcaggggggcgatatggaggcctcacagggacctagagtgattgttgtggggccaacagattccggaaaaagtactctctgcaagatgctccttagctgggctgccaaactgggctggaagcctacatatgtcgatttagatattggccaggggtctataacaatccctggatgtatttctgccacaccaattgagaaacctatagatatagttgatgggattcccttggaaatgccacttgtatacttctatggccactcaagtccaagtattaatgcggatgtttacaaagttcttatgaaggagctagctaaaacattggagaaacagttctctggcaatgctgaatctagggcagcaggaatggttatcaata

SEQ ID NO: 27599 - DNA, 445 bp, Sorghum bicolor
  Clone ID: 7217357
gcacgaggcaactccggtgtgatggtgatcgagccgtcggcgtgcacgttcgacgcgctgatccgggaccgccggaccatccggtcgtacaacggcggcgaccaggggttcctgaacgaggtgttcgtgtggtggcaccggctgccgcggtgggtgaactacctcaagaacttctgggcaaacaccaccggggagcgcgcgctcaaggagcggatgttccgggcggacccggccgaggtgtggtccatccactacctggggatgaagccatggacgtgctacagggactacgactgcaactggaacgtggcggaccagcgggtgtacgccagcgacgaggcgcacaggcgctggtggcaggtgtacgaccagatgggggagaccatgcgcgggccatgccgcctctccgagcggaggaaggtggagatcgcatgggacaggcacg

SEQ ID NO: 27600 - DNA, 535 bp, Sorghum bicolor
  Clone ID: 7217361
gcacgaggaagaagcgcaagcaagcgcaggctcaagctcaatccgaaaaccctcaaaaggtcgcaaaaaccacttccccctcgattccgacgcctcctcccgatggcacgaccacgcacttcgagcccaagaacctccataccgttgtatccgaagaagagctcgagatcaccatcgacacactcaattctctcgctcaataccccggcttgatcaaatcaaagctgtgcaaggacttgagagttgctgtttacgacttcaggcaagcttgcaccactggtgtcaacaatgctgctggcgcgaacctcacggcgcaggtcactgctgctcttgcagatcggaaatacaccgaagctcgaattcttctcgccgagatgaagattcgtggtgaacagcccaagcttggtgctctatgtcgatgggttcgagatcttgatgtcatcagcggcctgtcgacaattcctgatcagcaaggccttgtcaagcgctctgagagggaagagacactcatcaaggtcattgatgctgtacttcg

SEQ ID NO: 27601 - DNA, 340 bp, Sorghum bicolor
  Clone ID: 7217365
tttaaaaccttattatggatttatatggtgtgctcttatggagtataagtagcagccaagtgggcacaaaaaagtgtccgttttggtttagctgtaaaatagtagtactagcaaatagagaaccctcaagtttgactttattgcaaagatatatgtgtatgttgttttcaagaaaaataaagtttgaactgggcagtcactgtcggttattcctggtttaacaggttggccctcaatgctgcctgccgttcatcaagaagtaacctgtaatctgccgttcagcaaggcatgtctgtcctggctgacgaacattctcttttagaaataaatatgcttttat

SEQ ID NO: 27602 - DNA, 391 bp, Sorghum bicolor
  Clone ID: 7217371
gcacgagggagcggccagcttcatccatgggtttccgtcaacagcagccttcgccatcaaacgtcggctatcctcacgatgaatttgaggaggaggaggagcagcctgatccccgtctcattagacgtgcctctcgctctaagaggcctcaacagaatgaccaggatcgccggcgtatgcctcctcctgacagcatcccacgacccaagtctgcaatgccccctccaaccactccattccgcccccctccccagtcattgacaaggcaaaagacaatgactccctcgcggccaccgccttcgggccgtatccgagttgggtttgttgaccaaggctatgatgatgaagactacaatgacagtcctggcctgtttgcggactctcctgaagc

SEQ ID NO: 27603 - DNA, 237 bp, Sorghum bicolor
  Clone ID: 7217376
gcacgaggaaatcgcacgcctcgggtccctccactcgacgcttctcccgctcctaacccctagtgaccttcttcccccactcgttcgctccgccgacgccgcgacgtccagcggccagatccgcgcagcaggggtgtcctccgccgcggatcgacctcccgatccgcgcagggggagtggcggcgggcgccggagcgctccgccggggacttcgtgaggctggagacggaggaggaa

SEQ ID NO: 27604 - DNA, 561 bp, Sorghum bicolor
  Clone ID: 7217378
gcacgagggagcagcgcaggcagccggtagtcggacccttctaatatcgagacgaccatcctccacaccagatatgttggcccctcgcttgccttcctgctgttcaaaacggagatcatgtaccttgatttaagctattttgttatctgtacgaggtttcctatagcaactggcgagtggcaacatgtcggccatgccgttaatggagttgcggcgaagtgtactagatggattctgagtaggcgtcgctatctggtttcagttttagtcatatacgagaatctgataatatgcaaatatcttttttgcattgagttcaactaaagaatcttagtattttgtattttattcatgtgctgcaaatgtcagaattccttttatttgtgaactgaggtactatagaattctattctatatacaactcaaattagcacggccaaaagttcagatgggagaagagtaactatcctggtttgctctgaatgttctgaatttcaatccatgactatgatgaataactgagctaggtatcagtactcacttttcgggtctgtattttaa

SEQ ID NO: 27605 - DNA, 373 bp, Sorghum bicolor
  Clone ID: 7217385
gcacgagggtcatattactactactacaacagatcaagaaaactctcttgctattagtgcaggtgaattatatgagattgtgaaagatgtgaaattattagatcaaccttcttcattaatactattgagagagtcacaacaatcacaagaatcattgtctagtccgtttattagaatgactgctactcctcatggtctggataatgaccaattggactttcttgctgttttgtgtactcttgttaaaatcttgtttgttgaaggtggtaatcttcctcttattcactctctcgttcaacgtatcgaacctgctcgtgctggacgagagatccacacgacatctattagaaacgaacatgcatattattgttgt

SEQ ID NO: 27606 - DNA, 581 bp, Sorghum bicolor
  unsure (1)..(581): unsure at all n locations
  Clone ID: 7217386
gcacgaggcaggcataactgttggacagttagcactagtcaatggcatgtgaaaagattaaaataaaatggccatacggcatatctagtacggacactaatactacatacgaactacttctgtaaatttgatttgtgtgcaatttaaaaccttttgaatctcgagtgtaaatttgtctgctaatgaaagcttaaatgttatgcaataccagttcctgttcttagccctccagctgcacatactcataacagcagccacaatctagggatgctcatatccaacaaagttgggctgtagcacaccatgtaaaacacgaagtgtatcattacatttctttgaagttatgctggtagttgcttgtttcttgtccataataacgcagtgtctgattgttccagctctcttccaaatgtgacaataagctctttcgtattcaattctctacacttcacatgcaaagatatcctttcctggaagcatattccaaaccgattcgttgtatatctcgaagccgcactgtccaccccttgngtcctgnaaagcgggcgagttctgcaacagtagatgaaactgacttgctc

SEQ ID NO: 27607 - DNA, 602 bp, Sorghum bicolor
  Clone ID: 7217390
gcacgaggagattgaactacagagtttcattttggttgatctgcatttgaattgggctgtctgcatcaattgtgaaactcgtggccgtggatcagtattgcttgttgcgttcgatgttttaggtgtctagattcgagtccttgcgtctttttagggtatttggattcagctgaagaaggccgtcggcctcacaggatggcattgactggtaattcgctgcttccaccttgcaattgccgattttttaatcccagatcttgtcttgctgcaatgtgaattgcttttctggttgttaattttgggttttagttgctctagagtttcgatcaggtccatgtttggaggatttaccctaatttagctcggattgctaatctggattagtttattgaatgaagttcagatcgatttcgttttcttttcctttttctttcttctaattctgggtttaagttattactgcactgtaccttgcagtttgattcagcattggactgttcctaatttctctccatctaggttgcaatattggcattaaatttattcccaagattgtcttatctcaatttttctgttcaaactttccccagctacttgcagtt

SEQ ID NO: 27608 - DNA, 629 bp, Sorghum bicolor
  Clone ID: 7217391
gcacgaggctgttttttttgcagcggaaagtttttgaattgcttcaagagcaagattgaacctgattcaagacgatctggtccttaaaacttccgtcggtggacagtgacaagccttgaacgttcaagagtctcgccgttcttccggaccgcgacactgcgaaccaacatctctccaatatgtcagaagattatgccaataaccccgaatgggccgatgtaacccccatcgaactggatgatggctctgagtcgggtgctatgcctctggcgacgattgcctacccatccgactatctcgaagcaacttcctatctgcgcgcggtgatggccgccaacgagatgtctgaacgagctctcaagttgaccaaagatgtgatctcgatgaatccagcacactacaccgtctggacctttcgtgccaaaatcctgttcgccctggacaaggaccttctcgaggaacttgaatggttgaacggagtctctctgaaatatctcaagaattatcaaatctggcaccatcgccaagtcctaatctcatcacagaaacatttccctacaatgcccgccaaagagcccgaatttctcatggagatgtttactcaagattccaaaaactatcacgtctgg

SEQ ID NO: 27609 - DNA, 479 bp, Sorghum bicolor
  Clone ID: 7217397
cctgatggatcagatgtagtgtttttgtttggtgagatagattgtcgagaaggaatactacttgcagtagagaaatgcagatacgattcagtagaagaaggaatatgccacacagtggatatcttcttgacccttttagacactattattaaaacgaaaaagattcgtgcattcattcatcctgtggtacctgtattaaacgaaacgagattgatggtgaagcatttcaacatggtgtttgaacgtaaagttagatagagaaagaatatgaaatggttagattttttcaatcatttgttgacggaagatggtaccaatttgaatcctgagtttgaactggatggtactcatatgaatcctaaatatttacgtcacttggagaactctttgaatgctcttgagaaggatgaagagactactgaatcacaataacttcttgttatttacactgatacaataataaatgaaactgtgttttc

SEQ ID NO: 27610 - DNA, 460 bp, Sorghum bicolor
  Clone ID: 7217414
gacatccgcaagtcgatcgctcgtgtcctgaccgtcatcaacgccaagcaaagggcccagctccgtctcttctacaagaacaagaagtacgcccctctcgacctccgacccaagcagacccgtgccatccgccgccgcctatcacccgatgagaagtctcgcgttctcgagaagaccaagaagcgcactgtccacttccctcagcgcaagttcgccatcaaggcttaagttaaaaatgcttgtagttcttggcgtgtgacggacactgggtagaaaggaaacggggtatggagggcgcggcgtgctttttctttgaacacaagacttcgaaatctgcatcgcatggctcagggaatctcggtctgacttgtacttatttcccggtttgggcctcgatctgggacgggttatgtccacgagaggctgcccggaggcagtcttaaaaaacaaaaatgaggtc

SEQ ID NO: 27611 - DNA, 479 bp, Sorghum bicolor
  Clone ID: 7217427
gcacgagggctttgacctcgaagctgctcatttccaagcatcagcaggttcaactgcttgaggctgcttccgttctggtaaccatgaacggcgttgaaaacagcgctgacactccccccgagtccaccaaggacttccagagtgaagctggttcatcctcgcctgctgcgtctggatactccgatcccgcggagcgacaaagctctgccgacactaccccacctccgtttgctgaaggggtcaatgttgacggcacttcgtaccgaaacaagcgcttcagcagcaatggcggatacgcgaccagcttccagtctgcttcggctgcctccttcggagcaggaagtatgccgtacggttcaggatttggtcactaccgccagccaagccatgaacaccgcccaggatcttccgggcgtaacgctacaggcgaagacgatcgggacctggctgctgctgttgagcttctgagctgcagtttt

SEQ ID NO: 27612 - DNA, 357 bp, Sorghum bicolor
  Clone ID: 7217439
gcacgaggctcgttgccgtccaaattataccccatttagctttttgtgaagtgacaattgcatctggctcaccccgacatctcaaaacaccccaccttaagagacaaatctcttaatttttttttttcctgtcgcatctgacacacagcaacactaccaacgacaaaatgcccggcgttgatgcaactatcactacagatgacaccataattctgggtcaggatcctttgatccccccggctctgttgatctctgagatccccatgaccgccactgccgtcgagaccattctcaagggccgaacagatgctgccaatatcgtgatgggccaggacgacagactactggttgtcgtcg

SEQ ID NO: 27613 - DNA, 372 bp, Sorghum bicolor
  Clone ID: 7217441
gcacgaggggttaatatattttattaagatttgtatgcattttttgtcaatttacattgggcaagtactcctgcatagaaatctgagcacttttgttttctaaaaaaataaaatatgtctgtgcactattcttctgaaagacaattcttcttggatgaagtagcattgcagaaatctcatatgtgattcagctagatattatgcactacatgtcagctatgaataggctttagcgttttgtaggattgtgcttctttctaatgaagaagaaagtgacatagaaatgttaccgtccgccagcgctcaagctattgatggtaagatgacgcatgctcaagcactttttgtggcaggtaggctaatataatttgg

SEQ ID NO: 27614 - DNA, 132 bp, Sorghum bicolor
  Clone ID: 7217447
gcacgaggaacaaacctgggcagggcgctcatccgattgacaagctcattaacgacggcggaaaacgatacaaagatatcctctacagagaatcgcataccctccaagaggcagcccaagcgtaccgtaaac

SEQ ID NO: 27615 - DNA, 436 bp, Sorghum bicolor
  unsure (1)..(436): unsure at all n locations
  Clone ID: 7217449
gcacgaggggcaggcacacagagcgatcgagcgagcccgagccgtgccaaacaaggaccacccacccacccactaccagccccgcttcctctctgtctctccaccgctcgcgcgcggcgggcggcgtggctccgagggcgggaagcgcgggctcggcggggcgactcgccggcggcgacctgcaggtttgggtatgagaggggtcacccacgcggcgcccaccggaagcgccccctgcccactccgcggacgactcgtcatggacggcctcctcatcttcgtcttctacctctcgctgcctatacgtggcggccgcgaccactcgttaatctctaattgttagccgccgcccggtcggcacgccatcggtcggcccgcacccccgaagctctgcgctctcgttcgtctcgtgtctacggtctacgcacgccgncac

SEQ ID NO: 27616 - DNA, 425 bp, Sorghum bicolor
  Clone ID: 7217450
gcacgaggattcccatcagtgtcgtggctgattcgtacaaggcgagccacttcaccatgtacccggattcgcgcaaggctgttgcctatggcgagtttagaaagccctttggaggagacaagagcgacaatcgttttgtcttctacggtatccggtacctcgttgagaacttcctctgccgtaagtggaccaaagaggatgtggaaaaagccgacctcttctacagcacccataacgctggccacacgcccttccccttccccaagcacctgttcaacaagtttgtggaggaaaacaacggctacttcccggtcaagttgcaggctctcccggaaggcacttgtgctcacatccatgttcccgtctaccaaattacggccgagaaggagtacacgcacctcttgacctacttcgagacccttctc

SEQ ID NO: 27617 - DNA, 454 bp, Sorghum bicolor
  Clone ID: 7217487
cagatgcggtaacaccttgtttcagtactagaacatctatctatctagaagaggttgtctctcgtctggccgtcctcattagaattaagagcctcttacatgcttttcattaggagtaagtttaatcaattttagtgctaaggcataaattgagtaacctgtgaagaccagcccatcctggatgaaatgcagcatgacagataggctttccaaatactgctggctttgttattgttcactgcaaggaatgctatagttgtcatatgcatgaagttagctttgtagcctgggttttgttgtggcttgcctgggattattagtgtttacatgatgctagttttataaagttatactgttgcccttgtgattgagcagatatcagatatttgatatttctgtttaactactcatagctaccttttagctaatgatacaaatgcaattattgaccttt

SEQ ID NO: 27618 - DNA, 488 bp, Sorghum bicolor
  Clone ID: 7217491
gcacgaggctgcggcagcctgcctgtcagttgcttcggaggagtgcattagatttcagaagccggacaattcgccccgcagcacgcgcttttcatgcttcgacaccacggcaggacccgctcattgatacaattctctacctgccacatgagctaatatcggtaatccacaccactgtcccctggtatgctgccatacccctcagcgcattcgtagctcgcggtctgctcgtcaccactgccgggacgcgtgcgcgtgcgctcatggcacgatacattggtttacaccctctccgccaagcacttgcattccaaaaacgagacgagatcttgaagcgcggcaacttccggtcgaccaaacaagctttggtcacagtgaaaaaggaagtaaaagacgtgacctcggcattagacaaaaggtggaatgtgagcctttcaggtcaaatcagctggacattggcgcaaatacccatcttcttcgctatggcc

SEQ ID NO: 27619 - DNA, 528 bp, Sorghum bicolor
  Clone ID: 7217492
cacgaggcgatactcctcgttgtctccctcaggctactgcacagattctgactccgggttcaaggacgcaagggagcaccatggcactcccgtcttggatctgccaaggctcaggatttgcagcaagccgtcagagctagcgccactggcaccatgacgcaccttgcctggaactgccgaggctccggagggagccttcgcagttctaccatggctcatctctctcgtcttttagtttatacaagagctcaggtatgttgtatttcagaaactaggaattcttctataactaaaacttccattacaaatcatttcaaccttaacgatgctttcgtggtcccggctcaagggcagtctggtggtctttggcttatgtggaataatgaagttgatattactgtgattgatcacaaccataattttatttttgccttgtgcataaataaaactagtatgcggcaatatggcttggtctgcatctatggcgaccctcatcatcgcactactagagctatctgggaacagtgc

SEQ ID NO: 27620 - DNA, 469 bp, Sorghum bicolor
  Clone ID: 7217499
gcacgaggccaagggccttttatttagggggttatggccaccgaccgtttccacttgggtactaccaaggatttccagttccccagtacagttacccttcatatggaaccgaatacatctatccacagggtacattaaacccatattctggtcagcaatatcttcctatttatggagtctcagctgcagcaaacactggcaaccaaacatttagccagttgagtccatccatttctggtgggggcaatggttatttgtcggttcatagttacaacatgcctggaaatcaatatgtgcagctcactggatcaaacttcagcagtgcatcaccaacagctcgaccttccattcagactccttttctagtagcaacaccggttcccgcacatccacacctaataattccagccccctcaccccagtttacacaagctagtggttcagaccaaagagcaagctgaactgtgca

SEQ ID NO: 27621 - DNA, 415 bp, Sorghum bicolor
  Clone ID: 7217538
caaaagctagagcaacttgaaagaaactgattttccttcgtgttttaagcaataataggaactttaagagtggtataatggtgagcttgaagggaaaaaatcactgtaaagcggcttgtcgctttatgaaatgtgctcgtgtgttatttcgttaactatttatgttatatttctctcttttttgggagttatgttatactacttttcctagctacacttgaatattctatgttctgtgctgatattcctcttgtttctttaacattttattaggtgttacaccatggtgtttttgacatagacaatggaatttctcatgtatcacttataaatgaacaaagcttggaaacagttggacctgccagttgccaccttttcatgttttaactcatttttttttctgataaaataaata

SEQ ID NO: 27622 - DNA, 481 bp, Sorghum bicolor
  Clone ID: 7217544
gcacgaggtggaagcctcgtttctttgttctcaagggccgacggctggcatattattactcagaagatgacgaccaagaaaagggactcatcgatatctcatttcatcgagttctaccagcagacaatgagaaactcacaggtcttcatgctacgatcacaagccttggaggtcagtcaatgcctgcatcccagaatggcgatgataacttggagaagggagatgactctatcttcatcttcaagctggttcctccccgagctggcctgtccagggctgtgaacttcacaaagccaaccgttcactacttcgctgttcccaatctaaagcaaggtcgcctatggatggcggccttaatgaaggcaacaattgatcgagatgatacgaagcccatcactacgacgtaccaacaaaagacaatttctctttctaaagctaagcagatgcgtcatcgcccaccggctctgatgaacctcgacga

SEQ ID NO: 27623 - DNA, 537 bp, Sorghum bicolor
  Clone ID: 7217545
tgaatcatggcctcttgcagcacgcttctcgaatgtcaacctccccacccgttgatgcccattctccccacggcctgacgcgaactttgcaccaggagtcttcaaaccaaaattctaatcataatcttcccgaattggatatgcctcaaaacctgcagtctccagatactcccgggcatgatgagttgtattttggatccattacagaacgaagtcccagacgaccggttggcgcttctccagacacttacactcatactacgacgactaaacccgcccatgagcctcgcccgagccttggtggcttcgactttgggactggtaatgcttatacgcagaacgaccacgccgaggtaccgaccgcacacgagaccatctcgacttcacatccagtgggactacccagattgtctcttcccatgagcgagacaagcgattatggagacgagccgaaatccaacttgcctccggccaacagcatgcctgaacctgagcatcatgaccagcgggaatcagatcatcctcatccggcggaaa

SEQ ID NO: 27624 - DNA, 512 bp, Sorghum bicolor
  Clone ID: 7217552
gcacgaggctccatctctatcgtcgctgcgtgtatcaggtggacgaccaccagctagccgccgcagcatcggttcggttcctcatacgaaccagctaaaactggcatggacatgctatgccgcgtcaatcgatctcaccagtgctaatagcaagatctggcctgattcggcgatccagcagtcagagttcatgagatcgagtgcttcagctccaagactgcaggctacctagctgtgtgcactgtgcactgcatgcgtgccttggacttgaagacggcgcacgcaaagtgcaaggcatcgactgaaccgagcgctccgatccgacccttctcatgggtcttcttgagccccagaaacgatgagcaccggccggccggaggacatccagcagctaatcaacagtgccactagtagccccaaccgcactagtccatccgcctcgcccagcgacatggagagcggcggcggaagcgcgtcctcgccgcgcgcttcgacgtccgaccggcgcctgc

SEQ ID NO: 27625 - DNA, 542 bp, Sorghum bicolor
  Clone ID: 7217553
gcacgaggaaagtttgagcatgaagtttgttgttgcaatttttgcaacaacttttttattttttggcatttgccattctcaagatactgtacaaactccaaatggtaaattaaaatatgatgaagattggggatatgtaacagtaagacaaaatgctcatacattttggtggttaatgactgttaaatctgatccaactcgaccattgattctttggcttcaaggtggaccaggttcagattcaaccggatttggaaatattgaagaacttggacctaaagatataaatttacaagatcgaaataatacttggcttcaagttgctgatttagtatttgttgataatccagttggtgcaggatttagttatgttgattcaaattcagcatttacaacaaatgttaaacaaattggacaagatttaatggtctgggcaaaagcattcttcaaaaaacatccagaatatcaaacaagagatttttatatcttttgtgaaagttatggcggtaaaatgagtgctgaatttgggaaacaacttcaag

SEQ ID NO: 27626 - DNA, 490 bp, Sorghum bicolor
  Clone ID: 7217555
gcacgaggcgccgcttgcatcttcgctcgtaggccgcgccgcccgcatactcgctggttcgtcgccagctgctccccgcgctcgtccacaccgccgctcatcgcacagagctcgcccgcagtctttcgcggtgagaattagggagaaataagacgcgagtgagaagaatcgttggattagcaggcccacccatctagtcttgggcggatacggttccaatccatatctgcgggtgttctcggctttgggcgccaccgccgcatctgtcgccaggcacgatgtgccatcggtaaatcgccattgggcccatcgtcatctgcggacggtgcgaagcgcctcaaagtctcgtgctctgactggcgctgcatcgtctaccagagcattggtcaccgcctcggcctccaatctaagacgtcgttgacgagtcttccgcgtcttcgtcgaggtggagaacactcactgcactgcaatcagtaagctattgcctcta

SEQ ID NO: 27627 - DNA, 516 bp, Sorghum bicolor
  Clone ID: 7217560
gcacgaggggcatgcgacccaagtcatccgctctcacaccaccccacgatccccatgccggtcatcttcctcctccaggactccaggacgtgctgaaccttgaccacgacggggtgaattccgtggttcggccctctgcctcctcctccttcactgcgtgtccgacgggtgccgaccgtcacatcgccattaacgacaccagcaccgacgccaaccccaagagcgggcgccgtcatcctcgttcgtcgccccgacgtcgccctcaattgctagggtccgccacgatgccgccccggcctcgacgacgtgcccggtcctagacaccgagcacccagccgcctccccgacctcccactaatgccgccgacgccgacgcacgcgaggcgctcgagtctttgttagtaccttcgccagatcttcgacgagcaaccaacagatccagtaaccagtttactgctgcccatatccagaaagtcatctacacagctagaaaccacagaagagcagatttcacct

SEQ ID NO: 27628 - DNA, 621 bp, Sorghum bicolor
  Clone ID: 7217567
ctggcgcccaacccgatcatggtgtaaggcggggcgaactcacggagcgtgaggcatggaaccaggcatggagcatcaacaccgccagcacacaggtcatgaccacgaccttcatgccccttctgctcaaaggaaccgacccacgcctgttgttcatgacgtcgggcacatcgaccctggccggctccgagaatcaagcgctagccgtcaacaaatacccacccaagggttggcctaagcctttctatggcgttcccgcataccgcgccgcaaagacgggcttgaacatgctgatgagggagtggcacaagaacctgcacgaagacggcgtcaaggtctttggcatctctcccggcttcctggccacgggtcttggaggcatgactgagatgagtaagaagatgggtgcgggtgatcctgagattgcgggccccttcatcaaaagcgttattgagggtgaaagggatgctgatgctggcaaggtcattctcaaagattccattcagccttggtagatatggatatgtagatgccagcaccacattgtacttgtagtacaggcataataaattcatattcatggctgttgtacttcaacctggtatcaagccaaatcccgcc

SEQ ID NO: 27629 - DNA, 324 bp, Sorghum bicolor
  Clone ID: 7217570
gtttcatccaaagcaacttttttttccacccttccaggattactcgcatgcttacaagtgacgtcacgcgtttccggaggacggggatcctccggttttgttaatggagcttgtggttttcaaaaactatgactttttttttttgacaaaaaaagtttttttccctttgcccaaactgaaaaagccttttcggcccgttaacaagctgggttcggttttgccctttttggggccgttaacgggctgggtggtgttttggtttttcgggccttttcctttggttcccttggaaatttgaggctgtttaaattgggaattgttggc

SEQ ID NO: 27630 - DNA, 611 bp, Sorghum bicolor
  Clone ID: 7217571
ccgggatggcgctccggtacctggagtactacgtcggcgaggaggagacgagcctcaaggacaagtacccgcgggatcacgtcgtgttcagggaccccatgtcgctccacacgcaggggtggcaggcgctcgctcagaccatcatgaagcaggacgtcgccgtcaacctcaccaagttccggcccgtcctgctgcaggcgctcgacaagctgcagcagtgacggactggggttccttttcctgttcatcttcatcttcctcttcctcttcctaggaatgatcgaatgaattcgccattgccgaccggcaggagaagctcagctcgtcggccatgagatggccgggattgaggaggctagctgctgctgctggcctgctgctgctcctaccaagtacagtactattgctagaaaaaaagaggggaaatcagggaggcttcaactttcaatcaaattggtaatttgattggttcatcggccgccggtttgtcttttttttggtttgtaactgtagtagtaacaagagaagagcttggatagtgcactacatacactacacacgaacaggaattatgttcattctttcttccttgattcacttgagttcacctc

SEQ ID NO: 27631 - DNA, 612 bp, Sorghum bicolor
  Clone ID: 7217572
tcagctctctaattgcggcatcaacgaggcactatcttctccgctcaatcatcaatgaccatcccacacttcggagcttggtactaacagatgccgatggccaaggcacattgtgcatgggggcagagcagctgaaggagttcagagagaaccagttgtctgcctcagcgtgttctaacaggactcaggtcccagcctgcaacatgaagctcaagtatgctccatatcttgagctgcctggtggtatggcgttgcaaggcgctactttggtggctatcaaaccctcacctgagggaagcaatggaggccatcctaaccgtaaggaagccgacgggtttgtgtttggagcatttgatgggccatttaaggctgctgtgaaggcactgatgaagagacgtacttaccttctggagatgaatggcttctaggaatcttgggttcgacgtgacattgagcttgttggtgctatgcatggcacatttagctgagcttttcatctgtgtaatatccaagaaggcaccatctctagttggtgcttgctgtctcctgttttagttctttgtacagtgttgacatttggttatataaaaatcatatcaagttctctagtgt

SEQ ID NO: 27632 - DNA, 164 bp, Sorghum bicolor
  Clone ID: 7217583
tccgggggtccgcgcaacaaaaacagcacccggccaaggagtgggcggccccggctcccgtggcggcggcgctggtgcttcccaaggtcccggagcccgccccggggatttccccgtcgctcaaaaacttcctcctcagcattgtttccggaggggttgtcctt

SEQ ID NO: 27633 - DNA, 600 bp, Sorghum bicolor
  Clone ID: 7217600
gccgtacctgcacgagtctcggcatctgcacgcgatgaagagagctcggggaacaggcgggcggttcctgaacacaaagcagcagccagagtcccccggcagcggaagcggcggcggctcctcggacgcgcaacgcatgcccatgaacggtggtggcctgttcacgaagcacgagcacagcttgcctcccggcgatcgccaccactatcacgcgagaggagggggcggcgcgtagggagccagcccccccaactggcaactcatccttggcttatcagcgatttccactcggctcttgtctaaactgaactgaactcggggtttctgtctctgcatctgtaactaaactagtaggtgtgtccgaattggcgggtcgctctgttgtactagtacctgggacgcgcactagagagtggaggtgatgcgggtgcggaaagaatgctgttctttggtgacgtaagctggacttacgttgtgtgtgtgtgtgtgtgtgtgagtgtgactagggcgaaactgccaaactggcgcctgtttcatgtaacctttgctccaggacgatgactggtataataagtagcagtaataaccattttctctgtc

SEQ ID NO: 27634 - DNA, 650 bp, Sorghum bicolor
  Clone ID: 7217602
ccttcagctcaaagatctgtgtcgctatcagccattatctagacggcttgttcctcgcgacagtttgcaatttgctgggcgtaatgatggtttacaagtactgggattcgatcaccaaagaagatcttgaattctcagtcggcacaaggatgaacaactgggaggtcaaggagcttctgccagaggaagatcgaagggcgactgtcttttcggaggatccctatgctcaatccagctcctatgatctgccttactcgccaggcgcggcacgatactcggccaagtactaaacgctctgaccaccagaacaactttgacgccattaacgagacttcattttcttctgttttgattcagcgcgtggcgcgcagttcatggcgctcttatggagcgacacgaaacattgggctgttttacttttagaatccttacattgcgcggcgtttttaatggactgtataggtgtgaccagcctggatggccacaactgggggtaacgaaaaccgacgggcaaatggaaggcctggggggaagcaagagacgcttgttaataaggggagggaaccttgatgaccaggatggacaacgacattatagttgttgcgagttttgcatataatcatataggtagtttatatattattgagact

SEQ ID NO: 27635 - DNA, 501 bp, Sorghum bicolor
  Clone ID: 7217604
ctctttcaccttatacaaattacccagatctcaagccgccgtcaccccctggcagcaccacgactgaaggcccagcagcggtcaattctgcacctgtagcagatgctagcacggaatcatctcctcctcgtcctacccccagacctcagtcaccttaccctaattatccagatttcaagcccccgtcctcgcctttgccgtcacccccttaattaggcaagagtacaagaaaccgggtttagaggatattaaagaagttgagttgttcatatggagccggcattcgcaccaaaggtgtatgttgtactatgagcctgacagtgtgtctattagtcactgtggcaagttttctgcagcagtaaatgtatatgatgtaatttccattggtcatcgatgtgctctgattttctttttgttgtcttatttttgatacatgtaaatgttgaattactagttgtgagaaatgagagttcgagcctatagagcttgatatgtttgccc

SEQ ID NO: 27636 - DNA, 672 bp, Sorghum bicolor
  Clone ID: 7217611
agatgaatgagggacttggatctgggaaggtggagaatgggaaatatttgaagatgtacttaaaagaggagttgcctactcgcctacattactcagagagttacaggatcccaccaatcatcgggctggtggaggaagggtataagattgagatgaaacactccaagaaaaatgagtgtggaggggcacatgggtatgacaatgccttcttctcaatgaggaccatatttgccgcacatggaccacgttttcagggtggtagaactgtgccctcatttgagaatgtggagatatacaatgtcatcacttccattctcaatttgaagcccgctccaaacaatggttcagcttctttccctggcacaattcttttgccaagcaaatgatcatggatagtatgagctgtagttttgtaggagtaaggccatgcggatgcctgttggtgttctctgttggttgttgttgtacctcttaaattagatttctgtcaaccatcggttattcgctgtatctaaacaaaatgctgctagtagagaggttcttctctctagagacagcatttgggaacatgatccacatcaaactcctggctgcccaattgttctggatttttcatgagttcatttgagctccatatattctccttaattgatgctgatgctcgttctgttg

SEQ ID NO: 27637 - DNA, 641 bp, Sorghum bicolor
  Clone ID: 7217612
gggtggtacgtccaagggaaatcccaacgcgggcgccaacccgaacagtttcctgaggccggtgacgcctgtgacagcgggcgacaaggccggagcgggtatcgtcacagtcatcatcatcgggtctctatgtacaggacttgcgtggatgagtctcggcccttgaagcatatcttccgcatgggcaattcgtttcttttcaacaaaacatttcgagaaaaaaacttatgacgggtctgtcatggccaatgcctggctagactccttgtatggtgtttgggttggctattcaggggggcggactggtagcacttttacgacttttgctattcggcgttggaatgtacgtttactgggatcatctagcatttttcttttcttttttttatgcgcttttcttttttcttatttttctactcctcttcatgatgtagaggggtaacgctgttgttgctatctgctagatggcaggataaataccgactctttgagagctgatgaacggtctggatgacgggatgatgagtatcggatgatgttggatgagtcgattcgaggatatgaatatgaccgtctaggatagttacgaatatagtagtaacctcacgatggaatggcaattttccttgattggagttttg

SEQ ID NO: 27638 - DNA, 685 bp, Sorghum bicolor
  Clone ID: 7217616
cttttcatccaagatttcactcacaagcggacgacgccatacgctgtggactccaagaagatgacatcgcttgttagcgaatctggcgcagcgatccagaactgctatgccaggttgacctcaaagctgggtgaaacgccgggcgaggtcgactatgcaacgctggactacgctgccctggaggtggaggactacgccgagctgctacgtatcatggcacagtatcccgatacagcgcaggcgtctttcaagactcttgagccatctctcatcatcagctacctactccggcttgtcgatcaagtcatgatgacgctcgacgacgacgatgagcaggattgggcggacaaggatgaaacgaacaaggcgaggatggccttgtatgagaatgccagacaggtatttgagaatggcttgagagtgctgtgcgtctctccatatagttcatgacggtctaccctttccttctagttttgcttgtctgacatcattgcactcttgaccgagtcactcactttgttattagtctttctcagttacagtagcgggatgttcggggcgttttcacatttcacatttttcacattccatatatttagactgtctttcccatttccattcttcatggcacttcatatctttcatcgctctctgtttgcaaggccccaatatagctgtattatcc

SEQ ID NO: 27639 - DNA, 165 bp, Sorghum bicolor
  Clone ID: 7217622
agtacacccttgtttgtatttactttggaggatgtttcatttgaggtcatgggttgacgatcgggattttttcctaccccatccggttttggagtaaaggaaccaaacgagctttttttttcccccatgaagggttccttggctcaaaaggagcctggatcaaac

SEQ ID NO: 27640 - DNA, 682 bp, Sorghum bicolor
  Clone ID: 7217623
ccattttcaatttacgttgagaatggtgcaacattcccattatcaaataaatctacttgggacaatgatgtagccagagaccttgagaaaatcagagcagcacttagattggtcacatctgctgacaaatggcttgacggatatggtgccactttgaatttgccaactaatgtcaacattctaagcatgagaggacctagttcatgggcaaaatttggaaatggagatgccaaagtgagatacgacacttggacccaagctttggtttatgatggaagcaacacacttacaacaactcatgagaatgctacccaaggatacaactcggttaaatggggatctttagtgaacaacaggccttatagattctctgtagagggtagcactggaatctccttgacattgaatattatcaaagcagataaaacattgcttgctactagtggacctttaatcaatggccaaggatggaatttcaactatactccaaacacaaagttatatatgcgtgttattaagtctcctggtggtcctggtagcattagaggcaagcttgttcacaacactgtctatactatcccgtaccaaggaaacaacactctccctttctaattctaaattagcaacttgctgttatatttattatagcgtatttacgcccattgtaataaaatacttattt

SEQ ID NO: 27641 - DNA, 703 bp, Sorghum bicolor
  Clone ID: 7217626
atctcttcaatgacatgttttcggatcccgaggcgtacgggttcgacgaggactatgttgatcctccgactgcatgtctcacgggcgtttatacgagcgagggtgttccacgacatttatgcagtgatcccgagaagcatatcttcttcgattcgtatcaccccgttaaagaggtacatgctctagtggcaaagttgttcgtagagagtattgaaggattcttggcttgatcttgtcggccaggccttgggcatcaggtccagagcgtcgcgatgtctcaccgacttacttgtcaagtatcagcacacattctcattaacaagtcttggtcacttacaagccgagaagtcgtacctcggggagataccgatcgttcgggatgccccttggcgttccagtcaacgctcttgaagacaggcttggggctatcggtctcgtcacgagttgttgtgcccaggggagatcccttccggttcaggctttctccggttcccccgccaccccagttgacctggttgaagttgggtgatgcggtgtggtcgtacctgatcctatttctatgcgggatcgcgtggcttctcatgggtccaaattcgtagaggggacctttgccggcttcaaggcaacccctaccctttcgctcgatgtattcaccccctgtgtttctgaaaatataattggtgtgacgatacctccatctgtt

SEQ ID NO: 27642 - DNA, 691 bp, Sorghum bicolor
  Clone ID: 7217634
gaagggagacccgtccaccactccacaccacatcaccacatcactcaccgtctgccccgtgtcagttacatcaccgcaaacatggcaccagcagcagctccggagccccagttcaaaaaggatgagaaggctctgtgcttccatcacgagttgctttacgaggctaaagtgctcgaggtggcacctgtcgatgaagatgacaagaagagtggcttccagtacaaggttcactacaagggctggaagaatacttgggacgactgggtggcagaagatcgtctccgcaaactcacccctgagaatcgggagctcgccaacaatctgaggcacgaagtgctcgagctccagcgtgctgctcgagcgcaacccccgcccagtaaaaagaaaccccaaggatctgtccgcgacagtgaggaacgtctagtgcccgctcagtccaacggccctcgaggacagaagagggtgcgcgatcaagagcttgaaaaggaggaggttttccaaagtcgccgcgctgtgcggataaccatgcctgatcggctgaaaagtttgcttgtggatgactgggaaaacatcaccaagaatctctcgctagtgcaattacccgttaaagtaccagctgcacacattctggatgcttactacgagtttgcctccgcacctggtacccggagtagtgccgagaaggatattt

SEQ ID NO: 27643 - DNA, 469 bp, Sorghum bicolor
  Clone ID: 7217714
gcacgaggggctggaggagatccagtatttccagaaaatttgtttaggtttggagattatgatgggactggctcagatgtgctactccagcatcccttgggtgttgcttatgccagtgacaatcaagtatatatagctgattcctacaatcataagataaaaaagctagatcctgtcacaagaaaagttacaactattgctggaactgggcgtgcaggatacaaggatggtccaggcttggcagctcaactttctgagccagcaggacttgttgaagttggtgatggaaggcttcttgtagcagatacaaacaacaacacaatcagatatataactcttagtgacaaaggtgctgaggtgaagacactagagttgatcggagtgcaaccgccatcaccaaaaccaaaggcattgaaacgcctaagacggcggttatcagcagatacagatgttattattgtcgatggtg

SEQ ID NO: 27644 - DNA, 487 bp, Sorghum bicolor
  Clone ID: 7217719
gcacgaggcagccctctgcgctcaacagcttccaggaacactcgctccaatcttccgtgaacaccctccgcgccgtcattgcagcagctgcgcagcccacggctggaaagatcgctgatgtgtttggtcgcgtggaacttatttgtgtctctgtgttcttttataccattggaactgtcattgaggctgtggcgcagaatctggatacgtactctgctggtgcggttatttaccagattggatataccatgattcttttgcttgtggaggtcatcatcggagatatcacgtctgtgcgatcgcgtttgttcttcagctacatccccgctctgcccttcatcatcaacacatgggtcagcggcgatgtcgcagaagccgtccttggagctacaacctggcgatggggaatcggcatgtggtgcatcatctaccccgtctgctctctccccctcatcatcagccttctcgtcgttggccaccgcgccaa

SEQ ID NO: 27645 - DNA, 482 bp, Sorghum bicolor
  Clone ID: 7217721
gcacgagggtcttaggaagctgaggttgttgagattgttgtctgcggctatctttcgaacgccctgtccaaaattccacacggtttcgtcactcacgccgagcagatctgttcgctatcagtcatgcacgtactttgagcctattgtattaacacaccattatagacaaggccatccgaggtgatgtggcattcagccccgtgctcatacactgcgttgatcttctcgcacaatccgtcgagatgcttcaacgcaagctcctcacccaagtcgggcaaaacacccaggaccttatcctttgtgttcggagacttgaacggaaaaccagggagcagcatacgcacaggctctttgcgttcaacctgccctttgacaatgggtaggaacgtctcgaacccatcccatttgcctgtccgctcgtagttcagaccatactgctcgataattcggagtatctcgttggcttttgtgtcgttgtcagt

SEQ ID NO: 27646 - DNA, 479 bp, Sorghum bicolor
  Clone ID: 7217722
gcacgaggctgaacccccgagttgtcatccccctgattggcgaggttgacctcaaggagtggctggagctccgacctggcatgatgggttggatcatcttcaactgctcctggtgtgcgcagcagtaccgcaactacggttacgttaccgacagctccatctgcatcacacttgtccaggctgtctatgtctttgactcttggtggaacgagccagccatcctgaccaccatggacatcaccactgacggtttcggtatgatgcttgcctttggtgacattgtctgggtgccctttgtatactccctgcagacccggtacctggctgtgcaccctgtctcactcggccctgctggtcttgccgtgatgctgtccctcattggtcttggcttctacatcttccgctctgccaacagcgagaagaacgccttccgaaccaaccccaacgaccccaaggtgtctcagctcaagtacatccag

SEQ ID NO: 27647 - DNA, 380 bp, Sorghum bicolor
  Clone ID: 7217730
gcacgagggtaggattcccgaatgttgagattgttgaagaggataaagttcgcatgtgttctttcagtctgctttctcacagattctgtgcgttatctgtttgctcttggagtgttctttttttttctttaagaatttgtagagcttatggagtgttgtgttgaccaagtgtgttcttgatagattgacgtggtctggcttgagtacttgtgacatgggtttttgttttttgttttgtggcatagggggtagtgtagttgtgtcactttccactacacaaggtatatgctttcataaaaattgatgtgggcagcagtcagcaatcataaagtgttgcacttgaatctcattgataagtgtttcccttacaggaagtgggt

SEQ ID NO: 27648 - DNA, 187 bp, Sorghum bicolor
  Clone ID: 7217731
gcacgaggatgcagttcaccaagatcgcctccgtcctcgccatggccgccgctgccatcgctgctcccgctcccggcaactacgaggtcgagcctcgcactggcggtagcaacaacggcaacaaccagcccgcctgctctgctcagagccagaacgtttgctgtgacggtgtcggctgcctcgtgca

SEQ ID NO: 27649 - DNA, 454 bp, Sorghum bicolor
  Clone ID: 7217732
gcacgagggttgtgttgatatatggttgagccaccagcagtgatgtcaagggagggattgctgttgttctatcgacatatacctactttcccactgtctccaacagctagctttgtggttggttggacctataagttgcagcaactgaggcagttctcaactaattttccgtcctgaatttggagctgggcctcttgtcttgcttggattctacaaaatccagttgcctgcctctgtttactcaattttgcagcgaggttcaggagcatttccatctccactgcctatccgcatcaaatcaaccaacccaacaagcatgaagcaacaagtcccgagcagcaacggccatggcagcagcatccattccaagtctcctgtgccacaaacgcggacatcaagagcaccaccacccaaagtgaagcaacctcctgctactccaggcccaggggtgaag

SEQ ID NO: 27650 - DNA, 474 bp, Sorghum bicolor
  Clone ID: 7217735
ccgccgctcgcgtcgcgtgcgagctgcgtgcctccaccccgctcgcgccgtcccggtcgcgatggccctgcgctcgccggagctgcggtggctcggctcgctcacgcggcccggccgcctggctccatccccactcgcggcgctcgcctccccacggcgccgccgccgcgcaccgtccccgtcccagcccccttcctcgccctcgccctcgccctccgactcctccaccccatctaccgcccccgcatccgccggtgcgccgggagcggaggggttggacgggccggagtggaagaaggtcagtgccaagcggttcgggatcaaggagtccatgatccccgcagaggcctggaacgtactacaccgcctccgcagcagaggatatgatgtgtaccttgttggtggttgtgttcgtgatcttataatgaagaagacgccaaaagatttcgacataataacaacagctgatcttag

SEQ ID NO: 27651 - DNA, 241 bp, Sorghum bicolor
  Clone ID: 7217740
gcacgaggctgcagcatcgagtgtaccaccgtgtatgaagactgttgcagcgttgagggctctgacatccaggtgtgcaaaaaccagtacaccatctgtctcggctacaacccctacgagtctgtctttgtcaagcccaccaactgcaagcacgacgagagctactacatcgagtacgagtccaagtacaccagctcttacttcgaggagaagtatggagactactactcttcttgttctt

SEQ ID NO: 27652 - DNA, 481 bp, Sorghum bicolor
  Clone ID: 7217741
gcacgaggcctccgagtccgtcggtgagggccaccccgacaagatctgcgatcaggtctcggacgctatcctcgatgcctgccttaaggaggaccctctctccaaggtcgcctgcgagacggccgccaagactggtatgatcatggtcttcggtgaaatcaccaccaaggcacacctcgactaccagaagatcatccgcaatgccatcaaggacattggctacgactcttccgagaagggcttcgactacaagacctgcaacgtcctcgttgccattgagcagcagtcgcccgacattgctcagggtctccactacgaggaggctcttgagaagctcggtgctggtgaccagggtatcatgtttggctatgccaccgatgagacccctgagctccttcctctgactgtcctcctctcccacaagctcaacgctgccatgaccgctgcccgcaaggacggctccctcccatggctgcgaccc

SEQ ID NO: 27653 - DNA, 473 bp, Sorghum bicolor
  Clone ID: 7217745
gcacgagggacttcacaagaaacgggcaacgatctgtcgaaactgtagaggcgcgtttcaccaggaatggtcagcgatctgctgagcctgagcccttcactcgcaatggccaacgctctgtcgaggatgtagacgaggaggaagaggaaggagagctcgaggcccggttcacccgcaacggacaacgatcagtagaggcccgttttacacgcaacggccagcgatctgccgacccagagcctttcacccgcagcggcgtgcacaagcgttctgtcgaagacgaggccgaggaagaggacgaggagcaactcgaggcgcgcttcacccgcaacggacaacgatccgccgaccccgagcccttcacccgcaacggtgctcgtgctgctgaagctgagccaaccccgttcacccgcaacggacaacgatcagtggaggctcgtttcacccgcaacggtcaacgatccgccgatccc

SEQ ID NO: 27654 - DNA, 654 bp, Sorghum bicolor
  Clone ID: 7217746
gcacgagggcaagattcttgttggccgtggcagaccagctctgtccacctccgttgatcagtacttatctagagatatattaatattgtgctgagcggcgggactttccactatatctcagatggctgtatccatttcaacaatagttacactagagctgaattacctcctatccatacttgaagcctaaagactgacccgtgataggtttaatccatcaacatgcaaattggaacaagaacaagagcaagtcgaaaactgcgaagtcaaacattctttccaagacagcaatacagcacagacgaatgagactcatgaacacatacgcgagtgtatcaccgccagccataactcaacatgcgaatcagaacaagaacaagtcaaaacatgcgaagtcgaatattgtatcccagatagcaatacagcacggacgaatgagactcatgaacacatacgcgagtgtgtcaccgccagccataactcaacatgcgaatcagaacaagaacaagtcaaaacatgcgaagtcgaatattgtatcctagatagcaatacagcacggacgaatgagactcatgaacacatacgcgagtgtgtcaccgccagccataactcaacatgcaaatcagaacaagaacaagttaataactgcaaagg

SEQ ID NO: 27655 - DNA, 526 bp, Sorghum bicolor
  Clone ID: 7217754
gcacgagggtcccgtgcaaggagaaggacgacggcacgctcgaggagatccccctcaatgagccttgggtatccaagcactatccagagggcacgtggaaggactttctcgacagccagtggaagcccgaacacgacggcgtcctgcacagcgtcgccagagtgtttggtgtcaacgacaagactcgcccgcgcattgaggaggccttcagccaagctctaggctacaagccttccattgtccaggaccggtacgttccggccagcttcgtggattcacacacaagttgacactgccccttctccgcaaggctcaacgtggaataccccaagcccctgccggtcatagccgatccacggaacatggccgccttcttctgtcgaatttgctaccaggccgactgcggccaccacggcacgcatccggacaaggccgtgctgcccaccttgcgcacgccccgggaagacgagctcgccgccaaccgccgcccgtgcggccaggaatgcgcctaccgggcgctcgacgc

SEQ ID NO: 27656 - DNA, 386 bp, Sorghum bicolor
  Clone ID: 7217755
gcacgaggagcacttccggagcctgagggatggcgtggcggcgcagatgcaggtggtgcgccgggcgctcggcgagaaggacgcggacggcggtgttccggcggccggcgggatggtcaagggggagacgacgcccaggctgcgggtcatcgaccagtgtctgaggcagcacagggcgtaccaggccggcgtgctcgagagccagccgtggaggccgcagcgcgggctgccggagcgcgccgtctacatcctccgggcctggctgttcgagcacttcttgcacccgtatccaagcgacgtggataagcacattctggcgcgccagacgggcctatcacgcagccaagtctccaactggttcatcaacgcgagggtcatgctgtgga

SEQ ID NO: 27657 - DNA, 581 bp, Sorghum bicolor
  Clone ID: 7217758
gcacgaggcaacattgtcgcatcaccatggcttccgtatacaagaccctgtccggcgctgaaaaggaggaaaaggacgtcggtgtcaagagaaacaagcagcgtgtcctgattctgagttcaagaggtgtcacattccgccaccgacatttgctacaggatctgtactctttgatgccccatagtcgaaaagaagccaaactcgacaccaagacgaagctctaccagcttaacgaactagcagaactctacaactgcaacaatgtcctcttcttcgaggcccgtaaaggcaaggatctctattgctggatgtccaagcctcctaacggacccacggtcaagatgcatctccagaacttgcacaccatggaggagctcaacttcatcggcaactgtctcaagggatcccggccaattctttctttcgacgctgcctttgacaagcaggcccatctgcgtgtcatcaaggaactcttcacccaaatcttcggtgtccccaagacgagcaggaaggtaaagccttttgtcgaccacgtcatgggcttcactgttgcagacggcaagatctgggtccgcgtcttc

SEQ ID NO: 27658 - DNA, 475 bp, Sorghum bicolor
  Clone ID: 7217773
gcacgaggcagcaatcttgacgtctatccattagtttggcattggacgatttgaaagaaaaaaaaaccacatcataataccagtttttacaacagaaagaaaaggataaaaccacaatggccgctatccagctcaacttcactctccgtacttcctccaactgcaagaccgtgcacttgctcggttcctgggatggctaccagggtcagcttccgctttccaaggaccccaagaagtctggtggctgggtcggatgcttcaagttccaaggtcagacactgaaacagggacaacgatactggtactactacatcatcgacggctaccacgtctcgcatgatcccgccaaagaccacacaaccgaacccaccactggccgcaagctcaacatcatcgacatccccgccgccaagtcaagttccaagaccagctcctccagtgccgaccgcaagtcccgccgtgtctcgaccgccag

SEQ ID NO: 27659 - DNA, 532 bp, Sorghum bicolor
  unsure (1)..(532): unsure at all n locations
  Clone ID: 7217774
gcacgaggcttgtttgcccaccagactcttggataggccttcactctttggttctatcgtgagcattctggaagtattcctttgcatttccctaattcatcatggttttttcaataccgagagtggtcaccactcttggccttctcttgcctactgtcacatcacttgccctatcttatgaagatcgtgcaccgcaaacaccctcagtcccttggaaagataccggactcttcagtggacacgttaagcgatcgggatataacacttcttgcaacaatggcccgcaatcaagagactgctggtatggtgatttcaacatcgacactgatatggacatcgagtggccagacacgggaaagactgtcaaataccacctgactatcacaaactcgacaggggctccggatggtttcgagagaccgatgttcttgatcaacggccaatatcctgngccaacaatagttgctgattggggagataatctggagattactgttaccaacaatctagaaaacaatggcacaggtatcca

SEQ ID NO: 27660 - DNA, 487 bp, Sorghum bicolor
  Clone ID: 7217778
cgcgcacgaaaacgacctcgatgtagccgccgggttcttcgctgtgtgcagagagtacacgcctatggggatcaatgcgaagcctatcgaacggtcaacacctgtgggatctacgaccgtggccccttcaagccccagtgtctatcagaccatgtatcggagcatattcgagaggaagcccacgccaggacctctagacaacaacagcaacagcacgagtcaacggcccaagaatgcgggcaacgttttctatgtggttttgagacatggccatcttatgttgttcgacgacgaagaacaggtcgaagttcgacatgttgtttctctggcataccacgaaatcagtatatactcatgcggtgatgtcactcctgaaggcgaactcttcatcaagcgaaatgcgatccgactgtcccgaaaacaggctggtaccgaactgacttctgacagccctgtttctaaacctttcttcctattctctgaaaac

SEQ ID NO: 27661 - DNA, 201 bp, Sorghum bicolor
  Clone ID: 7217780
gcacgaggctgcgatggagcaagcactctttcaagctagggacgggagacagcatattctgaatgaaatgtcaaaatcttcacctccaccatcaaaagcactatctgcgtatgctcccttaattcatgttatgaaggtcaaacctaacaaggtgaatttaataattggttctggtggaaagacaataaaaagcataattga

SEQ ID NO: 27662 - DNA, 384 bp, Sorghum bicolor
  Clone ID: 7217788
gcacgagggcaacgcccaactggcgatgccctcattacttccgaggacccgaaccaccctgcaaacctgatcccttcgctatgcgcaaagttctggactctgggctgggttacgggaacaggaggcggttgctccattcgagatgatgatctcgtatacattgcgccctcgggcgttcaaaaagaactcatgaagaacaccgacatctacgtcctggctctttccgagcaagatcctaaccacaacaagctcaaccagcgcacctatctgcgatctcctccctgctataagccttctcagtgcacccccttgttccttgctgccttcacccgccgaggggctggctgttgtatacatactcactctcaatgggctgttcttgtg

SEQ ID NO: 27663 - DNA, 556 bp, Sorghum bicolor
  Clone ID: 7217795
gcacgagggtttagtattctactccacaactgggctcggccctgcttcctctgatcctcttctgcctgctgttctttcatagctctactgaaaaaagagacagagatgactgaatttcttgtcatagctctgctgttgtgtcatctcaaagatggagcatacaagaccacggcatgggatgatgccgacttcttcagcaactgcccaccatctcggtgcagcgaacatggtccggagatcagggccatggcttgggatgatgccgacttcttcagcaactgcccaccatctcggtgcagcaaacatggtccggagatcaggtaccctttccgcctcgaatccagcaatacctcctcattatgcggaacaccatgcatgaagctaggatgctacggcgacgacaccattctggttctcccaacagccgttatccactacaaagtgaccgccatagattacaggcgtggtaccctcacgctcgccccgcgtgtggacgactcgtcttcctcctgcaagcagaagctcatgtccgtgtccctacctgcaagcattatca

SEQ ID NO: 27664 - DNA, 455 bp, Sorghum bicolor
  Clone ID: 7217797
gcacgaggctcttaaccactggatggagtgcatttgttaataagaagaagcttgtttctggcgatgcagttctgttccttcgaggtgaagatggagtgcttcgactgggagtgcgccgagcagcccagctaaaaattgtaactcctattcctgcactgcataaccagtgctcaagccagaccactctgggaaatgttgcacaagctgtggccacgaggactgttttccacatttactacaatcccaggttaagtcaatctgaattcattgtaccctattggaagttcaccagaagcttgaatcaaccaatttctgttggaatgagatgcagaatgcgatatgaaagtgacgatgcttctgaaagaaggtgcactgggataataattggaagcagagaagctgagcctatttggtatggttcaaaatggaaatgcttggtggttagatgggatgat

SEQ ID NO: 27665 - DNA, 423 bp, Sorghum bicolor
  Clone ID: 7217814
gcacgagggtcgtcgccgactccaaggatgggtatctcccgtgattcgaagcacaagaggcgcgccaccggtggcaagcgcaagatccaccgtaagaagaggaagttcgagctcggtcgccccccggcgctgaccaagctcggctcccagaggattcaccccgtcagatgccgtggtggccgcatcaagtaccgcgctctgcgtctcgagaccggcaactacgcctggccctcggaggctgtcacccgtaagacgagggtcctcggtgtggtctacaacgcctcgaacaacgagttggtccgtaccaacacccttgtgaagagcgccatcgtccagatcgacgccactcccttccgtcagtggtacgagcagcactacggcatcaacctcggcaaggccaagactgtcaagactgaggccaag

SEQ ID NO: 27666 - DNA, 461 bp, Sorghum bicolor
  Clone ID: 7217819
gcacgaggatcgcatctttcttttctccaaacaacctcattgatttgtctttgattctctttgattctctattcaatctttgaaatgtcttggtggggtaaatctaaagaccctaagccagaggagaagaagaacgaagcgactcagatcaaggacactatcgttgagaagcttccctcaaaggaccagctaccagagagtattcagaaagctgtcaacaagacaggaagagacggaaatgtctttgacgacataaccaatggctatggccccgactcaaccgacaccaatttccgatatgctgcctatgccacgcgaattagaacgattcttttatctgcgcatcgatacgtcgcctacacctcggacatcggagagtcgtttcgccccgtagctcacccgaatctcgttcgcgctgcctacggtgtatcctggctgtatcttatcggcgatgtctcgta

SEQ ID NO: 27667 - DNA, 492 bp, Sorghum bicolor
  unsure (1)..(492): unsure at all n locations
  Clone ID: 7217835
gcacgaggggaatattgacgatattgatggttacaatggcaatacgcaggtgcaagaggagtttcctcagtctaatcagcagaagaggatgcgccatagtaacagtagcaacatatcacctggatcaggctttttcaatacaagtttttcggtacctatacagaacttaatggttgaggcaagcaggctctatgagcagaatgagcaaaaacttcagaatttgcaatttgagaaagaacagtggtctcacatgctgcagcagaaggaagccattatccaatccctaaactcagctcggtttgagcaacagaataaatatcaagcagagcttagacgcttcgagcatgatctgaatgttatggctcagttggtcactacctacaaaaaagctttaaaacagacccgggcttcttttgatgagtacaggaagaagttcccttgcaatgttcctctntatggtgatgttgctggtggcggtggtcttgttcttgg

SEQ ID NO: 27668 - DNA, 443 bp, Sorghum bicolor
  Clone ID: 7217847
gcacgaggttggagctcaacctgccgggcgggaagaaaaagagcaaggtggagctgggcgtcagcgatgagaagttgggtggtgctatcaacgactctctggatcacgtgggctgcgtgaagagcaaggcggtcgccgagctgactcgagggattcgcctccacttcgccaagttcatcaaggagttcaaggagggcgattacgagaaggcacagctgggcttgggtcactcctattcgcgcagcaaggtcaaattcaacgtcaaccgcgccgataacatgatcattcagaccatcaaccttctcgacaccctcaacaaggacctcaacaccttctccatgcgcgtcaaggagtggtactcgtggcacttccctgagctggtcaagatcgtaccggacaacctccagttcgcgcgggtggtcaagttcctcaagaacaaggcc

SEQ ID NO: 27669 - DNA, 523 bp, Sorghum bicolor
  Clone ID: 7217867
gcacgagggacaagctcatcaaccacattgccaagtatggccatggctgctggagttccgtccccaagctagcaggtctagagaggtgtgggaagagctgcaggctgaggtggatcaactacctgaggccggacctcaagaggggagcattctcgcaggaagaggaggacctcatcatccatctccattccatgatgggcaacaagtggtctcagattgcaacgcagctgccggggcggacggacaacgaggtcaagaacttctggaactcgtacatcaagaagaagctccggcagcgcgggatcgacccggccacgcacaagccgctcccgctggccgccgacgccagcagggccgccgccgcgggcagcagccgcacggcggtgttcagcgacgccgagctcatcctgtcgtcgacgacgacagccgccgcggggcagcacatgccgccgccgccagtgacggcagcggcggcggagagctacgacgtgtacagcaacagctacagccgcagcagcggcgg

SEQ ID NO: 27670 - DNA, 442 bp, Sorghum bicolor
  Clone ID: 7217869
gcacgaggagtttgaagcatcactgaacggtgcagtgcgaaggagaacggacacagacatcaactcacacgacctacctgggcgactgtcacacctcttcccgttcctgcaatgtcgtatatgcaagatccagactcggtgccggccacaccggacgagttcgacgacagcaatccagcgtcccccggttccgatgccgattcctctgaagccagtacaccctacgaccccgccagctccagttctgagaccgctccctccccgttaggctccggcctgtcgctgaacgacaacccgcgccgagtcccatcattacgcacagtgtcggatcctcaaaacagtacactcttgaactcttcgtctagcgtgacgggtgttcttaacaatgcgagacgaccaacacccagtgcgagcgcactgcctacagaccttatggccaagg

SEQ ID NO: 27671 - DNA, 335 bp, Sorghum bicolor
  Clone ID: 7217873
gcacgaggcaacaaatacctctcgccggccaagccatagctgtccacgggcggcggccatggcgaggactctgctccagcccaacagggccgatcaggcaaccgcgtcatcccactcccacaccggagcgccggtgacctccctcctcttcctcctactcgtcgtcgcggccgccgtcgccgcggtcgtcgtgtctctctgcaccagcggcaagaacgccggtccacggaagcagcgccggtcgtcctccctggcgccggcgccgcagcaggaggacggtggtggcaggaacaagcagctgctcgccagcttcagcggcatcggcgtcaaggcgg

SEQ ID NO: 27672 - DNA, 515 bp, Sorghum bicolor
  Clone ID: 7217880
gcacgaggcaccgctcaagatgcctttctccaagctcgtcaagaacgacgcgtactactcgcgctatcaagtcaagtacaagcgccgtcgccagggcaagaccgactactatgcccgcaagcgcttgatcacccaggccaagaacaagtacaatgcgcccaagtaccgcctggtggtccgcttcaccaaccgcgacatcgttgcgcagatcgtcagctccgagattggcggtgacaaggtcttcatggccgcgtacgcccacgagctgaagccctacggcatcactcacggtctcaccaactggtccgctgcctacgctaccggtctccttcttgcccgccgcactctcaagaagctcgagctcgacgaggccttcactggtgtcgaggaggctgatggcgagttcaccatgaccgaggctgccgaggtcgatggcgaggagcgtcgtcccttcaaggtcttcctggatgttggtctcacccgcacctcgactggtgcccgtgtcttcggtgcca

SEQ ID NO: 27673 - DNA, 486 bp, Sorghum bicolor
  Clone ID: 7217885
gcacgaggccgtactcctcgcgctccaaaggccaagcgcacttccccccttacacacgtctacgagtcatttgagcacactccaaagcccacctcgtccgcttctccctcctcagccatctctcccaagcccgctcgcccagccaccaaccgtgacgactccgattacaatgccattccagactactcgccgcccctcgacacactgcccaagggcaacaacaagatcctcaaggctgagtggaagggccaggctctctcgctcgcagacgaccccgatcgcgacatgctgcacgaggctgagctcaacctggctggcaccctccgcctcaactgtgccacttacctcaccagcaaacgccgcatcttccaggctcgcatcgaggccctgagaatcggcaaggagtttcgcaagaccgacgctcaacaggcttgcaagattgacgtcaacaaggctagtaaactttggcagtcctacgaccgggtc

SEQ ID NO: 27674 - DNA, 340 bp, Sorghum bicolor
  Clone ID: 7217886
gcacgaggctttcctctgtcctctcctctcctctccccgctgtccatggctgcagcagcgtcctcctctgcctcgccgctcctcctcccctcagggccgaggcatgcgtcggcctcggcgacggcgtggcttcgcggcgccagcgcgttcaggagcagggcgctgacctcagaggcgccgtgctgctgcaaggccgccggtgtcggtggaagcgcggcgcaatgcggggcggctgacgagttcttgatcggtggtggcagcagtacccggagggggatggtaggagtggccctgggagcctctgccttggggctggcagcgtttgacgcggtcgccgccg

SEQ ID NO: 27675 - DNA, 546 bp, Sorghum bicolor
  Clone ID: 7217887
gcacgaggcatcgatagccccccactgaccagcatcctttattcctggttgaagacttgtaccacctcatcgtgaaccatttcacccggctcctccttggcttggcttcacgtacaaatactcactcttcctggccatcgccatggctccgcaacccgagaagagccaattgaagcgcccgcgcggctcgttgccagatgatgagactgagaccaagaaacctcgccgagctgagcgcctcgaggctgatccagacaagaccccaattgtcaacaagcagcatctgccatcacctctcacacatcttactgatgactccaacgagctcaacaaagagccaaccgcgacccccccgggacagaagcaacacgagataacccccaagaagactgaggacacatattctcaaggccaagcgctatcgtcaccacctcaagacactcagccgctcagtcagttcgttgatcgccaccctgccatctccgacgacatcgaagacgaaattcgcgaaggcgtctggggatatctcgttccacttgatccgaa

SEQ ID NO: 27676 - DNA, 470 bp, Sorghum bicolor
  Clone ID: 7217893
gcacgaggcctcagcctctcagccaaagtcgcccgcaccgctccccgtccatccaaaaccggtgcccgcagctctcgctactcagccagtcgccgccgcgccctcgccgccacgagaggggggatggcgacggcgagtggcgtctccgccggctccgtgctgcagctgccctccttgcgggtgccggccaagagatcgctgctgcctcggagaatagccgctggagctcccgcaggtactttttttgtgaagagagatgttgtatataacagaagaagctaccaccaattcttaccatggaagcaaagaggaggcttgcaagcagcagtacttccagttacatcaccactagtagatgatgagggggaaaggaagcaaatggctgaagattatgggttcacacaaattggagatgaactaccagataacattactcttaaagatgtcatggatactctacctaaagaggt

SEQ ID NO: 27677 - DNA, 525 bp, Sorghum bicolor
  unsure (1)..(525): unsure at all n locations
  Clone ID: 7217902
caaacttagagcttcttgactcgtaccaacgtcaccactttcaagatgggcagtanccggagacaaaatcacgctttacaccaaccaccgttgcccttgggcgcaccgcgctcacattgcgatcaaagagcttggtcttgaatacgaagaggttatcattgatctcgacacgcctcgcgagccatggtatcttgagatcaaccctcgcggtctcgtacctgcgatcaagttcaacgaccaaatcatcaccgaatccggcgtcgttgcccgcttcctcgccgacgcgtacccctcgcatctcgtccctaacaccggcagcgctgatgccgcgctgacacgcgcacgcatcaacttcttcgtcgacacctggttcgacaaggtcggaagttactggttccagatcctgcgcgccgaagacgagaccaagaaggaggagctggtcaaggagttcctggagaaggtgggcaaggagatcgagccgctgctgaagaatgcgaagcccttctttggcgggagcagcaaggt

SEQ ID NO: 27678 - DNA, 492 bp, Sorghum bicolor
  Clone ID: 7217919
tcgctccgaaacgacgggtgctcatatgtgatggatggcgcacccgctggagttgtaggaaagcaaatcgcaaccatctcagcttagacacgctcacattcacactcagcatggctattcccgagttgctggggtctgtgacctcgagccagctttggagcttcggcgctctttttctaatcttgtcattcattgtcgatttcgccagtcacccgcaatatccaagccagattcctgttatgggcaagggccatggaatgctcaacgctttactcgacagctttcgttacctcacaaactaccaccgctgggtcagcgatggctatgtcaaatttggcaaaaaaggcctgccgtttgtcgtgcgatccccgttatctcgcccttcagaggtcgtcatccctcgcaaccagattggctggatgatggatcagcccgatcacatcctctcgacatatgatgcccacaacgccgtcctgtattccgagtacaact

SEQ ID NO: 27679 - DNA, 509 bp, Sorghum bicolor
  Clone ID: 7217931
cgcgactcctcacgaactctgcctcttctttacactggtcagatgcctgcgtaatcatcggggtcaagtatactcgattgtgctcaaacccacctctttatagacttcattcggaatgggttcagggcgtgcgagtaccaatgcaggaaacgtgattcttcgaggaccaggccttctcgaatcgttggcaacatacagacatgctcttggattttatactgccgtctgcctgtctgcaaggtttactgccacaatgcccgaaggagcacactctgcaacaagcctgcctccaactttcaccatacccagactgtacgcagctctgcgccaggtcatcaccgtgcacccgtcactgtcggttggtattgaggacgagccattgccttcggctcgttacattcgacttgcttcaatcgacctagagcgtattgttcaagtccagacgcttccgcgcggcacagatgaggccgtccgtctacgtctgctgaacgaactcatcgagtcgcggc

SEQ ID NO: 27680 - DNA, 113 bp, Sorghum bicolor
  Clone ID: 7217943
gcacgaggccggggcgggcaagcagcatcaggaaatttcaccgaggatacacgtgttcgggacgagagctaagcaaagcggagatggacgagaaggccaagatggagagcaag

SEQ ID NO: 27681 - DNA, 451 bp, Sorghum bicolor
  Clone ID: 7217946
gcacgaggcgggcctccttgcgcgggcgctctctctttacccgggacccgacgacgcgctccgggccttctcctcgtctccccccgccgcccgctccgacgtctccctctcggcgctcctttcggcgttcctccgcgccggccgcctcgatgaaatcaagtccaccattaccctggcagagtcctcgcatggggtcgcgcccggccgcgcctcccacaatgtgctcctccacgcgctggtcaagaattctgagcttgctgctgcccggaagctgctcgacgaaatggctaacaagaagttgaagcaccgccctgccccagacatcatatcctacaacactgtccttgctggttgttccgtgcaggatgatgaggaggggtttgagaagcttttgaaggagatcagcttgagcaacctggagccaaatgttgtcacctacaactgccggata

SEQ ID NO: 27682 - DNA, 450 bp, Sorghum bicolor
  Clone ID: 7217959
gcacgagggaaacaatgacaacctttgaattccttgagagtggattggtcaaatctttatcaaattatctctcaaatggcaagtacctccaggtggagaacaatatgaattgcagttctgaccattttttggctgtcgtgaaaagatttcagtcatttgctcggatgtctttctcaagaatgggccaaggttggggtgacatgcttttgacacttttagtaagcaagctgcagaatgctcttacttctgttgacaactttccacttataatgagccacaacttcaagccaaggagcagtatttctgatatccctacgaggcactcaacaattactccatgtatccgagtaagattcaagaaagacgaagatgaaactaacttgtcaagctatgatagtgctgtgaatgtggaaatatcgtcatcgttgcataccatcgaagaatttttgt

SEQ ID NO: 27683 - DNA, 412 bp, Sorghum bicolor
  Clone ID: 7217965
aaaactcgagagattcaaaaccttccaaaaccctcgccactcgccgccgtcgccgccatggaccgtgccccgccgcgcggcgcgccccgcgacgctgtcggccagcggtggctcgccgtcttcgccttccaggccgcgctctcggccgccgcttccgcgctccgcctcgcggtgttcccgcgcggccgcagccacccactcctcggcgtccccaccggcctcctcctcgcgctcgacccgttcctctcttgcgccgccacggggctcctcgcgctcgcgctcctcctcaccgagtccccgcacccgcggcctcccccgctgccccggagcgctctcgcgaccgccctcctcgccgcggcaggcacgctctgcgtgggcgccgcggcggcgatgctacccgaggacgccgggt

SEQ ID NO: 27684 - DNA, 110 bp, Sorghum bicolor
  Clone ID: 7217989
gcacgaggccaccatgggagacgaggttcaggctcttgttatcaacaacggttcgggcatgtgcaaggccggttgctccggcgatgacgcgccccgcgctgtgttcccct

SEQ ID NO: 27685 - DNA, 378 bp, Sorghum bicolor
  Clone ID: 7218016
gcacgaggccgaggtgtaaaaggacccgtgtgcagcgccgcaatccgaagaagcgaagcaaccaacccccaaaatcttcgacgccatcgccactgcgacatgcccgtcccgcacctcctctcgccgctttccctaccctgcccgctgccgtccctcctccgcaacggagcgccatggcgatgcccgacgctactccgtgccgttctacaggtcccgcctccggctccgcttcacctggggctcgccgtggcccgtggcgatggcgggaggcggttcgtcgggacgttgggctcgaagagagcgcgagcggctggtgcggttagggtttctgcgatgtccggagacggtggtggcggtgctggtagtacggggatcgcg

SEQ ID NO: 27686 - DNA, 567 bp, Sorghum bicolor
  Clone ID: 7218029
gcacgaggctcctattggtcctggcgccgatcgagccaagccagccactcccagcggacaggcagcacctcccacggaacccaaatcgctggctcaaggtgtgcgacagccctctcatgcccctacaccacctgtcgaatcgaaaccttcggttgaggaagtcaagcagactgctgcgagcctagcagccaatggccaagcaaagcctgaggacatcagcaaggctactcctactggacccaggaatcaccgggtcaatcctgtgattcctttgacaggatctgctgccaagcccttctctctaccaggcgcaggaggtgatgctgccagcaaggctcctgcagctactgcaccgcccaatgttcaggatgccaccaacgctgctagggctgcggtcgctgttgctatggcccaattgggcaacaacagtggcaacgctatggacaacctgacgaacaaggtcaacgagatgcgtgtcaacgccgttcgaggtggaccagccagcagaggtcgaggccgtggtggacgtcctgctgccgctaaggtcgcggttcccgactctgactt

SEQ ID NO: 27687 - DNA, 556 bp, Sorghum bicolor
  unsure (1)..(556): unsure at all n locations
  Clone ID: 7218033
ttcctgtgcaggtctgtgttacgggccatttcttcgcgtgctctgcttccgctggcctccggcgagtgaatccagaccatggccgagatagaagacgcgatgggtgcgccgccgacggtgacgacaacggagtccgagggcacgaccacagatgaggacgtgcatctttcgccgacctgcatctgcggcggcgcgggcggagctggtggtcgccggggtggaggccgcatcaagatcctctgcagcttcggcggccgcatcgtgccccgcccacacgacggcgtgctcaagtacgtcggcggggagacccgcgtcctcgccgtgcctcgctccatctgcttccgcgagttgaagaagaaggtggaggacatgttcaagacggaggtcgcggccatcaagtaccagctcctctccctggccgaggaactggacgtgctcgtctccgtcacctgcgacgaggacctggtccacatgctggacgagtacgaccgcctcgaggcgaagcgttcgccgaccacgtccccgcggttccgcgtctacgtcttcacgccgnagg

SEQ ID NO: 27688 - DNA, 323 bp, Sorghum bicolor
  Clone ID: 7218034
gcacgaggctgctcccaagccggcaagccccaaatcccagctcaggaggcagagcgggttgccatttccatcgccacgaatgctcacgtgaataccaccccgctccaggtagcaaagcagcggccggcgacgggggggagttgggtggtaggttttttttttttgggtgtctgcgactgcgacgctggcatgggctaccaccagctcctactatcgccgccggaggcgcagccgccccgccccgcgcttctccctccaccccgcggcaccagcggcgccgggcgggtggctaccgcagtctttgcctcggcgtccagcgccgc

SEQ ID NO: 27689 - DNA, 560 bp, Sorghum bicolor
  Clone ID: 7218035
cgccgcagccttcgtcctcctccccacccccgcatccgaatcacgcacgccaccccagccatggccacctccagcgacggcgggggcgaccagcggcgcctcctctccatccccaaggaaggcgagcgcatcatcgcgcccacgcgccgccccgacggcacgctccgcaaggccatccgcatcctcgccggctacgtgccccaggaggaggtcgccatctaccagtccaagggcgccctaatgaggaagtcagggcccgacgtgccgccggggtacgacccggcactagtggccgatgccaaacccaagacgaaggcggccaagcggaacgagcgaaggaaggagaaacggcagcagcaggccagttcggcaaatgataaaggaaagagtacggatatagaggaaactgatgctggagaaactgacaaggctctttcttccaaagcggataagcagaaggattcagtggaaagtgtaacaaagcagataagtagcattgctatttctgagtcacatgcaacgccgtccacaaatagtacaaacaattcacaaccggaatc

SEQ ID NO: 27690 - DNA, 553 bp, Sorghum bicolor
  Clone ID: 7218043
ctcgacctcgcgcagcacttctctcaccctggccagcggtctagacgctgctcggcgaacattctcttcatccaacctcggcctgccccaaatgcctggcggccaaactggagccacgtcgtcctctatggagggcggcgtctccagattcatcatgagcaacaagtccggcctgcagtcctcttcacgaacggactccgacccgaacactccgtcctcgtttctacctcactaccatcctcaaacacccccgtctcctaaccatgggagcaaatccaccgcttcgccagcacgcccgcgcggtgtcgacctaccttcacgaacccagcagaagctttggcttcagcgtacggcgacgctgaacaactctccacccgattcgcatggcgtgtccgcgaacatcccgccatcgactcttgacccggcctttatcaccggtagccactcccgtgctagctcgaccttcgatggaagcaggggcatgaatggcgggggccgggccggagtgccaggccacgataccgaagcgcgtcagattcgcaaggcgtacgag

SEQ ID NO: 27691 - DNA, 535 bp, Sorghum bicolor
  Clone ID: 7218059
gcacgaggcacggccggccatcgctgtcgtcatggctgttggcgcgatggaacaagcctcttctccggccgccttcgaccacggcggcggcacgaccatcgacgacctcccggcggacgtcctggctctcgtgctccgccgcctcgacggcgcgtcgctagcggccgtcgggtgcgccagctcggggctccacggcctcgccaccgacccggacacgtggcgcgcgctctgcctcgccatgtggcccgccgtccgcgacctcctcccctacaccgtcgaccaccgggcgctcttcgccgacgccttcccgttcccgtgctcgccggactcatcatccccgtcccagcccccgaccctgccggcgcgcctcgtgtcggcggtcgacctgcggcacgcgggggtcagcatcctgtcccgcgtcgtggagacggacgccgccgcctccgactggttcctgggcgcgccgttccgcgtcgacgcgatggtgcaggaaggcttcacgtcgccgacggccggcggcgcctcctcctccgga

SEQ ID NO: 27692 - DNA, 580 bp, Sorghum bicolor
  Clone ID: 7218071
gcacgagggcctcttctgttttgttttatctgctgctgcggtccaccaccatggatcttcgagagataacttaaaaatccaatcctgcagcagccagcctccaaagcgagactctgtagcgtgtgccgtcagccgtgtaggtgtagcatccacccgctttggttggattcttgttgccgctttcttctcctgatcgtccgcattgagttgagagagattctcgtttgtgcttttgctggacgccgcctgcaatagcggtttctttggtgaccatggtgaatgacggcgagcaatcggcgatcgccaccgccactgccgtggagcctggcgtcgtggagcggggccgcgtgagcggcggcgggcggcggctcgcgggggagagctcgggcgaagaggaggggagccagcgcttctcggatgctgaggaccggtcctggcactcgcactcgcggcaagggtcggccttggaggtctgtatctccgcgtccgcatccatcagctgcgacgccgacgccgccagtgccggcggcgtggacacggccgccgaacgcgccaggaagtcgtgcgtgtcggagtgctc

SEQ ID NO: 27693 - DNA, 544 bp, Sorghum bicolor
  Clone ID: 7218075
ttgacggtgaaaaatgggctaaacatcggaggattcttaatccggcattccatgcggagaagctaaagggaatgctgccggcattcttggcatgttgcaacgaactggttgacagatgggagaaacatatttcatcttctgttgaaccaaccgagctggatgtgtggccagagttccaaaatttatcaggagatgtaatctcaagagctgcattcggtgttggttatgaagaagggagaagaattttcctacttcaggccgagcaagctgaacgccttgttcaatctttcaggataaattacatccctggcttctctctcttgccgacagaaaacaatagaaggatgaatgcaatcgatagggaggtcaagacgatcctgaggcgcataatagagaagagacataaggctgttacggacggtgaagcaaccaaggacgacctgctgggattgctactggagtcgaacatgaattacagtgactcggatggcaaatccagcaaggggattaccgtggaagaggtgatcggcgagtgcaaggtgtt

SEQ ID NO: 27694 - DNA, 558 bp, Sorghum bicolor
  Clone ID: 7218079
gcacgaggcactttcacagcttcattcaccgtttgcaggtcaaatcaaacgttttatccttctttgtcacatatctctacaaccaagaaacttcttaccaaaatgaagctgtcttccttcctttacaccgcctcgctggtcgcggccattcccaccgccatcgagccccgccaggcctctgacagcatcaacaagctgatcaagaacaagggcaagctctactacggaaccatcaccgaccccaacctgctcggcgtcgcaaaggacaccgccatcatcaaggccgactttggcgccgtcacccccgagaactcgggcaagtgggatgccaccgagcccagccagggcaagttcaacttcggtagcttcgaccaggtcgtcaactttgctcagcagaatggcctcaaggtccgaggtcacactctggtttggcactctcagctccctcagtgggttaagaacatcaacgacaaggctactctgaccaaggtcattgagaaccacgtcacccaagtcgttggacgttacaagggcaagatctacgcctgggacgtcgtc

SEQ ID NO: 27695 - DNA, 573 bp, Sorghum bicolor
  Clone ID: 7218080
gcacgagggttcctttgttctaccttgaactccgtcttgtcaatcgcacagctacccactcgcagccccacgattgttgcgcatctcaagcttgcaatcagcactcagactttgtccataacgcgctaacacaaaatgccgacagtgtacagctctcagcaaaaggctgccattcagcaattcataaactttacacaagtcgaccgaaactcggcgataaggatcctgaagagccatggatgggacccgcagagcgcagtgaacgcgtactatggaggcgggggttccccccagccttcttctgcagccaagtctgctctcaacaccctgttcgataaataccgagaggctgatgctcaggacaaagacattgtcggagctgagggtaccatgaagttcttcgaggacataggagtcaacgctgaggacctggacgcgttagccaccttcgagatcgtccaggcaccgactatgggcgaaatggctcgcgaagggttcgtcaagggctggtcagagcgcaactgcgacactgttgagaagcaaaaggcgtatattcaaagtctcaaggacgaa

SEQ ID NO: 27696 - DNA, 558 bp, Sorghum bicolor
  Clone ID: 7218092
gcacgagggggtcgacgaggaacccgtacaacgccagcaaggtcgccggcggctcctccagcggctccgccgccgtcgtctgcgccggcctctgccccgtcgcgctcggcgtcgacggaggcggctccgtccggatgccggcggcgctgtgcggcgtggtcgggttcaagcccaccgccgggcgcctctccaacgccggcgtcctcccgctcaactggaccgtcgggatgccgggcatcctggccgggaccgtcgaggacgccctcatcgcctactcggcgatcgtcgatcagtcccagccatcctacttgcggccggaactgaatcttcctcagctcagctccacgccctccatcggcaacatcaagctcgccaaatacggaaagtggttcaatgacagcgctgaggacatcaggagctgctgcgacaaggctctgcaggcgctgcacgcgcactacggctggcagacggtggacgtgacgatcccggagatcgaggagatgcggctggcgcactatgtcaccatcggctccgagtgcaccacgtcgctcgccaaat

SEQ ID NO: 27697 - DNA, 583 bp, Sorghum bicolor
  Clone ID: 7218093
gcacgaggcacgatcaaagagggtttatttctcttgattggtgatgatttgcttcacttagtccttgtttagttcttcacccaaaaaaactttttatccatcacatcaaatctttggacatatgtatggagcattaaatgtagacgaaaacgaaaactaattgcacagtttggttgtaaatcgcgagatggatcttttaagcctaattagcccataagtagccatagctgctacagtagcccacatgtgctaatgccggattaattaggtttaataaattcgtctcacactttccaggcaagttatgtaatttgtttttttattagtctatgtttagtactttaaatatgtgccgacatatttgatgtgacacacaaaaacttttcgtcttgaaactaaacaaggcctcattgataaatacttgcctaattgctatgctacacaggtttttgtcctttcaactttgagttttgagttagcatttgatctttcatttttctcaaatttagtgaaaggatggaatttgggccaccacttcggtttacatccaaggctgtggtgtcaactcacgtgtccacgccaa

SEQ ID NO: 27698 - DNA, 606 bp, Sorghum bicolor
  Clone ID: 7218096
gcacgaggcagtgatcaataggtgtgtcctctctcgagctcccacatggatttattggatcgggaattgggatcgcttcacattcaagatggggcatcacaagatgggtattattcattatttaaatatgcacgtgaaaatgatgtcacacgaatttcacaattattagtaacatatccaacattggatatcaatcgacgggatagtgatggagatactgttgttcatatggcagcccgtggcgcctgtagagaggtactacgatggttagctgtccactgtgatactctggatctatcattatacaattatcatggttataccccactcatggtggccacatccacatatttatccagtattcataatcctgcatatgctttattcatacagcttctccttcagcttggtgctgatctgcatcaacgtactcccaatggaattactgccatggacatgttacatacgagtcgaatgacgactacctccgacatacaaaatctggcagaggttatgcaacaggcacaacaacatcctgcacgggatgtattagctgctaaaaatcgtaccatagcatctcttcgtgcacagctacaagccgaacaa

SEQ ID NO: 27699 - DNA, 585 bp, Sorghum bicolor
  Clone ID: 7218102
gcacgaggataacgagcagctcatcgaggaaggaaaggttgggcaagaggaatacgaaaagacggacgagaaggcgcgcgaactgctacgaagactcgccaacagcaagccttactttcgcaagggcaggactatcgaggagggggagagctccaagggtggaaacgcagctgtaggcgctggtcttggaggacctggcccaattcgaacccgagactcaaaggcagccgctgctgcgggagccaggactggtggtaagggtcgtcaggtcttccccagtgctgcccaactcccacctaacccacgcgactgggctcctcccgccgacaagaacatcatgtcactctttgtgacgggtatcgaggatgatctccccgaatacaagcttcgtgactttttcaaggttcacggcaagatcaagagcttggtatgctcacatatgtcgcactgcgcatttgtcaactacgaaacccgagaggcagctgagagggcagctgaagcatgccagggtcgcgccgttattgcaggatgccccctacgagttcgatggggacaaccaaaggctattggtactatggacaagga

SEQ ID NO: 27700 - DNA, 619 bp, Sorghum bicolor
  unsure (1)..(619): unsure at all n locations
  Clone ID: 7218114
gtcggttcattttgtccgcttttagaaatcttgtcactcaacaactttgaagggtttacagacaggagccttacttcaattgcgaaagggtgcaagaatctcacagatcttgttctcaatgagtgccatttactaactgatagaagccttgaatttgtagctcgtagctgcaaaaaattagcacgtttgaagatcagtggttgtcagaacatggaatctgttgcattggagcacattgggcgatggtgtccgggccttttggagctctctctaattttctgccccaggatccagaacagtgcatttctggagattggtagaggctgctcacttctcaggactctttttttggttgactgttcaagaataagtgatagtgccttgtcccacatagctcaaggctgcaagaacttaacagaactttctatccggcgtggttatgaggtaggagacagagcattgttgtctattgctgagaattgtaaatcacttagagagttaacgcttcagttttgtgagagggtatctgatgcagggctgtctgcaattgcggaaaactgccctctgcagaagttaaacttgtgtgggtgccatctaatcaccgatagtggcttgnact

SEQ ID NO: 27701 - DNA, 641 bp, Sorghum bicolor
  Clone ID: 7218115
gcacgaggatttccaaaaactaactaaccgccactccaatcaataacatgagtttcaatcaaccaggccgagtcctcgccccaggacaattcgctggtggtctcgtcagaggtgcctccccagctttggtcgcctcaaccggcccactgctgaccgcctcaaccggcccaatcggcgcccaagttttggcttcaccatcccgagtcgtcggtgctccatacctcgccggtggtgcaggctacctcgcccaccacggtgtcgttgctgccccacaagtcatcaccgcctcccaaccaatcatcgcccaacaattctaccaacaaccattggtcgtcggcgtcggcaatgaaggtgaaatcgccaacctccgagccagaatcctcggattggagccacaattcgctgccctccaagccgaaaacgctcgactcgtcgctgaactcaacagccgaatccaaatcatccaagaaacccaagcccgagtccacctcctcgcctccgccccaccaggagtcgtgaccaacgagcacgttgtcgacaaggtcgttgacgtcccacaaatcgtcgaacgagttgtcacccgtgaagtcgaagtcccagtcgttgtcgacagaccagtcgagcgattcatcgaacgacca

SEQ ID NO: 27702 - DNA, 585 bp, Sorghum bicolor
  Clone ID: 7218116
ttcttgtccctattcaggaacacataaaccgccttgttgctattcgtgcgcaggctgacattatgggctccgatctcctcgccattgcacgcaccgacgccgaggccgcaactctactctccaccaacatcgacccccgcgaccatgctttcatcctcggctctacaaaccctactcttaagcccctcaacgatctcatgatcgccgctgagggtgctggcaagagtggcgttgagctgcagcgcattgaagatgagtggctcgccaaggccaacctgagccgcttcgacgacgctgtgaccgctgccattgatgcaggctcttcctctgacaaggctggtctcaagcgagactatcttaccaaagcgaaaggcaagagtaaccttgaggcgagggccatcgctcgccaggtacttggccatgatatctttttcgactgggacgccccccgtacacgcgagggttacttccgtctcaagggtggttgcgactgcgctgtgaatcgagccattgcgtatgctccttattgcgatgccatttggatggagtctaagctgcccgactatgctcaggctaaggagtttg

SEQ ID NO: 27703 - DNA, 555 bp, Sorghum bicolor
  Clone ID: 7218122
ctcgacctcccaccaccacctcctccgcgccgcggcccccgtcttcctcagttcctcctcccgacacccctctttaactcgcccccgcttccaaaaaatgctccagttaatttaatccagacgaggaatcgcctcgccccgccccgctccgccccggatctctcgcccgcgaatccccaggcccgcccgctcgctcgccgacaggaccccgccgcgatcggctccggcgggaggttgactagctcgcactgcggcgggggggcgtcgccgcacggccgcagctcggcacgggggggcgctcgtcgggtcggcggtcgctttctttcgggtcgggccctgctgtcgaggccagcggtgccggggcaatgcggtcagttcgtggagctgtttgaggcgcttgggctgggggatctgagtgagggtgccaggtagctaggggaagcgaacgagcttctgtcggtggggagttggtggtggttgtaggcggtagggcgcgcgttgggctgccggcagggatggagcacgtggtcgggggcaagttcaagctcgggaaga

SEQ ID NO: 27704 - DNA, 156 bp, Sorghum bicolor
  Clone ID: 7218123
gtcccctgctcactcaccctgctccttgctttccgctgccgggccaccatgcaggcacacgccgcccgccgtgcctttggttacctggcctctaagatccatcctcagttgccgctgaccccactcgagagccatcagatgctcaacctgctcacc

SEQ ID NO: 27705 - DNA, 587 bp, Sorghum bicolor
  Clone ID: 7218126
gcacgagggaccaagacttggtgcgctagcaagtattataataggctgtaagctggctaaatactgaggtggagaggagagagaggagaagcgggctgtaagcttacagccagcttaggcacaggaacgaaggaactttgtgagagagataagtgagccatatattaatagtgaatagctaactattttataggtgggttaggagaaggctataaaaaaaccttacagacagcaaatacttgctctacctgtgccctccgcacgttggtcgatcgttgctggggcggagttggcgttggcgtgccgtgtaggacggagcgaggctccggcgagactttcagacttggcaggtttactgtgcttgccattgttcacccgacgttgattagtcttgagcttcaccgtcaccgatggcgtgtcagctgcagtgggttcacaggagagaattacaaggtcaagctgttgaccgttgcgaggccaagggcgcaatgtaaccctgcagcaagcttgtacaaatctgctatttatgagttctgatagcacgtgtgcgcctaacttttccagcgccctggtttgttaagcggtcc

SEQ ID NO: 27706 - DNA, 612 bp, Sorghum bicolor
  Clone ID: 7218141
gcacgaggctcaccactctcgtcaagcctgaagtctcgcacaactcttgttcccgctgaatgattgattactactggctctctctgcctatcgatgcaaggcattggatccaaactcactcactcacctcacactcctttctcccagtttagttttatcctccaaactacagcctcttctctttgtttagacgcgacctgacttgacctggaatttgaaaggtctaggggcctaggacctgagttgtgggcattgtcttttactgacataaccgaccgctctactcttttttctttaacagtgcagaactcgtcgtccccgatcgtcatagcatagcatacctagcattgccctgccttgcttgccttgcatcgcattcactgccttgcgttgcgctccagttccgagctctcttttttttggagaatactatttttgctcgcggcagcgcttggtctcttattcactgccctttgcgccactcgacatcgtcgagctttggctgaagcgcctgccttgattaagttgctctgttctgctactgctacgcccgtctttatatcgtgaggtttacctaggtactctctcgggtgcctgccttaacgtcaccga

SEQ ID NO: 27707 - DNA, 547 bp, Sorghum bicolor
  Clone ID: 7218147
gcacgaggatttatcatggagagtgttgtaaaaggccaatctcgtgggtcgaagacaagtgggacaagaagctcacggcattgacgagccttcggaaagaaaacgatcgcttgaaacaaaaggttgctgagctcgaaggacgagacagaacatacgagtctcgagtccagcgcgaggttgatgaacataaacaggctgtggtcatgcttcaagagaagctaaaggatatggaggataggtgtcatacgttagaggcagataatgccaaaaggaggagtagcacgagtaagcctccgagcaaaatggcgatgccgcgaccctatcgaagcagcacaacgaatcttgaatatgggcctgggcttgaatcgtcaccaaaatcgaagtcgacaccggttacgccagcggcaaggccatcctttcagccgtggtctcggtcttatcaacgtctccctccagaacagagagcctcaccactacaacgacaggccgtctcaccgcgacccccgaatgacataacccccagaggttcaatcgaattcccgacctc

SEQ ID NO: 27708 - DNA, 562 bp, Sorghum bicolor
  Clone ID: 7218149
gcacgagggcgagcccacctcggcgggcggccttgcccccactctccctctcactactagcctccatctcccaaccctaccctgaagaagaaggagaagaagggcgccccaagatctgcatcccccaaccctagctctagaggagtgcttcctcaacgacggccggcgccccaagctctgctccggcgaagtgaaggcccctccagcaagctcccccaactgtgcaagctcgctacgtcaacatgaggctcaacaaggtggaagtgaaccttataaggctgctggaggctgctccccgccagcaaaatcaggctaaacttgtctattatgtaaccacagcccgggagctgttggagcagctaggagctgagactacaccagaagggatatcaagcatttcaaaagctaagctttctgagtattcagaaaagattgaagcactagcttccaggcttgctgcttcagtgcctgaaaatgaaaagccaattattgaaagcagagatgaaatctcttatgaagaagcaaagccagaaagtccaatatctttatcatcaggactgcg

SEQ ID NO: 27709 - DNA, 624 bp, Sorghum bicolor
  Clone ID: 7218156
agttccttccaataaatctgacattattacatggaaacctgccactaaaggggtttgctctgctaaagaagcttttaagttcctcaaccaacagatgcaggtatcaagaccaacacagggtgcgcgaggcattactgatgaagcaatgaatatcctaaggagaatgtggaagcacaaaatgttgccaccaaatatcaaaacttttggttggaggctaatcagaaaagcaatcgcaacgggtgcaagagcagggaacctatcctcaagaattagcaaacaatgtgacagatgcaatgacatggaaaacgatgctcatcttttcttccactgctcctttgctagagcagtttggttttcatctaacactcctatatacacttcaatgctacctattgaacaggatggagtacaggagatcttggcgggcataatcacttctaacacttctgaacaacagatgcaaagaatcatgactacactatggtacttatgaaaggcaagaaatgatctacgttttcaaaaaaaaacctggactgttttgcaggtaaaacatgcagtagaggcggacatcaaggtctcattcttagaggcaggcgataatgcagcaactaatctatcagcaac

SEQ ID NO: 27710 - DNA, 544 bp, Sorghum bicolor
  Clone ID: 7218157
gcacgagggcggtagcggtagacccaaccaacctcctacccgcctccgcacccgcgcccgcgagctccaggccgagcccaagctagggtacccgccctcggcacgatgtcgctgtcgccggcggacggcgcggcgtactggctgcggtgggaggtcctcgtctgcggcgcgctcatcgcgctccccacggcggccgcggcggcgctgctgccgcggctgcggagggcggcgccgcccctgcgcgcggccgacctctgggtcacctgctgggcgcgcctccacccgggctggctcctcgcctaccgcgccttcgcgctcgccgccgccgtcgccctcctcgcgcgcctcctcgtcgccaagggcctcaccgtcttctacttctacacccagtggacatttctattagtcaccatatattttgcgtttgccacagctatatcagctcatggatgttgggtttactcaaggaaaagtttgaggaaagctgatgaatcccatggatttcttaatcctgatgtcgaaaatcttgatgtttccaattcta

SEQ ID NO: 27711 - DNA, 586 bp, Sorghum bicolor
  Clone ID: 7218161
gcacgaggcgggctcggacctgtgcggttgcccgtgacgtcattagatggtcggcgtcgcgggctacgtggacctgctgtcgcgatgcggcgaagcgcgggcgattgtgcggatccaggcggcgctggtcacctccgggcatctccggcggagtgtagagctccacgacgcgctcatccgggcgctctcccgctccgcgcgcccgcacctcgcgctcccgctctacgcccacctcctccgcgccgggctccttcccaccccgcacaccctcccttccctcctcaagtcaatggcgctgtccccggcagccccgggcgtggcggtgctggcactcaccgtgcacgcccacgccgtcaagctcggcctggagcggttcgtcctcgtcagcaacgcgcttatccgcgtccacgcgggcttcctcggccgcctcgccgacgggctcctgctcctgcggacggccgctgcagtggacgcctccacgttcaacaccctcatcaccgcctacgcgagggcgggccgggtcgccgacgcccgggcactgttcgacgaaatgcctgtgaggaatgctgtgtcttggagcgccatg

SEQ ID NO: 27712 - DNA, 617 bp, Sorghum bicolor
  Clone ID: 7218171
gcacgaggaaaaaaagtaatagaaaaaaacaaaaacaaaagcacaagctgaaaatagagcatggcaaactatagctataaagtagctcaccaaaacttgctggtgaattttcttcctcatctgtttcctaatgctgaggctcatgttaatactagaagagtggaagtgagaaaagaagatgaacaattagaaactcctcttgtttatccttcctctctttcctctcttgaacttgatgtttggattccttctctttctctttcctttgaattccaggacgcttatcactatgtcacaacatggtattctcatttagataaagaaaaaatcatcacaaaagacaatattaagagaaatctgactcaacagcatggtgtgagtttagtggatgttccttgttggtgggatggatcaattgaaagtttaattgcaacaattcaatttcaaagacctgatttgctagacaataattatagcgatcctatttctctcaatcctcctcctaaattctttgaaagtttaacgatacctgaggttggggaactcatgttggcatcttttcctgcgtacaatttggaaattcttcctgattcttggtggataggcgaaaaatatga

SEQ ID NO: 27713 - DNA, 559 bp, Sorghum bicolor
  unsure (1)..(559): unsure at all n locations
  Clone ID: 7218173
gaacgaggcaccaaccatatgtgggagcggtttcagcccaggtggagggcgtggtgccgccttccggggcagcggcatcaaggccatcgaccaacggatcacggcagcaatggcgtacagccaccacatggagcagggcaacggcaaagccatccttgtcttgcgcgtcagcagccgcatgtcatcttcaagatttcgcttggtggtggcactcctgcaggccaaggcagtggccgagtggtggctagcaaggaagaagctgggcagcggaatagatggacacgactgcctgcacaacaatgctgttgcaatatcaagactgggtatcaacacctcagccaatggtgaagaagactcctctagctgtaactaagaggtagtgagaagaaacgtttcttccaatatagaaggtaagccttgtgttcaaaatgcaaaataaaaggacaatgctgctgagtaagagcagtacccaatagagcactagagctagacagttttgctntatattttgtactcacatgatagatgccaacagtttatgctaataatctcttttctc

SEQ ID NO: 27714 - DNA, 604 bp, Sorghum bicolor
  Clone ID: 7218175
gcacgaggctgaagctcaaagctgtctacatgtatgctgctggattttacacatattcaattttcgctctccttttctgggaaacaagacgttcggactttggagtatcaatgtcccaccatatagcaactgttgttctgattgttctttcctacattttcaggtatttttttaataaaattcctaggagagggtgattgccattcttttgcaaactgataccagcatcatgacctagctgtattgttattgtgcctatcaaacagattcgctcgtgttggctctgttgttttagcccttcatgatggaagtgatatattcctagagattgggaagatggccaagtacagtagctgtgagtggctagcagttgtggcatttcttctttttgtggcatcgtggatacttcttcggctcgttatattccctttctggatcctaagaagtacaaggtaaacagcaattatatgctgtcggttttctggcatccagctccttccagccatttgtcactgtaccttaaagaagcggtactccactaaaatcactggcacattctgtcattgatgatttgatttatcttttgtttcttttgttcagctat

SEQ ID NO: 27715 - DNA, 574 bp, Sorghum bicolor
  Clone ID: 7218176
gcacgagggccatttcaagctttccatgttgatagtgatcacatatgacctgtcttcttgtcactatgtgctttgtttcattcagaagtcagaatgcacatgtaccttatttgcagcaatattgggatttactgcactagtcgtagaaatgtagacactgttgctgtttgttgcatcagtgtatcactaccaatttattggccattgtttcctaacgaaatctccccatggagtaatggacgtgttccagttaggaaggacaataactcaccctgttgatcacttctttctaacaatttttctacatggatatgttccagctggtaatgaccatagcttacccttcttctgttggaaattactgcaactcgcagtgattaacatgatgctagttgcggattaataaggatagttttaggttttagccttttttgtaaaagaaaacttgtctggcaggggaagaccgcctccacagtatttttcttgttttattgcatgcaataagtcaaacaaaacaaaacagtacaataagctgatggtattatctcctacatcgccagtggcggatccagaa

SEQ ID NO: 27716 - DNA, 571 bp, Sorghum bicolor
  Clone ID: 7218182
gcacgaggattggggtgtccattgactgacaagaggacttgcgtaccgatatctagaggcgtagcatcaagatactcattgattgcagctcaagcttcaaatcttgaccatcccaggccttggtcttgatccctccaatgccgaaccaaagagacaacatcaaggatccccggtccgagcagacgaagaaaaaggacctcattgcgcgtggcgactatacgcctacgccggctggaaagttaaccttcttcgtcctgcgtggcgtcgaacctgttcttcagtactcaatcctagcgcatggcctcggcacatccgttctgcatcgcgtggggttaagaacactgccgagcggtctccctgcacacacgggcatatcattgatcgatggtctaggtctttcgccttaccgtctggtcttgctgggcatggcagtcggtgcggcagtcaaacagaacatatgggttacagcactgtctggggagccgatgccagtaggtgcagcagtcgcggtaggagtgttcaatgccgtcttcaacagtctcagctcatacgccttcctcacttcggtgac

SEQ ID NO: 27717 - DNA, 462 bp, Sorghum bicolor
  Clone ID: 7218192
gcacgaggcccccaccgctccggcctccggccgacggctggcgtaacgtgacgatcctgtccggtcgccccaacaacccgcgaacggagaggacgacgccttgtgctcccggtcgatcgatggttcaccgccggctctggggcccatggactccttccgctcctcgaattctctagcgtcgaggagctccctgacgctgggggagttagcctgcgcggcgctgttcccggtgctcgccgtggtcgatgcggtcctgcacgcggccttgcggtgcttccagaagacctcgcccagtctgctgcctgtgctcgacatatgcgcgcgccaccgagccggcagacgcctcaccttccgtgagctagccgagctcgctgacgagtcccgctgcttttcggtgaacgaggtggaggcgctgtacgagctgtacaagaagatcagctgctccatcgtcgacgacggtct

SEQ ID NO: 27718 - DNA, 249 bp, Sorghum bicolor
  Clone ID: 7218195
gcacgaggctctctctctctctctctctctctctctctctctctctccttcctttctgcttgtttgccccgcgactgagactagatcccaaaccagagtcaccgtcagtacaccaacgtcatctatcgcgaacctcgtttcttactcattcacgatctatgacctccgataccgaaaatacggcagtgttcgaccgacaataatcgctacccaaccaggttctctttgagtaatcgaacacgatgtctg

SEQ ID NO: 27719 - DNA, 396 bp, Sorghum bicolor
  Clone ID: 7218198
gcacgaggctcgccgtcaactcgacaatgccaccgttgttatcaagaaggtgataggacaagttaatgctgaggccctccctttgttcgacactgtcgcgctcgactaccttgcttatttctgcactgccctcgatgatgttcgtgattacaacgacgctgcctgggccaagatgtcccccatcctcgaggcctttgttgcccccgctcaagccgctgagatttacagcaccctcaatgctcacttcgttgaggagaacaccaagcgtggaatcaaggttgttgaggttgaccccgaggaaggagaggagttgtgtaactgcgagttctctcttgcctatggtggtatgatcttgctcaacaataccaagctccgtcttactcgtggacaacgtta

SEQ ID NO: 27720 - DNA, 448 bp, Sorghum bicolor
  Clone ID: 7218200
cttgatcatcgcatacctcttcattcaactcatctaaattttaaagctatacagtgaatataaaatctttaatttgttcatctttttttggtcaatcgttattcagctgtcatatttttgttcaacatggatacaatgacatactatgatctttctggcaaaagcatcccaaagccacgtttctccactcaagaagatatcgatgaagtacaattggatgaaggaagatttacattggattgttttgtttctgatatatctgcaaccataaaagtcaacacttcaaatggaatgaaaaaaatgttgaagattgttctttctggtgaacaaggggcaagctttcatggtgaggtttggcagcctcatcatgaaactttccttgaagtgtgcaccattggcacatgtttaagaatctccttcgttcccaaacccatttatgggaatttgt

SEQ ID NO: 27721 - DNA, 476 bp, Sorghum bicolor
  Clone ID: 7218201
gcacgagggcaggtgccaaacacagagaatcaaacgctccgcagcgaattcaattttgaaagccccagagagcttccatggcttccgctaccacctccatctcatcgcaccctgccgacctccgcgatgtcgtccaagctgcgaggattggcgcgctgaggcagcaggtgggcgtggccccggcggcggcgcgcggccagcgcgctcgcgcggtgcgcccgctgcgcgcggcggagcccgcgaggcagccggtggcggcctccgcggccgcggcggcgccggccgcgcccatggccgacgaggctgcggcggccctcgcggcggtggactacgaggccctggcgcgtgagctggatggcgcgtcgccgctggagatcatggatcgggcgctggccatgttcggctccgaaatcgccatcgccttcagcggtgctgaggacgtggcgctgatcgagtacgccaagctgacggggcgt

SEQ ID NO: 27722 - DNA, 531 bp, Sorghum bicolor
  Clone ID: 7218212
gcacgaggcgcggatctacatctcgctgtcgcgaaaggagaaggaggacgacttccttgcgatgaagggctccaagctgccccagcggcccaagaagagggccaagaacgtggacaagaccctccaagtatacaaccaaaccacctggccttgagctcgatctgatcctgttcctatccgatccgatccgatctctcttctcgtcgtcacaaaacttacatgtgctgcctttatcatgcagtttgtcttcccggggatgtggttgccagatttgacgaaaggccggtacgaggtgcgcgagaagaaatgcgtgaagaaggtataaatcgaaaaccattttttctactacgtactaccctgatctggcctgctcgacgatttcagctcatgcagcttattcagcagcgacgataattcctaactttttcctttttcgtttttctgtatggctgaaagaataagaagaaaaagaaaggggggacgcagggaaaatcggttagaaaaaaattggggcatgggtgtgcgaacgaa

SEQ ID NO: 27723 - DNA, 494 bp, Sorghum bicolor
  Clone ID: 7218217
gcacgaggctacaagctgagagaagaaattaagaatgtcctaggtaccagaaaatgtttgtttgtcttggatgatgtttggaacaaggaggtgtaccatcaaatgatggaagacattttcaatactcttcgagcaagccgtatcatcatcacaacacggagagaagacgttgcatctcttgcatcttcgggatgccatcttcagctccagcctttgggaagttcctatgcactcgacctcttttgtagaagagcctttaataacacagctgaccgaaagtgcccccaagagcttgaggatgtggctgtttccatagtagaaaggtgtaagggcctgccattggcaattatatctatgggcagcctcatgtcctccaagaaaccaactaaacatgcctggaatcaaatgtataatcagttccgggttgagctagcaaaaccagacaatgtgcagacaattttgaagcttagctacaacgatttaccagggaacct

SEQ ID NO: 27724 - DNA, 135 bp, Sorghum bicolor
  Clone ID: 7218229
ggtgttaaacaggttgctgaaatgaacaaaccagttgttggatctgaaacttttgatgcacaccataatttgaagagttcaaatgataaaagtaaacatatgccttcagaagcggaatgtaccaatgcagaggtt

SEQ ID NO: 27725 - DNA, 499 bp, Sorghum bicolor
  Clone ID: 7218235
gcacgaggcatcgtcgagaggatagagtacgaccctaatcggagcgcacatctggccctcctcacccgcctggcaacgggcgaaaagtcctacattatcgctgcagatggcatgcgtgctggagacgaggtcgagagctatcggagcggtatcccccaggagctaattgccagtatgggcggtggtatcgatcctggtatgctggctgcaaagaccgctgcccgtggaaactgcctccccatccacatggtgccgctcggttcccaagtttacaacgtcggttccaagacgcagggcggaggcgtcttttgccgaagtgcaggcacatatgccattatcgttaataaggaggaagtagaaaaaggaagccgcacagaaatcaaacatgtcatcatccggttacaaagcggtgaaatccgcaaggtcagcgccgacgcgtgctgcaccattggcgttgccagcaacccacagtcacacttcacatcccttggaaaggctg

SEQ ID NO: 27726 - DNA, 494 bp, Sorghum bicolor
  Clone ID: 7218239
gcacgagggttggcaggactcatccgcgtgtgcggcggcctacaccaagaacagaaccacccacacatagtcttcttgcgggccagaaacgcgaatcacgatgattccaggaatcgcccccaagacggcggcggcggtgccggtggcctgggcacctcagcctcggcacatgttcgtgtttggcgcgggcttcgtcggccgctacgtctcggagcgcctcctcgcgcagggctggcaggtttccgggacgtgcaccagtgtcaacaagaagagagagctcgagatgctgggcatgaatgcttccgttttcgatgctacagagagcagcctggaaaatattcacaatttgcgacaagcaactcacttgctcatctccatcccacccatccctggaattggtgatcctctacttaatttaggcgaagacctgaggagaacactcagccatggtaatcttgaatggttatgctacctttcgtcaacaagtgtgtatg

SEQ ID NO: 27727 - DNA, 490 bp, Sorghum bicolor
  Clone ID: 7218250
gcacgaggtctgaataaaaaataatgtttccatacagctaaccaatcatgtcaattctgcattttgcactattaatcttttttgtcaaatgagctattgaattcctggaatcgatatttgaatgtttagaactctgcactcttaaacactagtgggtattggtaaacttcaacctcatcggaattttggcattccactttagtcaatatggcataccagttttatttgcagtttggcttcgtgattttattccctgtaatacaaacattgtatgtaatatttgcaatctttctgcagttaattcaattaatttgatgctgaatcctgtagagaaggcttataagttagtagcgcactgtgtagctgttttgtcaaattttcttatgtgtttaagcttgcatcaaaaccatggagtttgtcttagtaagaccatgttaacctcgtccgtctgcaacctctgagctaaatagtggtttcatacaagttttac

SEQ ID NO: 27728 - DNA, 577 bp, Sorghum bicolor
  Clone ID: 7218253
gcacgaggctcgtctcgactagtcgtcgcccttctttatctgcatctttgatagattgcatacacactccctactcggcggtgccgatcacataactacaactatcgcctcagccccgatctttcgttgttgctttcaccttgtcatcccgactgtgatcgacccgaatatcaaagtataacttcacattcattacataagtcgactgccgtctcggaaaacacagttccatcggtctttacccaatctccttgatcaggaataccagtcacatcagccaagatgattgccaacaagctcaccatccttaccgctaccaccgctcttcttgagccggctctcgctctcggccaccgccacgctcaccaccagcacgcccagaagcgtggtgactgggtcgttgctaccatcgacggtcaggtcgtctcttgggagaacaactacttcggccccggcggttctgcccccgctgctacccagcctgctgccgcttctcaacccgaggtatcttctgctcccgctcccgctgccgctcagcctaccaccattatcaaggtcgccaagccctctcaagctg

SEQ ID NO: 27729 - DNA, 558 bp, Sorghum bicolor
  Clone ID: 7218257
ccaaattttaacctcttcctcaccattcaggtatcatcttattcacacactcctaggccacgaatccaagatttagttgatcacatacagtttttccatatttcattccttcgtaatgaataagcctatgagttcattgctgcttgcagctactttactggctggcggctctattgcccagcaaactgtttgggggcaatgcggaggtcaaggatggagcggcccgactagttgcgttgctggatctgcttgttctactctcaacccctactacgctcaatgcattcctggagccactaccatgtctaccacaaccaagccaacctccgtttcagcatcaacgaccagggcgagtgcaacatcgtccgctactccgccacctagctctggcctcaccaggtttgctggagttaatattgccggattcgattttggctgtgggactgatggaacctgcgtcacttcgaaggtatacccaccgctgaagaactatgctggcacaaacaactaccctgatggcgttggtcaaatgcagcactttgtcaacgatgacgaatt

SEQ ID NO: 27730 - DNA, 605 bp, Sorghum bicolor
  Clone ID: 7218258
gcacgagggttacttccaagaaagaccaacagcaatactggtaccttgatcaggagcagtatcattatgtatctgtaccagactttgcacaacgtttcaagtcattccatgcatgccagcagatgcagaaggagttgcaaattccttttgaaaagtccaaaacccatcctgctgcgttgaccaccagaaaatatggtctttccagctgggaatcactcaaggcagtgatgtcgagagagcaactattgatgaagcgcaactccttcatctatattttcaaggtcacccagctgatcatccttgcactcatgtccatgactgtgtttctcagaacaaagatgccccatgggcagattgctgatggcaccaaattctttggggctctgacttttggtttaataacgatcatgttcaatgggtttgctgagctacaattgaccataaagaagcttccagttttctacaaacatagggatttcttattcttccctgcatggaccttaggagtggcaaacataatcttaaaagttcctgtctcgctcgtggaatcagcagtatgggttgctctcacgtactatgtgatgggctttgcacctgctgcagga

SEQ ID NO: 27731 - DNA, 204 bp, Sorghum bicolor
  Clone ID: 7218259
gcacgagggaacgtttccctgaaggctcgcggagcctccgcatactccgttggtattctagatatctacggcttcgagatcttcgataggaacagcttcgagcagttgtgcatcaactatgtcaacgagaagctgcagcaaatcttcatgcagttgaccctgaagacggagcaggaagaatacgcgagggaacagattaagtgg

SEQ ID NO: 27732 - DNA, 302 bp, Sorghum bicolor
  Clone ID: 7218261
gtacagtaacatcatcatcgcccagatcttgatggaatatgatacaccgctgaagatatctgctttcaccatcttagcaaactagtctgttctctgagaacatgccgattaaggtgttcctgttttacaaaataagatgtcaaggcttgcttagctgccaagaattttagcttgtgcaaggaaggaacaaaagaaaattactgactgtagtgaagaggatatataattatgtgtcttctaagcaaacactgagtaaatgtatatgtaagcattgagtacttgcttgactccttggatttcta

SEQ ID NO: 27733 - DNA, 523 bp, Sorghum bicolor
  unsure (1)..(523): unsure at all n locations
  Clone ID: 7218264
gcacgagggccggctggcctatctgaacaacacgtgctatgactgcccggcggagctgtcgtgcaccacggtgtcgcccagcgacgccaacgaccacatccagcagggctgcacgtcgtgcacggtgtacaccagctgcctgggcgccagggccgagaacttctacctggccgtgtactcgagcgacggcccgggcacgcagcaggagccgtacgcgcccatcacgtacagcgtctttggccagacgtacgacgccttcgaggcgatcgagccgggcgccaccagcacggccgtgaccttctcgtcgctgccggcggccacccagcgcacgccgttcgcctttggcaatgaggaggcgttcttctactcggtgagcacgggcggcaacgtccagtcggtgcgcatcaccgccgacgtcagcggcagcacgcccaactcggccatcaccatcgaggtgtacgccgacgcctgcctgaccgagctggtgttcacgcgccactgcngtctggagtacagcaacggc

SEQ ID NO: 27734 - DNA, 472 bp, Sorghum bicolor
  Clone ID: 7218265
gcacgaggccccattctccatcattgccttattagtttaggttgtcattgtcatcagctgggctccattcataaggtatcggatcccaacctgacttaaacctgacgggccggacctgttttcgattgcactttgcgcctctgcctcttcttagcgactttttgttctcatcgcctttgggcgtctttgctgcttttcttctgcttctctcgccttgttgaatgcgccatcgtccttgtcctcatctacgacactgttgcattataccagatcatcgactctcgatcgatatcatttatcgacccgctgaccgccgattgcctcgcttcccacgtttccccgcgatctgccctggatgtgagcgcgctatcatcgtgaccttgtttcacaactacctcctcatcttcaacttccacctcaacttcctccgccgttttctactcttctctattctctccgaatatggcggccc

SEQ ID NO: 27735 - DNA, 549 bp, Sorghum bicolor
  Clone ID: 7218266
gcacgaggcaacaatgggtgatgttcattggtatgattattcaagtgatttatatgaagtttcaaactttcccagaccacgttttttgagtgaatttggtgttcaatcacaatcatcattgattagttatagtgcagtgagtcaatcaattgattggtcttggaacagtgatttgatgttatttcgacaacatcatcccgatggaaatcaacaaatgatcgatcaaatttcaatgcatttcaatcaaccaaatagcaccaatcaaacactattatttagtgatcagatctatttatcacaagtcagtcaatcaatgatttatacaacagcttttcatcattggagacgtattcaatcggaaaaaggttattgtaaaggtatcatttattggcaattgaatgatcaatggcaagcaccaagttggtcatcgattgaatataatggtcgatggaaaatgacacataatcatgtcagtaatgcctatgaacaaagattgatctctggatatttgacacctttataattaacgaaaaacgtcaatcaatcaaa

SEQ ID NO: 27736 - DNA, 574 bp, Sorghum bicolor
  Clone ID: 7218267
tttgtctccgttttccttttttgctttttccttcttttctgcatctccaaaagtgcttctttcttgggtgcctgccggataatcacccaataatcaccccgccggatcctctgcgaaatcaacggctccttgcttgacaaaaaagtaccattgactctaattactccgttctgggaccacgtccagacttccaaaccgcaaaaataaaagcgactttcgaattgagttacgtcttgatcatttgagaccaactggcctttgcagatttgctttttccacgcctgcagcacgtgtcatctaactcctttattctcccctcaccccttccccgctctcgacttatctttcttatgccgggcggcgcacacttaaacaccaacaaaacacccccaaacgcccagtagattgaatcgaatcattcagtcacaatgggcttgttcaagaggaaagattcaaaacattcgattcatagcgaggaggaccaggatacccaatcggcgcacagtacacgaaactcaacagcctccttaaggtcgtctgcgatcaaatcaaccggaaatctgccggtgtcaat

SEQ ID NO: 27737 - DNA, 500 bp, Sorghum bicolor
  Clone ID: 7218270
gcacgaggatcgtcgccaaatcaattaatcaatcatcgcaatacacatacctgacacccgaaaactccatcacaccatgcttttcaagccgctcgcccttgcagcgaccaccgctgctgtgctcatcgtcccagagacctctgacaaggacgacagcatcttccgcgctcttcccatcgaggtcgacactttcgaggttcccgagaccgcctatggtcaagtcatcgacgtcccttgccttcagtgccgcggtcataatagccagctcgaactcaatttcggcattcaagaccgtcgcctggtattaaacggtttcgaactctatcctcatgccgacccttggaatggagacctgtcggctgctgttatcaaggccaacggcaagagcgatatgcgacgactgggatacggtttggctatccggcctgaaggagtcgataaggatcaacatctcgaggttgtcaatgtcgaagtcaggatcatcgaagtcggcgaccgtt

SEQ ID NO: 27738 - DNA, 527 bp, Sorghum bicolor
  Clone ID: 7218276
gcacgaggctctttacacttcattcttacacccaaatatacccaatgtcttctcagcgtgatctagaaagtaggaatgtaccggacgagcgcgcgcccctgctcgcacatgaggagaggcgcgagtactcggcggtaccttcggaacatgaggatgtacctgaagactcgcaggaagaggtatcaaagacatggacatatgtttggaggggtttctgggccattttctcgatcctgataatcgttgtcttcgtaaaagcatggatagacgcagacgatgtcaagtttgatctcaaaggagctctaaagcgtgccttgggcggtggtgtcagcggtgccgcagccatggtcctgcaggttctactactgatgcccatccgcaccataatgaactaccaataccgccatggtacctcgacaaccaccgccaccaaaacactatatcgcgacggcggcatcggacgctactaccaaggcatgggcgcagccctctttcaaggtcccattgcacgcttcggcgatacggcg

SEQ ID NO: 27739 - DNA, 572 bp, Sorghum bicolor
  Clone ID: 7218283
gcacgagggtgctgcgctcctctgagtacttcacaaggccatcaattgatgagctggtagagagggaggtggctaatcctggatactgcagcagggttccaaacttcatcatagggagggctggatatgggcaggttaggttcttgggcgacaccgatgtgaggggcattgacctgaatgaaattgtcaggtttgaaaaacactatgtggtggtttatgaggatgagacttgtaagccacctgtagggcatggtcttaacaaagcagcagaagtgtccttgctgctgagtttgaaggatcttccggagcccagtatccttgttgaggtgctaaggtgtcgtgcaagaaagcaaggttctaggtttctttcattcaatccagtgaatggaaaatggaaatttgaggttgatcattttagtagatttgggcttgtggatgaggaggaagaggatgctgtgatggacgaggcagctgttcggcagccaattactgaagtaagagaaagagacccaccttcaaatggtcatgaaattgagctttcccattcattgcctgctcatctcgggcttgac

SEQ ID NO: 27740 - DNA, 459 bp, Sorghum bicolor
  Clone ID: 7218284
gcacgagggagagagagagagagagagagagagagagagagagagagagagagagagagagagagagagagagagagagagagagagagagagagagagagagagagccacagtgagagaggctcttgggattcacaagggaacagttcctctatggttaaggtgcaacaagggcataacgtatgtgaaagatattcaaagttcagtgaagtaccatttggatgtgaccaccaaaggatacagaagtctagtttacagtggtgatcacgacatggctgtaccttatattggcacgcaatcctggattaggtcccttaatttctctgttgtggatgactggagaccatggtatgttgatgggcaagttgcaggatatacaacgttgtactcaaataacctcacatttgcaacagtgaagggtgctgggcatactgctccagagtacatgccaaggcaatg

SEQ ID NO: 27741 - DNA, 476 bp, Sorghum bicolor
  Clone ID: 7218288
gcacgaggcacatttctttcttgaaaacagattcaatctcgactcaattcctatttccatctattcaatctacaacttcaactcccaacatccatcatgggcagcatcgatatcccctctgagcagtgggcgcagatcgtcgaaaagaccggtggacccgtcgtctacaagaggatccccgtccagaagcctggtcccgatgaggtcctcgtcaacatcaagtactctggcgtctgccacaccgatctccacgccatgatgggcgactggcccctcgacaccaagctgccccttgtcggcggccacgagggcgccggcgtcgtcgttgctcgtggcgagctcgtcaaggacattgagattggcgactacgccggcatcaagtggctcaacggctcgtgcctgagctgctcctactgccagaacagcgacgagtcgctctgccacaaggccctgctctccggctacaccgtcgacgg

SEQ ID NO: 27742 - DNA, 609 bp, Sorghum bicolor
  Clone ID: 7218290
gcacgagggcacagccttcttcagctcagtcgccgggctgtgaatcaccaagcggatcttcagggtttgctaaaggtctatcttctttgacacattcgttcaaggccatgacagctggtctctggcccaagcccgatcctttatccactgccctttgtcaagctgctctgcgcggcgatgttcagcaaatgagtggtctactcgcacaaggagcgaacatcaatggacgaaacggagagggcaattcacctctaggctgtgctatcctggctaatcaagaagacgctgtgcggttcctcatcggctctggtgcagacaccaacggcaaggacatgaagatcccaccggtcttcctggccgcatcagttggaagcattggcgttgcaaagatgctcattgatcagggaacatggaatgttaacgccgccagctggtctggacaatcatactttgtcgatgtatgcaacagtgagaatttggagggtattcagcttcttttggacaatggtgctaagccaaacaccacgaacacctctggacgaccggttcttgcacaggctgtcaagaaaggcaacttggagctagttaggatgctgcttcgacatggcg

SEQ ID NO: 27743 - DNA, 590 bp, Sorghum bicolor
  Clone ID: 7218291
gcacgaggtacaattactctatctctaccatccatatcccatcatgagtctgaacgttacaattgtcggcgcaaatggcgaagccggtttgtccatcatcgatgctctctcgccttctccaaacgagtttaaattgaccgcaattgtacgacctgcttccatcaacaaacccgaaatccaacagatcaagaacaagggcgtttctgtggtcccaatcaaccttgaaaacaaccacgacgaactcgtcaaggccctcaccggtcaagatgtagtcatcagttgtcttgtacctttcactactggtcctgaaattgctttggcaaatgcttccaaagaggctggaatcaaacgattcctccccagcgcctttggcccgccctgccctcctgaaggtgtcatgcttcttagggagtttaaagagactatcatcaaccacgtcaagaaaatctatcttccatacactgttgttgatgttggcatgtggtatcaagtctctcttccatctctcccttctgggaagattgactatgctctcaaattccccgccgctgtcgtcgctgaggatggctcacatgccacaagcttgacag

SEQ ID NO: 27744 - DNA, 566 bp, Sorghum bicolor
  Clone ID: 7218296
gcacgaggcacacacctctctcacacaaccactcccaaagctctagcacgaactcgccatgcagattttcgtgaagactctcaccggcaagaccatcaccctcgaggtggagtcctcggacactatcgacaacgttaaggcgaagatccaggacaaggagggcatccctccggaccagcagcgcctcattttcgccggcaagcagctcgaagatggccgcaccctctcggactacaacatccagaaggagtccactcttcaccttgtccttcgtctgcgtggcggcatgcagatctttgtgaagaccctcacgggcaagactatcaccctcgaggtcgagtcgtctgacaccatcgacaacgtcaaggcgaagattcaggacaaggagggtatccctcccgaccagcagcgcctcatcttcgccggcaagcagctcgaggacggacgtaccctctccgactacaacatccagaaggagtccactctccatctcgtgctccgcctccgcggtggcatgcagattttcgtcaagaccttgacggggaagacgatcaccctcgaggttg

SEQ ID NO: 27745 - DNA, 517 bp, Sorghum bicolor
  Clone ID: 7218301
gcacgagggcacagccaagccatggcgcccctttccggggctctgctcgctgctcgcttgttttataactcatactttttttcgtcagtcagtagtatttttttataataaattagtaaacagtacttttaaccatgatttttttgtttttcatagtgccaaggctgccatcaattgccgtcttctcatcatctcgccatgcgcatgacctgttggacggaatgcagtgtagaggagatggaggtggagggggattttggcaacccggtggcccccgcatggcagcaaattcatggtgctgcttgggcgccttatcctctcacaccacagcacaccacaccagcagcctgcccagcgcccaccacaatgccaatgcctccagctcagctggttaaaaatcagtcacctgccacctggcgatcaatgaaatgatctagctcgtcaaacaaaccctctcctggataggagtagcagaggcatcaaggacactgaaccaaccaaactgcgtttgtgaggg

SEQ ID NO: 27746 - DNA, 489 bp, Sorghum bicolor
  Clone ID: 7218303
gcacgaggttattaggtatttctggtggtgctggaacaaattgaaggacaggattggtgatgatgtaccaatgccagcctacttcaggttccttgcactgctagcattcaagatcttttcagatgagcaggtggatgttgcggtgctcgaggttggtttgggagggaagtatgatgcaacgaatgtggtcagagcacctgtagtttgtggagtatcatctcttgggtatgatcatatggaaattcttggaagcacacttggagaaattgctggagagaaggctgggatacttaagaaaggagtttcggcgtatacagttccacagccagaagaggcaatgtctgtactggtgcagcgagcttctgagttgggtgtttctcttcaagtagtccagcctttggacccacagaaattagaggatcaaccccttggactccatggtgaacaccaatacatgaatgcaggacttgcagttgcattggctaatac

SEQ ID NO: 27747 - DNA, 638 bp, Sorghum bicolor
  Clone ID: 7218312
ggaagcatacaagccaccgatcaattgtacaagagtttaccaaaagttctaaggcttcattgttggttgcactcgatatgcctgctgtcatctttgctcgaaacgatgctctcgacgtcaatccccagtcgggtgacgctcgtctctctgatgctggttcagactggctctgggctgtaacagctatctacgtcgtcagcttcctcgcctactttgctctcagcttcaagcctcgcaacaacgagagaatcttccactacctcttcacaattgccctcttcgtcggagcagttgcttacttctccatcgcctctggaattgcctactctgttattcccacacagcgcaatctcggtcgtgctctttcatatcagatctactttgccaagtatatcaactgggttgttgcattccctatcatcattctggctttgggactcatgagtggtgtgagctgggccactatcctgttcaacatcttcctcgcctggatctggatcatctcgtacctttgctccgcatacaccacaacctcgtacaaatggggattcttcggtttcggcacattcgcctatctcatgcttgccttccagactctccatcccggccgaacatccgctgctcgcttgggcctatct

SEQ ID NO: 27748 - DNA, 549 bp, Sorghum bicolor
  Clone ID: 7218316
gcacgaggcgctgtgactggatctaccaccactcgtgcagcattatacatggcacgcatgcacgcacttgcgatctcactcggtgtcgggaagctcttctggtaccactaccaagactggagttttgaccgcaatgaggctgaggagaattttggcatgatcactttcgatggatatctccaacctacctatgctgtcatgattaaccagcagaacaaactggatggaacagtatttgtgagcagtacgactctcgctagtggcagcataaacagctatcactaccagcaaagctctgccaacaaggacctctttattctctggaaccccacatctactaccccaacttctgttgctctttcttccatcaaatctggtctttcctcaactaatgcacaggtttatgataaagtgggtcatccagtgacaatcacatctaatagtttctctgttgctgatagtcccctctatgttgttaccactattaactctgcaacaacaactactaccactactaccactactaccactactgggggctctactacc

SEQ ID NO: 27749 - DNA, 516 bp, Sorghum bicolor
  Clone ID: 7218323
gcacgagggcaacctcgggtcccctggaatcaatcgatcacacgcggcccgccccattcggccattcccagccttccagagcccgccgccgccggccgctgctccgccgacgcgggggatgccaccggcggtagggcccgcctcgccgcgccaaaaccctatcggggccgagctccctgccgcggcggcttgcatggcgaacccaggcctagggcttggcctcgcgccaccgggccccgagccctccgccggagcgccgccgccgtcttcacgccgcgcgccgcgcttggccaagcggcgccacgcgcccgcctcctcccgctcccgcgcgccgcaggcctcagccggaacatggaacccatttggcggcggcggcggcggcggtccggatggacagaccggaggctttgtgtttggttctgcttcggcagtgagccagcagccttcggagccagcagtgggggtagctccacccactgaggcgcccttcgtgtttgggagcgtaagggagagcct

SEQ ID NO: 27750 - DNA, 457 bp, Sorghum bicolor
  Clone ID: 7218329
cgtcggccggcatggcgaccgccactgccgccaccgtccccgccggcggcggccgcccgtaccgccgcgcccgcagtcgctgcggcccaccgcgcctgcaccgcctgcgcttcccggccatagccgcggccgcggccgctgccgctgccgcttcgtcttccccgccggccccgtcgtcgtccacgctgccgccgctgccagcagacgggggcgggcggctggtggtggagctggtgtgcgcgttcaacgagctcacggagcggatgggggaggacctggcgacgtcctcctcgtcgcgcctgctcttccgcgcgctgaagctggcgctccccgccctccgcgacgtcgacggcggccgggcactcgcgcgcgcgctcgccgtcggcgccacgctcgctgacctccagatggatgctgaagtcatatcagccggcatactaagagaagcattagatgc

SEQ ID NO: 27751 - DNA, 397 bp, Sorghum bicolor
  Clone ID: 7218336
gcacgaggatatcccctccatggattcctgctcccctcctctccttccctaggccagggccagcagctccttcccccgatagatcctgaaagaaacgcacacacacaggcactagcattgtcatccccatccaggaggagtcgagaggttgacgatggcgttagcctgtacagcagccaggctagtccacccctgcaagggcatgggcatggtgtccaagcagcacccaagaacaccgccgccgccgtcctcctcctgcttacacctccacaccctcctccataggcccgtcgccagcagccacttcgcgcgccactccgtcgacgtgtccaaggacgacaagccgcttgagacgccgacggcgacgaccacagagacagagagcccccagcaagcc

SEQ ID NO: 27752 - DNA, 519 bp, Sorghum bicolor
  Clone ID: 7218342
cgccgccctagcttccccgcgagcgggcctcctccccccaacaccgagcgtctctccgcgggtccaagccggcgggatccgcgtggcctgtcgtgtccgcctccgcctctgagtcaagctcgccggcagccgccgccgagcaatggaggcgctccggatcgcggaggcggagctcacggtgtacgtgcacccctccaacgccaagcgcgtccggcacgccgtcaaccgccagctcagctcgctcctcttcacgtatgacgaccgttttaatggcgtggtgctgatgcatgaagttgcattccatcttggccaaggcaatgagggcgaacccaacaaagatgaaagtggtggacccaaagatgaaagtggtgagcccaaatcttgtgccaaaggcaaaatcaaagatggacgtggtgaacccaaatcttgtgtcaaaggcaaaaccaaagacaaaagtagtgaacccaaagatgaaagtggtaaacctaaaatttgtatcaaaggaaaaatcatgaatgg

SEQ ID NO: 27753 - DNA, 406 bp, Sorghum bicolor
  Clone ID: 7218353
gcacgaggatttcgactgtttaattgacccaaaacgtgaatcaagctgttgtctcgggcatcacttcgaattcggctgtcattggctgtgccgactgccgtcaatcaatcaatcagtcaaccaatcaatcaatctatcaaccaaacagtcaatatttcatcactcaatcgtcatcaagtgcgtttaaacaacgcagcattctttagtgtaggtgcatcaaatagtcaatcaagtcaatcaaacaatcaatcaaagatgagtgatagtaagacaaacgatatgtttgatctattagtgattggtggtggtagtggtggtcttggttgtgctcgtcgcgctgcctcatatggtgcaaaagcagcaattgttgagaaaggtccaatcggtggtacatgtgtcaatgttg

SEQ ID NO: 27754 - DNA, 476 bp, Sorghum bicolor
  Clone ID: 7218355
gcacgaggcgcggtacggcgtctgaaccatgcatccgttgctttgcctggtgacatggacttggttcatgagccaggttctttgcagtgacatttcgaccttcctgactgagcttcccagctgcgcggagagctgtgttctggacttagtctcagcgtcttcttgcggcacaaacgcaacatgcctctgcgccgatccaaagctccaagacgatgtgcttccttgtgttgagagccactgtctacccagagaagctctcgccgcgataaatttgacctcggtggcatgtgacttccccatacgcgacaagcaccagcagttcaatattctcaccatcacgctaatcgtgattacgggaattacagttggtcttcgattcattgagaagatacgatatggtcctggacttcaagttgatgactacgttatcacgggcgcctttctggtcaatttaggcaactcgatcgtctgtttgc

SEQ ID NO: 27755 - DNA, 474 bp, Sorghum bicolor
  Clone ID: 7218362
gcacgaggaatctcagaggcctctgcaagcttcaccgacttttatggcagtgagacctcctatttctgtctctcctgttggtgcaactccaccacaaggtcccgttgcattggcaccatcaaatatgcccacaatgtaccgtggccagcatccaccagtaccaaatttcactggttcagcaccattcgtttccaggcctcctggtggacctcagtcttttcctacagctgtgcctcaaggtccttcctcagtagcatttcctggtggggcatcaccgcagtcaccttaccctccaacacctgatcagatgagagggccacctccagctttctctccagttggatcaactcctggcatggtgcctccatcaattgcatcttccggcccgcctgccccaggtcctgcaagcacaagcggcagtcaggcacaaatggcccctttgagacctccactcccagtcatgggtgattttac

SEQ ID NO: 27756 - DNA, 471 bp, Sorghum bicolor
  Clone ID: 7218363
gcacgaggcctctcgtctgcttttcaagattcgagcggatacatatctgacactctcggcgtacctcctactgttgtctacagcagcctcgctgtcctgctcgccgtcccattaacaatgtcgagatacggctggtccctcggccgcgaacagatttcgccctacagttctatgcccagcggcgtcccggctgtcaccgacgacgattttagctacatcacatctcaagatcttgatggcgtcaccgaggatcgatactatcccagatcccactcgactgcacccccaccagctccagaagacgatgtcctccttatcaagaatcgcggcatcacatatcccgctcactttcccgcatatgcgattggagatggaaagttgcgggtgatagacgtcaaggaccgggttggtctgatgatggaacttccagagcgcggaacatcacgcatcaagcttctctacaagggaaag

SEQ ID NO: 27757 - DNA, 433 bp, Sorghum bicolor
  Clone ID: 7218364
gcacgaggcctgattataggctgatgttttccttttcattgacattgctcacagactaatttgtctgtattgcttactgctgcagtaactgttgtccactcaaacaagtcaactctagaaacatctgctaggtccaatgtaaatgctgtacagagttccaatcagatggtgaaaaaccaggacacaaaaccagtggccgttcaagccatgacagttaaccctgttatagggcatcgtgccacaccaggtgtggcatttgttccgccaaaacctactttcgtcaatcacaatgagatagcaaagaatgttcaacagtttttgcaccaacctgcaaaccatcctagctggactccaccatcaactgagtacatgcattcttgcttgagttgtcaaatatgcaaagttgttatcattggtacagacagtgtacttg

SEQ ID NO: 27758 - DNA, 527 bp, Sorghum bicolor
  Clone ID: 7218367
gcacgaggccgacccgctaatggccttccccggagtagccgacgcaccagcagcgccaatgtcccccgacccaagtcgatgcctgttggcttcggtgactttggtgatgatgctaagctcaactttgaccagccaatccacgagtatctcggcgagtctgagaacagtactggcggtctccgtctcaagtccaagtcgactggcaaccttgctagcgataacctctccaaggatttcggctcgcctagcggacttgccttctccaaccggtatgactttggtgcttccttgagtgctgctgtccaggcctcgaaggacaaagaggcctctcaggataaggatggactttacatgaaggccaacgtccggactcccaagcccaccctcactgtccctgagcctcccaccaacgctaagagccggtctaccgccggagctacctctcccaagtcgaccatctccagctcttcatacgaagagttggtcaacaagtactgcttttttggatcaaaacagtcgagtcctaa

SEQ ID NO: 27759 - DNA, 434 bp, Sorghum bicolor
  Clone ID: 7218375
gcacgagggtgcgcagcaaacgcagcagcggccagggtcattatcgccaaatcctatgatgaaccctgctgcttcccctgactccccttccctgtataaagaggaggctccttcctcctctcattgtcgccgcatccctcccaagtcccccaagctcagaggaactcaggcaacggccatacattccggaggccaaaaagaaagaaagaaaaaaaaaagtgtagcctccgcccccgcacaaagctttggctttcctgtcctcgtcctcctcgtcctcgtggcgtcgcaactcgcaagatcactgtatccataacaagaagctaaatcctcaggggatgctgaaagatgtgctttcatagaagagatttctgctgcaacatcaaggacctagctgctctgcaaggtctgctagcctgctcgtctcttcatgtgag

SEQ ID NO: 27760 - DNA, 413 bp, Sorghum bicolor
  Clone ID: 7218376
gcacgaggggaaaaggaggtttttcttgcttctggtgatggtagtgggcttgcggatatcaatccgctggaagctattgctggaaaatgcactgttatatgcatttcaaaagacgagaggaatcgccagccttcgcctcaggaacaaacaatggctgattatatcttctataggtgctttgatgttaaaaactgcacactttctgatgagttgcctgataaaatcacagggctggaagttaatgttctgctgaatccaaaagacgagcaaggcatgtccagtgccagtgcagcaaatgttctgctgaatccaaatgtggatgaggttttagctgccacattcactgctccctgttcagtcactaaagaggatgatgaaagtctggctactgcaattccccttcctcaggcatc

SEQ ID NO: 27761 - DNA, 447 bp, Sorghum bicolor
  Clone ID: 7218383
gcacgagggacgacacggcggccatgtatgacgcgatcacgctgacccagcagctcaagtactacaaggagtaccagtcgaagctgggcgcggtggccgggcgcgccaaggctggcgccatcctcgccgacgcgctctacgtcgtcagcacgggcaccggcgacttcctccagaactactaccacaacgcctccctgtcccgccgctacaacgtccaccagtactgcgacctcctcgccggcatcttctccggcttcgccaacgagctgtacaggctgggagcgcggcggatcggcgtcacgtccatgccgccgctgggctgcctgccggcgtccatcaggctgtacggcgagggcaaggacgcgtgcgtgccgaggctcaaccgcgacgccgagaccttcaaccagaagctgaacgccaccgtcagggcgctcaagcggcggcacg

SEQ ID NO: 27762 - DNA, 495 bp, Sorghum bicolor
  Clone ID: 7218394
tttaacctgaccctcgtgggtttgaacttttcctgatctcacagccccgccccactcaacttttctagaggctgtaccgtatccacacatcccgccgactcgtgcgtggccttcgctgttgtagcagctcgtcaccttgcgcattcgctcgactgaacttagccgtgatcctaaataaaagcgttccgtctcctccaatttattcttcttttccttctagttccccttcttggcatatcaccacccaattccccattttgcccccttcccatgctgctttgcagcaaatcacaaccacttatacgacacaatacgttatcatgccgtcctttaagcccttcgcttcagtgacggggcgtaactcatatagtcttttcgatatccgccttgacagcgactttatcgtctttcgtggaagtgatcacgaatcatctggtcaagttctcaaaggcacattagttttgtgtctacaaacatctctgaaaatcgaagatg

SEQ ID NO: 27763 - DNA, 385 bp, Sorghum bicolor
  Clone ID: 7218420
ttgaagctagattagctatagctgctgcagcagacttcttcatatattggagaggggggcgcgagcggctaccagcatagcatgtggaggctaaagatctcaaaaggaggaggcccatggatgcagacggtgagtgagttccatggccggcaggtgtgggagttcgacccagacgccggcaccgacgaggagcgcgccaaggtggagctgcttcgccaggacttcacggagaaccgcttccggaggagggaatcgcaggatctactcatgcgcatgcagctcactggagaaaagcatctgcgcgcggatatgcccgcggccacgaagctagcggatggcgacgaggtgacggaagaaattctgcacgagtcgctgagacgagcgc

SEQ ID NO: 27764 - DNA, 426 bp, Sorghum bicolor
  Clone ID: 7218423
gcacgaggcacgaccggagccgccccgcggaggccctctccgcgcggtactggaaccacagcgtcgtcaactacgacgagcacctccccgacggcttctacgacgtctgtggcgcgcagctgcatcctggcttccaggccaagttcccctcgctccactacctcagggcggtcccgcctgggcgcgacgtcccgttcctggccatcttggtggatcgggagcacgatcctgccctaaaacgactggaagatagggctgcacagattgccgcgcaggctagggcacggcatggtggcattgcttcagctgagattgcacagaagattgtgggtctcattgttaatgccatgggtggtctggttgaggatgctgatggtatgaacagggaatggagcatcaagagccgcgagctctctctccagctaa

SEQ ID NO: 27765 - DNA, 351 bp, Sorghum bicolor
  Clone ID: 7218455
gcacgaggctcgcgggtctcgccgccgcgcgccagctcctccgcttcggtctccgggtgctcgtccttgagggccgctcgcgccccggcggccgcgtctacacggcccggctaggtgaggataaggccgccgtcgagctcggcggcagcgttatcactggtatccacgccaacccgcttggcgtgctcgcgcggcagcttggtcttccgctgcataaggtgcgggaccgctgcccgctctactacccagatggccggattgtagagactaggctggataggaccattgatttggtgttcaacacgcttctcgaccacgccaccaaggttcgggagtctcttaatgaagctg

SEQ ID NO: 27766 - DNA, 231 bp, Sorghum bicolor
  Clone ID: 7218463
gcacgaggcgcacctcctcacgcgcctcgctcgccttcgcttcgtcgccaccggcgagccccaccacgccgcccgagccgccgatcggggcgccgccagcgctgccagcggcggcggcggcgcccgatccgatggacgcggaggtgggggcgccgaatctcccgctgccggaggagccagccggatcggagcccgacgacgcgcgcctctccccgcctcgtcctgctcctg

SEQ ID NO: 27767 - DNA, 386 bp, Sorghum bicolor
  Clone ID: 7218469
gcacgagggcaagctactgtataaacactgggcaatctttctttgctcttcatacccccttgcttttctgagacccttagcatccgtgctgcaaatctcccgacctcacatcacgcgcctgcgcatcacacatccaccatcatctcgcatcacggttacacaccaacctcgttatgaaggtctcgcagtttctcacctgcctggcggcatcccaagtcatcagcgctgcctccatacccgaatctagcaatgcgctcaacctcctcgaggagcgccgcgtagtccctgcctcggaactggtctctccacaccacaccctagagcgtcgcaagggtggcggcggacgcagtggtgggagttcgagcggtagcagcagcagtagcgga

SEQ ID NO: 27768 - DNA, 326 bp, Sorghum bicolor
  Clone ID: 7218470
gcacgagggccagcggtcccgcccctgctgcttccgctcctgccaagtccaacaagaacaagggcaagaagcacaactccagctccggttccggttacaagcctttctgcggtggcaagaaggccaagcgcgccactcttgaggatattgctgccaagggcaacactggtgttcccggtgactttggctgcaacatgatgactgtcgatgaggacgtcgccgacaagtacgactacactaccaccttcaaaaacgaccacgacgaagataaggagtgtgtttgcttcaacaagatcgggcctaatggcttgatcgacggtttcttc

SEQ ID NO: 27769 - DNA, 331 bp, Sorghum bicolor
  Clone ID: 7218472
gcacgaggctcgcacccacccggtcgtcgactgccattccttttgagcaacttcttgctctgtacattctcttagctctccgacagttacgctccttgctcgacgtcaacagtccttgtttgcgctcaggtcagccgcatctgcttttactgctcaaccacatccaccagtagcacgcgcaacgcctcaataacaagccaaaacatcgacgtaatcgacaatgtcttcctccatcaagctcaccggccttctggccctcgccggcgccgtctcggcctctcctcacatgcagcaccagaagttccaccacagggctgcctaccccgttgga

SEQ ID NO: 27770 - DNA, 393 bp, Sorghum bicolor
  Clone ID: 7218474
cggcgcaaccagtttcaacagtgcaaacatcaattctctgaagatccctctttcatctgagattagtcgcgtggccagttggaagcttcgctcacaagctacttaagttttgagtcttaggagcgggatcccaaagacaaaaagacagaaaaagggccaccgactggctttgaactttctctccttcaacacaccgcaaccatgtcgaccctttttggcggtgcttcagctgcatcaacgacaagcaacaccgttggtgaccttaagcaagacgtcgcactctcagacccccctaccgataccatctccgacctttccttctcccctgcgccaaacgggcctgacttcctcgccatctccagttgggataacaaggttcgcatttacgagatt

SEQ ID NO: 27771 - DNA, 466 bp, Sorghum bicolor
  Clone ID: 7218494
gcacgaggggcaagcaaagcgcaactaaataaattccttccctctcttctgctcttggcatctcgtcctctctatcatcttcttcttgctttctatatatagctagcttcattcacaaggtcgtcagagactcagagggtgtgtggcagctcttggagagagatcgagcagcaggcagcgcagcaatggcagccatggacatgaagaagtgtctgctggtgctgactcttggcctcgccatggccgctacctcgtcggccgtcatctacaaggtcggcgacacctccgggtggacgatcctcggcaacatcaactacaccgactggacttccaagaagaatttccgtgttggagacaccatagagttcacgtacccaccgggcatccacaacgtgctggaggtgaagaaggccgactacgacagctgcaccaactcgacgccgatcgccacgcacacctctggcga

SEQ ID NO: 27772 - DNA, 494 bp, Sorghum bicolor
  Clone ID: 7218500
gcacgaggcgtgttagtgaggctctctcttcaccaatatacttacaaccgacaccggtacaacatagtcaacgcaacataagagacaacttcctggagtggatcacttcccctcccagttcaccgcgtctcctacttaacgatattacatcacagcaactgtgaatatcttcaaaaagcactgccatcagcaacgccgctcccgggttttgacctcagccgcatttagcatttagcatttacccaacggatatatacagcagcatctttgtcaaccaaccatggttcagttattggctgatcccgcattctcgcccgctggaacaccaacacatgagggcactaatgggcctcttatgaagcgtcctggtcctgtcagggctgactcttcaacaccaatgaccagggaggaacatgccaaacgaatgcaggagctcaacaagaagaggggactgatgagggcacccagaagaggttggtcaatgactgactacc

SEQ ID NO: 27773 - DNA, 408 bp, Sorghum bicolor
  Clone ID: 7218506
gcacgagggagagagagagagacaaggagcgagaacttgttgattgaaagcactaagcaataagagaataaatccgatttaatcgatctttgttctggtcgtttagattagactttttgacacaatggttgtactatctaccagcaagctagttaaaccggccggccaacaggccaccgatctggagaaccaggtggctcagactctgctcgatttggaggccaacactgacttgaaggctcagctacgcgagttgcacatcaccggtgcccgcgaggtcgacttgcagggtggcaagaaggctatcattttgttcgtgcctgtgcccgagctccgcagcttccagaaaatccagagcagactggtgcgcgagctggagaagaaattcagcggcaagcattttgttgt

SEQ ID NO: 27774 - DNA, 102 bp, Sorghum bicolor
  Clone ID: 7218508
gcacgaggagatggagcctccggtacttccacagtcgagtccacttacctggttccaagcacatcgtacaccgcccatgtccgagccaagaaacagtcacgt

SEQ ID NO: 27775 - DNA, 472 bp, Sorghum bicolor
  Clone ID: 7218533
gcacgaggcttctaacaatgggctagtgaagtgtgatcatactggacgtgtacttcaattttttgagaaccaaagggtgctgatttgaattcgatggttagcaattccttgtgtaatccaattctgttgtgttcctttctttcttgagacgaaccaggtcttttagttctttccatggatcatctgttcctggcttatctagaaatgattatctattttactgtaaatctgacaccaaagctaatagctactgatgttgcagagagttgataccaacttcctcagctatgctataggtgatgcacagaaatatcagtacatcgcatcaatgggcatttatgtcttcaagaaagatgcacttttagaccttctcaagtcaaaatatactcaattacatgacttcggatctgaaatcctcccaagagctgtactagagcataatgtgcagacatgcattttcatgggctattgg

SEQ ID NO: 27776 - DNA, 491 bp, Sorghum bicolor
  unsure (1)..(491): unsure at all n locations
  Clone ID: 7218543
gcacgaggtttggatctgtatgtgtgtcacatatatatcttaataataaagatggatggaacttttatatattttgctgttggttttgctggtactttcttagatatactctttttggatatggataggtaaatgcttagatacatgaagcaacgtacagtttaataattcttgttcatctaataaacacaaataaggacgggcgtaaatgttgctgtgggttttactggtactttcttagatatatacatgcttagatacatgacgtaacatgctgctacagtttaataaatattgtttatataataaacaaacatgatgtttattatcttggtatgcttgggtgatgttatatgcagcagctgtgtggatttttaaataccctgatgatcatgcatgaccttgccttagtttgctgtttatttgcttgagactgcttctttcgcttatactcaccncattattttggtgacttctgcagatgcagatct

SEQ ID NO: 27777 - DNA, 448 bp, Sorghum bicolor
  Clone ID: 7218550
gcacgaggcaccatcaatccatcgactgttccctcgccgtggctgctgtggttttattcgagcaggtggctccctagagcgcatcttgcgcattcaatcattcaatcattcaatcattcaatcattcaatcacaatgagtctattcgcctgccccaattcttcgagggtgttgctaaggtctgctctccaaagagcagtatcaaaggcatcagtctctgcggcccagccgtttgcgccaacccgatggatttcaagctgtgcgtcaaggaatcgaagcggccttctaccgtcgtccacttgttgtcgaagtaccatttttaggaacaacaataactcgtacgaaacccgacgaacgatattcttcgataagacgatccgaaactatgaggacttgccgagagactaccgagaccaggtcggccttcagttcggaagcaaggacctaag

SEQ ID NO: 27778 - DNA, 449 bp, Sorghum bicolor
  Clone ID: 7218552
gcacgaggctaatatctaatattaagatactctagatcttaccacgcgaaaatttttcaaaaaaaattatattttaactatattactaaaatgccactactatattatatacaataagtataaccatatactctatgtatgtatgcatacttaacatacatatcactctagatggtctagtatgatcatatactttgtctatatacatttcgtccggtcatatataccttaaatctagaggtacatagatgagagtaactacacgcgcgtgtaaaagaaacgcgtcctatatatatatatgcatgcatgcatgcagtgggccctacgtggacatcgacatgcgatcgggggagatggacggctacgacgcggtgttcctgagcccgcacaagttcgtcggcgggccgggcacgccggggatcctgctcatgaaccgggcgctctaccgc

SEQ ID NO: 27779 - DNA, 361 bp, Sorghum bicolor
  Clone ID: 7218558
cgacatctcttcttcgtcgctcttcatcctcttctctatccatcatatcctactacagactcatcaaatatctataacgatgcgtttctctaccaccgtcgcctatctggctgcctgcctcgccgctccggccacggccctcgccatctggggcgattcggcctccgcactcgacgcttctctcaaggtccctggagaaaaccccatcgagtactgcagcgccgaccgcggcgacgacctcattgacatcaagaaagtcgacttagctcctaacccccccaagcctggcacgccgctcctcatcacggccactggtaacgtcaaggggaggatcgcaaagggttcatacgtcaaggtggtt

SEQ ID NO: 27780 - DNA, 455 bp, Sorghum bicolor
  Clone ID: 7218574
tgagattcaaaacttatgatgatgctctcaagtactataaacaatatgcggaggattctgggttctcagcaatcattctgaagtcatcgtatttgaagtcaggggtgtgccgaaggttggtgattggatgtagtcgagctggaagagggagagcaaatgcgtgctatctatcgagagagtcaaccaagataaattgtccagcaaggatctctttgaagttaaggcaagatagatggcttcatattgatgatgctaagctcgagcacaaccatccactaaaccagtcctctacatcactcattaattgttataaaaagctaacagatgccaagaatgggggagctgcctcacgactgaagggtcgcaggaacattccatctgagaaagagcaagggaacttcacggagataggaaggcttaaatttggggaaggagacgatgaatatatccagagg

SEQ ID NO: 27781 - DNA, 479 bp, Sorghum bicolor
  Clone ID: 7218583
gttgtagatgcgtgttatctgcagcggcgtgttcaatctcaaaactttcaactagacataatttttcatgtgtagtgcgactagtggaatgtgttaagtggtgtctctttgcgtctttttatacgtagatgttttcattctccttttccactttgcgtagagtattcttttgactcaacactaatatctgttgcttcaaggtacaattagacgcttttcaatttcggggatgaaatgcgaaagaagatttcattatgcaatgcttgctaattacttataaggcccggggtataactccaataactccacaatatctgagtgtcctcttttttgtgctaaagaaagagctgtttctccataataagattccacgtgaatatctacttttttagtatccagcaacagtctcactaattctgtttcaccatggtttgctgctaagaaaactggtgtatgcccataggagttctctaagttga

SEQ ID NO: 27782 - DNA, 257 bp, Sorghum bicolor
  Clone ID: 7218585
gcacgagggcatcttccgccctggccgggtgtcccatgccttgagtgaggatgcactggcacatgctctgatggacaacaagttcccaactgaaacgctaaaggattatgaggagtggactattgatctgaggaacctgcacatgggcatggcctttgcacaaggtgcctttgggaagctctacatgggaacatacaatgggatggatgttgctattaagcttttggagcgacctgaggctgaccctgagaaagctc

SEQ ID NO: 27783 - DNA, 467 bp, Sorghum bicolor
  Clone ID: 7218593
gcacgagggtggcctcggttacaccggcagctgctgctccgtcgcctgataccgcgtccttcctccactgcctcgccgtccacctccctccgcgagccgtctacacgaacgcgtcccggtcgttgtacacgctcgccctcgagtcctccatcaggaacctgctgttcgtgacgccggcgaccccgacgccgatcgccatcgtcgcggcgagaagcgcctcccacgtccagtccgccgtgcgctgtggcgtccgccacggtgtcagcgtgcgcccgcgcagcggcggccatgactacgagggtctgtcctaccgcgccctccgcgcggcggggcgccccttcgccgtcgttgacctggccttgctccgcgccgtcagcgtcgacgtgtggaacgagacggcgtgggtcgggtcgggcgccacgctcggcgagctctactacgccatcgcgaaccacaccgcgcgcctc

SEQ ID NO: 27784 - DNA, 254 bp, Sorghum bicolor
  Clone ID: 7218599
gcacgaggcccaccgcacctctcccggcctcgcacccatggccacggctatgatggctgcatccaccacctcgtgctctccgcgccgtgctgcgccggtcctgaagccggtggcctcctcctcctcctcctccagcagcagctcggcgcggtcgcggcggcccttggcgcagcagctcccgcggctgctggcgacagcggcggcggcggtggctgcagagccgctcccggtgctggcggatcagatggagaagg

SEQ ID NO: 27785 - DNA, 430 bp, Sorghum bicolor
  Clone ID: 7218604
gcacgaggactcgaacagctgcttacccactgaaccccagcaatcgcttctgcttctcggcgcgacaagtaattcagcgacaacgacgatgaagcctttcttcctacttctggccttggccgccatcctcttctgcgccgcggtggtggtctcagctgatgacgccgaacgaagcgaacgccctcggtggggtgatgatgaccaaggtcgaagaggaggcgattgggacgaaggtgatgatgacgacgacgattggggagttcgcaaggccaaaaccacgaccaagaagtgcccttgcagcaccacgaccaagaagaagtgcccttgcagcaccacgaccaagaagcagtgcccttgcagcaccacgaccaagaagagctgcccttgctcctctaccaccaccaccaccagcagcacgactaccgcctgc

SEQ ID NO: 27786 - DNA, 448 bp, Sorghum bicolor
  Clone ID: 7218608
gcacgaggcgtttgtttattcttcttgcacctactttacaaccatccaaccaccttgcagcttctacagtgtagacatctgcactaccttctcacaatatacccacatcatggccatatccaccaccgccacccagcctgccgacgcccagaaaccagaaaacaccaccaacaatgccgccgccgcacccaggaagcggagaagaagagcacctgccaccggtgccagcgaggattgctttgcctgccgtaagcggggagcaaaatgcgatcgtcgacgaccttactgcggccaatgcatcgagctgggaaaagaatgctcgggataccggaccaccttgacatggggtgtgggagtggccagccgcggcaaacttcgaggcatgtctttacccgtagccaagtcgaccacacagagtgctagcaccacacgcgactcgaaaccccag

SEQ ID NO: 27787 - DNA, 451 bp, Sorghum bicolor
  Clone ID: 7218617
gcacgaggatttcttatttgcaacagaaggtttcccagaagttgctctacactttgtgaaggatgagaagaccagatttaacctggctctcgagagtggtaacattcaaattgcagttgcttctgcaaaggagatcgatgacaaggatcactggtacaagttgggaattgaggccctgaggcagggaaatgttggtatagtggaatatgcttatcaacgaacaaagaattttgagaggcttgcttttctgtatcttattactggttacttggacaaggtcggcttcatgtgcaaaattgctggacagaacaacaatttgatgggacagttccacaatgcattgtatcttggggatgccaagaagcgtgttgagatcttggagaatgctgggcagatacctcttgcttatgttaccgctgtcactcatgggctcacagaaattgctgagagg

SEQ ID NO: 27788 - DNA, 475 bp, Sorghum bicolor
  Clone ID: 7218623
gcacgaggaacagacaagcgacatcagtggttaatgatgaacagtatcagagagtttcgtattacacattgtcaagaggaactaacggattttcagaagctaacttgcttggcaaaggaagatacggttctgtttatagatgtaccttagaagaggaaggtgcaactgcaaccgtagctgttaaagtgttcaaccttcagcaatcaggatcttcaaggagtttcgaggctgagtgtgagactctgagaagagtacgccatcgctgtctcctaaagattgtcacttgttgctcgagtgttgatccacaaggtgaagagttcaaggcgttagtttttgagttcatgcccaatggtagcttagatgattggatcaatccgcagtcgagtaatctcactccagaaaataccctcagtctttcacaaagactttgcatagctgctgatatcttcgatgcacttgactaccttcacaacca

SEQ ID NO: 27789 - DNA, 530 bp, Sorghum bicolor
  Clone ID: 7218629
ttcggcacgaggacggcgttaagtgtttttgacggaccatatcgaagttttatcttcttttctttatgcaggctaattattcaaaaattatttattccatccttccatgctttttcagtaacacccggaaaaaatgatagcacgggaaatgtttactagctttttttttatttgaggggatactagctaacctatagcatataggtggcctggtatttgggattccttgacaaaaaaaaaatcaaatttggaccgcattgttctttctaacaactggctaaatccatatgcatgttatgacattctgttcagcaattgtatgcagtagttcaagtgtgaataaaattctaaaaatgtcatatatcattcataaattttgacaccaaaacccaacggccagtgccgctgatcgtgtccaacagtggaccactgtagttcattcacatgtgtgtacccaaaaacaaaaccagcttggccatctttctattttttttaaaaaaaaagaggaatatattaatatcctagcttct

SEQ ID NO: 27790 - DNA, 545 bp, Sorghum bicolor
  Clone ID: 7218633
gcacgaggtcaattttgactaaagaggaaaacatggaacctgaggatattacagtattcaagaaaaagaagagaagcagaaaggacaaagaacaagcgcaaaatgagtcagccaatgaagttgtagttgatactgatgtccaaactgaacaagttgaggtttctgaaaagagaaagaagaaaaagaagaaggaaaaggctttagtcgaagaaccacaacaggaagaaacccaagaagttgtcaaaacaaagaaacaaaagtccagtaagggcgacaatagggattattacatcgagcatgaggatcttgccagttttacagcggcggaagtcaatgaacaccgcaaaaaactcaacatgaccgtatcatatatggataactcaaatcccaaagatgtttttgaatctgagccagttgaatatcaagaaaattctgagtcttctacatttaaggatttgaaaccaattagacttttcagtgagctagtattacctgatgaaagattactcgaaagcactaagaatttcaaaacaccaacagcgatt

SEQ ID NO: 27791 - DNA, 393 bp, Sorghum bicolor
  Clone ID: 7218637
gcacgaggccgcggccgggcaggccacgagggaaggcgacgtgtacagcttcggcatcgtgctgctggagctcctgacggggcggcgccccggcatgttcgccggggaggaggaggacatcgtgaagtgggtgaagcggcagctgcagcgcggcgccgtcgcggagctgctggagccgggcctgctggagctggacccggagtcctccgagtgggaggagttcctgctgggcatcaaggtcgggctgctctgcaccgcgtccgaccccttggaccgcccggccatgggcgacgtggtgttcatgctggagggctgccgcgtcggcccggacatcccgtcctccgccgaccccacctcccagccgtcgccggcctgatctcccggcggccctcg

SEQ ID NO: 27792 - DNA, 169 bp, Sorghum bicolor
  Clone ID: 7218639
acgggttcaccttcgacgtcggctcctccgtcatgttcggcttctctgacaagggtaacttgaattcgatcacacaagcattggaagcagatgggcgtaagatggaagttctacctgacccttctacagaccatttccacctacctggtgatctctctgtgcttgtgca

SEQ ID NO: 27793 - DNA, 372 bp, Sorghum bicolor
  Clone ID: 7218652
gcacgaggtctctttgtctcccctatcccaatcgcaacatggccaatatcaagctcagtacgatgcagctccaactcatacttgtctccatggcgctcgccaccgccgccgccaccaccaccaccacgcacctccagttctacatgcacgacatttttacggcaacagcagacagcccggcaacgggggtgactgtggcgaagggcacggcggggctgccgggagaccccaacgtccacttcggcgacatacacgtgatcgatgacccactgacggaagggcccgatccgtcatcgccggcagtggggcaggtgcaggggttcgaagtcttcgcggtgcagcaggagatatcggtgatgctctccgccaaca

SEQ ID NO: 27794 - DNA, 423 bp, Sorghum bicolor
  Clone ID: 7218656
gcacgaggccgcaacaagatcgagaccgcgctcgacagtatcctcgccttctcccaagatgtcgtctctggcaagattcaatccccagctggtcgtttcacttcaattctctctataggaatcggagggtcagctttgggcccccaatttgttgctgaggcacttgcacctgataaccctccactgaagataagatttattgacaacaccgatcctgctggtattgatcatcaaattgctcaactaggacctgaactggcaactactcttgtaattgtcatttctaagagcggaggcacacctgaaacccgcaatggtctactggaagtacagaaagccttcagagatgcggggctgcaattctcgaaacagggtgttgcaattactcaagaaaattctctgttggataacactgccagaata

SEQ ID NO: 27795 - DNA, 437 bp, Sorghum bicolor
  Clone ID: 7218688
gcacgaggcccggatacccccatcacgaaccatctcacaatggcgtcacgcttggcacgaagcgcagtcggcgctcccctccttcgacccgtcctcgcccgccgagctgcccctaccatctctgttgccgccgcgcgatacaacagcaatgttcccgccgaggaccccaagaaaaaggcccagagcatcattgacgctcttcccggtaacagtctgctcagcaagagtgccatcctgagctctgccgctggtctttccatctacgccatctccagcgagtactacgtcatgaacgaggagaccatcatcgccatctcgcttctctcagtctggggtgccttgatcaagtacggtggccctgcctacagggagtgggctgagacgcagaacaacaagatcaagaacatcctcaacagcgcccgtgccgaccacaccga

SEQ ID NO: 27796 - DNA, 414 bp, Sorghum bicolor
  Clone ID: 7218693
gcacgaggaacctctactactgtgagcgctgcgccaagattgtgggctacaaataaatgaacgacgagatatcctctctctctctgtccttccctctccacacacaacacccgcatccacgcagccaaaaattcgtctagtatcgcagctgcgacaccatcttcccgctgtattttatccttccattttgagaaaagcgagcatacggcatattatagacggaaaatcatcgccctttttttcggcgccatagaaacgacatcggacacatcacctgcagctttccgcaacggctattcgcagccgtgaacgcattctggctgctgcacctcttccctcgaatcctggctgaaatgtaacctgtcaaagtcgagctctcacttgcatctctgggggccatggcgggattaggtc

SEQ ID NO: 27797 - DNA, 184 bp, Sorghum bicolor
  Clone ID: 7218696
cgtcctcggcgatttcaccggcaccctcgcagcgcccccatctcttcctcgacgacgccaaggaaggaggtggagcgcagctacctccgctagggtttccatcttctcggtggaggcgccgcgcctctgtgacgcggaccctgccagccaggatctcatgaaccaagcgtctcgtgaccaatag

SEQ ID NO: 27798 - DNA, 141 bp, Sorghum bicolor
  Clone ID: 7218700
gcacgaggctcaggtattgttgttccgtcaatgcctgatctcagtgggattgccatgcctaaaaagactgaaggtgcacttgcagtgtattgcaaaagatcaatttttgggacatcacacaaagttgggaatttaaaactt

SEQ ID NO: 27799 - DNA, 138 bp, Sorghum bicolor
  Clone ID: 7218704
tcacaaagactttgagtgatatgggagctaagaagattggattccttggtgtcccaccattgggatgctgcccttcacaaatgacacttggaggaagcccctcacgcctatgtgagccacaaaggagtcaagcatcag

SEQ ID NO: 27800 - DNA, 389 bp, Sorghum bicolor
  Clone ID: 7218714
gcacgaggcaccccctcatccctgtctgcttctacctgcaggttgcaccgtagcgcggatctctctgttgggcgcattatcaccggcccgtttgctgatttggaggagtcatcgcaaccgcctaccgactttttcctgcccagccagctggcaggccccatcgacttcctgtttggcccacgtctgcgctggcattccttttcctgcttccctcgccgtacccttcctgctaattggactcacgtgcgggtcatccccaattgacatcgtcgttcctgcatcacaccgccacgtgtcgtcgggttcttcgtgtccatcaggcccatcgtcaggcaatcaccatcactcatcgtgactcttcgatcgggcgctcgtcggtcgctcattaa

SEQ ID NO: 27801 - DNA, 483 bp, Sorghum bicolor
  Clone ID: 7218715
gcacgaggcttctcctaggtagtgtctttgatgccaacagtctcggaaagtggatctatgactggaccgtctaccaccaaggtcctgccactcccatctctgatatggctggcgagatgtggcttcttctcattcagctcgctggcaaggtcaagcgagctgaggagacagttggtcgcgtccgcactcctgacaaccgtgacctcgttgaggagttcatcgaggccggtgagcgcctcactgagaagctccgatctctcctcaaggcctgtgaagcccccatgctcaaggctgccaagcgcaagcaagctggcctcggcaagaatgccggtgtcgaatttgttgagaccctctttggacgtgaccgagagcttgacaagacggagaagtttatgcaaaacgtgaggctcttcaaccttcgctttgacgccaactgtgaagaaattctccggaaccctaccaaataagcggatcatccattgg

SEQ ID NO: 27802 - DNA, 590 bp, Sorghum bicolor
  Clone ID: 7218718
gcacgaggcgttacttgagtaagaagcagtaccatgaatgtgtgaaattgatcaatgaatcagcttctgaatcacaatctagttctggtaccacattatttttggttctgttagcagctcttctcgttggtggaatagtgatgggtgcacttggtacttcattcaagtatattgtgcttgatttggtagttttttttgttgtttggatcggtctttttcgaggaaacaaagaagagcatcaagaaagaagtaaacgaatgtttgactgtttaaatagtctcaacaaacgattgcttagtcaagaatcaaatgaatcaaatcttccttgctacttcgttcttgggttccgcttacttccagctagttgggttgcaaccatagatgcaaccataattccacacgagcagttatttctgatggttccgaagtcaagtaattcaacgattttggccaatgtacaatcagaatctcaatcaaatgttaatgacacgtcaattctgatcaatgaagttgatgatggtgaaacggaatcattggttcaggttccgtcagcctttcatgattcggaagatgaatctgatgacgatgga

SEQ ID NO: 27803 - DNA, 565 bp, Sorghum bicolor
  Clone ID: 7218728
gcacgagggtctctcccgcctcccgcgtcagatcgcatccctcctccatggcggcgctcagcctccgccagaagcagctcgatctgatcctgcggatgctgcacctcaaccagccgccgccgccgcccggcgcggccgcggagcaagaagaggaggtgtacaagatcctggtgctggacaccttctgcctctcgctgctctcgccgctgctccgcgtcgctgacctccgcaagcacggcgtcaccctctacttccccatcgacaagccgcgccagcaggtcgccgacgcccccgccgtctacttcctccgtcccacccaagccaacgccgaccgcgtcgccgcagacgccgccgcctcgctctacgcatccttccacctcaacttctcctccgcactcccgcgcccgctcctcgaccgcctcgccgccgccaccgccgcctccggctctgcccaccgcgtcgcccgcctcgcggatcagtacctcgacttcgtctctctcgaggacaacctcttctccctcgcccacccgcgctcctacgttgccctcaacgaccccaaagcggc

SEQ ID NO: 27804 - DNA, 474 bp, Sorghum bicolor
  Clone ID: 7218731
gcacgagggcggccgccgccgtcgccccacggctacaacgcgccaccggccgccgagccgtgccgccgtccgaccgtcgccgttctgtccctcgcggcctcgccctctccgctctgcactccgcggccggctcggctccttcctcaaatcctcagccaggcgccgcccgctcgactcggcacaccgaccggccgactctgctcggcttccgtcgctgcctcgctggctggccaagccgactagccgaggccgagcagttgcaggtgagcagacagcagagcagagcaactgagcaagcgtccgtaaggcctgccattggttgtccctcttgactgtgagtggattgggcactgccatcagcttaacccggtctgccactgccgtcgctgttgctgtgggcaaggaacgaagcgctcccccgttctcaatggagcacattttcttttcgatgcaccggatagcctctcgctcggt

SEQ ID NO: 27805 - DNA, 583 bp, Sorghum bicolor
  Clone ID: 7218733
gcacgagggttcatcagattcagcttttgcgatgacacggtgggggttggtggtggctgtctgtcctcccagctcgccacgagttggactcgctctcgagctgttcttcctttgtttctccctccctctctctccatccgctggatttggacaagatgatgggcggcacatgggacgagcgcgcacgtgcacgctcgctcactggctagtgatcgcttctcgagagaatttcttcctctctctctctctctccactccagcacgaatgcgccatgtagtacgtgctgtactacgtcggagatctggaagctgagcttgggtgcggtggtggagatgatgatggagtgccgtagttaagtaaacagcacgacgtgcgccacactaatcagctagtgtcagcggcgtcgtcatcgctctcagctgagtttccgggccatttattgatcacaagacttggataccaccaccaccaccaaagctggttgcgcgcagagatgcaggcggttcgaatgtgattttggtttcctttctgaagtgcggtttgagcccaatttcaggcgattctttttaattaacggtgctt

SEQ ID NO: 27806 - DNA, 501 bp, Sorghum bicolor
  Clone ID: 7218739
gcacgaggcttctccccaattcccactcatcatcacaccacagcaatcatgtccctccacgttcccatggcccatcgcaccaaggaccagggcgccacaaaggccgtcatcctggtcggtggtccttctcgcggcactcgtttccgtcctctatctctcgacgtgcctaagcctctattcgaagtcgctggccatcccatcatctggcactgcctctcctccatcgctcgcgtccccaacaagcagatccaggaggtctacatcattggctactacgacgaatctgtcttccgcgacttcatcaaggactccgccaaggagttccccgccatcactatcaagtacctccgcgagtatgaggctcttggaaccgctggcggtctctaccacttccgtgatgctatcctcaagggtcgccccgagcgtctctttgttctcaacgccgatgtttgctgttcgttccctcttgacgagatgctcaagcttttcaacgataaggat

SEQ ID NO: 27807 - DNA, 563 bp, Sorghum bicolor
  Clone ID: 7218758
gcacgagggtgggcgtgcacgcgtgccgccgcgccggtgtcgggccggagacgggcgtcctcgtcgtgggcgccggacccatcgggctcgtcaccctgctggcggcgcgcgcgttcggcgcgccgaaagtggtgatcgtggacgtggacgaccaccgcctgtccgtcgccacgtccctcggcgccgacgcgacggtcaaggtgtcgacccgcgccgaggacctggagtcggaggtggagcggatccaggcggcgatggggtcggagatcgacgtgagcctggactgcgccgggttcagcaagaccatgtcgacggcgctggaggcgacgcgccccggcgggaaggtgtgcctcgtcgggatggggcacaacgagatgacgctgccgatgacgtcggcggcggcgcgggaggtggacgtggtgggcgtgttcaggtacaaggacacctggccgctctgcatcgacttcctgcgcaccgggaaagtggacgtcaagccgctcatcacccaccgcttcggcttctcgcagcgcgacgtcgaggaggccttcgaggtcagcgcccgc

SEQ ID NO: 27808 - DNA, 637 bp, Sorghum bicolor
  Clone ID: 7218760
gcacgaggggatactggaacagagttagcttcctttgacaagtcacttgaaagtgttgaagaagctttggttaagttagaaaatttgcttcaagaattacacgtttccagttcgaactctggtaaggaggatctacaggctgcatgctctgatcttgaaatgataagaagactgaagaaagaagctgagtttcttgaggcatcctttcgagcaaaagcagaatatctggaggccgatgcacctgcagaggaaggacgtgtaaagacaggtagcaggacgaacgatacatcagcaccacaaaaatcaggaagcagggtggataataaacgccgtccattttgggacttctttggtcggtctttgggaaagaaagttgatccagctcttgcagatcaggatggcactgttgacaatgtggagaagaaagatggggagtcaaatgacatcctccgctttgaacagttaaggcgtgagctgattgagttagaaaagcgggtgcagaagagtgcagatgaagctcaaaaggaggaggagatggttgtcacagacgaaataattgcgccatcacctggttcatcagttccttccggccaggctaccaagaaagaaaatgtcataactaaatcagtggagaagg

SEQ ID NO: 27809 - DNA, 623 bp, Sorghum bicolor
  Clone ID: 7218766
gcacgaggcctttgcgcatcttacgcacaagctagtatcatttccgtcaaaccagacttccattaggtgttgactggctgttgactaaaatgagctatagtgcgtgcagagatgcaaattgagcagcttcaagagcgggaaaagcagcggcgtctaccacacgaatctgaactcttcaagctagaagaactcggttggccatgtcctgcactacgacaggggcggtcgttcctcgaagcgtcgtggagacaccactagccccgacgttcgacgtgaacaccgtatctgcgcgctcacccagctacccctcgcatcccatacccagacgtcatccacggcacaggttacaaacaccatgcacccacccaccccacccgcccccacacaccgcgccctcacccctaccacgcacccgcaccgaacgaccctgcccttcacgcccacgcctaacacgaatgagcacagttctccacaacgtcatgtagcacgaaaagttttgtacgacgggtccccatcaggatcccgtcatggagatgaatagaaatccacggatccaacgcagcattgtcccttgcgtttccttttgttttgactcgacagaatcacattttgtcggtcgttgt

SEQ ID NO: 27810 - DNA, 637 bp, Sorghum bicolor
  Clone ID: 7218768
gcacgaggctcgtcttgacccagcagctcctgccagttgattttcgtcggtgccatctctgccggactcggtccgcctccatcgagtttcagctcgagcctgggggcgctcctgcactgcgatgagaggatgacccccgcgcaggatcccttctacatcgtcaaggacgagatccaggactcgattgataaagtgcaagatactttcctccaatggaagcagacacctgaaaatcctggagagtatgtgcatctgaccaaagaactactaaccagctgcgaaagtatccagtggcaggtggatgaactggagaaggcaatttcagttgctcagagagatccagcatactacggacttaatgaggctgaaattgggagaagaaggagctggactagcactgcacgtaaccaggttcttgctttaaagcgaaatgttgaaggtggaagacagaagagtgtctttggacgttcaaccaatccttctgaatcaatcagatccaagaagaatattgtacaagacaatgatgaattcattgcttcagaatctgatcagcagattctcctgataaagcgacaagatgaggagttggatgctcttagtgctagtgtacagcgaattggaggtgtaggtctcacta

SEQ ID NO: 27811 - DNA, 644 bp, Sorghum bicolor
  Clone ID: 7218771
gcacgagggaaacatcaatgttacacaaaaatgccgaagaaaaagttaaagttcttcttcgagttcctgaacaaaaaactcgattagttggtcttcatactcttccattaacattcatccgaaaatatgatgcaaaattaggccttcatggaaaaactcttgttaaaacaatccgctctacaatgatggattctcgtcataaagaaattcatccaactcaaaattctttcacagtatctggacactattatcatccaagagaatttacagtatctgcactcaatggaatggcatggtcatctgaaagccatgttcaagtcaattttgaacgtcaaagcgaatgtgctgatgccattgaacttctcattaccagccgacttttccaatctactgaaatttcatctgcaaaaccacaatttgatcaattctatcaagatgccaaaaagttccaacccgtttttgatgatgatgttgaagctgataatgatgatgaaactgatactcataatgatcgtcgaagccgtcttacaacatatctttccgatgaatataaaccacgtgcagcttaccgtcactttgttaatgctgttgttaaaaccattggtggatcagttgatcatcaagcatcagcaaaacttgaagcc

SEQ ID NO: 27812 - DNA, 616 bp, Sorghum bicolor
  Clone ID: 7218778
gcacgaggcttattgaaggcaggctaggcgagagcagcgtccgccgccgcgccctcatggcggcgcccaaaccgatctgggtgcgccaggctgaggaggccaagctcaagtccgaggcggagaccgctgccgccgccaaggccgccttcgaagccaccttcaaggccctcgctgccgcacccggcgacgccgacaacgacgccgaccccgccccaccctccccggccgagcctgcctcccccgagtccgacgaagacgatgccccggccccgccaggccctgtcgacccgtccaagtgctccgccgcggggcccggcatcgctggcggttccgccggaacgccctccaccttcaccgtcgtcgccaaggaccgccacagccggaggctcaccgccggcggggcgcgcgtgcgcgtgcgcgtctcgcccgctgcgggagtcggcggggacgatctcgagggcgctgtcaaggacaacggggacggatcctacacggtcacctacgtcgtccccaagcgcggcaactacatggtacacatcgagctcgacggcgcccccgtcatggggagccccttccccgtcttcttcagcggctccaccgccacaccatcagccgc

SEQ ID NO: 27813 - DNA, 627 bp, Sorghum bicolor
  unsure (1)..(627): unsure at all n locations
  Clone ID: 7218780
gcacgagggtgccctatacgatcgagtctccgggctatctcaaggtggcaggcgagagtcttcctcgtcgtcatcctcgagccaaacatggcctcctacgatatccctccgcaggagtgctaactgtcttcgatatcgtgcgccgtagcgctaaattgtaccctgataacaaggctgtcggtagccgaagactcatcaagatgcaccgcgagttcaagataatacaagacaaagaaaaagaatggatatactatgaattgggcccttacaattacttgagctattcacaatacgaactgctcgccatccagatcggctctggtctgcgcaagttgggcctctctagcagtaacaaggtatatttatttggtacgactaggtatgtcttccctccatgcaaagacccctgaggactttgactcggcaattgtctgatgttatctatttaatgtgggcagcgcaaattggatatccatgtcacacggatgtgcctcccaaggaattcccatcgtcacaggttacgacacgcttagtgcaacggacattcaacattctttgtcgcanactcacgctgaggtgatatatcttgacccacatcttctgggtactgcaagcattgcactcgaa

SEQ ID NO: 27814 - DNA, 630 bp, Sorghum bicolor
  Clone ID: 7218789
cggtcgccttcgtcgcggcaaacaaggcgctgctggctgccgcgtgggtcgtcgggttcgcgctcgtgttcctgtggcagagcgcctcgatgtccttcggcagcgctggcgccggcggcgccgctggcggagggttcctcaggctcctgtcggcgccgcctccgccgccgcgccccgcgccgcggcttcgccccacggcgtacaacctcacggacttcggcgccgtcggggacggccgggccgtcaacaccgaggcgttcgagcgcgctgtcgagaccatcgccgccctcgcggagcgaggcggcgggcagcttaatgtgccccccgggcgctggctcacggcgcccttcaacctcaccagccacatgacgctgtttcttgccgagggcgcggagatccttggcattacggatgagaagtactggccattgatgccagcattaccatcatatgggtatgggcgggagcgcaaaggaccacgctttgggagtctcattcatggacagaatttgaaagatgtagtcattacaggacataatgggagcataaatggccagggtgaagtttggtggatgaagcatcgcagaagaattctgaatacacaagacctcctcttgtgcagctgatgtg

SEQ ID NO: 27815 - DNA, 622 bp, Sorghum bicolor
  unsure (1)..(622): unsure at all n locations
  Clone ID: 7218795
gcacgagggctgtttgtgcttgtctatgatgggactgttcacgacggccacgaatgctgtcaagggtgctgctgggaagcctccatcatccggagaggacaagcccccttcggacactgaggctgatgagacgtccatcctagatgaaaatgaggggtcaatcatcacccatatggtctcgcaattacgagtcggtatggatctctccaaagtctccttccccacattcgttctcgagcctcgaagcatgcttgagcgaatcaccgactttatggcccatcctgacctcatctttggggccgagaatgtggaggatccagatgaacgtttcatcaaggtgctacagtactatctggctgggtggcacatcaagccgaaaggcgtgaagaaaccgtacaatcctgtcttgggcgagttcttccgatgtcggtacgaataccctgacggctctcgtggattctacattgctgaacaaatatcacaccacccaccaatctcggccttcttctatacttcacctgccaacaagctcacgatcattggcgagctccgaccaaggtcgaagttcctcggcaattccgtctcaacgcanatggacggagagaaccgcgttattctccat

SEQ ID NO: 27816 - DNA, 636 bp, Sorghum bicolor
  Clone ID: 7218796
gcacgaggatcggccgaaatgatttctaaaccgatcactcccctctttttaggattctcactcatggctaccgatactggcgattcacacccaacatcgacacccggatgcaagtcttttgaacagctgaatgattctgctggtcatcattctgcctattgatcgcggtcgaatgttggagcgcggatcggtcacgcctattttctacgcctttgctctatcttgttcttcgacgtatcttttggcgaattcacgactttacgcatggctcgggtatctcttgatggttgaaaagttgcacaatggataaaccttcgggtttcgtcctttgagcgagtataataccttcaggagaccttcctgaacggcatgtccggtactcctatttctgggtgtaccgaacctgtggggctatcattgctactcgcaaaatagccttacctcggaatgccacatgccatggtgtcgataatacaaaattcgcccctggagctgaatttgggtccacatctcgctatggctcacctttccgtcgaagcggctcagctcgatcccctagcaggcatttccttcatcgtatttttctttgctttcttttaatttgcacggacgtttgctctggtcttttgagtctgc

SEQ ID NO: 27817 - DNA, 555 bp, Sorghum bicolor
  Clone ID: 7218814
ccatcgtcgaagcggtgggcgaccaccgcgccatccacgtcgtcgacttcgacgtcagcctcgcgcagcacgcggctctcatccagtacctcgctgagcgacgcgtgcagggcaggtccctgaaggtcaccgccgtcaccgacccgagctcaccgttctcgcaggctcaaacggcgtcgctaaccaccatcgcggagccgctgaagaagctcgcggagcgagctggcgtggagtaccgctttaacgtggtcagctgcagagcagcagacctggacgcgtcgaggctgtgctgcgagcccggggaggcggtggcagtcaacctcgccttcgcgctctcccacgtgcccgacgagagcgtctctccggccaacccccgcgacgagctgctccgccgcgtgcgcgcgctggggccacaggtggtgaccctcgtcgagcaggagctgaacaccaacacggccccgctggcggcgcgcttcacggacgcgtgcgcgcactacggcgccatcctggagtcgctggacgcgacgctagggcgggagactagtgcggagaagg

SEQ ID NO: 27818 - DNA, 597 bp, Sorghum bicolor
  Clone ID: 7218818
gagctttcttcagataagtcatcggtatcagatattacaccttccgcaatttccagatccaactcgcttggtgggaatctggacagtctcccctctgcacatcataattggccacactctttacaagaacatctctctggaagcacttcaacgtctactgttgatgctcaaagtatcagtccttgtactgatggatctagtaacttgcgtatctcagaaaaaagtccaaccgtgagcagggcactgcaggaattgatgctctcagaggacgaggttagtcatgcgttttcttcaaatttcatcttactgcattatggtgttgaatcattatacatgagaatccaatcaatccatgccagacctctatatctgtgtctccaattagttgtttgtactaaagcagctctgcaatcacatattacattctgtatagtatttatccttctggtttcctgaatctgaactaatctctgtaattcctgtaatttgaaaaatatagcacttaaattacattactgatctaagctattaatacttcttatctaggcaagcactccttgtgctagtggtcaaatttctgcatctactaatttgcct

SEQ ID NO: 27819 - DNA, 569 bp, Sorghum bicolor
  Clone ID: 7218822
ttaaacccacgttagttatgttggcagcttactcaaggagtcaaggtgtaccctttatctttcaggggttgtctgaacaaactataaatgcacttcagttaatggaggaagaaggattgttatcctgaatttgttaatcaacgcttttggcactgctggaaggcatttggaggcactagctgtatttgaaggcatttggaggcactccaacatatctaggataatgagatgaaaatgtttttttagtcttgttttaagtttatgatgttttgctttctttgcactcctacgattatctattattaacaaggtgttgagtatgtcaagttcttgttgttctgcatggccatctcaatacactaaagtcatgataagacaatttccccttgaagcgtcaatttctccaagtctgctacacaggttttatagactaatgtatggttagacatttatttatatatattattttaatatctttactaataatttactaatgcaatactctgataatgatacacaaacacgagttctatattattcttttatgaattgtatattagtcttcatgg

SEQ ID NO: 27820 - DNA, 626 bp, Sorghum bicolor
  Clone ID: 7218823
gcacgaggggaaggcggtgctatgtgggggacgtatatggattactggaagtgcaccggcgattctacctacaacaaagtggtgatgcagtccatgcagttccaagtcggcgatgatcaggactaccagcccgccaacgttactctgtccctcggaaacgacgatcaaggtttctggggaatgtctgccatgttggctgctgagctggactttcccaaccctgcttcagaccagcctggatggcttgccctcgctcaggccgttttcaacactcaggccaaccccgatcgacacgacagcacttgtaacggtggtcttcgatggcaaattcctcgaactaacaacggctacgattacaaaaacagtattgctaatggatgcttcttcaacctgggtgcccgactggctcgctacacaggcaacaagacttattccgactgggctgagaagacctgggactggatggagggcgttggtttccttgaccccgacacttataagatttatgacggtgctcatgtcggaacaaactgtaccgatatcaacaaggctcagttctcttacaactctggcgtcttcctccaaggcgctgctttcatgtacaaccataccaatggtgagcagaa

SEQ ID NO: 27821 - DNA, 619 bp, Sorghum bicolor
  unsure (1)..(619): unsure at all n locations
  Clone ID: 7218835
gcacgagggggttgcaatgtccctgaccgtgagatccttgaacggtgacaccgcatttctgctcacgttcagcccactcgaggctccaccgtcctctccaggattcttcccgggatccttcacggtcttgattgacccctggttggtcggtccatccatcatcttcaactccgttttttccatctcgcaccaaaaggcacaaccatgcatcagtcatctcaaagaactaggtcgcgagccagatctgatcctcatatcccaggataagccggaccattgccacgaagaaacgctacgtcagcttcccccagagtgcgaatccacgattctcgcaactcctcctgccgccaaaaagatccgctcatggagacacttccgacctgagcttgttcatgctctacccagatacgtgcagaacgatgatcgtaccattcaccgtattgtgctgccaccgcccactccaaggggttcatgcggcgaggttacgatagcctggatgccagagaagagagatgtttcgagactgcaccatgctattggtatcacgtaccgaccgccttgcaccgtgctgtcggccgcaaagtcgggcttctatctcgatcttcccatgagtcctnct

SEQ ID NO: 27822 - DNA, 585 bp, Sorghum bicolor
  Clone ID: 7218842
gcacgaggcttttatatgttctgggtacaaacaaatggaattgttccggttacttcttcacataatccatgtttcttctcgcggcctccatggaccatagtccaccaaaaataaagtgttgatgcttatttagatattgtattgtcagactttatgaaattaaatagtccatgagagtttggctggtttcccctcattaccatatcgtagattgtatctctcattatatgatgtttgcctacatgttctgacaaatatagccaaaccattttacttctcggatgcttgcaagcatcaaccaatgaattgcaagcctaagaaggtagagaaacaacatcaatcaggaacacatggatcaaccaatggatgatacgtgtgtccaagtcgtggtggggatatgagatttgcccaagcttggctcagtgaccattactgctattcctgcagtccaaatgtgttgcctcgaacataggtccatgtaatcttcctaaacccacaacctcctatatatgcttatatcacatgagtgagattacagcttgcatacttccatcaatctcttttagtgtctgtcttagtatctaa

SEQ ID NO: 27823 - DNA, 629 bp, Sorghum bicolor
  Clone ID: 7218843
gcacgaggcatctccggctgaatttcttttcccttgtcttttcggttctacgctggaattcatttgatccactctttacaagcgcttcctcttctctacagcaggcgtacaatcatatcctcccgtttcgagtaaccagcgtctatttctagtcaacactcaccaggctccactgaacccgaaaaacttctactaccacaacctttcccgttcatcgatcctgcgtgggttcaactgggcaatggaggccctttgccagaatatgggtggaatcgaccgacaagttctgacgagcctgctggccaggagagtggagcgcaaattgatattggatcatctgctttccagctatccgaaaaagttgataatgccgtcgttccttctttatcgcataatgagatcagggaaagtgcagtccaaaaaaatggcttatccgagtcccccgagccccaaacccatggtcggcctgttaacaataccttgcgatgcggcgactgcgggttgctgtttccaaagcagcatcttctcaataagcatcttaaaaaacacaacccaccattcaagtgcactctggatcagtgtggcgaggctttccgatacaaaaaagaccttatccgtcatcaagcgtc

SEQ ID NO: 27824 - DNA, 629 bp, Sorghum bicolor
  Clone ID: 7218846
gcacgaggcggaaatcatccgtatgaaagagactcgtattgccgaagttggcgccgccgaacccgtcacacagaaagagtatgccactcccctatggcatcaaatcaagcacgtcaataagcgccaaaacttggctttctggagaactccaaactacggtttcacacgactattcaaccacgtcatcattgccttgttgactggtcttatgtacctccagctcgacgattcccgttcatcaatgcagtatcgtgtcttcgtcatcttccaggtcacagttctaccagccctcattcttgcccaggtcgaaccaaagtacgccatatctcgaatgattgcgtatcgcgaacaaatggccaaagcttacaagacattcccattcgctctttcgatggtcattgctgagatgccgtataacgtcctatgcgccgtctgcttcttcctccccatctactatatccctggactcaatccggagtcgtctcgcgcgggataccagttcttgatcatactgatcaccgagatcttctctgtcaccttggcccaagcattagctgcacttacacccactcctttcatttcttcgctcatcaatcccttcgtcattgtcatcttcgcgcttttctgtg

SEQ ID NO: 27825 - DNA, 631 bp, Sorghum bicolor
  Clone ID: 7218849
gcacgagggtgattctgtgcacaacgtcatcgagcaggttcacggtgacaagagaagctccatcacggctgagtctgacatgcatgacccatctctcttggccattgcgcaaaaccatcgtgtcaacaatttgactatggctccttcgactctcttcgccgacatcgcttttaccctcgctaagcacctcatcgagaaccacggcctcgacacacagtcgaacctaccctccatcaataacatggctgtcgaaaaggctctcatcgttggagagactggccctcagctgttccgtgcatcgcttgatatggactggaccaccatgcagggctcagctcgtatcttcggcgtcaatgcaagcggaaagcagactactctccacgccgtctgtgatgtagcggtcgacaacccgggtacccaccgcgaaagctggcagagccacgcgtatctcattcagcgaagcatcaaacagcttgtccaaggcgccagtgatggttctgctcatatgatgcgtcgtggtctcctgtacaagatcttctccaactcagtccagtatgggtctgcgttccagggtatcgagcaggtttggtttgacagtgaaggtctcgagggaactggcaaggtcttgatg

SEQ ID NO: 27826 - DNA, 633 bp, Sorghum bicolor
  Clone ID: 7218851
gcacgaggcggagaagtcgaacatcccgtggagggagatgacgaaggaggtgctggagtcggacgtgtacgaggtgttcgagagaatccaagacccaaacctcgtgtaccctgactattatctcaacccgtttcatgcctacgacgaagggaatctatcatggctggctgcagcagaggctgaaccggcaacaatgtcaatcgcaaagagggccatacctgatgctacatcgatcgaagaggcgaaccaaatcgtccgcgggaactggctgaatgtaattgaggagcatcatgtcaagtactcggggaactgtcaagtaaatgacatcttggacattggctgctctgttggagtaagcaccagatacctcgccgagaagttcccttcagctcaagctgttgtaagctctcaaatctcttcttaagctccttttgtgtattgttccgtacggagcaataataagctccagtatctttatattacaaattaattatcaatagtatgatgccattatcggtacaattttatctgaatctatcccattgttggaccattcacaagcaacccatgttcaccaaaagaataatcgagtagtagatagtaagtagcttgtatacattgcagtcttctctg

SEQ ID NO: 27827 - DNA, 574 bp, Sorghum bicolor
  unsure (1)..(574): unsure at all n locations
  Clone ID: 7218855
gcacgaggcagattgggagcattgactttcaattgttccgacatgcagtgcattgtgttagcaagcagattgagagctcttcaaagattttgctcgctaactcttcactgtcaagaaaaaaagtgatcaaaataccatacaagactctcatcaaccttgaggacaaagctgaacatgcattcagtagtgaattcaaaaacggtcttgagattcttctgaagtccaaagcagccattgtacttgttagaaatggctctgactctgatgctgagtttctgggtttgctcaattcttttagtgagttaatgaaggttgtagaaaatcaagtttctcccccttttattatcgtttcaccagctggtcatgtggagtcagttcggaactgcctggtagagaatgactattttggtttggacactgaaaaggtgtgggtgctggaagagctggagcttccagttgttagtatatcctccgagggaaacagganaaaggttctgatgaagtctccctgngagataataaaaaggccagcaggatctgggggtatcttcagcttactggcatcaaacaagat

SEQ ID NO: 27828 - DNA, 643 bp, Sorghum bicolor
  Clone ID: 7218858
gcacgaggtatatctactcttgggaccatagcaaattcacaaagtctagacacaattggatggtttgcacgagacccatgtattctgcaccgtgttggagaagttcttttaccaactgctgcaggtggacttaagcaaacaaggcaaattgtttttgccgatgattgctttcagctgctaaaggtctctaatcagaaaactgtgcatgccataaaaaatgctgtccaggcattacgtggatatcaaccacctaaacacatcaatattggccaatatatttgttccaatgtacctagcctgaaggagttttgcgaaccagctacaaagttacaagaaggaacatcagccttgaaagcaatctccacagtgatgttgttattgcagagatacgagtttaaagcaaaccatgaggagtgggttaacactgttaaacctaagcttggccttgatatctctactcgtgtactacaagctgtgaattttgcacatgaaaacatcaaatctttatacgcagtaagaaatgaattgcgggctgcactcaagaatcttctaaaggatactggaattttagttctaccaaccacagctggatatcctctaaagagaaactctaaagaaaggctatcatctggatttgaggata

SEQ ID NO: 27829 - DNA, 615 bp, Sorghum bicolor
  Clone ID: 7218861
gcacgaggattcgttatacaactatattgtgcccaaaagatgagcctcttgcatttgacaagatttatcattatgaaaattcgaggctcttgaaactatgtcccacaatgaaactacccttgaatcaggtaccatcggcacttttctcgaagttaacttgtctgcgtgcactagacctgagttacactgagctagacttcctgccagattctgttgggttctgtctacacctcagatacctcaatcttcggaatactctgataaagactcttccaaaaactgtctgcaacctattcaatttgcagacacttgacctcagggactgttattggctcatggatttgcctgcagacatgagccgcttagttaacttgcggcaccttagtttacatattgattgggatagagttactgcttttagatcaatgccaagtggcattgaccggttacagtcacttcaaactctttccagatttattgtggtctccaaggatggaggcaagtgcaacattaatgagttgaagaatttgaagatccgtggagagctttgtcttcttaatttggaagctgccaccaatgacggtgtcatggaagctaatttgcgcgggaaggagt

SEQ ID NO: 27830 - DNA, 626 bp, Sorghum bicolor
  Clone ID: 7218866
gcacgaggccgcaatcgctgtctacgaatccccccaagcccgccagttcgctgaagatgttcgtcgccgtatcgccatagctctgcactcgcttggcgacgaaattaaccctcgtccaaactcgcggcagcctcgctttaaccgacccgaagatgcagatggcttctatgagagcaggggaggtgcagacccgggcgttgacgccgacgaggagagtcaaaggcgacagagagaggagctgatgtactggaatgcggtagcactggagaaaaaagagaaggaaatgaggatgaggtctagccgaagcttaagcatgaacgagaaagacgacatcgcagaacctaggagccccgcatctcgttttgaagatttcttacaggaacacccaactgagaaaggaacctacgtttacaacactggctcagacgcccatgacactgttgattacggcctcatccaccgccggggtggtgtggaaggacttcgtggcttgggtgcctcgatatactccaacccatttgcagacgaacaccatattgacatcgaagaacagcgtaatttaatggcccctgatgagtccgaaaaggtcgaaatcctatccgacatttacaacgctagcgagaggg

SEQ ID NO: 27831 - DNA, 580 bp, Sorghum bicolor
  Clone ID: 7218867
ccggccgccggccgccggcctccggcctccgcttgcaatggatgctgtcatcgcgttcacctcaggaagccctagccccacgcgcttctactactcagcttcgccgtcgatacgcgtcccccagagcctctctgtctgcggcccatggcgcgggcgtgggcgccccctcctcgcgctccggcatcggtcccagacccaggccaccgcagcggcggccggggcggccgaagtatcccaccacgatgttgtagttgtgggcgctgggatcgtcgggctcgccatcgcgcgccacctcctcctccacacttctctctccgttgccatcgccgacgctgccgtcccctgctccggtgccacaggcgcagggcagggatacatatggatgtcgcaccggaggccggggagtgacacgtgggagctggcgctgcggagcaagcaactttgggaggagctggcggccgaggttgacggccagggaggcggcggtgcacgggagagattgggttggacgaggacaggaagcttgctagttgggagaacttcggaagagctggacacattggaggaaaggaccaaggtt

SEQ ID NO: 27832 - DNA, 545 bp, Sorghum bicolor
  Clone ID: 7218870
gcacgaggctgacaactgcggaaccgaggtagtttatagtgtttgaaaaaggagggacgtctatgtctgccattgaaagcgcttttgtaaccgccgtggtcgaccgcgagacaaacacgtgggaatcgaattctggggcaactacaccccgacatagcaacacaataccagcatgcgcgcagcacgatactatggaaaagaggatgttcggattgaggatgtggagcagcagaagtgcggagcgggacaagtcagaattgccccggcctatgtaggcatctgcggtaccgatctccacgaatatctcggaggcccgacctttgttcctaccgagcctcacccatgcaccaacgacaagatacccatcacgctcggccacgaattctcaggcaccatcactgaaatcggatcgtctgattcggccttctctcttggccaaaacgtctgcgtccaaccaagcatctactgcggcgtatgcgaagcctgcaaagccggctgcgaaaacgtctgtttccaaggcggtttcatcggcctctctggcggcg

SEQ ID NO: 27833 - DNA, 543 bp, Sorghum bicolor
  Clone ID: 7218889
gcacgaggctcgtttcgattctagcaggcgtggaaaggtacagccaacagttcacgcaccagacattgcaagccgactccgagcaacaaacttgtccactcgttcggatactactccacactttctatcctgctgcaattcacgccacgagatctccatgctgagctagcgcccgcgttcgctcattcgtcgtcgcgatatcttggaggaagatcaacagcagtgtcaagcctcggcgacctgtttgctataagggaacagacgtgcgcccaagatagaacttggggtccgtatttcctaatttctggccctcaacagacctcgaatctatatacagaacaccatgtttcggtcaccactctttgcttggtcgccacggccagaccaggaccaggacatcgaggcttctccaacgacacactcaccatcccgattcagcgccttccgcagcaatgtacggacattggtcaacggttcatcaatctattcgcaatcacccgctctccccaacaccaacaatgaaaacacgccaaagattccgtt

SEQ ID NO: 27834 - DNA, 588 bp, Sorghum bicolor
  Clone ID: 7218891
gcacgaggctcaacatggattccaacaacaaccgactgcatttgaatttcggcttcaacaacaacaacaacaacaatgacagaaactacaatgcggccaacaaccatgtctaccccacaacgccctccgcattcccgcaaccaatataccagggtcaggacttcgtagatcctcatggcgcgcagaacactgcttatggtcagggatattttgtgaatggtccatactcgcagcaggctcactactctatgcaacaacagcagcagcagcagcagcagtatgcccaacacaaccttgcgtctcctcagcccgcctacggagctcgtgcctacaacaatgacgggacaaatgggttgattcagcagttctcaaaccaggaccttagtgcatcacctcgaccaggactgtctccacgagctgcttctcctgctcagcgacctcgcaccgctggctcgacgggaccacaacagcatggcggacacttggcccctggaatgggtaatcgcagctcaaagccacctggcgaagaagaggagcttcagagatatcctgagcggtactccgagaacgttcataagcgtggtaagg

SEQ ID NO: 27835 - DNA, 559 bp, Sorghum bicolor
  Clone ID: 7218895
gcacgaggccacaccacaccacaccacaccaccgaaactgccccgcctccgcagccgccgcccgcgcccacgcccgctcgtcctccccgcgccgcctcggggacgccccggtcggcgatgtggcgggagcatgctgggcccgctcctcaggctcctctcggcgtgcggcggggtctggcccacctcgccggcccctggcgccgccggcgccgcggcctcggcctcctcctcctccggggacgactctgagggccgcgacggcctgctctggtggcgcgacctcgcgcgctgccacgctggcgacgtctccgtcgccgtcgcccaggccaaccaggtgctcgaggaccagtgccgcctcgactccgccccgcccctcggcaccgtcgtcggcgtcttcgacggccacggcggccccgacgccgcccgcttcgcctgcgaccacctcgtccccaacctccgagaggcgtcctcaggcccgcggggcgtcaccgcggacgccatcagggaggcgttcctggccacagaggaaggcttcctcgcgctcgtgtcaagcctctgg

SEQ ID NO: 27836 - DNA, 640 bp, Sorghum bicolor
  Clone ID: 7218902
gcacgagggacgtaccaagataaaaagtcaaaagcaagccggccgccactcgcaacacaatagcaaatcttgcctcttaatattacccttaccgacgaccaagaagccatagacgcatgggagaaagacaagacagcgtcagcagcattcgcaatcagatacacttacagatatagaaagcaacccgtctctctctcccccgccaccaaggacaatcgcatccgcatcatagcagccagcccacacactcgcttgttcagacaacctcgctgaccgccgctcaatcacatgcaacgagcccggtctgccgtggatttctccaatctccttaatccatcgtcggcaacaccaagccaggaccaaggcagcggagccatgtctaccgctgcggttaccgtcatcaagcccaatgggcccatcccaggagcgcaggcctcagagtctgccaacgagctccctcgcccctacaagtgccctctctgcgacaaggccttccaccgtctggagcaccagaccagacacatccgcacccacaccggcgagaagccgcacgcctgccagttccctggctgcagcaagaagttctcccgctctgacgagctgaccaggcactcgaggatacacagcaaccccaactcga

SEQ ID NO: 27837 - DNA, 617 bp, Sorghum bicolor
  Clone ID: 7218903
gcacgagggcgaccgactgttgcacctccctcgtgctctctctgcctcctttacccctcgagttccagccctcaccaacccccaattgcttttgcgcgcccttccccaaacacgctcccagtccagcctcctcgcccaccacttcgctcgccaacccacgggtaactcgtactccgagcagggatcgccgcactcgcactcgtatacagcagccatgggtgcctcgatatccaagatgatgaacaagatcttcggatccaaggagatgcgtctgctgatgctggggctcgacgcagcaggcaagaccactatcctatacaagctcaagctcgaccaggacgtgaccaccattcccacggtcggtttcaacgtcgagacggtcacgtacaagaacacaaagttcaacgtctgggacgtcggcggccaggacaagattcgaccgctgtggagacactacttctctggtgtccaaggcctcatcttcgtcatcgactccaatgaccgcgaccgcatcgacgaggcacgaaccgaactcacccgcatcatccaagatcgcgaaatgaaggatgcgttgctgttggtatttgcgaacaagcaggatctccagtcagccatgc

SEQ ID NO: 27838 - DNA, 581 bp, Sorghum bicolor
  Clone ID: 7218907
gcacgagggcaatctcctcttcttcctcaatcgttaccttacgatggtgacctcagttatcttcgttagcatccgagaattagtatcaacatcctctcaatgccaactatacaattactgtcatgaatttgctcttgtgatggcacaggtgatcgtgatcgccatcatgtttctgcgcacgtatgctctatacaattgctccaagagggtgcttatactcctccttgttgccgcagcggtagcttttgctgtaatgacctggagtttctttggtcagcacgccaaacctatacagggcaaagccagccaagtgggctgtcagattgaaacgtcagaggagactgctcgacgcatttctatggcgtggatggcccagctcggactggacattcttgttttctgccttacattcttccgcacctttcacgcgtactcaaagcaatctcggctcaatctcccgagtatcctgttcagggatggtatcctctacttcggcgcaatcacaatcgccaatttggccaacattgttgctctatggaagctgcctggaccactctgcgcctcactaactcaattcgttt

SEQ ID NO: 27839 - DNA, 576 bp, Sorghum bicolor
  Clone ID: 7218912
gcacgaggacgattgaaaatgttattgacctggaagctgagaggtggatttttaaatctggttttgtccaatggctaatagctctgatactaggaacttatttcaaggttggatcatcatatatagcactcatctggcttgtttcgcctgcttttgcatatggttttttggaagctactctctcccctgttcggctacctaaacagcttaaggttgtcacgttggttctgggtttggctgcaccagttgtgtcctctgctggtttggctgttcgcatggctgatgtaattgttggaagtattgtacgcattgacaggaatcctggcggactaccagactggcttggaaatgtaatagtttcggtggccattgctgttgtcgtctgttccacgtttgtctatcttctttcatacgttcatatctcaggtgataaaataattctgggtttactactattcatatcctttggtctttcacttgctttggcgtcaagtggtattgtgccagcatttaccgcggatgttgctcgatctgtaaatgttgtacatgtcgttgataccacaggaatagatgacg

SEQ ID NO: 27840 - DNA, 213 bp, Sorghum bicolor
  Clone ID: 7218914
gcacgaggctctaacaaaggaacaacatcagctggcagctcccagtgatctccttctgcctgccagattgcattgatctctccaggccaattgtgtgcaggcacatcatcgttgatccttgtaagcttctagtgctttaatttgctagagttctgccgcagctagccatggatctggcgacgaccccggcgcggcggtccatggagcccggtc

SEQ ID NO: 27841 - DNA, 211 bp, Sorghum bicolor
  Clone ID: 7218915
gcacgaggcgtaccttcaatggcactttgcatgaggtgacgactgctgcgttcaatgccatccgagatatctgggagaacatcattctgatcccccaggaagaggcagtcaagcccaagtctgcgcctaagcccaagcctcctcgtgagtcgcgtatcagctccctgggcgactccgttggccgcaagccatctgttggaccaggcacgag

SEQ ID NO: 27842 - DNA, 141 bp, Sorghum bicolor
  Clone ID: 7218917
gcacgagggccagatcgcgcgggagattgccatcctccgcaccgccgagcacccggccgtggtgcggtgccacggcatgtacgagcgcggcggggagctgcagatcctgctcgagtacatggacggcggctccctcgacgg

SEQ ID NO: 27843 - DNA, 424 bp, Sorghum bicolor
  Clone ID: 7218929
gcacgaggcagcagcatcttccctagctataggctatatagcgagctagcttagcttccttcctctcgagcaagctccagaaaagctacggaatggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctgacatgcaggctgaaacatctgaagatctccggagatgatgaacataataggacgaacgatcgatga

SEQ ID NO: 27844 - DNA, 144 bp, Sorghum bicolor
  Clone ID: 7218933
tgtcagtccaaaaggggtcaagtttctctctactgctgataaaatggatggagcaccactggtatttcagctgactgcagagatgattgaactagaggagcatggtagttcacaccataaagaaggtggtggtttaaatcctgt

SEQ ID NO: 27845 - DNA, 594 bp, Sorghum bicolor
  Clone ID: 7218961
cagcagagatttgcaaattcaggttacagaagaaaaacattataatgctctagcttcctctgttctattgattatttgttaattgcctttttttctttccagcatacaagatcttgtttagccattttagtttaggatttaaactatttattgacatttaaaggatacaagtgcctgaatttgtgtgtccatgtctgttcttgctgtttttgcacattgcaaattgcagaagtgggaagtgtactctggttatacatcaggtaaagagcaaggcatttgaaaacacatgtccagctatgttgtgccattgatgtaagtgaaagttggctggtataacttcatgcctttgtttctggtttgaagtgtgaaattgtttcacttgacagttgaggggaaggaggaggtagaaaaagatgacattgactaaaaaccgttgatatttctttcaaaaaagacaatctacagctgaaatggaaataccaacatatgccccttccaactatctcaagttcaatacatataaccctcatcgttttttttacaaatttgttcaagttacagtgaagtgagtacaatgatggactatcccttgat

SEQ ID NO: 27846 - DNA, 184 bp, Sorghum bicolor
  Clone ID: 7218964
ggggctgccccccgtggtggaggtgctggtggaaaaccggacggaggcgcttcaacggcgggcggtgtgggccgtggagcgcatcctgcgcgtcgaggacatcgcgctggaggtggctgctgaccagaccgtggcctccgcgcttgtggaggcctaccgcaacggggacgtccgcacccggcag

SEQ ID NO: 27847 - DNA, 645 bp, Sorghum bicolor
  unsure (1)..(645): unsure at all n locations
  Clone ID: 7218966
ctacgatgagcactggtttgtcttgntggttgacataaaggaccgttcgtttgttttcttggattcatactatgggttacaagatgagtaccaggttgaaatgagggacaaattgatttcgaatttcaagttttggtggaagaaatttggtttgattgatatgggtttccatggttacacagtttcttatcattttgttcctaagcaggctgctaataatctctctgattctggtatttttgccatgatgtttcttgagcactggaaatctcctcgttcttctatattcactctcttcaaggaatctgatatccctaatttgaggattaagtttgctaatgatctcgtcttctctgcaaagaacacaggtcgcaaggatcttgttaccagttatcagtttgaggatgaccaagacgtgtaatcaacttggtgttgtgatatagctctaatgctcacatgatgtcttagtgttaagtagaggcacaaatgttcagacattacattgtccatatatggatgtttctgtaataggagtagaatataaaactaaaatgcttgctatgatgacctatggtctataattgctacaatgtaatagataatattgttctccgtcctcattgatggtcttgtttgtttttgtct

SEQ ID NO: 27848 - DNA, 341 bp, Sorghum bicolor
  Clone ID: 7218969
ccgataatccaggggcatggttcaaacattgccattttgagttccatttggcgatgggcatggctccagtgttcattgtaaaggatggcccaacgccaaataaatccctccctccaccaccaccgggtttcatggaaggaagtccatgccaataatttcctgttccaagttatttttccctcatccaaaaaaaaaaaaactgcgaactttcaaaaaacatggagtcagggtctatttaaaaaaaaatcttctactgttagtagtttttgaataaacccattaatttatgaattaatgaggtaggtatttttaaagacaaataaacgtatgtgtcattttcc

SEQ ID NO: 27849 - DNA, 658 bp, Sorghum bicolor
  Clone ID: 7218971
gtcctccgtcgtttgttggtcaagtaccgtgccagcggtaagatcgacaagcacctttaccacgagctttaccatctcgccaagggtaacaccttcaagcacaagcgcgcccttgtggagcacattcaccgcgccaaggccgagcaggcccgtgagaagcagatcaaggaggagatggacgccaagcgtgcgcgcaccaaggctgctcgggagcggaagcaggagaggcaggcggcgaagcggaatgctctgctcggcgaggaggaggagaccaaataagtctttgtgatgcgaagggaagacggacgtctcggcggcttgcattcggagtaatcggttgggctcttttcctcatcacagcactttacacatgtcagcctcccgagcttcacggaaccggcggatttggtccggtttgtcgcctagccattctggctgcgatgcactggtttgtcgggcaggagacattttcggcttctgcatgtagggcagggaaaaacggaaacaatggcttgatgaacacataccctctggcctggagttcttgtccctttgctggtgattttgtggctgtgatgcggtgcaatttgagagggagagaggccaagttggctacttggacatagccgtgtatcaatacatgacttatgaccgctgg

SEQ ID NO: 27850 - DNA, 123 bp, Sorghum bicolor
  Clone ID: 7218974
aattcaaatgactattattggcccctttttgtaaactagcccctgtcaaaaaaagcccaattgtagtttggtggaaactggaaaggcaactgttaatttttgtgtacaacaaattcaaaagcc

SEQ ID NO: 27851 - DNA, 694 bp, Sorghum bicolor
  unsure (1)..(694): unsure at all n locations
  Clone ID: 7218978
gtcagcgatgatattgaacggcgttgtgaaagagcaaatgtactctgtgaagcactccgggctctggatgctacagatcttcctgctatgggtgtacgtgatctgcttctgccatcaatacagaatttgttaaaagatctcgatgctctagaccctgcgcacaaggaggctttagaaatcataagccgggaaaggtcagggggtacgctggaaagcatcagcaaggtaatgggggcacatcttgggattgcatcatcggtcagcagtttctttggtgagagcagtctcctcacaaagaaagaaggtggcgaggaacatgaccctgctggccccaccgtgcctgagccaaacctgcaggctcagccagagagcacgaggtttggtcgcataatgaggagcggctttggagacatattgcgaggtcaaagcaaaggatagtgatgcacttggtttgaaacggtcaattacatacatagctctcagtacctttgttaattattgttcttgtaagttcaccgaatatacctcaaggattgtattttctttcccgagaggtttaaaaaaaagcgatgtgacgttgcaatttgatctagcatcaaactttctgaataagacgaaatatatgtatgctgaaagacgaaatatatgtaggctgctcatttataagacanctaatagttgtgtactttgtttt

SEQ ID NO: 27852 - DNA, 136 bp, Sorghum bicolor
  Clone ID: 7218982
ggatgtggcatgtttgtgaaactacttttatgcccgtcaaaccccacgggccttttgtttccccccctttagtttaaatctgtgaatttcaggtaaattgcggtctattaaagggaatcagcattttgcttttgct

SEQ ID NO: 27853 - DNA, 225 bp, Sorghum bicolor
  Clone ID: 7218990
ataggaaaactggatttgtttgttaaatttcctttccttttgctacttgtatcaatgtaccctacataatgtatgccccccttttttttgttttggggtatggtataccccaattcccccatatatgtaaatgtttagctaaattcaaaaacctgtaatttttattttatttttacttttttactcgtttaataaaaatccggtaaatttttttgcccccttttg

SEQ ID NO: 27854 - DNA, 599 bp, Sorghum bicolor
  Clone ID: 7218991
gcctccaaggcatcgctggccatgatcttcatcttcggcggcatctactccatcggtatcacgcccctgcaggctctgtaccccgtcgaggttctctcctacgagatgcgtgctaagggtatggccttttcctcgctggctgtcaacgctggtggtctcctcaaccagttcgcttggcccgtggccatgcgcaacattggctggaagacctacatcatcttcaccatccaggatgcttgccaggccgccattatctggtggatgattcccgagaccaaggaccgcacactcgaggaactcgacgagatcttcaactccaagaacccggtcaagatgtccacccaaaagaaggctgtggctgtcaacagctacggcgaagttgtcaacattcgcgaggtctaaacgggtggcttaccgtctgtctgctatgccagccatatcatgactattctccaggttgtggctcgcgctgttcacggggttgcccacactgtgtgaggcacattcagcgttgcaatcatttccacaccaatgtcctttttcctcttcttgtaatgtctttagagagcattgcataccataatacaactctgcttctc

SEQ ID NO: 27855 - DNA, 131 bp, Sorghum bicolor
  Clone ID: 7219002
tttcgagaagaccttcatccaggctattgtcttcaaccaccccaccctaaaggagctcggtggttagtccgaggtcaaggccaaggtcaagatcatggccaagggtaaggaatacgtcgtcgaggacggcg

SEQ ID NO: 27856 - DNA, 581 bp, Sorghum bicolor
  Clone ID: 7219003
gtatttttcataggatctatagcagaaacaaatagagccccttttgacttggcagaggctgaatcagaactagttagtgggtttatgacagagcattccgctgttatttttgtatttttctttttagctgaatatgctagtataattcttatttgtattttaaatagtattttatttttaggtggttatctgtttgactttaactattatctatatccttacttttatttactgcaatttattgcaggagatagttatatgtatttaacagaaaatgaaactaattttaatgtaattgactttgataattacaattcagtaataggaacaactataagtggtgtggtaataggttttaaaacttgtataatggtatttgtatttatttgagcgagagcctcattcccacgtatacgttacgaccaacttatgtcctactgttgaactgttctgttaccaatagtaattgcatttattatactagtcccatgtatattatacagctttgaaataatgcctgttaatatacctttactttaatgtatttttatttacgtatagctacttttacaacaaaaaat

SEQ ID NO: 27857 - DNA, 135 bp, Sorghum bicolor
  Clone ID: 7219006
tttgcccttggggttccctggtttgagcttccaatgcaggcaaagttggagccccgttttactaatcaaaaatttttccccccctgaaacagaagtttgtttgttcagggaatttgcatttaggggtttgatggg

SEQ ID NO: 27858 - DNA, 469 bp, Sorghum bicolor
  Clone ID: 7219011
ggtgagtggaccacctccgccgctctgccccagttcgactgcggctccactcgctacgtccacgacgacaccgacaccgtgccgtgctccggcttgaacaaccgcaccatcccgtttgtcccgcccccgcccttttacatcaacggcaccaacaccaccagctttgtttactccctgtcgaccaccaccggtaccaccacgaccaccaccttgtccacgttgtcgaccaccaccaccggtattgatggccacatcacgcccttcacctcgctccgtgatgacaacaacgaccagctgtcgcccaaggaacagcccgtcgccgccaagctcaccaccgctcaccgctcgtcctcttccttcggcttcctccctgtcgtcgccgtcgttgtcggtgtcctcgtcgctctggctcttgctgtcctggctgtccgtaagatccgtcgtgcttaaaaagtaaatgattgcttgg

SEQ ID NO: 27859 - DNA, 530 bp, Sorghum bicolor
  Clone ID: 7219012
gctgcacttgccgaagctagtaccgaaaatcgtgctgatcctggagccctttctcaaaacactccccatgagcaagatggttccgctatcgcccgtgaagcattcgtaggtgttcccaatccggtcgttgctacaactgcaggcaccgaggcagatgagccatcaaacgctcatcaacttcctgcaactacaccagcactggatgcggcagaggagggcaagctgggcaatggcgagcctgctgtaggccatatgggagtgaaacgaacagacacaggtttcagtgttagtgacctacatgtgccaggggagtatccgaagacgaaaggtgcataaatcattgctcgaagaaaaggtcatctcatgaattctgtacgactgggaggatatctgctttggcgtttggtcggtatgatatcactagattcaaggacgaatgtcaatattatgatggaacggtaatatatgggtaggactgtgtgggatgacctgccttgttttcaattgtcttaattcataatgtaagactg

SEQ ID NO: 27860 - DNA, 203 bp, Sorghum bicolor
  Clone ID: 7219019
tttggagatcaatttgtttttggagttggccgttgtccggcacggctgcaggaactgcagctcccggccggccggtaaacaagtccctgttgaatgggggtagtagaatgattttgctttgcagtttgtccccaaagacttcatttttttagtagaaatttgcaccaatgagctgcaaaggaggttatttattccccccaggt

SEQ ID NO: 27861 - DNA, 659 bp, Sorghum bicolor
  Clone ID: 7219020
aatcgtcttcctcagcaaatgggtttaatgtctgaaaaccagtggtaacaggtacttcatggataacagatgcttcagggaagttcatctcaaacaatttattgtcaggtgcttctgttgaagctcgttggactggcttctcctgaggcactcgatcggagtgactcatgctatttatgttttcagcatgtctcctttcatttgtatcactctggttttcagatgtaaatgaaaagggtggcatggcttttggaaagtcagtaaagatatctgacccctgaaatatcccactggtattatcaggggcatcaacctttgtgttcccttccttcacaggcatgccgatgttattcaaaagatctgaaaacaatccaaaagatgaatatcccgatttgtgtgtaccacctaaaatgacgaaaggatcttctggcatgctcacactcattttgctggatggaattgattcactttcttgccttattataggttcctccctgtatatatttcagtcacagcttgccgaatagggatggctcgtgcctccaccaaagtcagggatcacaccatcatcaaacgccactgtctcaggctccatttgcggcgctggcttcatgttcccatcgaatccagggatcgaatcgtcgtcgaaccccacctgc

SEQ ID NO: 27862 - DNA, 458 bp, Sorghum bicolor
  Clone ID: 7219021
tgggtcaacgcgcttcgattctcaggggtagaaatagatgactttccaaatgtcaagaagtgggcagattgtatcagcgcgcggccggccgtgcaaaagggaaccgccatcccatcgaagtcccccttcggcaatgacgcatatgcgcagaggcttaaggacgacaaagagtttcccgagaaggaagagaagttgaagacgcaaataaaggaagcgaaggagaagtacggctacaaatacgcctctccttgagtcaagtcggaggcctttacgagtcggtagcccaaaccctggaataccgaccgaagagaacctgtctcgcggatacggcgacgtccaaggtcgatgggtagtcatgatcgatcgcacgcaggcatccatgtatcgtagtgtagtgatatgaagaccgtcaactgcgacgcaaagttaaagaatagaattgaagatttgccctagtc

SEQ ID NO: 27863 - DNA, 638 bp, Sorghum bicolor
  Clone ID: 7219026
gcacgaggcctccttccatatctcacctgacatttcactctcaccctcgccctcgcccacctccactctctgacctatactgagtttttatctgccattttgcagcacaccaacacaatggccatggaagctgcacatcatgcactgattgatcctctcatcgagccagacccgagcgacgagacaggactcaacagccacttccgttcaacttttgcgcccgcagctccaattactccgcctggatccgctggacaccccaaggagcacccctctgttagcatccaacacaccggcagctccgttgaaaccaacccataccgccgctccagggctgcatcggacaccaagggcatgtcgccctccatgacgcactacggacagaattggtcgcagaacaggaagtacgattacccgtctcctcccagctctgccagccccaaacgcagccggttccccaacaattaccgtgccgaagccctcggatccctgaacgagcccaagccacgacgagccagcaacccaccgccatccactctcaacaaagatgagctctcccggaaaagctccttgaaagcacgttacccaggcgacaagtcccaccgaccgctcgaccagctgcgtcatgatgaaaaggt

SEQ ID NO: 27864 - DNA, 644 bp, Sorghum bicolor
  unsure (1)..(644): unsure at all n locations
  Clone ID: 7219031
ttttctttctcatgcgctgacatccggggtgcctgaacgtcctcggttaaagtctccaaccaacgtccactctcccccaccctgacaaacaaagcacctcaaaagaaaacatatacaagaaaagaaatggatacgaaacctacagtacgctcacaggcacgccgtcgcaagctgctctgtattgtcttgcccattgtcgctgtttgcatcctcgccatcgcactaggtgtgggactgggaatcgggctaggcggctctggcggagacgacgatgacaacaacaacaacaattcgccatcaccactcccaacccccaacggcacactcccatgggttccggccgtatcctcgacttggcagattattctttcgcacccacctgacctgactgactcctcctccagcctcactcccaacgtgagcatctacgacatcgacctgttcgacacgccacagtcgacaatcgacgagctacatgcacgaggtgtcaaggtgatatgctacttcagcgccggcagctacgaagactggcggtccgacgccaaagacttcaaagactctgatctaggcaagccactggatggatggcccggcgagaagtggatcgatctaaacagncgaaatgttcggaacatcatgaagaa

SEQ ID NO: 27865 - DNA, 470 bp, Sorghum bicolor
  Clone ID: 7219033
gcacgaggcttcttcaccaccgcgtctggcctgctcgtcggctacgcctatttcctcatcacctcaagagatccgacgtatcaggacttcatggagaggctgttcttgtcaaggcagaagaagctttgtgcagcgaagaagtttgatatggagaggtacctggagttgcagaagcactgtaggtgtcccctggaaggccatcgccctcatggtcctaagcttcatgacttgtaacaccgcaggagctaaactttctcatctgttacctgctgcattacagtgcaccctctaggttgcaggatactaggatagccactacttatttacatgccctgcagttgagactatcgttccaggcagaaatgtgatcctgacagacacggatcatataggagttaccttttggctgcatatcaaaaggcgaactgaatgttcgaaccttgctaatataacctatgtgtgttttgacc

SEQ ID NO: 27866 - DNA, 633 bp, Sorghum bicolor
  Clone ID: 7219036
ccgacgcgttcatcacagccaacgatgacgactactacaagctcggcggcgttgccatcaatgatcctatcatcggtgacaccactcttcagcagcaggctgtcatctacccgtacatcgagtcctggtcgaacttgttctacttcaaccagtcatttatgaatggcttacgatggacgcatcagcactgtgggtacgagaagtatctcgagaaatatggaactttccctccacccgaggagaagttccctcttctgcctgatcctactgccgatacgaatcccaagagcaactatacctgcgatatcttcgattgggcttactatgccgctcttgattcgaacccttgcttcaacatctatcacatcactgatacctgcccccaagtctacagccagctcggcattgtcaacgagggcgactattctcctccgggtgccaaggtctacttcaaccgcacagacgtcaagaaggctctcaacgcccccatcgacgtgacatggtatcagtgcacccccaacaaggtctttggcttcggcgaccccaactccaaccgcagcgatacttccctcgcccccgctcagaacgacgttctcaagcgcgtcatcgagcacacaaacaacaccatcatcg

SEQ ID NO: 27867 - DNA, 633 bp, Sorghum bicolor
  Clone ID: 7219040
gcacgaggtgaagatgacaggaaccatggcagatatctgaaccgtgctccagattggcctgattcagggtatggggcagccaatgatggtccaggggtcacccaaagggaaggtttgatgacgtacaaacagttcatgcaagttcttgaggatgatatttcaccaagtgaagctgaacgcagataccaagaatatagaactgagtatatcactactcagaaacgtgcttattttgatctccacaagaatgaagattggttgaaagacaagtaccacccaactaacttattatctgttattgaaaggaggaatgaacgttgcaaggttatagcaaaggatttctttcttgatttgcagaatggaactctggacctaggccctggaataactgcgggtgccgcaagtaaacctggtggtagtgatggaaattctgaggatgatatggacaatgacaagagaagaaagcatggcaaagattcctcaaaagcaactgattctctttctggtgcccccaaggctcatccagttagttctgaatcacgtcgagtccaagctgacatagagcaaactctagctctcgtacgtaagcttgacgctgagaaggccattgagggcaatgtactgtcaagttgt

SEQ ID NO: 27868 - DNA, 628 bp, Sorghum bicolor
  Clone ID: 7219046
gcacgaggctccagtgtggatgtcactatccatatagttacccacaccacatgtccgcacatatgtgtgctctaagtcgagcatctctcacctgcctacttatccatctacatttgcactgtaagtacacgcccaacttgcacagctcgcatggctgtgtataattcccctcatttcaacatctaccggtctttacgattcatcccggtacgacataccccgccatttcgcgaaagcagaatgtcaagtcggtccctttacgatcgccaggttcatgacagttgtcattgggaattgaagcagtgttcttcacgccgcgaggagcatgatcaccacaacacacccaaccttgggagttatggctcgtagtcagtcagtcatcaagcagcgaaatggggagaatgttttccgctctgcaactgccccgatttcacctccaccattgactcgaccgcgcaaaataattaagcacaattcccctcctaatgaatcgagcttcctgtgcaaaatatctgccaatgcgagagctacgaaccatgaatactcacaggccaatgttgcctccgacacgacaaaaaacgttccgagatgccgagcatgcagacagaagatcataaaagacttcgat

SEQ ID NO: 27869 - DNA, 594 bp, Sorghum bicolor
  Clone ID: 7219049
gcacgaggcaaccatctaggaatctcgcaacgttcagctacgatttttttttactgttcagaccagcacattcaacccagttgatcaacaagctctgcaatattttgggaagcaacaatcatcgccatgaacaaacgtgggcgaccttgacctccttgacacctcaagtcaagcacgccatccaatcaacggcaatagaaatcagcaggcgcccccgtaccttctcaaaagtcccacttacactcttcctttcctcgcatcatggcgcctgctgcacccgttctgcaacaaattcagtcggggctgtcggacaaagagcgaattccgcaagatggtttggcctattcggatgaacccaaagcacggctttggcgtcgcgtgctcggtggaacgaacgccccggaaaattcaacgcagagaggcatgaaaagtcgacatttgactatgattgcattggggggaaccatcggcactggaatttttctaagtgctggagcgtccgttgctctggctggtccaggtgcaactctactctcatatatagttgtagggctcttcgtctactctgtcgttattgctctgggagagatggcc

SEQ ID NO: 27870 - DNA, 626 bp, Sorghum bicolor
  Clone ID: 7219059
gcacgagggagggaacagcacataccagaggatggctgaggtggaaaccaatggcgcccctgaggcatctcttctgatcccctgcatcaaatccctcaaacgcacctacgacctcttcctcaccaaccagctcaacccccgcgccctggatgacctcgagagccaacgcatcaaggtgtattccaaggtgcaggatgaatacgccatggtccgagacatgccccctcccgctcctccctcccgtgcggtcaccaccacgacaccctccaccaccggctccacagcagtcactaccactcatgctgctgcggagggtaccctcgcccttccttccacttcagaggtgccctatggcgagattagagatgaggaatcacaaattactgttgttggtgctcattcatatccttcaggacctggagtatcattatcacaagatggtaaagcagtgggcatcaccgagaagggattcgatgaattgttgcacacattgccaaacaagaatgcacaagagaaggctaagatttcacatgggcttgtggagtatcgccaagctgcaggtatcggtgagcgtattaatccaccagcgccaggcacagcactcgctggagcgcttacacctattc

SEQ ID NO: 27871 - DNA, 626 bp, Sorghum bicolor
  unsure (1)..(626): unsure at all n locations
  Clone ID: 7219060
gcacgaggcactgctcttgatggcaactcacctgcttcgtccaacagtgtaacgtcacagctatcgtcggcatcgccgcctccagtcattcctgagggaccctccaacctctccaagaacccctccaacatccgagcattggtgcctcagatcaaggcaagtgggccagccgcgaatttgacaattgttgccacggcgtcttcaccccaagatgatggcggcccctcctcgagtggagcgggcccaatgaagaaaacctatgacattccgccacgaccaaagccgggccgcaagcctgcaaccgacgagccacaatctaagcgcaaagcgcagaatcgagagtcacaacgagcttttcgtgctagaaaggcgcagagggtgcaggagctgagtgacaagcttgcaactagtcgagagacattcgaccaggagcgaaatacattacttgtcgagctagatcaatggaagtcgcagacgcaagaactacaggctcagaacgcgaaacttgcgatggaggtcgaatattggaagcagcagcacgatcacctcaagaatggcacaagtgcgccagacaccgtcccatccatggttntcaacgcgcatcctgagaccccccatgcatatac

SEQ ID NO: 27872 - DNA, 623 bp, Sorghum bicolor
  Clone ID: 7219062
gcacgaggctgaattgtaccgcgctaaatacgcattgcagtcacgacacgttgaatacattctctgaaacttcaaaatgaacaaaaagccgtggacacaaactttcttagctgaatgtgcatgcaaaattacctgcattatatttgttgcagtaaatattaaaatagagtgacatctcgtataaattgttgcagtaatatatatttgttgcagtaatatatattaaaatagagtgacatctcgtatctctactataattcatgtcatgtatgcgatatttaccaatagtcataggttctgtatttctagacgtggttgttgtgccgttgctagtatcgtttggttggatattttccttgtccaaacaaagtgcagacttctgggattcggcattcttcctttgtcgatattgacgcgagtactcacgttgtttccttctcatctcctcctttcgttcgtcggacatctcggctcgacgagcccgtagccgcaagttccgttcttccctcgtccgtcggacatcatctatagagagagataggaaataaatagacacccacaaatactatacatgtaccttatttggcatcatacctgcgacgttagtgatgtcacttagtgca

SEQ ID NO: 27873 - DNA, 610 bp, Sorghum bicolor
  Clone ID: 7219073
gcacgaggggcacatacatacactcgtactaccacggctcttgcatgcagtgcttctctctctgctgcattcctctagtagccatggctccagctcatgctgatcatcagctccgactgagtttcctcgtcgtcgttgccggcgcggcggcgtcggcgttgcttctggcgtcgccggcggacgccgcgctgccacgggtggagcacgcgcccaccaaggctgacgggtcactcgccatcctcgccgtcggcgactggggccgccgtggacagttcaaccagaccttggttgcccagcagatgggagtggcgggggagaagctggacatcgacttcgttatctccactggcgacaacatctacgacgacggcattgccaacacgagcgacccactcttcaaggagtctttctccaacatctacactgccaagagccttcagaagccttggtacctcgtccttggcaaccatgactacacgggaaatgcgctcgcgcagctcgaccctgccattcgcaaggtggatagccgatacaccgtcatcgcaaagtccttcattgtcaactcaggaattgcggatttcttcctcattgacacgacgccgttcatcct

SEQ ID NO: 27874 - DNA, 620 bp, Sorghum bicolor
  unsure (1)..(620): unsure at all n locations
  Clone ID: 7219077
gcacgaggagaacctatatttgatgtatataacatcgagaaggagatagacagcatcctttgcaaaagggtaccactatgcaatgggggttctctggtcatagaacagactgaagctctggtgtcaatcgatgtgaatggtggtcacagtatgtttggtcagggaacatcacaggagaaggctattttagaagtcaatcttgaagctgcaaagcaaattgcccgtgagctgcgcttgagggatattggtggcattataattgtggattttatcgatatgtcagatgattcaaacaaaaggctagtatatgaagaaatgaagaaagcagtagaaaaggatcgatcgacagttggtgtttcagaactatcaaagctaggtttgatggaaataactagaaaaagggtccgaccaagtgttactttcatgatcagtgagccatgtacatgctgccatggtactggtcgtgtggaagctcttgacacatccttttcaaagatcgaacgtgaaatatgtcgacgtcttgctacctcacgacgaanatcagaccctgagaaaccaaaatcatggccaagatttgtgcttagagtggatcatgagatgtgcacgtatttgacgtcagg

SEQ ID NO: 27875 - DNA, 624 bp, Sorghum bicolor
  Clone ID: 7219081
gcacgaggctgatctgcctatcgaagctacgaataaggttttcagatccaacttgtcgatcaaccttaaacaaaacgccaatatggcaacattgaattacgtgaaacgaagctcagaaaccatcacagatatcgccaaagatgtaatacgacttctaaaagaagagaaagaaactgtcggtgtcgccgagtccttaacaggcgggagtatcatggccgccctcacagcagtcgaaggcgcaagttctgtctgtcgcggcggcatagtttcctacagcattggcataaaggtcaacatactcggagttagtcaatctatcatcacgaaacacggcgctatcaacggggaagtcgtggaacaaatggctgctggcgctcgcagcatcacaacgctcgatacgccaacgacgtggggactcagtactacgggtgtggcaggacccggtactgaggaaggaaaagcacctgggacagtgtttattggaatctcgagggccggtcaggatagggcctttgggccgttttactttccgggagatcgagatgccgtcaggaaagctaccattacgaaggcgctggagcagttgagagaacttctacgtgaccgagatcacatggatgagcg

SEQ ID NO: 27876 - DNA, 627 bp, Sorghum bicolor
  Clone ID: 7219091
gcacgaggcaagactcgtgcagaatatgaaagagatagtgcaacggcaagctgatgaagttcagcgcagtttgaaggaaaagaaagttcttgcagctcccaggaatccacccacttttgagaaagaagatagctatcaaattgcacatgacattgtttcgggcttagtagattgtatcaggcaaaatggaggtgcaaatccagatggagacctttcaacagttgcttctgctgtttctgcaattgttgtgaatgctgggcatgtgatagcaaaacatttggactttgcaggaggtaactatcaaggtgttaattctgtgagtaattcgctaaattttgttcgccacactttgcgtgtccacatcaattctctttgcttactgaaagaaacccttggggaccgcttcagccgtgcatttgaaatagctctggccgttgaaacttctgcagctgttacagcagcttttgctcctccaaagatgcaccgcaatcagtttcaaccatctcctgaggtccatgatgcatatggaaatcatacgagtgatctcagcaactcagggaaaggctttgttgggagagctgcaaaagtatctgctgctgtttctgctcttcttgtgggggccgttgt

SEQ ID NO: 27877 - DNA, 630 bp, Sorghum bicolor
  Clone ID: 7219094
gcacgagggccgagagccccaaggaaaagcctaccgccaccaagcgtaacagcttcttcggaaacgtcttctcgaagaaggagaagaagacccctgagctcaagcctactgagcctgaggctaccaaggaggttgaggctgagactactgctcctgtgatcccccctgttgaggccaccactcctctcgctgttgacgtttccaaccccgctaccgtcccaaccgagaccaccgagactgccgccgccacttctcctgcccctgaggccaagaaggaccttaaggagaagcgcaagtcttctctgccttttgctttcggcaagcgtgacaaatctcccgcccctgctgagggagagaagaaggagtctcctttctcgaagctccgtaacaccattcgcggcaagtcccccaagcctgctgagaagcgagccgaggagaacaaggaggagaccgtccgggaggagcccactgacgccaaggccgaggagaacaagaccggtgaggctcccaagattgaggagcccgctgagcccgagactgaggacaagcccaaggacgctgcccccgctcccgttgtcaccgccgctgcctagatggttgcacggctctgagcgttgagatttacgactg

SEQ ID NO: 27878 - DNA, 615 bp, Sorghum bicolor
  Clone ID: 7219095
gcacgaggctcaggttcacaggtggctagtcttgagacctatgggactttgggtgccattgtgaagagtcgaactggcaataagcaagttgggttccttacaaacaggcatgttgcggttgatctggattatcccaaccagaagatgttccatccgcttcctcctaatcttggacctggagtttacctaggtgctgttgagagagcaacatcatttataacagatgatgtttggtatgggatctacgcaggaacaaacccagaaacttttgtccgagctgatggtgcatttataccgtttgctgatgactttgacattactagtgtcagcacctcggttaaaggagttggagtcattggtgatgtaaaggcaattgatttgcaatccccaattggcagtctcatcgggagacaagttgtcaaagttggaagaagttctggtctgacgacaggaactgttgtcgcatatgcacttgagtacaatgatgagaagggaatatgcttcttcactgactttcttgttgttggggagaaccaacaaacgtttgatcttgaaggggacagtggaagcctcataatcttaacaggacaagatggtgagaagccgcagcctata

SEQ ID NO: 27879 - DNA, 622 bp, Sorghum bicolor
  Clone ID: 7219103
gcacgaggattggataggttgtgtggtcaattttgtcgtattattttgtagtataaattactagaaagaaacacctatagtactgtaatatgagactattctaaaaatcatctcgcatcatggtgatcgtgtacttgaatacatcacatgtccatttttttaaaatttactccctctggtttccaaaaggatgtcgttgtagggtgggaagcaaagtagctaaaggaagttgtttcaccattttgccactgatctgggctaaaatgcccctgcatgcatgcaagcaagcattaatgggtatgcttcgtctcccacacatgcagccgttggacgcatgctgccgccctccagctccatttaatccgctgcaccgataggctcccagcttactgcgccaaaatttggaaagtttcccaagcactggtcatcgaacagtggatattttctgcagctgcaaaagctcggcacgccgcgctgcaaaatttttgcgcagcggcaaaaaatcggcatgtcgctgctgaaataccagcgcttggggaaaaaaatatccatgcaaaaagtctggcgcagcgaggagtcgagccctgcccacacaacacaattcagagtatagtgaccaatc

SEQ ID NO: 27880 - DNA, 659 bp, Sorghum bicolor
  Clone ID: 7219172
taattcactacgagacgttgatgaaggattcgatgactccttcggtggagagggaatggacttcccactcttccctagcggaaacggcatgacaaacaaggcaaacgagtaccagcagccactctttggcgaaatccctagcgccaatcttggcttctcccagacctcgcagcaggacctcttccagatggacctgtccaacatggacttccagcagaacttcacggactagatgcctgaagttccagaggagcctcgtgtgaaggcggagaaataaaagagcacaaggctcgagattgtatcatgcccccttaaaattaccaatcagttttttggtttacgatttatgacggacttttctcaggccatcgagagcgcgatgaggcctttcatgtaatatgagcagattttaccttgccccttacgttagctttgcttgctttgttgcttgctaccgtcttgcagagacgaggggagatgggggtttgagaatggaggggagattgagtgaccaaattgggtatcagaacacgcaacacatcactacacaacaccatatgacactgcacggttcggtttttgcgagatctggttttcactggtatagagttcgcccctctctcgtacagtattcttagggatagaaatacacccacatc

SEQ ID NO: 27881 - DNA, 615 bp, Sorghum bicolor
  Clone ID: 7219183
atgcgcgccaagggtgtcacggatgacgatctgctcgctatccttcgcctcctcgacctgagccatctcgtggacttgtatccggaaggatgggacgccgaggctgagtggcgtgatgtcttgtcgggaggtttgcagcagcgcgtggctatggcgcgtctcttctatcaccgtccgcggtatgccatcttggatgagtgcacgagctccgtcactctcgagacagagaagattatgtacgacaatgccaagagcctgggcatcaccctgatgactgtcagccatcgccgcagtctctggaagtatcacagtcgcatcctgcaatttgacggccagggcaactatgttttcaccaagctggacgccgacaagcgtctaaagctcgaggatgagaaggaagatttggatgtcttgttacggcaggtgcctgagattgagcgtcgcattgccgaactgactgccgcttgaggtggaattagcaatcaagtgtaacaacagcgggacaagaaggctgtacctcagcaaagcctgactcgtcccataaagcctttggccatcgtattggtggtagtatacatcgcgccttcaatggcaataagagaaacttggaaagtc

SEQ ID NO: 27882 - DNA, 601 bp, Sorghum bicolor
  Clone ID: 7219186
agatcgaggttcctcacagacagctcgctctgctcagtgctatgcagctggctattcgcaacaagaactacaactctgctttgagcttcgctaaccgcatcatcgccaatggcggtgctaccaagattgtagaaaacgccaaaaagaccaaggctcagtgcgagcgcaatcccaacgatgctattgaaattgagttcgaccagttcgctgagttcgacgtgtgcgcagccagccatactcctatttacagcggtactgcatatgaggagtgtgccttcgatggctccaagtatcaccccaagtacaagggccctgtctgcagagtgtgtgaagtatgtgagattggcaagcatggaagcggtttgaagttgttcgcctagactgggcagagcatggttgaataagatttaataacgggagcgcatagtcggaattgggagtttcgagtcaacgatgcccaaaaaggagccaggtagacgaggtggaaagtctagggctttaaaaaggttggacttgaacgactggctgatagaacgatggcaagggagtcatgtctttgtagttgcaacttagcctgattatatgcgagaagcccaagatt

SEQ ID NO: 27883 - DNA, 644 bp, Sorghum bicolor
  Clone ID: 7219191
gattggccgcttgatgaggcagagatgtttgccaggctcggattgagatgcacggcattgaaatgcagggataggcctgatcttgagtcagaggtgctgccgaaactcgatgagattctgcacaggataacttctgctgtctatttgagaaacccaaaactgagtgtaccaagtcacttcatctgtcctataacacaggagttaatggaggatcctcatgtcgccgcagatggccacacctacgagcattacgcgatcagagcttggctcaagaggcacaagacatcgcctgttacgaggaggaagctgccgaattcgtccatagtcccgaaccattccttgcgtgccgcgatacagcagtggaagtcacaattaccagctcagacaaacgagtgaaatgggagtcaggttcatatctcttcttgattcagctgttaatagtggtgaaattgttttcgcgaacacgcaagaagcctttgcttttcggatgttaacttgttcaaaacctgtaaatgagaaaggggcagctgtaaagcagagaatcacgaaggataattttgtaattggagtgataggttttgtggccataataatggtcatcagttttggaatagagcaagcttaaatggcttcttgctatttat

SEQ ID NO: 27884 - DNA, 662 bp, Sorghum bicolor
  Clone ID: 7219201
cccacaagttattgagaacaccaagaagaacgtcgagaaggaacaggacgaggacctgcagaagatccagatgattagcggaagcatgttcgagccgtatcccgaaagcgtcaagggtgcccttatctaccagttccgccggatcctcaacgatttccccgatgaggacgtcctgcgagccttccataatgttcgaaaggcagtggcccccgattcacgcattcttattattgaggagatgctgaacccaaagcgtatccccatgaatgtcgggttggacatctgtcttatgtgcgctgccggcaagaggcgaaacgccgccatgttcagcgagttagctgcgcaagctggtttcaagctcaatgcggaattccagcaaattgcgggtgaatttgatgactttggtgtacttgagtttgtgttggcctgagaggctctgtgagtactatacacatgttgcgtggtcctgtacctaacaccgagctcttgtatcaacatatacctagtagagtataaagagcaacagagggaacacaagagctgtatcagacctgccaaggttagcattgagttagctagagtttctgaccctctttataacagttaggcaagatgttccaaacataggtagctccaattaatgcagttcgggctttgatgtt

SEQ ID NO: 27885 - DNA, 564 bp, Sorghum bicolor
  Clone ID: 7219203
acccactgaaaatggataccctacgccttctgcaaccccgccacctgctcttgaaagcaagcctatcaacgttgtcaagaatgatgcgcttgatccaaagcccatcaaggctgacgttgatgaaggtgacagccccaaggtgctagctgccgaacccaatgggaagcctctagaagagcaaaagctctctggatctgcaatgagccaggaggaagacggagaggagagcgctgaccgtgagggtgatatttactctgatgctgtacttgcttgctcgatagaaaacaaggaggcgtgcatcatgtgcagcggttagatcgggctaagttgtgtgttcatgaaataatgtgtataggtacaggtatgagtatatgccggatgttgatgggaaagcggaggttttcaaacttgtttttctttacttcacggagttgagtgtctcttagagaatggcagttaacgtgggaggaacaaatctttacgattgggtatgggacagtcatcagttatgatttaataggaatggtagaccgattctagtattacaacctcttaccgttttcc

SEQ ID NO: 27886 - DNA, 599 bp, Sorghum bicolor
  Clone ID: 7219205
gcgttgaagagaccccgccatccagctcctccgctttggtcaaggatggctcttccgagctattctttgaccttacggaagccaacgttggtttccgtcactggcatcctatgccagtcacctcccgaggcaacaagcttgcgggccagtctgagatgggcggcgtctgggaatggacgagctcaccacttgagcgacacgagggttttgagcctatgtcgctctatcctctctacacgactgacttctttgacggcaagcataacgtcgtcttgggtggttcgtgggccacacacccacgtattgcaggacgagccagtttcgtcaactggtaccagaggaactatccctacgcatgggtgggagccagattggttcgagatgtttaggtatctagactagagcatttgttcctatatatacgattggtttcatattataaacgagccgttgggacggattatgaactgccagagtctgaatttgtatgggcccagattgctacgagaggaacctgaaggaggacagtcagtcactccctaagaaagcaaatgtattatcatgaccatctctatttactcctgtttttttttaactcc

SEQ ID NO: 27887 - DNA, 606 bp, Sorghum bicolor
  Clone ID: 7219221
atggttcgccgagctgctttgctgtctcttgccattcctttctccgctcatgagcggtttagtattttttctttctttctatctctttccatccccttgatattccggcatctgacccttgcaccgaaagtctacctaaagagctaaatgtgtggattgtcgtcaagcaaccatagtattatcgggataagaccatcaggcagtcatgcccatggctacccgtaatcaggtattcattcagacgcctccaatctcctttccaagcatgtctcttccgagtccgtcgaatccctcccgctgcactttgagcgtagccagtcgaacggcgaaacccagcttctgccccatgctccagtcgtcagggtgacagatcagtccgtacagcattccggctatgaaagtgtcccccgctcccacggcactatatctcgaacagtggtcaggtcctgcagttttacgcggcttgtactaggtttgttgctgtgttaggtattgtcagggcgggacaactcactcgagcacggaaatgtctcgccctgatttatccagggcagggcagtgaatactctcgcctgtcggtcgagacagcccagctgctccatcttc

SEQ ID NO: 27888 - DNA, 584 bp, Sorghum bicolor
  Clone ID: 7219226
tcgctggccgtggagaagcccggcgcggcgtcgggcaagatcttcaactgcgtctcggaccgcgccgtgacgctgagcggcatggcgaagctgtgcgcggcggccgcgggcgccgacgccgtggagatcgtcctctacgaccccgccgccgccggcgtcgacgccaagaaggccttcccgttccgcaacatgcatttctacgcggagccccgggcggcgaaggcggcgctggggtggacgagcagcaccaacctgccggaggacctcaaggagcggtacgccgagtacgccgccagtggccgtggggagaagcccatgaacttcgacctcgacgacaagatcctcgccgccgtcggcaaggcggcgccggcgagcgtccccgtataagcccaccatcatcgtcctcgtatataaagagtccattgttttttttgtgtgtggatgcactaacagctcttcttgccatgcacgcacgtagcaaacggacgctacaaaatacgacaaacattttttttttattttgccttgatttctagttctttacaaggatgaagagagagagaaaaaaaattgtttgttccctg

SEQ ID NO: 27889 - DNA, 646 bp, Sorghum bicolor
  Clone ID: 7219228
cagtcaagttccaaaaatgctttcagttctgcgaaaccaatgggccccgttggccttctgtatatccttcaagctggagacggattcagatattctagttcagaaagcagaaatggctctaaacaagtacaggatgaacgttgttgtggccaatcttcttgcaacgtacaaagaggaggtcgtcattatctcaaatggcgaaagcaataccattcgaaggtgcaacaaagatgaggatctggaggagcatataatcaagctcctagagaagagccactcaaaatatatttatagtagcacagaagggcgcaataagaatgattacggaaaggttataccgttaggcatcaagagtttggcatgagggaaacactgattgattctggaactcaaaataacaagagagctctgccatcaactatgagaaacccctatacatgtaattttttttaacgactctatacatgtaatttgtacctttgctggtatgtatatgtaagcagcactgttataattgttctctctctctcaaacacaccaccagaaaagatggtccaaagttaaatgtatcatttgctattcacttattgattaaaggctttgtaatcagaaatacttattctttgaactgtttgttgacttgttc

SEQ ID NO: 27890 - DNA, 694 bp, Sorghum bicolor
  Clone ID: 7219231
atcataaagtcagtccaagtggtgaacggtatattttctataagatttttgtcagtgaactgaactatgttcttgatcaaaataagcctcagaatgactcagactcaacaagtccaccatcaatgccatctgtcacccctcaaatgcaaaaagagaatgagtgtataggccggcttcgcttgtggcaggtcttctttgccaacccttatgaatggtgggacaaccgacaatccaaaccatggcccacctacgctgatttcaagcacaaggacactcgtgagaaaatatggcttcgtccagacgaccctccctgggtacgaaagcagcttgaattacatgacctggaagtagcagagaatggtcacaggggcaacagtcgactgttaaaaagtcaaaattggaaagcccaagattttgactactctgatgatgaagcacagcattgtgcggaagcatgaataggacacatgacattgtctgccaagaatgaagaattcaactggtcatttgggtgggtgggggtgcactttttaatttgtccagtgatcttactcaattgtatagatggtatgtttggtaggatgtgacttcgctaattattggaactgcaaggttattgtgtactttgtaactttatttgtacgtatggcaaggtgcactgagtattattaccatatatagagagtattcgttt

SEQ ID NO: 27891 - DNA, 463 bp, Sorghum bicolor
  Clone ID: 7219250
atgaaaaggacgtggaggatgatgctaataatgaatatatttgaactggtgcagttttaatggatgaggctcaaatggtcatgttccgttccgaagcagtaaaagttcaatgctgaaggctttgtccccgcatgactgcacgtctgcaattccacgggtccaggaatagcatggagcccctgagtggattgcaatattgagatcaaacgtacggtacagttcactttacagcacagaccggcacatgaaaccaagatgcccttgttttaaggtcagtctcaatggtggatttcgtttcactctttccaagacagccacgtcagcttatttgcagaactggattgagaaatgaaactgtttcttagtatgggtttcatttccctgtttttaggacaagctgtaacaggtaatgtatgcatgatgttgttgatccaatatgccaaataaactatgtagtcatttg

SEQ ID NO: 27892 - DNA, 621 bp, Sorghum bicolor
  Clone ID: 7219262
gcctggaagctcaccagcaagcccgactacaccgagagcaaccccaactacgacgagcagaagtacatccacgccttgtctcctctcctcgagcaggagggctggtccggcgccaagttcctcatcgaccagggccgttccggcaagcagcctaccggccagaaggcttggggagactggtgcaacgccaagggaactggtttcggacttcgacctagccccaacactggtgatgccctcgccgatgcctttgtctgggtcaagcccggtggtgagtctgatggtacatctgacaccagcgctgctcgctacgactaccactgtggatatgacgatgctgtcaagcccgctcctgaggctggaacttggttccaggcttacttcgagcagcttctcaccaacgccaacccttctttcctgtaaagaaacaccgcttcacaatcgtttccaggtgttgaaccagatagaattatccggtttatggactagttacaagagcaaagggattggacattggaggaattgaatcaaacacaagactgagagcagctgatcagttatggaaattcacccagcaaataacttagataactatcacaatgcacttcagttgatacaatt

SEQ ID NO: 27893 - DNA, 697 bp, Sorghum bicolor
  unsure (1)..(697): unsure at all n locations
  Clone ID: 7219267
tccaaaagtgcaacgccggtgacgtgacgtgccaggccgcttgcatgggcaacgcgcgccccaacgcttcncaggtcgacgagaccactcagtgcgctgccaagtgcgaccagggtgacggttccccccaggccaccgagaaatatgcgaagtgtcaacaagactgctttgctagcctcttccctagctcccagaccaacttccagggcgccgccggtggacaggtttcttcggctgcttctgccgccaccggtgccgccgccagtgccaccagcgctgccaacagcgctgcttcatccgctgcctcctctgcccgctctggtgctgagtcggccactagctctatcgctggctctgggtctgccactggaactggctctcagtccacctcctctcccggtgctgccaacgccaactctgtgaaggtcgccgccgctggacttgccggcttcatggccatcttcgctttgtagacggtgtagaaacgcgtctcccggtggctcagtagcatgacgacaatggtaaacgtgcccaggaaaccaagccgtgtccggggtggacgggtggattctggggaaagtcaacatgcgttctacgctaagatggatagttggatggatatggtcgaggaatgttgggggaatgtgactatgtgtaacagtaaagccttgtaattgcaaagcgcattgtcagttcg

SEQ ID NO: 27894 - DNA, 658 bp, Sorghum bicolor
  unsure (1)..(658): unsure at all n locations
  Clone ID: 7219276
acattcagaccttcctccgccagtaccacgccgacgacaccggcccctttggcgtcaagcgcgagacgctcgacatcttcattaagagcttggcgggctactgcgtgatcacctacattctgggcatcggggatcgacacaacgacaacctgatgctgcgctccgagggccacctgttccatatcgactttggattcattctgggcgccgaccccaagatcttcccgccgccgttcaagctcacctctcagatggtggaggccatgggcggcgagatgtcagaggagtacgagcaattcaagtcgtactgttgctcgtgcttcctcatcctgcgcaagaacgcgaacctcatcctcaacctgttctcgctgatggtcgacgcagacatccccggcatcgccgctctcggaggtgagaagagcatactcaaggtgcaagagaagttcatgctggacctgacggacgagcaggccatcaaggagttccaggacctcatccagtcgtcggtgggcaacgtgtgggcgcccatctttgacaacgcccacgacatcgccatgaagttcaagtaactcgtagttgtagaagctggcccgagcctcttccattttgttttttttagagaggccttttgctgaacagaccacgngcccggttgttg

SEQ ID NO: 27895 - DNA, 670 bp, Sorghum bicolor
  Clone ID: 7219283
tgcgcagcaggtggctcaggctgagcgccgtcgtgtcgcggtcccgccgcatctcgctgcagaagatcatgcccgagtactgcacctacttcaacagggtcagacagccatccccagcctacgcgtgggtgaagtgcgagagggaggaagacggagactgctacgaggcgctgctgaaggcgaatatcatctcgcgcaccggcgtccaatatgaggcgagcagcaggtacacgaggatcagcctcctcaagtcggacgacgacttcgacgtgctcatggagaggcttcaagaacttgtcgatgccgagaagcacgacgacgcttccaacggttccagctcaatgtgatcacggtaattaatccatggaagcttaataatgggtccgccgatgcggaaagtaccaaatctaaactctggggttcgatcgagcccattgtttctcgtgataagctagctggtgtgtgtatatagcagctatgaggacaagtttgtgaagcggcgtggtaagatacagttaatgcactgccaaaatgcgaatgatcagctaggcgctgattgttctacaaatgtactggaacagtcaactagaagttgactgtgttcccatagtaattaactacctatattgggattggcgcaaattgtgcggtcagtatattcgttcgattt

SEQ ID NO: 27896 - DNA, 477 bp, Sorghum bicolor
  Clone ID: 7219294
aggccgcggcattggcctgggccagaagctccgcgcctacaatctccaggaccagggccacgacaccgtcgaggcgaacgtcgagctcggcctcgccgtggacgcccgcgagtacggcatcggcgcccagatactccgtgacatcggcgtgcgcacgatgcggctgatgaccaacaacccggccaagttcatcgggctcaagggctacggactccccgtggtggggagggtgccggtgatctctcccatcaccgaggagaaccagaagtacctcgagaccaagcgcaccaagatggggcacgtttacggctccgacctcccgggaagcctgccggagttcgccaatccacaagacacccccacagaacaagaagacgataaccaaaactgataaaatacacatctttttttatttagaggaaagataccaatataaccacaatcacacattctcatttcaattcggttgctcatgcc

SEQ ID NO: 27897 - DNA, 691 bp, Sorghum bicolor
  Clone ID: 7219306
aagggttgaatgtcggtgctaacgtcgccggcgctggcatgacgggaatggacaactctatgttttaaaacttggcctggagcaatacttctgctgcatcacttatcgctggtgtacagcaccgttttacctgataccccacgttcgatccgacatggtcatggcgttctttcctccatagatatgggccggttgattggattttctcccggcgtacctgcattcacaaaagttacgagcgacatcacttccttgcatacgggctggcctacgatgacctaacatgtccagcaccgagctgggcacctggaaacgacgtccactgcatcttctactcttcgtgtacatctcttgagccgcatctttttgatcagtagcagagctggaatgacgattcgatgtgcatctgagaggtgttctgagcggtcttttacttttgtctttcagcgcactctatattccctttaattgctcattctctagattcctggcggcgttctttctttcacgaataaaagtttggatatgagatatgcttatgggcaactcgtcgagtctacgtttttctatagtatggctttctgtttggttacggtgtgcataggtttgcttattcacgacattgctactacggtatgtcgctacaggtatcttatcactggtctgaacataaattgaaatgactctactc

SEQ ID NO: 27898 - DNA, 666 bp, Sorghum bicolor
  Clone ID: 7219327
gcgatgaagtccaaatgctgcgtattgatgaactagcgcagctcggctgctgctgcttctgcagtatcttgtacattggcaataatgcgtttgtccaggagaacccagataaaatccgcgccttccttcgcgcatgcaagcgtgcgacagactttgtcttgtcgaatccggacgaggcgtggcgcgaattctgcgccttcaagtcggctatggatacgccaacgaaccgcaagatttttgagcgaagcttcgcatattttagcccagacttgcagaacgtgaggcgtgattgggagaaagttacaaagtatgggaagcgcttgggcgtgttgactgagacgtttgccccgaattatacaaatgagtatttggattgggcgctggagcacgaggcgagcgatccggtcggtgaccagaagaaaatggtcgtgttgcaggaagaaatcaagcagaaaggaggtttcaagcgccttgagggcgtggcgggaaagaccgtcgttggagctgctgctcctgctgctatctgagctctcgatgtggatctgtatacttcaggcttagcactttcactctttcgcgccttccaaagttatacaggaaaatatagtagtcggtgtagtatgggaatagtaaccatgcactgatgagtactgtctcatctcgcct

SEQ ID NO: 27899 - DNA, 574 bp, Sorghum bicolor
  Clone ID: 7219329
tactctctccgcaacactctctccgactccaaggttgacgagaagcttgatgccggtgacaaggagaagctcaaggccgagatcgacaaggtcgtttcttggttggatgagagccagcaggctaccaaggaggagtacgaggctcagcagaaggagcttgaggccgttgccaaccccatcatgatgaagttctacggtgccggtggcgagggcggtatgcccggtggcatgcccggtggtgctggcggcttccccgacggtgctcccggcggtgccggccacaacgacgacggccctaccgtcgaggaggttgactaaacgattcgctcacctgagtggtttccttttgtcatttgttccttcttcggcatacagggtttttgaatggcggtcatgggagttctggggctgtttgagtcagcactctggcttttttctttccactgcatgggacgaatttacgattacgaacagggtggtacagcaaaagtttccaattcggggattgcaatgtacctagtctaatggtgcgagttggcccatcagggccaagtgaataagattcgataacttc

SEQ ID NO: 27900 - DNA, 657 bp, Sorghum bicolor
  Clone ID: 7219330
gacgaggacgacgactcctacatcgattctgacaacgactctgacgtaccatccctcacatcgcgttcgacaaacagttcatcaccgtccagtgtgagctcgcgcagcagttgctgcacgtgcgaacgctacggtatcacgcgatccggggacagagtccgactcgactgcgggggctcacgctgcggctacagcgacgattcgagcgactgttcttcggaagacgaacagctgctcgaatacgaagccaagacgacacggaggcagggcgtcttgatccgcttttagacgccttgttctctccacttctttggacgcatgcgttgctattagctcgccattgcttcaactttcttcttcttccagcccattctttctgtccatattacgaaattttcttctttccttcccgttcactattttcacgcaacgaatgtcctgctgtcatgaatttaccacattcattggatacgacacgcgaatttttctccttgccgctgggcattgaagctagagggttccttggtggaggaagaatgagaccactgcgctgaaaccccatggtcaagcgacatcacgattgtatacagatgtcgggcttcaatgcacgttatgtagcacgtttactgaattgaaatgttgcatggctcgtgcgcg

SEQ ID NO: 27901 - DNA, 684 bp, Sorghum bicolor
  Clone ID: 7219339
tacaaggggaagctcaaggaaggcagtctggtcgcagtcaaacgctgtgtttcaatgaccagtgagcagcaaaagaaggagttcggcaaagagatgttaatcctttcccagatcaaccacaagaacatcgttaagctactgggctgctgcctcgaggtagaggttccaatgctggtttatgagttcatccccaacggcacactattccagttcatccatggtagcaatggctgccacaacatccccttctcgactcgcttacacattgccgtcgagtctgctgcagccttagcttacctacattcatgggcttcgcctccaatccttcatggtgatgtcaaatcatccaatatactccttgacgagaactatgcagctaagatatcagactttggggcctcgatactggcaccgactgatgagtctcagtttgtcacacttgtgcaagggacttgcggttacttagaccctgagtatatgcagacgtgccagctgacggataagagtgatgtctacagtttcggggtcgttctcctggagcttctcactggcaagaaggcattcaaccttaatgggcctgaaaacgagaggagcctttcactacgcttcttatgtgctatgaaggaaggcagactcatggacatcattgacgaccgcatcaagaatgaggacgacatggggttg

SEQ ID NO: 27902 - DNA, 676 bp, Sorghum bicolor
  unsure (1)..(676): unsure at all n locations
  Clone ID: 7219341
ttatttaaaagtgacatttccagtatgtttttgccgtcagttccgattatgaggacttcattagggacttaacaagacaactttgtcagttgtctcatggcagagttgacagctacctagaatctgctatccaggcatttgatgcaccttggccagtcataagagcaaacgcggtttgtttggtgagttgcatgctatcctttttggatgatcagcgattcatcgctccttatttctcccaggtgtttgctacgttagttggtagaatgagccaatcgccagacgcaatcgttcgagcggcagcatcatctgcactgggcattctgattaagagatctaacatgctgaagtcattggtttcacgatatgaccgagcagatttgtcacgcaattcccagagtggcgattctaatagcaagacaccatctgaatttcaagaacagacagaaggaagtccaaatgatgcgcaagtagagcaataataaagctgactgaagccgatcaatcatgtaaatttacttgtatatgtacagtgttctagctgtgcaggcttgtgtatatgttgtactccccttgcaaataggaatagtacagcaaatttattatgtcatgtcaatagatcttcagtacacctgtaaagctcacgtttcgacgnattatttattgaattttcttt

SEQ ID NO: 27903 - DNA, 288 bp, Sorghum bicolor
  unsure (1)..(288): unsure at all n locations
  Clone ID: 7219352
gggaatcacgaagaaatacgccaaggaaattgaggtgattggaaaacagttccctgctgaatcatttaagtggagaacaaaggagcagggtgggaccttgagacttccttggggagatgcgatagctatccttagagaagcgggcgtccagattggtgattttgaagacttaagcacggagcaggagaagacgctgggtgcccttgttcgtgaaaagttcgacacangattactatattcttgacaaggttcccaaccgaggatccgnaccattctacacatatgccn

SEQ ID NO: 27904 - DNA, 554 bp, Sorghum bicolor
  Clone ID: 7219353
cacagggggttggaggccaggcgcctcaccacccactgctcgcccacagcgcagcaacactctagcaaagcaaacactgggcatgtccacccccagcctccccctttccctcacgccccaactaagagcgagagaataaagaatggaggcgggtatcgaggcgggtccttcccacccactgctttgctttgccacgtctacgaatctatatttagaagagaagggggcaaaggttcacactcggtccaggcgcaacaggtcttattttttttagagagagaaggaaggagtgacaggcagacagaaggtgacgaaagttatataccccctccccccttttttatacgccttggggaccatcagcagctcgacagcgctacattatcattactatttttcctttgttgagataccttgtttcgttttgtatgttgggcggcttgactcgcacctcccctttttttttgagtcaccgcggtaaatattcacccacttccaatggtggtgttgttgtagttgtaggatagatagtatgaaaataagttaactacgtc

SEQ ID NO: 27905 - DNA, 652 bp, Sorghum bicolor
  Clone ID: 7219354
acgagtttctgactcgcgagctgtcggaggacggctacagcggcgtgtcggtccgcgtcacccctgccaagaccgagatcatcatccgggcgacgcgcactcgctccgttctcggcgagcgcggccagcgcatccgcgagctgactgctgttgtacagaggagattcaacttccccgaaggccacgtggagctgtacgccgagcgcgtccagagccgcgccctgtgcgccgtggctcaggctgagtctttggcgttcaagctgcagggcggtcttcccgttcgccgcgcttgctacggtgtcctccgcttcatcatggaggagggcgccaagggtgttgaggtggttgtgtcgggtaagctccgcggcattcgcgctaagagcatgaaattcacagatggctacatgatcaagacgggcgagcccacgcgcgtgttcgtcgacaaggctgtccgccatctgaagatgcgccagggcgtgctgggcgtcaaggtcttgatcatgctggccgccgaccccaccggcaggtctggcccgaagaacgacctgcccgactgcgtccgcgtctccctgcccaaggaagacgacaacgaagtggccgccgctgcccctgctgtccgggcagctgctcaataaatcctcgagtttcttcc

SEQ ID NO: 27906 - DNA, 678 bp, Sorghum bicolor
  Clone ID: 7219370
tgtcagtctattcaatatttacaagtataaaaggttcaaaaaaggacatcacaatgaagatactgggacaaatatccaatcttccaatgggacttcaaagtacgttatccttgacgatgatactgaagcccaagatgatacaggctgacctgaatgtggtagaatgcagactattatatgcactggcgtttccagagaagcaagatcatctgtgcctgcatagccttgctttcacaggctaactgatttaatattttttgagttcatcaatcgctctggtcagccatgcacgagcatgtcgcttgcagccatgtgacaagttgggaagactacacgctcatacatgcaacatacagcctggtatcagtacagatgttttgtcctttcattcaaaacaaagaattgtgcatatatctgaacgagactttctgcagtatgtccactaagaaaatgttccatcaattgcaatttttttaaagagaattgcaattagaaatacatctgacacactattaattttctggaagaggagagagctcaattttgtagggcattctgaatgttgtagggagattcagcatcagaacacatagctttcttttctttcttatttttttagatgatgaaattaaacactcttatatgtaatgttatcattatgggaatgtatactgtttg

SEQ ID NO: 27907 - DNA, 677 bp, Sorghum bicolor
  Clone ID: 7219374
aaaatggccggcatgatccccggcatgagcaacatgatgcagggcatggacgacgaagaaggcggcgctaaactcaagcgcatgatctacatctgcgactcaatgaccgataaggaactcgactcggacggcaagatcctcatcgaacaacccaccagaatgacacgaatcgcacgcggttccggaacatcagtacgcgaagtcgaggacctcctcacccaacaacgaatgatggcaggcatggcaaagaagatgggaggaaacatgaagaacatgcagcgagcccaacaagccatgggcggaggaaacaaggcacagcaattagcagccatgcaaaagaggttacagagcatgggtggtgccggcggtgcaggtggtatgcccgacatgggaagcttgatgaagatgctcggcggaggaggaggaggcatgcccggcggtatggacatgcaggctatgatgaggcagatgggtatgggcggcggtggcatgcctgggatgccgccttcgggaggaagaggtagaaggtgagcatgcattaaatggaatacgattgtcagtcacttttgtccctgtcggtacctagcataagtatacgcatcttaaaattgaagataccctgacctgagggcaaagctcctgaccttccgaggtgtcttatgagtctcgggttactg

SEQ ID NO: 27908 - DNA, 611 bp, Sorghum bicolor
  Clone ID: 7219382
atcctattcatttcaatcagggccagagccagttctcttggatgcaactgcaattgcttctgacaagatccttttgttggactcttattttactgttgtcatattccatggggtaaccattgcacagtggcgaaatgctggctaccaagatcaagaaggtcacgaggtgtttgcccagttgttaaaagccccacatgaggaagctaatttaataataaaggagcgatttcctgtaccccgtttggtagtatgtgatcaatatggatctcaggctcgatttttactggcgaagctaaatccatcagtgacatataactcggataatgcctcccctggtggagacgtcatattcacagatgatgtgagcttccaggttttcatggaccatctccagcggctagcagtccaataggatatgaatctgcagatcagtgcatagagcaattttgtactatcaatggtctcttctgtagagtaaagaaaatatttttgttttgcaatgtcttagaaattcgttgtagctggttttaaattatataattttctttcttttaggagacagtcacattttgcaacttgataaattatgataattataagtgaactgtagt

SEQ ID NO: 27909 - DNA, 692 bp, Sorghum bicolor
  Clone ID: 7219385
aaacaatcccgatttaatgttcgccgactttgctcgacgctggatggtcaagattgtaaagagtgctcttcctggagacactattgccaccgtggaactctctaaacgtggagctgttctcaagaattttggaaaaagagactacgacctcattccaagttatctcttactgcgcgatgatgactacgaccatttcataccaaacgaaggaaaatgggagaagaatccaacctcatatgatatgaggcttgtccgaagacttggaacattgttttctcgtgacgaaagcaagaaagtccttggttttcgtgatgtagtcaaagcgttcaagtatgcatcctccgaactacagtgggagaaaacctatgggtttaccagtttcacgctgcggtgggctgtttcgcttgcctatcaacaatcgcccattccggtcttcaatcaagacaaaattcaacaagtgatcgacatcctgaatacgtggattaagaatcagcagtttcctgacccgtacactaagaagacggttccactacttcccgcccacttgatcacgagggactccgtactcggtgtgctccaatagcgatcacaaacccaaaaagaagaaatccttattgtcttcttttcttcttattcttattcttattctttaaaaattttctggacgacaactaaaactaccaagtcacccg

SEQ ID NO: 27910 - DNA, 175 bp, Sorghum bicolor
  Clone ID: 7219436
tgtgcggcttttacagtttgagcaggtcagtaattaactagtaccccttccatcgcgaaataagtgtacatctctcctattgaggagttaaatttggccaaagatatactctaaagtagtaatcttcatgatgtcgtaataagcctttttatatcaaaaacatatttggaaatat

SEQ ID NO: 27911 - DNA, 384 bp, Sorghum bicolor
  Clone ID: 7219471
acaaccaggttttaagagatggaaagtagctcccaatatttatattgaggaaaaggaataggttgggagttttggaaaaatttgtccttttctctatcccaagattgactttttgattcctgaattcatcctggttccttgaaaatcagtgaaattacttttcgttccatttattggaggaattctctgaatagttccctttcggattaggaaaagccccctcattcctttatgagaactcgatggaacgttgaaaatttcatattcagattgagaaccccattaatatgaaattttaaaaaatattctttactattatggttaaagaaatattgttctggataatcttttattcgtcagcaattgctttcaaatttttaaatt

SEQ ID NO: 27912 - DNA, 295 bp, Sorghum bicolor
  Clone ID: 7219475
tgtgcgctatccacgccaagcgtgtgactattatgcccaaggatatgcaattggccacacgtatccgtggtgagggtgcctaaattcattggtaatacaatgaatttaaagacacgccaatacattggctctgttatattaatgtatagaataatagtcgggttcacgaaggctagaataagattttcgtgagcttccttccaattcaccgtggctttgctcacaatccggtctgtgtgttttgttacggtggatataaatattaaaaaaacccaataaagaataattttttttt

SEQ ID NO: 27913 - DNA, 451 bp, Sorghum bicolor
  Clone ID: 7219484
caattcggaacgtggcctctgcccgcgtgtcaattcctgctattgttcgcccagcgtctggcgctggagaacatgcgattgagtggaggacccccctttgatcccctgccccctactggagaagttggttccccggccttttttcctcatttttggccgcccgtaccgcgaggttactcatcctagctggagccgatcgactggacagggaacttatgatcggccaaatgcagggcaagttccaaatgacagttgtatccaacgtcggacatatgctgcatgaggacaatcccgtgcggttggctgaaattgtcgtggacttttggaggaaaaatgatcgggtcgtacctggcgtgaaaaaggttggcgagctctgattacgatgttaaagcatgaaccaatattttgcatgtacataagcctacccaagaaatccccctccctaaatccg

SEQ ID NO: 27914 - DNA, 706 bp, Sorghum bicolor
  Clone ID: 7219486
tcagaccagagttattcgtagcaagaagcgggctgttggtattacatcgtctatgaggtctaataagaaggtttcaagtttggtggataagtggaaagctgcaaaagaggaacttcgtggtgaagaggaagaggagcctgaaagtgctctggaggcattagaaaggaagcgacaaaaggaaatagaggaatggcggaaacaacagatcactagcggagaggcacaggaaaatgccaattttgttcctgttcgtggtgattggcgtgaccgtgtaaaacgtagaagggctgaagcaaaaaaggaatcaaaagatgacactgttgctgcatctctaagtagttccgaacagcataaaggacccccagatctagcagagctctccaagggtcttcctactagttggcaggcatacttggatgagtctactaagcaggtctattatgggaacaccctcacgtcagagacgtcctgggagcggccaacaaaatgaagatctacaaccttggtgtgcggtcaaccgaacgataggactaatttgaccatgtagatggtgctgttcaatggtcagctcaattttgttgtagatatctccttgtcgagtcctctaaatgaacgaacagaagtgccaagcatgtttagagaatgaatatggaaagtacaaaagttaaaatctatgatttagccattttctaaaatagaaagctct

SEQ ID NO: 27915 - DNA, 542 bp, Sorghum bicolor
  Clone ID: 7219490
aacactgttactgcttggggtagtgctgatgtaccttatcacgttacttctcttgattacattgctgccgcgtttgcttctctcttcccatcgacgcctatcgaatctctcgccggtcgtcgtatcggtgtctatgaagtagaagtcactggtaataaacttgtcgaagcactcgaggccaagaacggtacaaagccaactttcaaacttgtctcactcgaagatgccaaagctcaacaaaaggcagtcatcgacgctaatgagaagaacgatctgatacgtttaggcgttacgttgcacgtcaagatcgctcaaggcacggcaaatgttggtaaggatgtgtatgaagtgccgggttataagaagaagacctttcaagagttgttgtcgttctaaacgattgttgtcgttttcctttcacttcttctttctgtggctttctcgagtttgagattcatgcgttcactaaacttgatttgaattccttttctgtattcttacaaggtttggttgtacaagcactatgaagcctatattatttt

SEQ ID NO: 27916 - DNA, 340 bp, Sorghum bicolor
  Clone ID: 7219498
caacttctgcgagtcgaaggaccaacggcccggatttcctcatgggtcgacaaatgcgcacccaaagtagttgtttgggcttgcctggcagtgcatatgactcttccaggccagcaagctcaattgctgtaagcatccccgagtatatcagaccagcccagactgccagggtttggtgatggttctgttcccagagtacaaaaaccaagtatgatatgtgacatatgactgggtggaaattttcgttaggcgtttttgggcaggcgttatatgcaatatcaaagtgtaaatctggctagggttatccaggtgaaacccaaatggcttttgaccccaagcg

SEQ ID NO: 27917 - DNA, 195 bp, Sorghum bicolor
  Clone ID: 7219507
acaggagtttggaaaaatccataaagggaggtgaaataatgggactggcttgtattatgcctggcgcaaaaatggattgctgggaaaatgtaaatcgtcattggttttgacacccggattaaaccagttggggtagttaaaagggttttttccctagtggtatgaacttaattaatgccctttgtttaaggtatg

SEQ ID NO: 27918 - DNA, 613 bp, Sorghum bicolor
  unsure (1)..(613): unsure at all n locations
  Clone ID: 7219528
ttgtgttgcttttgttaaagccctgctgtccagtgtattttcttgaaatttaatcaattccttttcaatttaagctttaagatactgtcgtaaaatttgatgtattccaagtttgatgaagttaccgatgctgttttctgatatgtgatttactgatactttgtaatttagtcaatctttttcagttttttataccttcacctaaatagctgcaagtagatttgatcatggagtagaagtttgctgctatgtctactaagaacatagttgatgaaaatatgaagaaactgtgaaacatctcttttaatagttgcaatttgcaaatcattttctgaaagatgtttgtttcatgcataagtcatgtactctcattctttctttctcctcatcgcagatgctccatttcccttgaagatggatctaattttcatatattcagcatttgttaagggtgaccacacattttttgaatttgacttgtcaactgaaggaactcaactatatccccatgtaaattatacaacaatgaacgagtacttggatactctagtttagaatatttggtcgnatgtatatctttcttgtaagtcataaacaatgccttttttgtgtc

SEQ ID NO: 27919 - DNA, 330 bp, Sorghum bicolor
  Clone ID: 7219533
tttcaactgtcctttatcagtccataaaaaaagaatgggaaaacatgcagcctgacccatgaggaaaccgtccctttaaacagcataaaaaatgtttttaaaataaaatggggggccagcatcggggggctccccttgaaatcatttggccaagcccccgctatccttttggctttatgaccggaactaaacaggggggtgagaaaaatccatgactttcccaactgctttccccactttttaattgtttaaacgattcaaactgatttgattgggatttgtaaacaatttgtccttgaatttttgaagtcaaacaaagtcaggtggccg

SEQ ID NO: 27920 - DNA, 226 bp, Sorghum bicolor
  Clone ID: 7219544
acccctttttccccttatacaaattacccagatttcaagccgccgtccccccctggcagccccccgattgaaggcccagcagcggtcaattttgcccctgtagcaaatgttagcacggaatcatttcctcctggtcctacccccagacctcagtccccttaccctaattatccagatttcaagcccccgtcctcgcctttgccgtcccccccttaattaggcaaga

SEQ ID NO: 27921 - DNA, 634 bp, Sorghum bicolor
  Clone ID: 7219555
gactctgcccagctcatcattccccagtcccaggtcggccgaaagaacgacatctacatcgcctgtgtttcatctgcccacaacgtctgccccaagggctactggatcgccattgtctccaccatctctgagactgctgcgaaccaccacctcgagctccagcccggtcttgagcgcctcggagccattgaggagcagttcatgggtcctcctatccccatctatgagcctcttgaggacggcaccaaggacaacatcttcatctccaagagctacgacgccaccagccactttgagacaacgacagatgacgtcaaagacatttaccgccgcgccaccggcgaggagctcaaggttgaaggtctgagggagggcatcaccgttgcggaagagtaagaagcgaaattagtggttgcaaatctttttgtctgttaaatcatgctatcgagatctttggagttgatacttctcccattctaaaacttgcgaagagcgaccatgttttcttcttgttttcttggttcggtaaatgtcaataatcaatgatgaaaaacaaacctacttttttttatcattttttagtacatcaatcaacattggtggcaaaggacaagtatcgagaagcagaagagag

SEQ ID NO: 27922 - DNA, 104 bp, Sorghum bicolor
  Clone ID: 7219559
ggaaaataagggctcccatcatctgccagtaaattccgaataccctagtcaaaatagctttcaaattgaatagcttgtatcagaggcttgatactgctgtgtat

SEQ ID NO: 27923 - DNA, 500 bp, Sorghum bicolor
  Clone ID: 7219564
agagtcagaagagatcgaacataccgaggtgaccactactaccagtgaaacccacaaacctcagcagcataataatatcaacactccaaatggaaacttgacggattctggaacagttgaagagaaggtggtgttagtaaaagtccgtggtttgtttgattatgccgccacttgtgatactgagctgagcttcaaggagggcgatattctttcaatcaccgagcaagacgagagtggctggtggtatgctgaaatagacggacgtgctggatttgtgcctcaaaactatgtggaagtggcagaataagtaatagaaaaagaaagaatagagaccctttaacgaatgacatatcacacttaggagattgaaacagatggcacggaatagcaattactgtgtgctagtgtattttttttttttaattgcacaattatttatataacttaaaggtaaattattgcaaatgtatttttttctcttggattccaataaatcatgt

SEQ ID NO: 27924 - DNA, 640 bp, Sorghum bicolor
  Clone ID: 7219569
tccttacccatgttacaatggagaaaatatggtggtacattggttgtgcaaagtgcaagaaagctcgaatggaagaaacagccacattttgatgtgatccatgcaaatgctccaaaaccatggcaatgtacaaattctcattcaaggctacaaacgacaataggtacaagaccgatggatccagactccagccaaaacctaaagctcaaagggtgcaccatcatcttaaaaacatgggtcatcttcttttgcaaaatgacaaggatgccctcaccccaacacaaatcaccaccagcttccacaccaagcaaccagctacacaggtcacggtaatgaaactacttcggaacttagagaatcgtcaaaccataattcagattatgatgtgacaccaaggcgaaatttagatgactacgaaccaggttgggaatcagaccgtagttactggaaagcagactagacaatcttaccttcggtaccatgtgaacggaaaaaaaatatgttatgctgaccttttgtaacagcaatatcacgcagtgaactagcctatcccggacagtgtgatctctccacttatatcttattctgatgtattaaactttgaattatctctacaattatatatccccttctactatcc

SEQ ID NO: 27925 - DNA, 678 bp, Sorghum bicolor
  Clone ID: 7219571
tcccatccagccagggatatggacctcgccggtttgccttgtttgaggttggcacggctgagcagatgagggggattgctccgttgagcagccttggtgatcgagctctgttcctcggccttgaccgctgcctctctgtgtctgcaaacaacctgccttccatcagcagtgatgccatttatttatgctctgatggtctctatcctcttcttatgtactctgtcagcagcagcacctgcgagaaattgtcaacgctatccatcatccatgacggccctctgtgcggcccttcacactagcagatcaactgttcaccttttgcagccatcgttgctggtcaagggggctcatgtttcatgaataccactacatacctacatcttggacgtatttgtccgagaaatacaaagcccaagactgcgaagttcagtttccaagctcaagaggtttgagctgtaagaaataagggctcctttcaccgagaatgactgccctgcccttctgcagttggcacacgcacaactcggtcatgatcaaaatccacactggaattgtggccctcagtccaacctctcccatttgttagttccttttcatgtttattactacaatttatataaacattgaatataaacaatgatgcactgatttcctcctgaagtaagtttcaagctactg

SEQ ID NO: 27926 - DNA, 581 bp, Sorghum bicolor
  Clone ID: 7219585
tgctggtagattgccatagagtgaattgtgggacaggttgaggtgcagcaaccctgtaagattgctgagagatggtgggatcctcccttggagccctttagaagacagcgagactcctgtgaccatgccatcgaagctgcaggtaattccttcccatctgcagcaatctgtgctgttggcccatgagacactgaggcttcccttgccctcctgtgagagcccatctcggaagtcaatgagggagctcttctcttgctccgtgcaagagctggcgagagaggcacaggagaggaggacgaaggcaagaccaaagaaaggtacaggtaatttggaggtgctactgttgcttcttggcaaattcactgactgcatgattctctcatgaaactcacctgctgcagagatgcttgttaatgaaaacagagcagtcccgtgtgttgtatatatagatctaaagatctcaactgaaaagagaagaagaaaactgggcacttgttgatgatgtaaattgcataactctgcaaataaaaaaaatgcggaaagtcaaccgcacaaacttacagtagaatgttaagccctgg

SEQ ID NO: 27927 - DNA, 200 bp, Sorghum bicolor
  Clone ID: 7219588
ttagactggatccttagtaaggaactgaactaggggcggcattgcccgtatacgtgaaacgcacggccctgtgattcgtcttggggcgtgaaccggccatggctgcttgtaaagcccaataaggcctcgccccagcatgtacacatgcaaacacttgtgccatcttgatgccgaatgaagttttgctccggtccctagct

SEQ ID NO: 27928 - DNA, 650 bp, Sorghum bicolor
  unsure (1)..(650): unsure at all n locations
  Clone ID: 7219593
tattaaaatctcatggtatgttagtccttacaatttaacatgtcacccttatcgttcaattatatatctgttaaaaacaggaactcatatacacacaaccttttagattgttgtcacttttataactcagattgctgaattttttgtatgcaggcattcatgtgggtaaatcacaatgaggtggtgtgactttcttgacaactaactcaacatatagttcccctacttatttttatgttgcttactgccatggcatgactgagttttcaaactaacgcaacctcccagcaagacaagacaacacagaggtatacttattcaaggcttgatctccggttatgacaaagtgtaaccatccaaccacgttgcaactctcgaaggtaagatacctctccatttgttttagtactttcatgcttccggcttgatccggttgaggagcgcaatcattagcaccaggtctcctcggcaacaagcctggtgcacaccatcaagcatactttttcattttctgtagaaccgcatatactatattaatgctctttatttccaatgtgtaataacatatgtaacatatatacttatgtacatatttgcatactattcttaattattttcaatccacanaattaaatgtattttgctttttt

SEQ ID NO: 27929 - DNA, 527 bp, Sorghum bicolor
  Clone ID: 7219599
tgtagccttgacacttttcatcccttggattttttttatttgctttctttgtttgggactaaaccgaaaacccccattttcaacataccgtcaaccgggagaaacccccgggtgcatgggacttccaccatacatgagtttgtagcgctagagataccatttccttgttctcctctcctctcaacatctcaacaaaccgatacccaccttcacctttcgacatcatgttctcttccgcttcacgcctcatcgcacagctcgctctgtgatgtggcacgttgtatcattttaagaagctacttttggtatctctctcctttgttatcctgcttgggtgcattgcaaactgcatatggaaggggttgaattgaaatttgggatgattcaaactgaaatctgacatgatggaaagggcgttagttctagtgtttttgcgcgatcttcgattcgagcaagggatgattagatagtcaagactcgtatctgcgatgacggctgcatggccgcctgagtagatttaccccctc

SEQ ID NO: 27930 - DNA, 614 bp, Sorghum bicolor
  Clone ID: 7219602
tactttatagcaaacaaagaattgatgatgctttgaattcccctcgtgaaaaagtttgctcgtgctgtgggcagcattttaagcaacggactgtagctttgtcctctagaaagactgcagagctagagcctactggagcattcggctcaccagaaatttacacagagtattctgtagtatgtcaagtggacgagcctttggagcctaaagatatataccaccaaactgactacaggtctaatgagcgagatgatctgctacagatgacatctgactctgagattgaggtcccttgtgccaatgatgtgaaaagttcacaatctcgtgaagccagtgttgtggacgaagacttacaagaagatgcagcttgtgagcaacccgttcttccttcccctgtggtgatcaaggaatctgaaataattgtcaagaaggagcccagtgttgaagacacctgcaatacatctttggcgtgtcctgctgtggatgatcatccaaatagcggaggtgatgtggaccggacggaagaaaaagaaagcctatccagaaaattggcatcccggcatgatcctgtacttgttatagaaaattcaggtttagaaggtaaattttgcttc

SEQ ID NO: 27931 - DNA, 283 bp, Sorghum bicolor
  Clone ID: 7219605
acgccaagcgtggtcgcgctttcgtctgagcgttcgcatcgcttttggctagtcgacgacaagaatcaagcacatggacactttcataacgcaggatatcacaaaccacaatggcagcaaccttcacctttcttcttccggcctgctagacagtacacaggaccatttttctctctcttccctctctcctctcctctccgctctgtggtatagggagtctcagtacgtacgttacggcgctggggggtgtatgatacggtttgccgcatcaaccccctcggca

SEQ ID NO: 27932 - DNA, 612 bp, Sorghum bicolor
  Clone ID: 7219609
cccttgctccagggtgtgcgtctcacagccatctttgactcatgccattccgccaccgtcatggatcttccatacgtttactcaaccaagggtgttctcaaggaaccaaacctggccaaggaagctgcatcaggactctttgacgccttcagcgcatactctagaggagatctcgctggggctgctagttcagtgttcgcgctggccaagtctgctatgaccggcgatgaggtttatgagtacaacaagcaaacccgaacatcgcctgctgacgttgttatgttctccggaagcaaagatgaccagacatcggccgatgccaccatcaacgcacaagctactggtgccatgtcatgggcgtttatttcagcactcaaggcgaaccctcagcagagttatgttgagttgctgaacagcgtccgtgatattctcgaagagaagtatacccagaagccacagctctcgagtagtcaccccattgacaccgacctcttgtttgttatgtgaggtagaggaggtgaagccatgtttgggctatatgtaattatgtaccggacggttatgagccggcgcatctgcagtttcaatggcatactgcatgattgatgaacg

SEQ ID NO: 27933 - DNA, 602 bp, Sorghum bicolor
  Clone ID: 7219610
caaaccatcaacgttggtggcaaggatgatgtctctgctgtgaagaagtcagggtgctgttcatcctaaatcacttatgcccatgaaaaggagccatatactcagccgatcttatgattggtaactgaaaatatgactctctctaacctggtggttatgagattatgttggtactccagagaaatgatctagaggttaagaatttgattccaagttgggacaaaaactaacttttcaccgtgtcattggtattcatggtttctttttggttcatatgcactacactgttccacactaattgacattagaatcctccccacacctcactgcgtaacgtaccctgctaaaagtgttgtaattggagctactgatgtttttcttactgggagcaaagagttttacgttgtctttaatgtaacgaggggttatgttccactcggtaaatgcccatctgtcattggtaggcagcaagtgttttagagggttatatcatgtaattctctcagatgtacaaaatttggattgaaggtttatgttctgcaccaggctatttattgtcatgttcatacatgtctatatttactgttcatgatggttaagct

SEQ ID NO: 27934 - DNA, 585 bp, Sorghum bicolor
  Clone ID: 7219611
acaggcacaaacgccggcgtcgctattgccaggcggcacctcggcccagtttggccaaacagtgtctagtttggctgagagccatggcacttggagtggcattactccctctgtcaacacctcgccccctggacctgccggggaagggccagttgacggatcagccgcagcagaaaatcgacgacaacggcgtcgactcgaaaggagacgtgcaagcggacctactgcagaaccacctgccactaccaatgtcgacatgtttgactaaaagaccgtggatcgagagtttggtgtctctcgtttgtctgtcggtttcaagctgactggtgaacgatcggtcggtgaaaaagatatgcatctagcatgggcggcgttcttggagggagatttatgaatttcgtaacggcacgtcacgtcacatcgatttcaatgtttgcagatagacttggaggacgatactgatgtcaatgaacgaattgattggcttgagaatgataacttgatatatggcaactttcttagtactagagtttggagggatccacaaaggattgacgataatgaattcagaattgcgcttctctc

SEQ ID NO: 27935 - DNA, 605 bp, Sorghum bicolor
  Clone ID: 7219624
ggtcaacatgctttggttggattccacctacccaacaaacgccactgcttccacccctggcgccaagcgaggaagctgctctaccagctctggtgttcccgcccaagtcgaagctcagtctcccaactccaaggttatctactctaacatccgcttcggacccattggcagcactggcggcaacactggcagcaaccctcccggcacttcgaccactcgggcacccccgtccagcactggaagctcccccaccgccacccagactcactacggccagtgtggtggaactggctggaccggacctaccagatgcgctagcggcttcacttgccaggttctgaacccattctactctcagtgcctgtaaggtgctttggtggcggcttgagatgttaggttgtagatggattgtctcatcttcaactagatgtaggatttatttttattgtatctacttctgatgctagcaaagacggtcatttgatttggaactatggctgtttggtgttgcgatgaatgcttagctgctgggcaaaactggctttcgcaaagcatattgaccccttgctataaaagcattatatagaaagaacatggaactcttt

SEQ ID NO: 27936 - DNA, 618 bp, Sorghum bicolor
  Clone ID: 7219626
ccttagagctacccttacccgaagatatttcgctcaatctgcatttatttcatgataccatggaagatcaacggtttcaaaagagtcagaagcagttgtacttgcttgaaattacgccgtatattgctcacgaagattccccgaaaggcttgcttcttattccatatgacatgcacccaaatgggacgcagatattctggcgatgtgggatattcgaatgtttaaggcgatcagaattcacaagaacgtgttttgatggatgtactgataccaatgtggacatcttatagcacagatcacagatcttccttatcaaactttcaagtcctggcttccagaacgcgctggtcagtttatatgaattggagtctcagcaggttcgcggagacagatgctaatacaattgctggtcaaaaaggtatgaaaccggcctgaagaatacagataaaaagactacatctgaagtaaacaaaactgtgattttctgtttaatggtttcaataatcttttacaattagcctagaagcatataactatatactaggtctatatttgggataccattaataatgtctcccatctataactataggaccatgaaaatagattttcctatct

SEQ ID NO: 27937 - DNA, 667 bp, Sorghum bicolor
  Clone ID: 7219627
gccacaatgccacccacgttctgcccctgcaggatttctaccgcgacgccgccaacggcaatctcccgcagttcacgtggatcaaccccgagtgctgctcgtaccagtccttccaccccgcgtctcccattgacgaaggcgaaaagtttgtcaagggcatctaccaggcgctgcgcaactcgccccagtgggacaacaccctcttcatcctgacctttgacgagcacggcggctttgcggatcacgtgccgcccccggtcggagtccctgccggcgacaacttgacatataccgagaaggccgccgacggcaagcccatcacatttggctttgaccgcctcggcctgcgcgtgccgacgctgctcatctcgccttgggtccgcaaggggtctctgcagcaccgcggcatcaacaacggcgagcagtacacgcacacatccatcctcggcttcgtggctgagctgtggaacctacccaagctgacgccccgtgtcgagtggagcgccacctttgagcatgtgattgagtctcagccgcgcgacgacaaggatgtcatccgcgacctgcctgacccagcgcacttctaggagccttgggaaccaagtgatgcgtagagatggagtttagataaagtcaatgacgaataataatgaactattttacctct

SEQ ID NO: 27938 - DNA, 240 bp, Sorghum bicolor
  Clone ID: 7219637
ctatcggacttggatatcaacattaacaactcatgacaagtttgagcatgttttacaaggatggattcggctttaaaggcttgggcagccctgtattgagtttttaattgttgcagatccattatgccggcatggaaaaaaaaactggtgtcctttacacatttttgtttggtaccccaattaaatcatttaatttgaccattatatgcccattgctaaaaaaaaaagcgcccgaacttg

SEQ ID NO: 27939 - DNA, 187 bp, Sorghum bicolor
  Clone ID: 7219644
ggtttggccagtgaccccgaccaggcccccatcctcaaggtgaaggagatcaagaacggccggctccccatgttttccatgttcccctttttcatccaggcctaggtccccggggaaggccccgttgaaaacctcgccaagcccctcagggcccccttgggcaacaacctgttccccgtcatttccg

SEQ ID NO: 27940 - DNA, 688 bp, Sorghum bicolor
  Clone ID: 7219654
tgcttcatgcaaggatctgaatttgctgcgtaaaagactctctggcctcagtttgggatacgcctcgacatttatgttgaaggacggaaattacgttttctgcgccgatgacggaaccgttgtcttaccggaagcgtgggagtctctacgccgtccaggcatgactttgaagattcaaagtcccagtgtcccaacaccaccaggctggccagtaggcggcccaacgaccttgaaccgtccgggtatgatgccacctcatatcactcgtcccttgaatgttggacctgcaagcaccactacttctgacagttcatcaacacattcttctgcttctccgactatgaaacacgttcacagcgagatggaggggctgcttcagctttccgactcttggtgtcctgacccggatacaatgagcgctggcctgggcagacttcttggtttgtggactaatgctcttgatccgcatgtcgacgtgacagaagattcagattcaggatcagtgtggagttgttcgtcgacgggggattctgactatagcaaccgcagtatatgcgactaggggtgaggacgtattgctgatggaggaatgggaaggattggtttaaattgaaacacaatgggttcatgtaatctcgctgcagataactctcctaccactgatactaaattggataactactatttc

SEQ ID NO: 27941 - DNA, 307 bp, Sorghum bicolor
  Clone ID: 7219655
tcaaggggtcatcctcgtcgctgtcaacgaaaagcccttccagcaagctgctgagtacgtccgcccacccggtaccgtcatttgcattggtctcccccccggtgcttacctcagggcccccgtttttgagactgttatcaaaatgatcaggatccagggtttgtacgttggcaaccccaaggacagctcaaaggctattgagttcttcccccgcggcttgatcaaggctccctacaaaattgtgggattgtttgagctgcaaatggtgtacgacaaaatgccccagggccccgttgttggacaaaat

SEQ ID NO: 27942 - DNA, 524 bp, Sorghum bicolor
  Clone ID: 7219665
cacaatacctgcttgaatgggcctggaagctatatgaaactgacaacttaatggccttgctggatgagtcactagatcctgaagaatatagaccggatgaggtaaaaaggataatggacatagcccttctctgcactcaatcagctgttgctgcaaggccaatgatgtcagaagtggttgtgatgttgttgacaaaaaatgatccagagatccagcccacaaggcccacttttattgatgcaacaagtagagtgcgaggcgaaacatcctcctccagttcatcttctgcctcgaaggcgaccatatcagtttctcagttctcggccaggtaaaaagcactgtatgtgactttccctcttttttctgtagtaacaacatttgtaatctgtatatgtacatataggatatatctatatagcagggagtgactgattacttctcagcatatatatgacagcagtgtaaatcatttgaaactccccttttgttcttgtactatgtaatgtggttcacatgcatgtttt

SEQ ID NO: 27943 - DNA, 219 bp, Sorghum bicolor
  Clone ID: 7219673
caacgacccagtcaaccccattgcgctcgagcctggtagtgctatcgcgggtatgccggtgcttcatgcgtggaagagcaagcaggtcttcttcatgaagggtggttttttgtcaggatacgcaaatgtacccacccccatgttttacatgccgaatgcaaaaatgttattcggtgacgcgaaggactcatgtgatgcgatcaaacgtgggctggaggc

SEQ ID NO: 27944 - DNA, 568 bp, Sorghum bicolor
  Clone ID: 7219678
agtgtaccctcaaaggcgaagcgcatacgcaaggcccggatgcccaaggacttcgacccagacagaaaaatggatgcggaacgatggctgccgatgcgggatcgcagctattaccggccaagaggaaagaagggcaagaagcgagcagatggcttgacgcagggcggcgcggtcagcgaggataaggacaagggtagcccggcgcctcaggtacagaaagccggtggtgggggtaacaagaagaacaagaagaaagggaagaaatgaatcagtccccaaatgctcgcaatcatgcgggagaactagcgtggccgacaagcgaactatgtacaattttggaataaagtcaaaaaggtcgacatgtaaggggaaagcttcataagatacgatacgttttctcagtgaatatgctctgttgtgagtagagcagccataccggtgaggacccgtgtgttaggagcaaaactaaagatttatatacccgtcgaaacccatgaagatggacaccaaaacgccttctgctcgtgtgtacatattgaaccattctagatcccatgaaaatatagcg

SEQ ID NO: 27945 - DNA, 664 bp, Sorghum bicolor
  Clone ID: 7219683
aggagcttcgggatcgagaagatcctgaaattgttccactgctcccttcttgagaggttatttggcgacgagcgatcccgaacaaagtcctccaatctcgaggtctactacgcgcgagcacgaatcgcgcatctcgccaattgcattatcaccatgatgattcttgtgcttctcattgttccaatatataccctctaccaccttgtgaacgacgtatccacagatcgagcatacgcaatctgcatgggcatccttgtggttgcaacattggcattctctgcagtactgtcgctgttcactaaagcgaagcgccatgagattcttgctgcagctgcggcttactgtgcagtcctcgtcgtatttctaggcaacgtaggacccagcaatttgggtggtcgacaaccgcaaattccaatgtagtattattgtattttcctaaaacctctttaagtcgcgatttcttcagaagatgtcaaatttcgcattacctagatatggtaggatctgaaaggtgttttttcccatcgagattggagtcgaagattcgaggttcgaaaagtgtttcacaagagttacaatttttctacgctggtcataatatcctggtacctatcttccaatatagattacgagaaacgttctcgcaaaactacatagattcccg

SEQ ID NO: 27946 - DNA, 689 bp, Sorghum bicolor
  Clone ID: 7219684
ttcgagtagaattattacacagttccagtacacatcgtggcctgatcatgggcttccagtaagcactacagcctttcttgaattagttagaatggttgataaactaaaaaagacggcaccagtcatcgtccactgttcagctggaattggaagatctggcaccttctgcactgtacatagcacaattacaaaatataggcatgatttatctacaaaacctgatgtaccaccaacttttgacatacttcacactgttatttatatgcgccaacaacgacctggaatggtccaaacaaaagagcaatacatgttctgttatttgtcaatagatgaagaggcgtcgcaagttacacgcaagtttaaccctctaggcagagctgccttaagttattcccactgatttgctccctcctctacatccccttcttcctctccctctccttctcttcctacttcttctcctgcacattataaactttctttttcatcaacatcccttactcctttcccttaccttcacctcccacattatttcacttcattctcattttattcttcacctattacctgacttataggtactcttttgctctagtagtaattaattgtaatttatttatttagactaaataagaaaaataacaaaagctaaaatatatatatatattttaaaataaaataaaaatttt

SEQ ID NO: 27947 - DNA, 580 bp, Sorghum bicolor
  Clone ID: 7219690
caaccgcgacattgagatcgatctacccaatcagttaatcaagaatgctgacggagagaccatctgctcattcgaggttgaggagttccgcaagcactgcctggtcaatggtctcgacgacattggtctgaccatgcagcaggaggacaagattgccgagttcgagcgacgcatgacacaaaacaccccatggctcgacggcacaggttacctgaagcgccccgggcagggtgggaagctggccgctaaggctgtgcctgttcccaaaacaaatcggggcgaggagaagaaggagcccctcgagtggtgattcggaccgagagatgagggaatggagaaattatttaacggcgaagggatttgggttactaacatatgatgattagcatgtggtttttgtggtttcaaatatttgctggggttgatggacaaaaaggattgctggctttgctcccactgaatgcagaagcactgaaaaatttggagcagatgtcaactcgtagctcctgaggagatttatgaatcaaaacgatcataattaatagcaacagattgaaacgaaaacttttttatacgatgt

SEQ ID NO: 27948 - DNA, 540 bp, Sorghum bicolor
  Clone ID: 7219697
tccgtgtcaccgtcaagttgaccatccaaaaccgtcaagccgctgtttccgtcgttccctccgcttcttcccttgtcatcaaggccctcaaggagcctcctcgggaccgcaagaaggagaagaacatcaagcacaccaagagcattcctcttgatgagatcatcaacattgctcgcaccatgcgcttcaagtccatggccaaggacctgaagggtaccgtcctcgagatcctcggaactgccttcagcactggctgcaaggttgacggccgcagccccaaggacatctctgacgacatcaaggctggcgagattgagattcctgaggagtaaacgtttgcgcagtatgctcaacaattacgatgaatgacatatgccatagagggcgctacatagctgaatgaggatcatgtctctaacctcgaggttgccgtttcggaactgggggggtttgcacagctacggcgtttgggatgtttgataccatactataaaagtgactctggcatacggcaatgatatgatcaatcttgccactctg

SEQ ID NO: 27949 - DNA, 528 bp, Sorghum bicolor
  Clone ID: 7219699
tgctgcctgatgcacccaataaggagcactacaacagcgccggcatcatccaagcctgcaagctgctggacgagctcgtagttctcgaccccgacgactttcagctcatagaatggctcttcctcaccgacacgatcgacgccgtatacaaaccagcgtcgccgcccgctctccaatcttttactgacgagatcaacgaggtccttacccaaacttcatcagcgcctttaatcacccccacagttcaggatacgacgcgcgacggcgagccggtacggagccttttcttggaccctctgatcaaggcgctggaggaagaggagggcgcgccggtgctcgatatggcaagaggcgagttgatagatagggtcgtcaggccctttttgggaaatctggccatggtcgcgtttgaagcaaggtatggagggggtgaggcggattggaagggggtgtgggaaagcgtggtcagagacgctgctacctagactcggtattagctagaatttgtcaatgctgttttttgagttg

SEQ ID NO: 27950 - DNA, 558 bp, Sorghum bicolor
  Clone ID: 7219701
ggctgagttcagtcaggggcaaattcaaggtggtggtggcggcatgccaatgagtgaactccgattcaatcttcctacagcagaactattcaagtctgctgaaggccgtgaggaagtcaagactcagctccaaggacatttcaacaagttactccgccgcgacgaacgaggcgatggttacgataacgacggcatggtttcgccgttcgatatcaatcttggaaaggagaaagccggcggtggcaaccgaggaaagagggccaagcttggcaaactcatcatctatcctgatggacttaagatgctcgatctactggtatctgcaaacatgggcctttggtggcaagcttgggagaagagtttttaggaaactcgtgaccatctaaaccaatttttgagatacctacatgatttctggagtttttgttttcatttttgtaaagctgatggtttgcatattggctatttacgtagagggagttgccgctaggattaagacgacgtaatgatcatatggaaacggctgagataccaaaacatagcaattggatgatatat

SEQ ID NO: 27951 - DNA, 629 bp, Sorghum bicolor
  unsure (1)..(629): unsure at all n locations
  Clone ID: 7219708
acccatcgagaacaagatgcagtggatggaactaaaagctgagtctcctgtgctagcatccaatcctccaaaaaggagaaatctgagcgcagattacagcgagaaggctcagcaaacgtttacaagttccacagttacagagaccgaatcttcagaatatgtatccttcccaattcatgacaactgtgcagtgcagattgaagtgatgtcacctgatgaacccaaagaccaaaatatcaaccaacagcaggatgaaggtgaacacctattggagcagagttcagaatatggaaagcgtggagtcacaagcctgtctcattggctgaagccatcttctgcagatgatgagagcaagtgcagccctgatgatggcaacgttgggaaggagacatggtatgagacgagcgtctctgatgtgcctatctttcctgcatttggtttcaactgggaaaccgacaacccaactcctgtgttgcccaaggcatgggacggcaacggcatcccaaataccactaccaaatacaaagaggaccagaaagtcagctggcatgccacgccatttgaagaaaggctgttgaaggttttgtccgacgagaaacctcgccagaaaggaaaatcagcggaaagnt

SEQ ID NO: 27952 - DNA, 521 bp, Sorghum bicolor
  Clone ID: 7219709
agacagcgtccagtcatatgaaaaggcagggcttctccaggggaatccttgtcgcctcccctttctcattcgtgcgtggctgtagaacatattgaaccacatgtttgctcccgtttacgaagttcgcccacagaatgttaactttgtcctttatgttggctactatgttgctactaaagaaacccagagaagcagctccgaacttccgaagtagcaaacgaacgatggtgactcaacccgctgtcccttgtggtgcaggtgtacgtcgcttgaagctgtcttgtgttagattgtttttttgtacccgatagaggagtaggttatgtgttgtaatgattaaagtgttagattgtttttttgtaatcgatagaggagtaggttatgtgttgtgatgattaaagtgttagattgttttttgtaatcgatagaggagtaggttatgtgttgtaatgattaaagcagatcattacggccagtggtctcatatatgtttattatttctgcatgtgcagtttgaccag

SEQ ID NO: 27953 - DNA, 523 bp, Sorghum bicolor
  Clone ID: 7219713
ctccgttctcccccagtccgttgtcgttcggtgcggtgctgctagctcagcccccgagccacggctgcgcgagacgtctgattcgagcttgactgctgcccggagacggaccgaggagacctgcgccgcgcacgcctgcggggaacaacacgtggacgtcgggggtgagtggaactttgtctcgctggtgtgctgactgactagatcccggattgtcgggtggttattcgcttgggctggccgttggctccggtaatgggcggctgagtcaaggattcgccgacgacgagcaccggccccagtccttttgacgaccaacggactcgttttgttttcgccacccagacccgacttctcttttgcacgcccgcgcgccgcgcccgcggtcggcatcgatggcataatccgctttagctcggcaatttgtagactcgctgttgtttgtattacctgcattgcactctctcttacaccctctgtactaccgctctccgcgccttttgccaattacatgcacattagc

SEQ ID NO: 27954 - DNA, 623 bp, Sorghum bicolor
  Clone ID: 7219714
gcagcgatcttagtgtttctaacgtcgtttttcgaaagctgcacaagctgttgaccactcgccatcaaccaagtgcacaacacccagaaagtgcaggtaagagcaatattttcactgtgttgtcccagtacacagttattcttgatgctgaaccacaaattggaaagactggtgctgtgttgtctgctttggagatattgctaacaaagtatgttaacagacctcaagatatgcctcgtcaggtgcttcctccagctgttccacctccagctgtgtctcttcccgataatcagtatgattatggttttctgaaacattggaccaaagaactagctaagttgatcgacacacgtgggtttcttgctgttcaggaaaagtgggctcagattaacaatggaatgagtctgttcgaccaatatcacgaatcaatgagattagccgcatctacggtccttgcgtttgttcgctttggtacgtcagcagcaatttcctcatattgtgtgatgccagatccccctcgtcccatcacagttgtcgacgctggatgtggattgcatggtattgtgaccactctgcgtgcagatatttgtcgacaaacctggcatgtgattggcattgatttt

SEQ ID NO: 27955 - DNA, 177 bp, Sorghum bicolor
  Clone ID: 7219718
ttatggataaagtgaagcttgatgccattgagaaggttttagaccctttgttttcctattggaaaagcccgccccaggaaggtgaattttttggaagcttcccaacccgaacgggattcgacaaattgaaaaatgtggtgaacaagtgggcaaagtccccatcacccgcatgaagtt

SEQ ID NO: 27956 - DNA, 580 bp, Sorghum bicolor
  unsure (1)..(580): unsure at all n locations
  Clone ID: 7219729
tggagagaccatcgtcccccttttcagcaaggcctcgcctgccgttgatatccccaaggacaagtacgatgctctcgtgaaccgcgtccagttcggcggtgacgaggtcgtcaaggccaaggatggtgctggcagcgccactctatcaatggcttacgctggtttccgatttgccgagaaggttctccgtgctgtcaagggcgagaagggactcgttgagcccagctacgtctaccttcccggagttcctgacggtgaggccatcgccaaggagactggaaccgacttcttctctgttcccattgagctcggccccaatggtgctgagaaggccagaaacccactggagggcattaccgagcaggagaaggctcttctggccaaggccactgagggcctcaagggcaacatctccaagggtgtcagctttgtccacaaccctccccaaaagtgaatacccccaatttgatatcttccctaatacccagtaagaggcttccagagcaggcaaggacactcctgaggaggcccatagctatggcactagacatagtaatatgagtcatgagcgcgattgntg

SEQ ID NO: 27957 - DNA, 384 bp, Sorghum bicolor
  Clone ID: 7219730
acggcgtcgaggtgtggaacaggtcggacgacaggccgctccgcttcctgctcatcgccggcgagcccatcggggagcccgtcgcgcagctgggcccgttcgtcatgaacaccgaggaggagatcgacatgaccgtcaacgactttgagtgctacgccaatgggtttgagaaggccaggcactggaaatcgcaggcgatggtagcgcttggcgtagagtagggcgaaacacagaacacaggatgaagaaagaaaacgaatagactatcttcggttcttttttttcctcacgttaaccatcgttctattctagtttgttgcattcaattttaacccccaaacatgggtcgctttgtgtacatatttgcgataaattaattttatc

SEQ ID NO: 27958 - DNA, 560 bp, Sorghum bicolor
  Clone ID: 7219740
accttacactcaaggatgagatcacccgtatctgccttggtggttccggcaagctgccccagttcatcatgccctcgattgccgagcagatcgttgccggtggacctctccgccgccttactctcgccactgccgcctggttccgctacctccgcggtgttgacgagcagggccgcgacttccagctgtcctttgaccccaggaacgacgagcttcagcagattgcccgcgatgagggcaacccaatgaagctcctcagcatcaaggacctcttcggtgatgaccttcgcggcgatgagcgcttcgtcaaggaactcaccgaggcctacaacggtcttgagcgtgagggtgccatgaagatgatcgagaaggttgcatagacatgtgttattagcgattgagcgatttgaggttatagaacctagacttgggagatgataccacctaatattcggacacaaagcattagacggcgaactggcgcaaggaaaagtcatgaacactttagcgatagaaagcgttgcatcacgctagattctcaatttacttcttgaatcttc

SEQ ID NO: 27959 - DNA, 635 bp, Sorghum bicolor
  Clone ID: 7219742
acggccatggagcaaaaaacatctctccagagcacaggagtaactttggtgaacaatctgcaaggataagagataaattggatgtatcagtaaattataagttctgggggccaatgccttcaatcatcgtttggcgttgcttattcagtaccatctttcttggggattcagctccattacattcttcaaaggagctggaaaatatgattaaattgggatcatgtttacattcagaaatgctgtcattgtttctccgaaaacaaggttacctatcagaatctggaaatgctttagttgaacgaagacgcaggcagatctgcagccagatgattttggattgtcaatacatgctgaaattcattgaattatcaagatggacgcaagtgacataaaatattcaatcacaaatcttccataaaattcatgtcttacctgaccaaatttgctgtccagttcataccaactagccccggattcattttcagtgagaacagctatggttacagatccaataactttgcatttgcacaaagtgtcccaatcatatattgttatggttacctgtgcagaaagtagcaacacatgtcacatgttttatcacagcaattctggcatcaaatatttttttcgagttc

SEQ ID NO: 27960 - DNA, 556 bp, Sorghum bicolor
  unsure (1)..(556): unsure at all n locations
  Clone ID: 7219751
tcgcgctcttcaacgagaacatgaagcccgggccgacatcggagcgcagctacggcctcttcaagcccgacggaacgccggcgtacgagctctcctaccgcctcccgcaggacaacaccaccacctcctcctccggtggcagcgttaccggcggtggcggctaccatggccacggctacgggtcggacaacgccgggtactacagcatctcggccgctgccaaggcgacactgggttggtggacatggccacaggtagctgtggcagcacgtgtggctgtactggccatgccactgtgaccattggctgagatcaagtggtgcctgcctgggcatggtggacgggaagcctctggctttcgatagagtctggcagcgtatggtggagtcagtgaactgatgttgtagacaaactcattgatcgcggtgatctatctatcgctgttttttttttgtccttttttcncccatgttgtaaattgaggtgcccttgcaattggtggtaaacaaatgggctagacgattgtcattaatnttcgacaaccaatttttgtttc

SEQ ID NO: 27961 - DNA, 545 bp, Sorghum bicolor
  unsure (1)..(545): unsure at all n locations
  Clone ID: 7219766
ggacgcctcgccgagcgggacggcgttggcgcccgtggcggccgtcacggtgaagtcgtcgtagaggtagacgagcttcttgttggggttcttggccgtcagcgtcacgtcgatggcgtcgctcagcgcgggcgccgtggcggacgacgacaggctcagcttcgtcacgcgcgccacggtcagcgtgaacgccgggcggtgcgggcggtacaggaggtagaaggcgccgcccaccacggcggccaggaaggcgaggaggaggatgacgagcaccgtccagaagaagcagcagcagcagctgaacgggcaggaccgcccgccagtgcgccggcgcttcgcgggcgcctgctgtggccggtagatgggccgctggtactcttgggcgggccgcccgctccggcgccgttgccggccgctgccgctgccgggggctgcggggtgggcttgccgttggaagacattgctctgctctgctccgcgcgccgcaggggacggacgagtcncgcaccgcaggcggggcggggtggttcctggaagaattggaa

SEQ ID NO: 27962 - DNA, 431 bp, Sorghum bicolor
  Clone ID: 7219770
aagaagatgatgatcaggtactacgagcagccgaggacggtggttggctgcagtgcggtgagcttcttgacgtggacgacagggcggaggagttcatcaacatgttctacgagcagctcagggcgcagaactttgccgcggtttttcattactcgccatgattatatttgtggcgtacgtagccgcgcgtatagagtgatcttgatctggcgagatcgttgtgatgtggtttggaggagccttcacttctcgaggatgcggttgtgtgatgatctgtgcattttgatgtacggagagtgagtgtgacacaacgacgtatgtgttccatatatatgtgtcgtaattgagtaccaaccgggtgtaatgtattggtgcgcacgtacttttatatgttggtctatatgaacatatataaaaaaatatatgccccc

SEQ ID NO: 27963 - DNA, 520 bp, Sorghum bicolor
  Clone ID: 7219783
tggcagattaatgaagagattacggccatggagtacgaagtcattacgggaaggaaaagaccagctttacaccatcgtgtcggcggctgtagcacttgatctgcgcatgaagaaacaacgcgccgactatcgcttcgtcacatttacagggggccaacctaatcagttttggggctatggattttatgattccgaaatggaggacattgacgaaggcgaggagcgtaagggcaggagggtacagatgagtctggctcctgctcttgaaagatgcggcaacgccaatggccacatatttgaccagaactttattttggtgaaggcagacgtaacgtgcaagagactagacaagacgaggccacgcaccggtaagaagttgggcacgaagaagaacttctggagcagtcgcagttgacaagtttttcttttttattacatgtacaatttaatgcattgtgactctagtcacgatcgcctataccacctactgttaattagcataccagttcccgtttcggtt

SEQ ID NO: 27964 - DNA, 141 bp, Sorghum bicolor
  Clone ID: 7219784
aacccctgagttttaaatttgcaaggacggggttacggcaaatttgcaatgtaacagtaaaagcttttatatttttcaacacgcccagcgatcatgaacccttttccaatttgtataaaacaaagcaaagtttaacttgtg

SEQ ID NO: 27965 - DNA, 450 bp, Sorghum bicolor
  Clone ID: 7219785
ggtattactcatgatcatctcttcctcatcatccaaggatttgttgtcatcagtcaagtcatcatcgtccagtacggtggtttggccttcaagacagctcccctctctctctctcaatggttgatcaccatcggtatcggctcactctatattccagcaggcaccttcatccgtcttttacctaaccgtctaccttgtttttggagtgagaacaatgatgatgaattcaaccacgaaatcagttattctcgtctttactgggaaagtgctgtacagcatgttatgaaggatgttcaaaacaagaaagccgttcatgaatacaagttttaactagtgttgaattagacttcccttcaacaaaaacttgttattatttatgtgtatattccctctttttttttttatccgcatatatatattcatatatttataaatatacttcgtttgatt

SEQ ID NO: 27966 - DNA, 281 bp, Sorghum bicolor
  Clone ID: 7219792
aatttgcccacattcacacaggatcaagtcacattatcaaatgatatgattgacttttggaacaactttgtatggagtggtcatgtgaattcaccagctgctacagtggactactggaaaccatacaacggaacatttgatacattaaacgttatcacaactcctcaagattatgccgatattggattttatgatgatatttgtgacttctgggataccattggctacaatcactggggttagaattttagagtaccttctgaactctacttattttttgt

SEQ ID NO: 27967 - DNA, 559 bp, Sorghum bicolor
  Clone ID: 7219796
ccaagtcattactatcggctggtttaccatgatcgttcgcgtcattatcaaggtcctgaagggaggcgatgctgaagatgtgcgaagtgacgatgagggtggcgaagaggaggaggaagaggagtttgtgtacgaagaggcacagcctctggaggaggaggttggcgtcgaagagctagacctccgaaactgggagcgacgatcaggcgttaagaaacaagccagcagctcaggagtgagcctccctggtcacagtgatcgaaaggagttgttaggtcgtattggctgcgagaagcaggtcgactagacgaggccacgcgttgggagttagtttaacggcattttttctcgttccgcatccgagtgatgctcgcatttttgaaccttttttctgcttttgtttatgtttgggcttgcatttatgggaagaagatgtcttgcccgctgttttgatcacaacgactggtagatgggagctaacgaaaaataaccgaggccaggaacctcgtagggtctgcattagagagctccgctaaagaatagacggccgccgttagag

SEQ ID NO: 27968 - DNA, 552 bp, Sorghum bicolor
  Clone ID: 7219797
gatgaaaattccaaatgggcgcacaactcaatttgttttagttactgcgggtgcaactcttccatttaacacacacggaatatcagagaatgaggattacaatgttaggttacgtgatctaatcgtattggtcatgagaactttccagaaaaaggctctagatgctaaaaggaaagggaaggcttagaatccatgtagatcttttacaaaagattctaggtagaaccatagaagattttcctatttttgattattttgtgcagtgttcgattcgataatttttgttcttgaggtggaatgagctcttaatagagcagaaatttcaagagttacctggtggaggtgtgagggactgtgggcacataaatggttagcggagcctaggattaattcttatcctactaggattaatagtaaattgtaggtttgtgtaattcttttttttcccttctcattgcttgctctaagttatgccatgtcactgcggtctttgtaaatttgaagcagccagtgctgcaaataaacctatgagatgttcaccgcagctgttgg

SEQ ID NO: 27969 - DNA, 602 bp, Sorghum bicolor
  Clone ID: 7219798
cttcagcaaaaacttacaattgctgtagaagagactatgggtttcggccaagagtaatcgataacggtattggtttcaacaggacagggatactgagctagagagattcaaactgcactgaatgtattatcgtgtagttatcggaaaacaacaacctctcttatctgtcctattcctctcgctcacatacacgaacttttgggtatttgttttggtcccaagagtggacagacctgggtagtttggcgctggtgggattaatctgccttcaacatgcgatgcaacacctacttccctctatcagctcagagtatagatgatggaacagaacttgggcgtcgccgtcactatagacgcaccttggtgaaccttgcgggagccttagcggacactgtggaattaccgggcatacgccaggacagacggtcctcggatgtgatgctgtttgacagacgaggaaaaaaagaaactgtacttagctatgtattacgtgcgatgccgacagtggcgacggagctggcgtgtttgggctggaagttaagaagaaggatagggttacagcgcttcattttcaattactttatcatatatatagcactttc

SEQ ID NO: 27970 - DNA, 449 bp, Sorghum bicolor
  Clone ID: 7219813
catacaggagtaagttggagacggttaagaaccttccaatggctattattgccaagacctacgagatgatattgggtcctcccagctctctcatccgcctaatcctcaaggtggcagctaagattgcttctggacaatggcgaggtctcgtgtatggatatggtgaggatggcgaagagataccggtgcagtgggattactctgagggagaattcagcgactggagtgatgatgaacatgaacatgatggcagtcataaacaagggaagcgagagcatcggcatagcagacaccgcagcaatgctcaagatatggcagtagaggatgagatgcgcaggcggccctcatcctctgacgatagccgaagctggggagttgattgaccgattaagtgtggtgtgcttagtacgtgttatgcttatgctgtatgatgctgaaaggtccgtatg

SEQ ID NO: 27971 - DNA, 187 bp, Sorghum bicolor
  Clone ID: 7219817
aataaactatcctttccgaacaaagtgcaatggtccccaatgtggagcagaaaagccttcccagccaaacaatgtaaatgattcagcgccagatcaggccaatcagtttttgtcatgtaacattacgaagcttttatcaaagctacgacttttgcatgaatttcaagacagcagtgagcagacagag

SEQ ID NO: 27972 - DNA, 542 bp, Sorghum bicolor
  Clone ID: 7219823
ttgcctccctccatgctgaaatcgagacacgccaggcagcttccggtgcaggaagcggtcaatccattggggcagcagctccttggtttaaggaggttccggcagcattgacggcaacctttgcctccgaagccgatgcgccaacattccagacggccatattgaggctgatcaaaaagcgtttctccaacttgatcctgatgccggctgatagaatcgacgaccgcacaccattacctgactttggtgtggatagcatgattgcgtccgaattcaggagttggttttggtccgccttcaaggttgacatacctttccttaatttgatgagcgcagagaaatccttggcgcttttggcagagctcgtggaggagaagattcccaaggcataggtcttggtttggttgcgctgagatcttccgattgttttcctgttttcctgcgatgaaaaattgtctttatctgtgtttttgcttttctctagtttggtgatttagagtatagattatcgatcaagctaaattgaataaagctttctgttt

SEQ ID NO: 27973 - DNA, 153 bp, Sorghum bicolor
  Clone ID: 7219837
tccgggtaagccccccggtactcagtttgtaaatggtgcttgtcctgggggtgccagtttcccgttgtaagctaagtttttgggtgtgccctgttttaggggtaagttattgtagcaaagcaggacagaccgaaaaagcaggcaagaaaccgt

SEQ ID NO: 27974 - DNA, 242 bp, Sorghum bicolor
  Clone ID: 7219841
tagagccaggataatccaagggtggttgagagcaggttcaatgtgtccctcccatgaccgttcagtggattgagtgggcaatcatcccagcagaatgggatcaatggagccagtggtagcaactcacaaggcagtggctcgcaatatggtggcccacccagcagcaagatttgatcaccaatcagatgaaggttcacttttgccgatctgttgaaaagtctatgcagtatttatgtgtcacc

SEQ ID NO: 27975 - DNA, 322 bp, Sorghum bicolor
  Clone ID: 7219845
ggaagcggtcctggagggcttagtcgtgttgtatacactatacactcttcagttgggagggatcaagaattttttgaaatatattgcgtaatcaatcggaaagcttgaaatcaaggtgctagatgtagaagtgttgcaatagcatcttagtattaatacaaagcgaagccaacgaagcatttttgtctaggcggttgtatttgttgcttcagtgctaacaggagaccatattgcttaagcatgcattaaaatgaagatttgcagtgaggactatatgaaaggtggaccagtagccattccgttcaggattttttgataaacc

SEQ ID NO: 27976 - DNA, 251 bp, Sorghum bicolor
  Clone ID: 7219847
gttgctggcgtcattggcgcccttgttactctcgttgtcattttgggtgtccaggctgcctttattttgctcggcggtttgcgtcttgtcaagaagtcgacgcttgtagctgctggcgcatctcaggccggagcagtcaaggcgtgaatatgaatcgatgggtagtgggaaagcaaatgtttttggtcagaatatgcatgacccatgcgatgttatgatttttcaccttcagataccggaatagccattat

SEQ ID NO: 27977 - DNA, 656 bp, Sorghum bicolor
  Clone ID: 7219848
tgcgacaaaacaacgtgcaggacccagacatcagcggtggccgtttcaggcgttcagtacgagaacatcaggggcaccttcacgatcaaacctgcccacttcgcgtgcagcgacagctcgcctgttcggagatcactctcactgggatacaactcaagcccctgctagtgccacagtaccacctgtacaaccccttctgctggcaggcatttggagagctctacacccccaccgtgccccccatatcttgcttgcagatcggcaagccagcagggaacagcgtgctgtctgacggtgacctttgctgaaacgccaatccaggaattagtgttactgcttgtgttcatcagttaaggcggtcgtcgtgattcttccgacccctttgcgtgatgctgtgtaactgtgcatagtgcatatatgcagctagtgtcaggaatcaggatgtggtttccatggcacaaaaccaactcccctctcctcttgataggaaaggtagtgtttgcacagtgtctccattttccagtgatgcatcctgtatggggatacttcagggtaagagtggcataggacgagtcgtctgtaaacaaataactacggagtaatagtaagtagcaaagcatgttcgtcttcaaaaaaaaaaaaaaaaatccgagggg

SEQ ID NO: 27978 - DNA, 603 bp, Sorghum bicolor
  Clone ID: 7219849
gagttcagcagcaacggcaacacctacagcgcgggcagctgctacgacggcggccactacagcaataggccgaacggcgccggcggcaacagcaacggcgccgtctcagcattcagcggtgccggcggcaataacagcaacggcgccggcggcgacaatggcgagtggtggtggcgggcgccgggcgccgccgcggccgacgacgaggtgcagcggcagcagcggcaggtcgtcggcttcgacgacgaagaggagctctgggcgaccctcggcgacatgctgtcggtgaacctggcctcgtagggcgagtgatcgcggaggcaggccagtcaccagtcactagcgccgatcgagcagccccggcccgccaggggggatggagcgaacgcgacgtggcgttggtggccggtggggtccggtgcacgcgcgagcactcaagagctccgctccgctcgatcggggcgcgggtgcgcggcgcagtgcggtgtggtgaagaggtctggtcggcgtcgttgaccttccccttgtgtatgattgattgccttgtaaacttttagccagagacatcatgaagcagcaacaacaacaacaaaaaaaagttcg

SEQ ID NO: 27979 - DNA, 559 bp, Sorghum bicolor
  Clone ID: 7219861
ttggtcaactgtcatgtctgtcatcactctagtcctcgctatggctggtcgtgaaagcctgttcgtcgtcttccagaactttgtcagtcttatgggatactgggtcatgctcatgatctgtatcgtcatggaggaacattggttcttccggggtcgccagggatttgattggactgcctgggaggataagaactatcttcccgttggtcttgctgctcttgcaagctttatcatcggttgggttggtgctattgtcggtatgtcccaggtttggtatgtcggtcccgtttccaaagctgcttccaatgcggatttgggaatgtggctgggttgcggattcgctattattgtcttccctgtcttgcgatactttgagctcaaggcttataagcgataaaggagacgtctgcacacggggtatttgaaagagataaaatttgtaactggattactctaaatctcataagtgtatcaacatcgagacagtcgctctgtattcagttcagctagaatctgaaatctgttgcagttgcccgactcaactggcgttcgaactgct

SEQ ID NO: 27980 - DNA, 556 bp, Sorghum bicolor
  unsure (1)..(556): unsure at all n locations
  Clone ID: 7219863
ccactctcatgcgcgccatcaacaacgagcaggttgagggtttccctaagcagagcgaggtcaagactgtcttcgtcgagcacgaccttgactccgctgatactgagatgaccaccatcgactggaccatgaagaagctcgaggaggctggtgtcaccaccacccaggctgatgtcgagaagcagctcatcgagttcggcttcactgagcagatgatcaagggtgagatcagcgccctttctggtggttggaagatgaagctcgctctgtgccgtgccgtcttcgaggctcctgatattctgcttcttgatgagcctaccaaccatttggatgtgaagaacgttaagtggctcgaggagtacctcatcaactctccttgcacttccatcatcgtctctcacgactctggtttcctcgacaacgtctgccagcacatcgtgcactacgagcgcttcaagctcaagcgctacaagggtaacctggctgccttcgtcgcccgcaacccctctgccaagtcttactacgagcttggtgaatccgagatggagttcacttn

SEQ ID NO: 27981 - DNA, 465 bp, Sorghum bicolor
  Clone ID: 7219869
aggagaaccttgagaagctcggctccaagcacgattggtctcacatccccagccagatcggcatgttcgcctacactggattgactgctgaggagatgactccccttgctgaggagttctccgtttacgctaccaaggatggccgtatctctgtcgccggtatcacttttgagaatgttggtcgtcttgctgaggccatctacaaggtcaagggttaaatacgaaatgactagggcataaaatgagaaggatgtgcacgcagtgatcacactgctttgacaggcaattttttggatgcaaaaatgacagctacgcccatgaaagctgttggggaagatggatttgaaaataccccgagtttagggtctaagtctagtatggacttggagaagtaatgacgagatgaagagaccctgaaaatacatgtacgagtaacttatagagaagacgttctatgcgtttgct

SEQ ID NO: 27982 - DNA, 683 bp, Sorghum bicolor
  unsure (1)..(683): unsure at all n locations
  Clone ID: 7219873
tgtcagtttgtgtgcatggaacttacagaaagaatcttgactcgattttgcaatctgggctaaagcgtatgacaaggttacatgtacatttctcaagtggcttaccgttagatggaggagtaattagtggtatacggcagaatgtaaacatcttgatacatttggatgttagtaaggcacttaaagatgggatgaagctttatatttcagacaacaaagtgatcttgacagaaggttttgatggcgtcgtccctgtgaaatactttgaaagaatcgaaacatggccaggacgagctccaataccgttccaaagataacagcccacggtggcagcaatgtagattcagcgttgctgcttcatacatactgaaaatttgatttgtcgtgctgtaatctcagcagttgcgtacagtgtttgctccgttatgtaattgatgatttctggactctgtaaaaagctgtggtacccagcatccagcagattctggtgtagtacatgtatggtcacagactgcacttgtcaaggcctctccaatctgaaagtgaggttctttcagacaagacgccttcgaaatcaaagagcactagtagtgcattatggtggtataccacgaacacaaagaactaaggtcaatagtggggttttaaaaaaaaaaaaaaaatctccgagggggggncccggt

SEQ ID NO: 27983 - DNA, 559 bp, Sorghum bicolor
  Clone ID: 7219875
tacagttgccactcaagagacagcctatgctcttttcgaagaagacaagctctgcctctgctccgagatcgccaccggcagcactgcagcggcggcgccagggagcaacgacagcccggagtcctacttcgccggtgcgtgctcgcctccgtcgtcgccagaggacgacggctgcggtggcgccgacgaccgcaccttcttcctcccggacgccctgctcgccacgggcgtggaggagagcctcgagcgcgctgccgaagaggacgatggcgctgggacgcagctcaacaactgggcatggttatggaacgatcagcagtattagggaatgcacgcatgatattattgcagtgcaaatttggtctcgagctttgctgatgttgatacggtgtattctgctaattggccaggtggttgatttatgcctccacattgttcactgacatttctcacatcagtaacgtttgaggtgtaaaatggccaaagctgggccggatatgtaactaaatggagaactaaattatttgaataaatgggccaaggcccttgttttgatctc

SEQ ID NO: 27984 - DNA, 187 bp, Sorghum bicolor
  Clone ID: 7219877
tttccttgccaaatccatgtaaaaggggtatcccaacccattgggcccccaaattgttttgggagattttttttgtatatcacgtcaaaaatgggcccttgggccttgggccgtggccttttgccccattacagttgcctagcacaattggtccaaaaaaagcagggtgttacattttaaaaattat

SEQ ID NO: 27985 - DNA, 616 bp, Sorghum bicolor
  unsure (1)..(616): unsure at all n locations
  Clone ID: 7219878
tgaacttgcaatcgcttcccatcagaacatcccaaagttggtacctgattatgcattaattgatggtatgatgcacccaaaagatgtgaatgcatcatcaactggttttcttgattctgtcttaagtgcaactaacctaggaggatcacaaggttctgaaggttcggtcatttctgtacagcttgctgagagttccaaaagtgtgagtgactatggggctgaggattacagtactactatggactgtggtggtgtgtacaaagagggaatcagtaaagtagattgcagccatgttttagatgatggatcgaggtccattttccatatagatcaagcatcacctttcttggagttggccagcagtggttcatcaacttctacggataatcaggatgtgctgaacggggagcttgttttgattgaagctcagtacaaacattttgttgatgagttgacaaggatgcgagaagaggctatggaaggagctcgaaaaaagtggttgccagataaatgacgattttgtttgaatttggcatttcttctaaacatcataactcataagctatgttcgatttcatgttcgaagtgtgagaaacgttaataatntgttttagtt

SEQ ID NO: 27986 - DNA, 508 bp, Sorghum bicolor
  Clone ID: 7534829
gcacgaggatccgatccagtgaaaattgctgttgagggtgtggagaggttcaagaaagaaaactgtgatctcatcattgtggatacaagtggaaggcacaaacaagaagcagcactctttgaagaaatgcggcaagtttcggaagcaacaaaaccagacttggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggagagcacattgatgagtttgaagtttttgatgtgaagccatttgttagtcgcttgttaggtatgggagattggtcaggctttatggacaagattcatgaagtggtacctacagatcaacagcctgagcttctgcagaaactgtctgaaggaagctttactctcagac

SEQ ID NO: 27987 - DNA, 558 bp, Sorghum bicolor
  Clone ID: 7534833
gcacgagggggcactctaccacactcactaccagcagccacctttgcacactccacacctgccagcttcatctctctcacttcttcacagcctctgccccttcagctcttccttcgacccaacaacacaacacaacacgcagcagagcgcagcaccccacattcaagtactagaggcagcagcgatggagagcagcagcacgccctacaccgcgttggcagtgtttgtcaacaaccagcaggtgttcaagctgccccccgacgagaagaagccaccactgccggacctggcactggcccccacgcgcctcgacgaagtggacctctacggcggcctggaggccgtcaaggagggcctcctgtcggtgctcgtcgtgggctgcctggccgtcgtcgacgccgtcgtcaacggcttcgccccgcccagcccggccagcaagagccgcggcctggacgaggaggagcacgacagccacggggtggacacgatgatgaacgagagctggatgccgtcgtggggcttgggcgacctgtcctactacagcgacgaggcgtccta

SEQ ID NO: 27988 - DNA, 522 bp, Sorghum bicolor
  Clone ID: 7534837
gcacgaggctggctgtcaccgctctcgagcacacctccagcttcgccaaggcttacgccaagggtatcaacaagaaggagtactggggttacacttttgaggactccatggacctcattgctaagctccgcgcggtgcttctcgcatctaccagaacgtcttcaagggcggaaaggtcgctcccatccagaaggacaaggattactctttcaacttcgccaaccagctcggcttcgccgacaacgccgacttcgtcgagctcatgcgtctctacctcaccatccacaccgatcacgagggtggtaacgtctctgcccacaccactcaccttgtcggcagtgctctcagctctcccttcctctctttggccgctggtctcaatggtctcgccggtcccctccacggtcttgctaaccaggaggtcctgaactggctcactgagttcaagaagtctgtcggtgacgatctcagcgacaaggccatcactgactacctctggtccaccctcaacgccggccgtgt

SEQ ID NO: 27989 - DNA, 477 bp, Sorghum bicolor
  Clone ID: 7534841
gcacgaggccgatgtcggcggtcaacccccacggcgttctttctctgctgaaagaaggcactcggcactacagcggcttgttcgaagccacggtgcgcaacatccaggcctgccgggccctgtcggaaacgacgcgcacgtcgctggggcccaacggcatgaacaagctgatcatcgacagccgcaacaagctcttcgtcaccagcgacgccgccacgatcctcaaggagctggaggtgattcacccggcggccaagatgatcgtcatggcgtccgaacgacaagaaaacgaatttggtgatggtaccaatttggttgttgccttttgtggcgagcttttgttgcaggcggagtctcttctgaccgccggtctgcatcccagcgagatcatcgccggctattccaaggcgggcgcccatctgcatcaagagctggaggcgcttgccgtccaccggatcgacgacctgcgcaacgtga

SEQ ID NO: 27990 - DNA, 456 bp, Sorghum bicolor
  Clone ID: 7534846
gcacgagggtcgtcttcaacgacgagtcttccgatgaatcacccgggccccggcaaccgtccgcctagctataccgcaaacttccctcctggtcaagctcctcttggccgtaccagtcctcttgctcagcagcccaaccgtactcctccaactcaaatggtcggcggtcctcctccgatcaacaccggagccccaatgggctaccctcccggaatggcgcccatgggtcaaggtcctcctccgatgggaggtcctcctggtttcggacaacaaccaccgcctccccaaggatatcctcctcccggtcccccaggtgctcctatgaaccagcagttccaacgaccaggccctgctgctgaagttgagggcgccagcaagagcaaggctcagctcattgttggaattgattttggtaccacattctcaggtgttgcttttgctttcgcgaccaacaac

SEQ ID NO: 27991 - DNA, 531 bp, Sorghum bicolor
  Clone ID: 7534855
gcacgaggtccaggtctagcctccaactctttctaccttcatttgttgatcgagaccctattaattgtttgtttcgttttgtcgcttccagtttcccctctccctacggaactgaattgtctcctttcgctccttcacatcaccaactaaagttacaacgcgaccgcagcatcgatacctaccttagcaacttaatttctgaacccgtcatgggcaacgacagctccattctcgccgatggctccgccatggccatgcccggcacctcattcaatcatacgctcttcgaaacagctttaccaccgctgccaacatttagtctagaggtccagcctgatctcttcccttgggtctccgacttttggctcaatttgttactccctgttgttgtgtactgggtcctgtccctgacgttccatgcaatcgacgtcaacgactggttcccccaatatcgactacacacgcccgaagaaatcaccaaacgcaaccacgtctcccgctttgaggtcgcccgcgatgttatcctgcagc

SEQ ID NO: 27992 - DNA, 494 bp, Sorghum bicolor
  Clone ID: 7534862
gcacgaggcaagttccggaccagaagaacacaccgcgagcgacgctgacgactgagatctcggcgcgcggaccggcccgaacaggcgacccaatcgccgcgcggatggcggcggccgccgctcagctgctgggcgaggacgggcgcggctacgagctcgcgcggcggctggaggcgtgcggcgcgtggcgcgagtggctgggcgacgattccgcgcacgccgcgctcgcgcagcacctcacgtccccagcaacctgggacgccttcctctaccccgcggcctccccatcaccgcccccgcgcccgctcctcctcctccagctccgcgtgcgcgcgctcctcttcgacaaggcatcggccgcgctcctcctgcctccccgcagcgcggccccagtcggcctccattccatcaacgctaactatctgcgacttcatggagatgatatttatttctctttggaagatgagcaggaagataatgctcaacatcaagtg

SEQ ID NO: 27993 - DNA, 563 bp, Sorghum bicolor
  Clone ID: 7534865
gcacgaggggtatatgtggcggtctacacgtctcattggcaagtagtgctcagactcctaccgaactgtgtcatcagatcaaagacagcaatcctagccatattctcgttcatcctgatttactccccgtcggcggtgaagctctcaagctgcttggtatcagtccaaaggatatgaagcatcgtattataatattggctcctgactcttccatccctgagtctatcctgtctcaggagtggatcacgatggaagctaccatgcatcacaaaagaccctatatgactgacaaacgagatggtctcgacgctgatgagacggctataatcttctattcatccggaacaactggtttgcctaagggagtggaattaagccattatgctctcatcgcggctactcagatgatgggggcctcaagcatgtatcaaatgaaatatcaacaagacatttgcataggcgtcgtccctctctatcatgtctatgggtctcttatgctcattttccatggccttgattctggtgtcccatcagtattattgcctaaatttgaaccggttaat

SEQ ID NO: 27994 - DNA, 528 bp, Sorghum bicolor
  Clone ID: 7534867
gcacgaggaaacaactcaaagcctgaataatgggggacgccaacggcggcagtatgcacgtcgtgctgctgccatggctggcgttcggccacatcctccccttcacggagctcgccaagcgcatagctcggcagggccaccgggtcacgctcttctccacgccaagaaacacccggcggttaatccgcatccctccagaactcgcggggcaaatccgcgtcgtggacatcgcactgccgcgcgtggagcgcctgccggaggacgccgaggcgagcatcgacctcccgtccgacgacctccgcccgtacctccgcgtagcctacgacgccgcctttgccgacaacctctcggccatcctgcaggagccggggccggagcggcccgactgggtggtcatcgactacgccgcgtactgggcgcccgcggccgcggcgaggcacggcgtgccgtgcgcgttcctgagcctgttcggcgccgcgacgctcagtttctatggcccccccgaggggctcatgggacgcggcaagt

SEQ ID NO: 27995 - DNA, 466 bp, Sorghum bicolor
  Clone ID: 7534871
gcacgaggtcgatgtttaggcaatgcagaatggtgtatgacatatcctgctactactatttaccaccttcctatgatgtatagcgaccatgctccaatccttgcggtttaaaattctaaacataatcgcactaacaaaccttttagatttgaaaactggtggttgatggaacaggactaccatgatgttgccaagcaaagctggaggaaatcctcctgtcgcaacttttctcaaaaaacaagatacctagttgctgaccttcgcaaatggagaagggctaagcctagaaactcagatttgcttgcacaaatagaaaatcaaattcttgatgagcaatcaaaaccaccagcacaacaagatcaaagtctccaacaacagctaaccgagcaacatcaagatctactaacaaaagaggagacctaccacattcaacgtgccaagaagaaatgggctacccaaggggaca

SEQ ID NO: 27996 - DNA, 477 bp, Sorghum bicolor
  Clone ID: 7534873
gcacgaggcagagttgttgtgttcgtttttttgtctattcttttttatccctcccccctttctcatctcttactctctccacaggcctggtgccatctaatcactacactaccgacgaccttttcccccaagcccccattttttttttagcaattattcaattctttgtggccggtccactccaacgtaatacgcagctctacttgctcgaaacgaacgaccaaaatcataccgacaacgtaacctcgcacccctcagcgagactctcgacatacacacactcaacctcctcagcaatcttgacgtctatccattagtttggtactggacgaattgaaagaaacgaaaaatatcatagtacaagtctttttacacagaaagaaagagatagaatcacaatggccgctatccagctcaactttactctccgcacttcctccaactgcaagacagtccaccttctcggttcctgggatg

SEQ ID NO: 27997 - DNA, 543 bp, Sorghum bicolor
  Clone ID: 7534874
gcacgaggtagattcgatgccgataacgataccaagctaccacctctgagttcacttacgagcgaaatggccatggaaccgaccaagacttggcctcctctacatcctatgccttatccgcctgtcctcacgcgtagtattgacagcccgacacgaatggatcttgatgggagtagcaacagtgtcagcgccgcttctcctgatgctcttcttgatgcgagggctggtagcgtcagccttgatgatccagatgtgcgactggcagccgaagcgctgggagatttgagagcagactttatatcttcaccaccgcatagaaattcctctcttccagttagtccacccacctcaggacttcaatcgaaccaaccacaatcgccgcagcccgaaccgcttctgtctctacttacgacgactcatccattgttggcgagtacaattgaaggcgctacttcggcgtatggtggcgccaagaacttttcaccgcgttttcgatctggcgccgaatatgtcgaaggatacctgacacctattgcgaatact

SEQ ID NO: 27998 - DNA, 497 bp, Sorghum bicolor
  Clone ID: 7534876
gcacgaggcttgggcatgctatggatgcctttgacagaatgcgagaagaagagattgagccggatgttgtcacatggaatactctcattgatgcacactgtaaaggagggcggcatgaccgtgctatggagctctttgaggagatgcgtgaaagcaattgcccaccaggcacgaccacatacaacatcatgataaatttactcggagagcaagaacgttgggagggtgtggaagcaatgctatcagagatgaaggagcagggactggtacccaacattatcacatatactactctcgtggatgtgtatggaaggtccggtagatacaaggaggccattgattgcattgaagcgatgaaagctgatggcctcaagccatcgcctactatgtaccatgccttagtcaatgcatatgctcaaaggggtttagcagaccatgcattaaatgtggtcaaggctatgaaagcagatggcctggaggttagcatcttagtgttg

SEQ ID NO: 27999 - DNA, 488 bp, Sorghum bicolor
  Clone ID: 7534880
gcacgaggcgaccactaaaacatttattgccttgaagagcttcgcggcgcgaacgtcgaggagcttccggcagcagaagggtacaccagcaaagcaaaggctcctgcttgcgtaggcgaggagcgtaaggaaaggaaagcaaaggcaagggaacgaccgagctgcagagagcgcggttgaggctgatcggctcatcgaccgatggcggtgaccgcgacgacggtcgcggcggcgaccacgatgctggcggccgtggcggcggtcttcctcaccctggtgctctgcttctacatcttcctctgcgccaagcggtaccgcggcggggcgccaccgccgccgccggcgcacgcgggagccggaggcgtcagggcgtggctgcgcaccgtgttcggcggcggcgggacacgcgcggacggcggcgccacggagtggtgctacgacggcggtctcgacgagaagtccatggcgaagctgccccggcgggaggt

SEQ ID NO: 28000 - DNA, 508 bp, Sorghum bicolor
  Clone ID: 7534896
gcacgagggagtacatggcgctgggcagcgtggagtcgcacctcttctcccgaacgtcgccgccgctcccctggtcgacgcggatgaagatcgcgctgggcgccgcccggggcctcgcgttcctccacgacgccgagccacgccccgtgatctaccgcgacttcaagacctccaacatcctgctcgacgccgacttcaacgccaagctctccgacttcggcctcgccaaggacgggcccgtcggggagcagtcgcacgtgtccacgcgcgtcatgggcacctacggctacgccgcgccggagtacatgatgacgggacacctcacggcgtccagcgacgtgtacagctacggcgtcgtcctgctcgagctgctcacgggccggcggtcgctggaccggtcgcgcccgccgagggagcaggcgctcaccgactgggcgctcccggcgctgccgcacaagaagcgcgtgcagggcatcgtggacccaaggctggcgggcggcgccggcgg

SEQ ID NO: 28001 - DNA, 619 bp, Sorghum bicolor
  unsure (1)..(619): unsure at all n locations
  Clone ID: 7534899
gcacgaggcattagttagtcatgtaaggatgatataaaccctttatctagatatggtttaggaattaggatccctctatcgtggctcacgtcaatcctgggccccacctctgtgttgtttagcaccttgttttagccaatgtgacaagatcctagtttcggctattattttgcttattctttgttaattattaattcattgtgaatttttgtttcaaatcaatggactctcttatttgttaatttttttgcagtaatatgagttttggattgacccctttcctcgcatattgcacatagcacctacttatgttgcaacatgaaatgcttgctagtctcctcattaattcctcacattcgtgtgtgatgcaaatgcactgagctctaatgctgtatatatctgaatggaagttgagcgtgcgtactgcttatgtgaataaattttgtatgacttgtctagattggtttctgtagaaatgccctatatcttatgccatgcaatgcctgcgctgtgttgcattacacaatgcatatgcatgtacttctgtatgatttctntatttcagaatgctcatatgtcacagatatagtgctgttatatatctaaatatactctgaat

SEQ ID NO: 28002 - DNA, 431 bp, Sorghum bicolor
  Clone ID: 7534902
gcacgaggctccacctctttttctctttgtattttttcatcactctaaaaaatgggaaaggacaagacccacgttaacgtcgtcgtcatcggccacgtcgattccggcaaatcgaccaccactggccaccttatctacaagtgcggtggtatcgacaagcgtaccatcgagaagttcgagaaggaggctgctgagctcggaaagggctccttcaagtatgcctgggtgctcgacaagctcaaggctgagcgtgagcgtggtatcaccatcgatatcgccctctggaagttcgagacccccaagtacatggtcaccgtcattgacgctcccggacaccgtgacttcatcaagaacatgatcaccggtacctcgcaggctgactgcgccatcctcatcatcgccggtggtaccggtgagttcgaggctggtat

SEQ ID NO: 28003 - DNA, 416 bp, Sorghum bicolor
  Clone ID: 7534904
gcacgaggcgcagtcccgcacggcggcgatggacggcggcggggtcgacacgggcacgacggcggcgtggatggagaagcaccggcagatgtacgagcgggccacccggcacccgttcaccgtctccatccgcgacggtaccgtcgacatgtctgccttcaagcgctggctgagccaggactatctgtttgtaagggaatttgttgcatttatagcaagtgtgttgcttaaatgctgcaagcaagaagacagctcggacatggaaattatcctgggtggagtagcttctatcagcgatgagatctcttggttcaagaatgaagctaccagatggggtgtcaatctagcaagtgtttctcccttaaaagccaatttagagtaccacaggtttctccagagctttactgagccagagg

SEQ ID NO: 28004 - DNA, 471 bp, Sorghum bicolor
  unsure (1)..(471): unsure at all n locations
  Clone ID: 7534905
gcacgagggttttctcttgctcgtctgctgctggacagtggatgctcgagacatgctatcgcttagagcgccatcagcagcgcatcagcagcgtttcagagacaagcgtgtcaacaatctggagatagctcgtctcattcgaatgatcgccagtctcaatcaagacgccaagcctactgtgccacttgaaaatgatcaaatatatcagattcttgctcagattccacaagtcggcaacgactctatatgtcttcagtccgagtcgtgcgctcagagctggatcgactactacaactacgctctaggaaagatctacgagaaatcggccgtacttgaatatcaattcgagacgaacatcaccgaggagaacggaaagctgaacgacgagtttgcgcccatttccaacaaatttctagccctgactaaattcacttcggccgagtttctcaaaaaactctcaagcctgngatc

SEQ ID NO: 28005 - DNA, 518 bp, Sorghum bicolor
  Clone ID: 7534910
gcacgagggttacttcaatgaacttctaaatagaagcctgatccagccagcagacatggatgacgatgagatgaatcctttttcttgccaggttcatgatatggtgctagatctcatttgctccttgtcaagagatgaatgttttgctgccacattaaatggtgactgcaaggaaatcacatcttctttgggaagcaaggctcggaggctctctatctataataccacttggcctactattaacatgtcaacattgaggtcgctcactatctgcagttatgctttaattaacagtatgccacccctttcaagcttttatcttctgcgtgtattggatcttgaagattgtaatcttagtgatcattcaagtatagagtttgttggtaaattacttcacatgaggtatctaagtctagcaggcactggatatgctggcgacatcccaagagagatagggaagctactgtttttgcagtcatttaggttcgatggaactgacataaaagtagtgccattga

SEQ ID NO: 28006 - DNA, 541 bp, Sorghum bicolor
  Clone ID: 7534912
gcacgagggccatcaactccatcgttgacagaagcccaccaattcaaaggaggtggcatctggctgtggagacaagtattataaaccaaccttttgcaggagataaagccacacttgctgggcaaaaacgcaagtgattagcaggtttagcattttgtcagttaaaataatcacataatgggcacctttcaggatgagggatatctgtggtccagtatcttctgtgtgccaccaaccacatacagaacctgcacttaccaggcgtccaggtcttccgaattctgtcccaaagcctgaaagtgactgcaccttgaaactcacctttattgaacacatgtccaaaataaatagttgcctgtgtgtctagctgcagggagtttaatcccacactggatagtgaaattgtgtaattctaggtttgcctttttgtatgaaacaaggacaaatgtccagggggcctggtacctatggataggcttgtccaaagttgggtttgggccataggatatatatggatctacggggcatgacatttgcacca

SEQ ID NO: 28007 - DNA, 480 bp, Sorghum bicolor
  unsure (1)..(480): unsure at all n locations
  Clone ID: 7534915
gcacgagggattgtgaaaccgcaggaattctctaatccgccgcctccaaattgaaatctctctctcccgggcttccggctcgccatctcctctccgctggaaaaccggccaccgccatggagacgagactcttcctcgccctccagtgcgtgcagtgcgccaccatgcaggtgaagcagcagaagaagagcagcaacaagtgggtctgcgtggtgtgcaaccagcgccagtccgtgctccacgtccacgcccggggctaccgcgctgccgatctccgccgcttcgtccaggacgccaaccttgcccgcggccgccgggagttcgcgccgttggccgagcccgacgtggactgggatccggcggcagttgaggaggagggagatgtgttccccttccccatcgagaagaggcagacggagtggtccgagtacctggacgatgcgggggagccgggtaatggttgtggtggcctgngcgccg

SEQ ID NO: 28008 - DNA, 464 bp, Sorghum bicolor
  Clone ID: 7534916
gcacgagggcgagccagggcgtcctcctgtccagctccctggtcggcggcgccaagggctccgcgtcatggccggagctgctcggctccgcgcactgggagggcctcctggaccctctcgacctcacgctccgccgcctcatcctgctctgcggcgacctctgccaggtcacctacgactccttcaactccgacccccactccaagtactccggcagctgccgctactccaggtccacgctcttcgctcgcacgctgttcccggccgccgccgacatctccccggccgcgtacctctacgcgacctcccagtcgtcgttcccgggcggcatcatggtgttctcgctctcccgcgaggcgtggagcaaggagtccaactggatcggctacgtctccgtgtccacggacgccgccgcggccgccacgggccagcgcgtcatctacgtggcgtggcgcggcaccatc

SEQ ID NO: 28009 - DNA, 537 bp, Sorghum bicolor
  Clone ID: 7534918
gcacgagggtcacacgaggactgctcttgaagcgctgcacaagaacattcatgtcttccgtcatcctgaccacttgcccacgggttacgacctgcagagggaattgggcaagtctattaaggctttgaccaacttcgatcttgccaaagcatctggagatgctatcaaggctgtctatggtactgctgatggtgttgtgctgtattgggcgcatcatgagaagctcctcgtcattgacaacggcaagattgggttcatgggaggactagatatgtgctttggaagatgggacacaaacagtcaccccatcgccgacgctcatcctggtaacttggatgccattatcttcccaggacaagactacaataatgctagggtctacgacttcgctgatgttaaggactgggatcaaaacaagctcgaccgaactaagagctcgagaatgggttggtcggatgttgctctgagcatgaacggacctatcattcgtgacatggtcgatcactttatcgaccgatggaacttcatcttcaaaga

SEQ ID NO: 28010 - DNA, 436 bp, Sorghum bicolor
  Clone ID: 7534919
gcacgaggcatgcgttgtttgtgttccatccatatcttcaaagaggttcagcccgaccgcttcgcgaataaccatgtgtcggctgctttggtcggtaacgagccactcagagcatatattgtcatgttcgcctttgacatatactcggcgtctgatcatctacctcgatcgctttttgacacgaaaacgggcccttctttcgacgtcatggatacagctttccaggcagcagtaaatacgcaaaaagcacgatgggactggctagaggaaaaggtcacggtgcaaaacttgcaggacggacgttgcggaacagacggaggacctagcagctatccaggtccttttgggtctgaactcgacaaggcagtgcaaggaaaatccgcgtctgacctggtagggcggcctgaactgcccattttcggactcgccatggttg

SEQ ID NO: 28011 - DNA, 412 bp, Sorghum bicolor
  Clone ID: 7534930
gcacgaggcccagccccaacccaatgctgctgccgcatcccagtcccttcgcgcagctccgcgccagctcctcctctccggccgcgcgcctccgcttccgccttccgttcctgtactctcctttcccatcgccgctcctctcctcgccatgtgcccgaccccgatggccgccgccgattcgcgccgacgcgtccggcgagccggtgctcggcggtcgccgcggcgtcttcggccccgactcgcttctctcggctgcggagctgctctgcctcgcgccgacggccatctgctcggtggtctgcgccgcgcgcctcgtcttcctgccggctagcgccagcgccgggtcgccgccgctgctggtcctgcagtacgtgctcttggtgggtgcggtggccatcgggagcctgatacg

SEQ ID NO: 28012 - DNA, 463 bp, Sorghum bicolor
  Clone ID: 7534931
gcacgaggccaaaatgagtcaccgcaagtacgaggctccccgtcacggctccctggcttatctgcctcggaagcgcgctgcccgccaccgcggaaaggtcaagtccttccccaaggatgacgccaagaagcccgtccacctgactgccgccatgggctacaaggccggtatgaccacgatcgttcgtgacctcgaccgacccggcgcgaaggcaaacaagaaggaagttgtggaggctgtttcgatcattgataccccccctatgatcgttgttggtcttgtgggctacatcgagactccccgtggtctgcgctccctcaccaccgtgtgggctgagcacttgtccgacgaggttaagcgacgattctacaagaactggtacaagagcaagaagaaggctttcaccaagtatgccaagaagcactccgacaacagcggctcttccatcacccgcgagctcgag

SEQ ID NO: 28013 - DNA, 429 bp, Sorghum bicolor
  Clone ID: 7534936
caactctcctgaccactctttcaagaacatcaccacatctctatcataccttcgctccaaccttcaacatgaagttctcaaccttcatcgcccctctcatctcaatccctctggtcttcgccagccccaaccccaacaacgaccactacccacctccccccaagacgaagaccgtgaccgcaacagtcacccacaccgtcacaaagcccatctacaagcccccggtaaccaagaccgagaccgtcaccaagaagtaccccgtcaccaagtacgagaccgagaccgtcacaaagtacaagtggaagccccccgtcaccaagaccgagtatgtcacaaagtggaagccccccgtgacaaagtacgtgaccaagaccgagaccgacaccgtcaccaagtggaagcctcccgtcaccaagtacgtcaccaaga

SEQ ID NO: 28014 - DNA, 513 bp, Sorghum bicolor
  Clone ID: 7534939
gcacgaggctcagccacacatcaacgcaattcctctggatcgctcttggtctcaactgtggttcaagtcttttttatctgggtcgctcttatcctggccatactgcaaaacacgctcgtcgtgctctgtatttttagccggccgtcgatgcaactcctctgcagctcctccgacgtacggccaccatgatcggtccaactcaaaagctcgatctgtttcagattggtctgtaattccactgaagagatagacacggcctgcttgattttaagttcaagtcttcattatccgggccgcgattatcttagccgaccatctgtactgcaaaacacgctggtcgtgctctgtttcttagctgaccatcgatgcaactcgtctgcagctcctcccacggccaccttgtttgatctgttcttacactgaagaaaaagcaaaacaagtgaggacataccaactggaacacactacaactttgcaggctatcagattaccagcacagtgattggttaatca

SEQ ID NO: 28015 - DNA, 150 bp, Sorghum bicolor
  Clone ID: 7534944
gcacgaggctccattttacagagtttgtagagactggaacagagtttatccatttttgtggagacctacctctatttttctttttcttggatgtcggttttggacctcccgcagcatggctgcgttatataggagtagttgccgaagttc

SEQ ID NO: 28016 - DNA, 315 bp, Sorghum bicolor
  Clone ID: 7534948
gcacgaggcttcgtacatcactggtattcgctacaagtgtgctgtctgccacgacaccgacttttgcgctgcttgtgaagccttgccaaccaacactcacaaccagacccacccattgatcaagttccgcactgcagtacgcaatgtgactgtcaacactctaggtgatgatggcttcggtggtcagaccatggtcatgggcgaccgcactcctccagctgtgagcagttttgccaatgtcccatcgtccaacaactctgtcgtcgaggcgccgtccgttgtggaaaaggtcgaacccgtagtgcccgaggcagt

SEQ ID NO: 28017 - DNA, 508 bp, Sorghum bicolor
  unsure (1)..(508): unsure at all n locations
  Clone ID: 7534950
gcacgagggcgctcctcaccaatcctcatggcgctcggcgccgctgtagtcgtaatggcacaggatggtagtgtcagcggccaaactaccagtgcggacgctgctggctactcgtgcgaccccaacaagtgcaagttgcccaactgccactgtgcgagcaccgatcctccaggcggtctctctccctctgacacccctcagttcatcatcttcactgctgatgatgctattcaatcgtacaccctcgacgccgtcaaccagttccttgctcagcgcaagaaccccaatggatgccagcccaaaatgacatactacacatcgctcggttacaccaactacacgttggtgactgactggtatgtcgctggtaatgaaattgccgaccacaccatgacccacgtcggtgaccctggcgaggatgagatcaatggtaacctgatcgctctcaatgaattggctggtattccgttggcatcattgaagggcttncgtgcacccttcctcacta

SEQ ID NO: 28018 - DNA, 531 bp, Sorghum bicolor
  Clone ID: 7534952
gcacgaggcccaaattgccccctcccctccaaggcttccacgtcgtcatgtctatttgaccgcgccgaccacttctgggtggtctcacatcccaattgcagctgtctttgcatcatcaacatccaattcttctaattcattacgaccatcaatctgccctgttcccatcttaccaacgcatgtggacaacctctcccacacaagccctccatcttcttgacgtgacgtagtcgcatcacttcctcaaccatgcctgaccctcgcgtcttcgtaattcgtcacggcgagacggaatggtcgctcaatggccgccacacaggcacgacggagctgcccctcaccgcaaatggtgagtcgcgtatccgtgccacgggaaaggcgcttgtaggaccagaccgtctcatcgtgcccggtaatctcgcacacatctacgtctcgccacggcaccgtgcccaacgcaccctcgagctactcgacctcggctgccgcgagcgttatccctgggaagcgaatgaccctgcagctgttgcg

SEQ ID NO: 28019 - DNA, 397 bp, Sorghum bicolor
  Clone ID: 7534953
gcacgaggctgaaccatatgtaatatacatttgcagcactatgttttctatgtagacgactgtttatggcatatgcaccatgtatgatatacatagccctatgtaacatatgtaagtcctctgtacctatgcatcaatgttgtataagtcttacgcatacaaaactaaaggtatcctcccttctcctctacctgttgtgtgacacagagcacccaaaccctagctttcgtcaaactctctggtatatagatgtgctttgtttttctttttcttaccaatttcctgatcaaagttgtgcctttgcttggttacatggatgaatggttatagttaattatcagctacttgggatgagtatcttttatatgttctgggtacaaacaaatggaattgttcc

SEQ ID NO: 28020 - DNA, 515 bp, Sorghum bicolor
  Clone ID: 7534960
gcacgaggccaaggttaaaaaaacgtggtctacaatcctgttcctttgcggattgacagccgctcagaacatcacgagtgacactacatcagaaatctggccacctacaaccccagcaccgacacatcctccaatccccattgcaagcgcaatacctctacctcccgagttctccgacataccaaaatcgattgtggaatgttgggactcactcatctcatatgatatcacccgcagctttctccaagctgaactgggaagaggacaggtgtatacatataccgaatatccaacacctgtaacgcaaacctatacttacgggtatccccttgaaagctgctcgacaaatttccctggactgaccacactttgtgacgggtatcctcgtgcagaggattgcagcgcagaatgtcagtacactggatacacctcgtggaccaaccaattcaccataagcggtactggaagctggctcactcctacgtggtctacggagctttcggagttgcctattc

SEQ ID NO: 28021 - DNA, 268 bp, Sorghum bicolor
  Clone ID: 7534961
gcacgaggcacacaagctttgagagtttgagttggccatgttcagttctcacctctaccagcagcagctcgtcagttgagacccagaggcgcggccagaggaatcaaggccctggacctaccaattataggttcctagtagttttgctgtcaacaacctaggaccatagatttactgaagctagcacctgaaagacatgaactgaattaattacttcagttgcggcactctggaaaacaggaccatggactggagagaacaagtgttg

SEQ ID NO: 28022 - DNA, 109 bp, Sorghum bicolor
  Clone ID: 7534969
ggagactatcgcgaatgctgtcaagttggtcattgaatttaaggagaccgggctcaaacctgaggtgtatagttatctcattgggttgactgccttggttaaagagcaa

SEQ ID NO: 28023 - DNA, 148 bp, Sorghum bicolor
  Clone ID: 7534975
cccatcgcagccgccgacattggatgcgaaatgggcccgacccatgggcagccgtcccgaggtggacgacacatatgcccagtatgttgcgggcctgaccatggactggagcaggctgggctacgtccatgtggtgcgcgaacatgta

SEQ ID NO: 28024 - DNA, 384 bp, Sorghum bicolor
  Clone ID: 7534977
gcacgagggatactgatggggtcatccaattgcagattgaaagccaagatattcctgggcttagcttcaaaacacatccaaatatcaacaaggatttgtttaacgggcagcaaattttgggagcaaaagatccaaacaggccctttccgagtggtcaaaatgaaactcctctggtgaaatggagaatccaggggatggacgagtcatctttacctctgtcagtcaattgctggccgtccgtatctggaaatgaaacctatgtgaacattgaatatgaagcttctgagatgtttgatctgcacaatgttgtcatatctatacctctgccagcacttcgggagcctccaagtgtcagacagatagatggagagtggaagttggact

SEQ ID NO: 28025 - DNA, 207 bp, Sorghum bicolor
  Clone ID: 7534978
ctgataccgatgctgtcattgactacgttgctgaaactgtgtgaagaagttgttgaagctgcctcatctgatgaatcctctgaaggctcttatgatgaatccgatgttgaaaccatcgaagaagtcgctgaaactgttgaagaagccaccggtctctccaacgaggaagtcatcgaagctgtcgctgaccaaactgggctcgatgtt

SEQ ID NO: 28026 - DNA, 503 bp, Sorghum bicolor
  Clone ID: 7534985
cgcaaacctcgagcctctgccgactttcacgacacaaaaatgcctcccaagttcgatcccaatgaggtcaaggtgatccacctccgcgccactggtggtgaggtcggtgcctcctctgctctcgcccctaagatcggtcctcttggtctgtcccccaagaaggtcggagaagacattgccaaggccactggcgactggaaaggcttgcgcgtgactgtcaagctcaccatccagaaccgtcaggccgccgtgtcggttgtgcccaccgcttcctccttgatcatcaaggctctcaaggagcctcctcgtgatcgcaagaaggagaagaacatcaagcacaacaagtctgtcagccttgacgagatcatcgagatcgcccgcaccatgcgatacaagtctttcgccaaggagctctctggtactgtcaaagagattctcggaaccgcctacagtgtgggctgccaggtcgacggcaagcctccccaggctatcatcgaggctat

SEQ ID NO: 28027 - DNA, 400 bp, Sorghum bicolor
  Clone ID: 7534989
gcacgaggggctcttcttcctcgtcgaatcgcgcgtatctctgctccacaaccttcttgattttctgaagctcgggcgggatctcgtctcgcctctgcctctgcctatcactatggcgccgcggggccaccacctggcggaggtggccctcctcgcctccgcctcggcggacctcgcagccacaggcgccggcgagagggaggggtggctggacgaccccgccgtcctcccgtcgctcgggccccgcgcgcgcgccctcgccgtagccagcgcggcgcggtccgtgctcgtgatcgtcccggtagtaggaggtggaggcggcggggtcacggtgaagcctgcgttggggcccgacgagggccgaatctccgccgttgagtgggtcccgctcgccggggag

SEQ ID NO: 28028 - DNA, 487 bp, Sorghum bicolor
  Clone ID: 7534991
gcacgagggcaaaggcagctacggcgtggtttgctctgccatggacactcatactggcgaaaaggtggctataaagaagataaacgacatcttcgagcacgtgtctgatgcgacgcggatacttcgggagatcaagctgcttaggctcctgcggcatccggatattgtggagataaagcatatcctgctccctccgtcgaggagggagttcagggatatatatgttgtttttgaactcatggagtctgatttgcaccaagttataaaggctaacgatgacttgaccccggagcattatcagtttttcttgtatcagctgcttcgaggattgaaatacatacatacagcaaatgtatttcatcgagatctcaaaccaaaaaatattctggcaaatgctgattgtaagcttaaaatatgcgactttggcctagcaagagtagctttcaatgatactccaactgccatcttttggacggattatgttgca

SEQ ID NO: 28029 - DNA, 327 bp, Sorghum bicolor
  Clone ID: 7534992
gcacgaggcgctggacgcgggtggccggggatctagatctctcacctccacctccaccaacgcgcgcgccccgcctcgtctccctccagtccaccaccaaacctagccagcttcccccgagtccacgccgccgtcgaccgccctgccccgaccgtcgcggcgtccgcactcccaccctgctgccggatcccctgcccctgccgtacggtctgcccacttccgccgcccgccggcgacggcctagctggggtcgagtggagatccaccaggacgctgttggcggcctcttcttcttctcgtgcgggtgttgtgattttgtcaagacct

SEQ ID NO: 28030 - DNA, 510 bp, Sorghum bicolor
  Clone ID: 7534993
gcacgaggcttgctctctccctcagccttcccactctcgactactcagcaggcaatccgacttgtcgtccacgaattaaactcgttatatcggcttggacagttctatccgccaactcggtctcttcatataccaggaaatcttccgccctccactagcctagctatcaccactacacacaaaccgccaagatgtttatggcaagatctgaatacgaccgaggcatcaacaccttctcccccgaaggtcgtctcttccaggtcgaatactctctcgaggccatcaagctcggctccacggccatcggcgtagccacatccgagggtatcatcctcggcgtcgagaagcgagtcacctcgaccctcctcgagacctcctccgtcgagaagatcgtcgagatcgaccgccacatcggctgcgccatgtcaggtctccaggccgatgcccgctccatggtcgagcacgcacgtgtcgagagccagtcccatgccttcaactacaacgagcccc

SEQ ID NO: 28031 - DNA, 355 bp, Sorghum bicolor
  Clone ID: 7535007
gcacgagggctgccgcaagacgttcaagcgtagcggcaccatgcaagctgagatggaggccggcggcagtaagctgttcttcgacttgttcgttgccatgtgcaaccacttggacgacgtcattgacgtcactaagaaccgttcgcccaagactgtgtaaatgggcagatcaaagaacaactttggcttttcgggacgggctgagtacaacgacagccgttggaaagcggaggataaaaaaacaaaaaacattaaaaaaaaactcaaaatgggaaatcggatcgatataagctggagcaagcatttggttgcgttgctttttcattgctttctttttctggtaccgctttttggt

SEQ ID NO: 28032 - DNA, 339 bp, Sorghum bicolor
  Clone ID: 7535017
gcacgaggctttaattcttcatcgccggtttcttcctatcgggtctcgttaatttgaggcggaactttaacttttcccgacactcatttacaaacgctcttgctactcgatccgattgcctctcttccggctcattcgtcgcgaactcgaggaaaaaggggggtcagcattccaacaacaatttgggcgttgaataaaatcatcgcttcattctagtcattcattactctctggtctttttacttgccggttgatacacaacacaatgaagttttccgctgccattggcgctgcagcggccacggctgccagcgccaagctggagcccatcaccatgag

SEQ ID NO: 28033 - DNA, 419 bp, Sorghum bicolor
  Clone ID: 7535019
gcacgaggcagataccccaattcgttttcacaaccatgtctgagactgtagtaaagctgtcgactccccagacgggcgagtacgaccagcccaccggcctcttcatcaacaacgagtttgtgaagagcggggacggcgagacctttgaggtgcatcaacccagccaccgaggagggcatctgccatggcgcagaggccaccgagaaggatggtgatatcgccgttgctgccgcacgcaagggcttcaatggccaatggaggaaggagacgccagagacccgtggaaagcttctcgtcaagctctccgagctctttgagaagaacgccgaccttctcgcctctgtcgaggcgctcgacaacggcaagggcttcaacatggccaggaacgtcgatctccctgccgccattggatgcttgag

SEQ ID NO: 28034 - DNA, 563 bp, Sorghum bicolor
  Clone ID: 7535109
ctttggtacagtacttcgactgtactctctgatctgacgtctatcgtgcgactggaataaaagttttcatcccatttttcactcttgccaattgtttctcccgccatggagttcagcttgtacccgggcgtagagcccctcgcattcttcgctggtgttctcagctacgttgcatatttttatcatggcgagcatcacatgtacgccgtgagttacatccaaattcacacaatccttcttgcaacttcgactttcctactatatcgactaggctccactgtagccgatgctttcctacagacactcacgtatgatggctttttcttggccggtctgttcggcagtctcctcacgtatcgtgccttcctgaacccgctcaatgtcttccctgggccttacatcgcccgcatcgccaccttttggatatcttttcgcatcaagagacttcgcatctacaagactctcgaagagctccatgacaagtatggatacttcgtgcgcattggcactcaggaagtatccatcacgcatccaaatgcggtagtggacattttcggacccaa

SEQ ID NO: 28035 - DNA, 524 bp, Sorghum bicolor
  Clone ID: 7535110
gcacgaggcggatgtacatacctaaggatcttttgcctgtacaagctctataaaacaccttgaggaaagttgaagaagtcctttcaaggtttgctaaacatggggtgcctctattggatccacaagaagatatgaaagtacaatcgaaatcatttctgaaagctaccagacgaatagaagctctggagagcttgtttgagaagcacgatatccgtaactctccacatatccagcaaaagctgaaagtctttcatgctaagcaagaactatcagccaaaataaagtccataaagaaaacaatgcgatcttccactgctttagctttcaaggatgaactcaaggcccggaaacgtgttcttcgcaggctgggatatgttacgagtgatgatgttgtggaagtgaagggcaaagtggcctgtgagataagttcagctgatgagcttacattgacggagcttatgtttagtggtgctctgaaagatgctacagtagagcagatggtggcactgctttcttgctttgtt

SEQ ID NO: 28036 - DNA, 435 bp, Sorghum bicolor
  Clone ID: 7535116
gcacgaggatccccccctgtctctcgtctctgactgcgatcgaagttggtgactgcgtgttcatggggaacacgccgtcgtgcatactgctggcggtggcggcgcccgccgcggggggtggcggccgcgcctcgtcgtcgtcgtcgtcgtcgtcggcggcggcggccaccaacaccaccaccaaggtgatccacgcggacggcaccgtgacgcggctggcgcgcccggtgcgcgcgtcggagctcatgctcgaccacccgggccagttcgtctgcgacgcccgccgcctcgcggtcggctgccgcgtccccggggtggccgccgacgagctcctccagccgcgccacgcctgctacttcctcctgcccatggacatgctctactccgtgctcacagacgacgagatggccgcgctctccgactcccacgccgaca

SEQ ID NO: 28037 - DNA, 424 bp, Sorghum bicolor
  Clone ID: 7535117
gcacgaggcttgcctcgagtctccggaccattaactcttttcttactgcagcctcgtgcaccatgacctcgacgggtgattccgccacggcggtcgactccaaccatgatttggagaaacgcggcgccgaaactgacggcagcgccaacgggtcggcgcccgccgcacccccgcctcgcaccgtcacaggcgtcctctgggcgctgctggtgtgcgccatgatgtcctgcatcttcctattcgccattgataacaccatcaccgccaatgtgcagattgccattgtgcacgagttcgacgccgttggtcggctgtcgtggatctctgtcgcctaccttctcagttcttctgctgtcaacctgttttggggccaggtctatggacgtttcgatgccaaatggatctacattctttgcgttgtcct

SEQ ID NO: 28038 - DNA, 412 bp, Sorghum bicolor
  Clone ID: 7535118
gcacgagggaggcttggtttcggattgttgaacaaggtatcaatgttgtttccacatgttttctggagtactgatcttgatacctttgggcatctggttgaagatccaaggcgacgtggggagttctttctgttctatagctatgcaacagtggctggtggtccattgttgatggccttggttgctggtgaagctgcccacaattttgaaaccacgccaccaactgatgctgtcagctcaattctccagatactaagaggtgtctatgaaccacaagggattgatgtgccagaccctctacagagtgtttgcactatatggggcactgactcgttcagtctaggttcatactctcatgtcgctgtgggggcctctggagatgactatgacatattacccgaaagtgttggtg

SEQ ID NO: 28039 - DNA, 466 bp, Sorghum bicolor
  Clone ID: 7535120
gcacgagggttccatgcgcccctcgtgaggtcaacattcctgctcaggtccgagattgcctcctccgcgtgccgtatggccccaaccctcctcacccctccaaacttgccgaagcgggacgcatcatatacgaattaatgaatgattccctgttggtgccctttttgcaatccgtcgctgcgcccatgcccgatagccatcatgacttccattttggatcgcccaaggcatcgtctgaccgaacagcttcaagcggcacggatctggacgttttgacggttgaaagcgatcccaattcacccgtcacggagcccatgacgccccctactacaccacccacctcggaatggaccttcaacacgtcgcccggtggctttcaccgtgcggtagcggcgcataacaaaggctggaagaaagtcggcgcaaagctgggcttcaatcgcaaaagctctagccggagaacaac

SEQ ID NO: 28040 - DNA, 471 bp, Sorghum bicolor
  Clone ID: 7535134
gcacgagggaacttctaccagggcagcagccgtcgatggcagagcactgatggcgctcagcagcagcagcagagctggttcaagcgtatgatggagagcgaggttggcttcaagactgtgcatttctgggctcctgtcatgaagtgggctcttgtccttgccggtatctccgacttcgctcgtcccgccgagaagctctctttcactcagaaccttgctctgacctgcaccggtatcatctggactcgatggtgcctcatcatcaagcccaagaactaccttctcgccgctgtcaacttcttcctcggaatggtcggcctcgtccagatcacccgaattctcagctacgagtccgcaaagaagaagagcctggagggtgtcgttgaggacatcaaggccgacgccaaggagaccatccaagaggccaagccttaaatgcaatcaagcatgggcgagttagacaattgtcga

SEQ ID NO: 28041 - DNA, 581 bp, Sorghum bicolor
  Clone ID: 7535135
gcacgagggcagagaggtggtcgtgcctgcctgccgctggtggcgcctctccgacgccggttgtgccttggccaagatccttgaccccggccactcctccccacctccggccacgatgttccatcctgaaagctcctcgctcatcctaggttggttccatggaggcttcacgaaatcaagggaatgctgggcgggtgcgcagcggcatcgtcatcggcggcggcggcggcagcggcggcgctggtgctgtcagtgaagcgacgagagagagggatacccaaggtgcaggcacaagcacaagtgtgaacccgacaagagctgcagcagcacggcctacacaagctaaccaaggtctctaccctgttcttcccagatttgttgccattctttgtgcaggagcagatgtgtagctctattactattttaggtgaattgttacggtcctgaaaccattcatggattagcagttgaaatatttgattgatgttcttttggtcttgctctgaaagccgtgatgctagtgcttcaatacatgatgcaacatgtaggcttggtagactgctttgctctgtatgcttaat

SEQ ID NO: 28042 - DNA, 518 bp, Sorghum bicolor
  Clone ID: 7535150
gcacgagggagcaatgcttcagcccattgtcctctacgatctcaatcgacagcttttggatggtgagaacgaggctgaaaggtgctggtcgcctaatactttcaaagccaggattccgctgaacatcaaaaacatacctttcactgtcgtatggctcaacttcgtcgacatcaaacctaccctctctgctctgggcgttgctcccaatctcccccatgaaaattccaatgagtatagctgccctgccatccatgatccaaacacaggaaaaaaagtcatggactcgcaaaaaatactcgcctaccttgaggagcagtattcagatacaccaacactcttcccaccacacacgcgcgcgctccaagtcgcgttcatcgatagtatcatcccacgtctgttcgacgcgttgccgggaacaatgatacttgacgttttgggccgactcgtcgacgtcgaccagccttacttccgcgctaaacgcgagcaagctgccggtactaaggtggaaaaccttgtgc

SEQ ID NO: 28043 - DNA, 517 bp, Sorghum bicolor
  Clone ID: 7535158
gcacgagggtcgttcaaagacttcgaagcgctcgtaagaatttgtcttaataatccataaaatgttttcccgactatcgattggcgttgcccaggcaggcagaacattttcgacatcgtcacagaaaaatgttaaagtggctgtctgcggagcctctggtggcattgggcaaccattatctctattattgaagcaaagtccattggttactcaattacatttgtatgacattgttcatacacctggtgtcgctgctgacctatctcacattgatactccagctgttgttcgtggtttcaatggaccagataatttggacgctgctttgaagggcgctgaagttgttatcatcccagctggtgtaccacgaaaaccgggcatgacccgtgacgatcttttcaacacaaatgctggtgttgttcgtgatatcgccgctgccatttctcgcaattgcccaaaggcattagtcggaatcatcacgaatcccgtcaactcgtgtgtaccaatcgcatcagag

SEQ ID NO: 28044 - DNA, 532 bp, Sorghum bicolor
  Clone ID: 7535176
gcacgaggtctccctccaccgtttgccgcaggaggaggacgggtgggcgatgcagctgctggccgtgacctgcctctccctggctgccaagatggaggagaccctcgtgccctccctcctggacctacaggcaagacaattaggacacactagtacttgccatgcatatgtgccactacggttacacgtttaatcccagttgagggcaccagcagatacgacttcgaccctgggacggtcggccggatggagctcatcgtcctgacggcgctcaactggcggctccggtcggttactcccttcaccttcatcgacttcttcgcgtgcaaggtcgatccgggagggaggcacaccaggtgtctaattgcccgggccacgcaagtgattctagctgcaatgcatgacatcgagttcttggaccactgcccgtcatcaatggcggcagcggccgtgctctgtgccaccggtgagacgccgtcgctggagtccgtcagccctgaggctgccgtcagctggtgcatcggccttgcag

SEQ ID NO: 28045 - DNA, 534 bp, Sorghum bicolor
  Clone ID: 7535177
gcacgagggacgacccatggccatagtccataatactcttgccagcttgttgcttgtccttgtagccgcgcaactccctactgttgctgcccatgtagcttctagttctggttctacctcctgcatacctcacgagagggaggccctgctggccttcaagagaggcatcatcagggatccttggggcaacctcacgttgtggcagcgaggtggcgaagactgctgtaagtggaacggtgtcgtgtgcagcaaccacaccggccatgtcctcaagcttcaacttggaagctgttctctggttggccagataagtcactctttgctttcactggagcatctagagcacctagatctgagcgggaatagtctcaatggctcatcggctggtcgtattccagagttcttgggctctatgaacagcctaaagtatctggacctgtctgatgtaccattttctggtagagtgccttctcagctcggcaacttgtcaaacctgcaatatcttcacctttcttcgtctacacaagacagttt

SEQ ID NO: 28046 - DNA, 516 bp, Sorghum bicolor
  Clone ID: 7535183
gcacgaggattaaaatattggcttttaacaacttgcatttttctgcagtttatctgtcaatctaacaatgtactgctcctgcctgcatctaaatcacaactgaatattgagttgcatgcaccaaccagttcaacccaaaagcttaagctgatggggagaggtggacaattcacttatattccaacactccccctcacgtggaggctccctcaggcctcagacgtattttatttaattgtgctaaccaagattcaaactcgagacctctggctttgatacttaagctgatggggagaggtgggcaattcacttatattccaacaatgaaaaaattagattgcttgtataatagcattttcgttatgcatacatcctagctaatgagtgaaaattgagtgcgatgtaaaaacagatagtacctgacagtgtatcactgttgaggggaaacatgattaacccctgcaaccgtgataggcagggattttttttattttgaaataatgacatgagctctgc

SEQ ID NO: 28047 - DNA, 527 bp, Sorghum bicolor
  Clone ID: 7535189
ttgaaatggataaggattatgtgactgctgaaactctagtcttggtgaaagatcttctcagaaaatatcctcaatggagccatgattgtatagctgttgttggaaatatcagcagcaaaaacattcaggagccaaaaggaaaagcagctctcatatggatgttgggagaatattcacaagacatgcatgatgctccatacatccttgaaagtcttgttgaaaactgggatgaagagcactctcctgaggttcgcttgcatctcctgacagcagtgatgaaatgtttctttaaaagacctccagagacacaaaaggcactaggagctacactagcagctggtctatctgacacccaccaggatgttcatgacagagcgcttttctactacaggcttttgcaatacaatcctaatgtagcagaacgtgtagtaaaccctcccaaacaagctgtctctgtatttgcagatacacagagcagtgaaatcaaagatcggatatttgatgagttcaacagtctatcagttgta

SEQ ID NO: 28048 - DNA, 474 bp, Sorghum bicolor
  Clone ID: 7535190
gcacgaggagcaacccaactcagtgttatcatcagcacatcattatcatgtccgcacattcctcgtctgtttcatctcctctgcgcgttctgctcgtcggcgccaccggctctctcggccgcgctctggccaacgccttcgtcgaggagcgcgatcgcgtgcagctgacggtgctcgtgcgtgaggcgacggccaccacgcccggtcccaagtccgatgagctcaagcagctgcagcagcgcggcgccaagctccagttcggcgacatcgtcgagcagagcgtggacgaactcgccaaggcgctggccgaccaagacgtcatcgtctcggccgtaggcccagctcagctgggcgcacagcacggcttgctggcggcagccaaggcggccggagctcagtggttcgtgccatcggaatacggctttgacctggaggtcatcggaacgggccatccgtggctgggcggcttgttgg

SEQ ID NO: 28049 - DNA, 499 bp, Sorghum bicolor
  Clone ID: 7535191
gcacgagggcggcgctcggcgcggcgcgctcgtcgtcctccacggcctcggcctcggcgccgcggctaccccagcagcagcagcagcaggagcagcggaggccgcccgcgccgccgccgaggctggcgtacctcatcacgggcgcgggccccggggacggcccgcggatccggaggctgctgcgggcgctctaccacccgtggaactactacctcgtcggcgtggcgggggaggacgagcgcgcggatctcgaggccttcgtgcgcggccaggaggcgccgcgccggtacggcaacgtccgtgtggcggccgcgggggagtggggcgccgtatcgcggaggggacccaccgaattggccgccacgctccacgccgccgctgtgctgctccgggagttcgatggctggagctggttcatcaacctcagcgcatccgattacccgctcatgccccaagatgatatccttcatatcttctcatacatgccaagagacctcaa

SEQ ID NO: 28050 - DNA, 505 bp, Sorghum bicolor
  Clone ID: 7535193
gcacgaggataatctgctagctacctactccctgtccacaaaacagagcttgtctcaggatcctatataagtatccgtgtcgcactcccttgcactgggtaccctctactcctgctgcttttaacacgcttcctctctgtcacaaaagcaaccacttatacttcgctctcagcacgtggacttggaagaagcgcccgaatcatggatgacgatacaaagggagtctcgggtattgccccaggcctcaaatccgacaatatctcaaccgatagcgagatcatcctcacgcctgatcatgaagctccttcgtctccgaacaacccgcccgccgactctacccttcttgacactccaatgatgggtgccacgacgcccagaggctcgatgcactcgagaaacccgtccttttctggtagcagttccaaccatgaggactgggatggccttccacctcttgatcgcctatctgtgcttgaccttctcgacaactttgctcttccccagc

SEQ ID NO: 28051 - DNA, 602 bp, Sorghum bicolor
  Clone ID: 7535199
gcacgagggagatatcacattcacatagcaggcattcaactaatgatgctagatctgcactggacgttgagcaaagcaatgtacctggaggaagcgagcagactacttctgttatagcatccttaagaaaggttatgccatctgaagtatgggttgcaacaaatggatactcaaccagcaacatcattggccgaggtggatcttgcacagtctacaagggcgtactggatgatgggaacatgattgctgttaagatttttcatgatacttccttggaatgtgcaaacaagtgttatagtctatatgttcttgcttcaaagcttcagcacgaaaatatagcaaaagttttgggatacacaaaaggcagagttggtcaaaatagtgaacaaaaatacattttgatcgaagaatacattccaaagggaaccttgcgcaaatttatttatgaacaagatttgaattatgcaggaccccagctgctttatcattggttctctctaatgtggataattaaggggatagctcagggcatacattacctacatgagcaacacgttgtccatttggatctgaaaccagacaacatcatcttggattcagag

SEQ ID NO: 28052 - DNA, 500 bp, Sorghum bicolor
  Clone ID: 7535210
gcacgagggttccgttggtgtcctgtggcggcgttggattagaggccgctggatcaagcacagacggccccgtctgcttagaaaaaaaaaaaacgtgaaaccgcatgtcacgctttgccagtgcaacgggagtgtcacctgtactgtaccaacatgcagatgcaggcaggcctgcaggtgcaactttgtttgacatcgtctggagcctggatccttggttgaccaaaagtccaattttgattaggaagggattccttggtctcggcaggggatttttgggcagattggctgagcaaaattttggattagactatctccaacagcgaaggcataacatgacttatacctaaaatacttgctttgcttcacagtgtttcagcagaaaaaaatacgctccaacaaagaaggcaacacacatgacccattttgcgtggggggcgaaacccaaataagcgtccatcctccatctctttgggcgtgtttgctagtgggcgcggagg

SEQ ID NO: 28053 - DNA, 461 bp, Sorghum bicolor
  Clone ID: 7535226
gcacgagggcaaccgcccgcagcgacgaggcggaggcgacccgacccgcgcagcggcgccagcgacaagcaagcctgcggcggaaaccctagcagcagcggctggagcaggaggcagagcgtccaatggcggaggacggggacaaggccgcggcgtctgcgggggaggcaggaggaggcggaggaggagggaacgagggcggcgaggaggagaagagcgtcaagctcttcgtgggccaggtgcctaagcacatgaccgaggccgacctgctcgccatgttccgcgaggtcgccgccgtcgacgaggtcaccgtcatcaaggacaaggtcaccaaggtctcccgagggtgctgcttcgtcatatgcccgtcaagggaggaagctgacaaggcggtgaatgcctaccacaacaagcgcacactctctggggcatcaagtcctttgcaagtaaaatatgctgat

SEQ ID NO: 28054 - DNA, 536 bp, Sorghum bicolor
  unsure (1)..(536): unsure at all n locations
  Clone ID: 7535229
gcacgaggccaaacctttgcgccgctcccaacaacgtcccgttggcctttttaaaacaccaccgacgtggcttgcgcatgaggtcgactacatgaaagtcgtggcttttctccgccatggcctgggcctactggtgccgctctcgatagccttcacaatctacctctacatcttccctatcgttcaaggatgcgcattccccgtcgagtcgagagatagtcaggaggcttatgacttgaccaagaagttccactggccttcgaagccgactgcggacgatcatgctaagcttgcgccttttcgactccttgcgctgggagatcctcagctagaaggtgatacctcgattatcacgaactacctgngcacttttcctcatgtgcagagtgttttcaagcatgtgacgtttcagacgacgcattggtgcttccgcgagcgagtgcgaaagatcatacacgatattgtcgatataatcatggaggatcttccctactacctcatgtcgcagcgcaagcggttcgatctatggggtaacg

SEQ ID NO: 28055 - DNA, 584 bp, Sorghum bicolor
  unsure (1)..(584): unsure at all n locations
  Clone ID: 7535232
gcacgaggctgaaccaagaatatcaaattcattagctggtgagaatgtatcagctgatctgtttagcattggtcatggagaatttccttctggcagcattcatggcgaagaaactcctttggccagtggaaaaacgatggaccatgttgatttgttgagagagcagttgaaaattttggcaggggaggttgcatttaatacaagtgctcttaagcgcctcacagaggaagctggaagaagcccaaagaatgagaagattcagatggaaatgaagaagaagaccgatgaaattaaggggaagcagcagcagatagcatctttggagagagagatagctcatgcaacattaggaactcaaggaaaggttgacaagctagagctttcaccgtcttatcatgaactacttgaacagctcaatgagaaatctttcgaactcgaggtgaaggctgcagataatagagtgatacaagatcagctgaatgagaagataagtgaatgcatggaattgcaagctgaagttactcatctcaaagaacagctgtcccaagctcttgaagctaaggatntgctgtcgaatagcatga

SEQ ID NO: 28056 - DNA, 459 bp, Sorghum bicolor
  unsure (1)..(459): unsure at all n locations
  Clone ID: 7535238
gcacgaggcacccttccacttccattcatcaatcaatcaaaccaatcaatcaaacaaccaataaacttcacattcatccaaaaacaacccaccagtcttttttcccgtcatttcatacccctttaccctttttcgcgcttcaaaatgaccgataatcaaccaactaatcaagatcaaagcgatgcttctcattcaaccaataatggcaatgacaatcaaattctcgaatttcgtttcttgattgataattcgtgcgttggtggtttggttggtaaaggcggggccaacgttaaacgtgttcgtgatgagagtggcgcccatgttagcgtgatcaaatccgagagtcgatcagtcaatgaacgaatcatgttattgaaaggtactgttcgatcaattgccaaagcggctcaaatgtgtggtgaattactcattgaagctcgagctgctggcgccgaanat

SEQ ID NO: 28057 - DNA, 447 bp, Sorghum bicolor
  unsure (1)..(447): unsure at all n locations
  Clone ID: 7535245
gcacgagggcccaacnnaatcccaatctccggnagaaaagcaagcatcaagaatcctaataggggcgcaccaagaactccactgagaatccccaatcatttcttggtgcatttggccccccctccaggcctccaccatcatcgaaattcccaagaaaactcatcctgaatcggtcggtcctacaccgcaccagatcacagctcataattccagtgagaattcgaaaaggaggaagcaatgacggaggtggcgctcctccggggcccgaccaacctcgcttccaccgcaagccgcgcctccgccgcctcctcctcctcctcctccgcagcgctgcgctatttagccaatgccgacagcgacgtgctcccaggaagcggcagcccggagcgcgcagccggatctgcagggagccgacgactccttgaactgcgcgggcaagaggcggcg

SEQ ID NO: 28058 - DNA, 449 bp, Sorghum bicolor
  Clone ID: 7535246
gcacgaggattttttttctttttgttagtaccaactaccacctaggcaactagcacagctatatttgtaaccttaagtacctctcatcagccatcccaccaccagacatacttggttcatctacatctttttttagaagagtaacatatgagttttataataatatctgctcctgcatactaaatatgttctataagtatctattctctagattttatgttctctttgagcaatgtggaacttgttatgtcactatttatttcctactttttttatgtgtgtagcaccaaaatcatagtacccttctctgcaaaacctgattgttaggtactgttactgctcttccttacctcgtctcaagatccaggtattgtaccacgaaattcacacccacctgtggaagagttctcgtatgatgcttcagctccacatgctcttcagttccctcg

SEQ ID NO: 28059 - DNA, 574 bp, Sorghum bicolor
  Clone ID: 7535256
gttgcatcatgcagatccgtaactttggggatgctgtcgctgtgtgcactcgctcgccggagaaactttcccggattcttgacatgtatgaggcgcttgctgaggtgatccctgagctaaaggagctgttctttgggagctatggggacgatgtcatccatgatttggagggggttcttgaaaggcttggtgacgcagtcaagggtaccctgcttgagtttggaaaggtcctacagcaggagtcgtcgcggcggccaatgatggccggtgagatccacccaatgacacgttatgtgatgaactatcttaggttgttggtcgtttacagtgacacacttgacacacttttggatgacagtggtgctggagatgtagatcataatattttacataatggcaccgatgaggatcaggagtatctgaagagtttgaccccacttggacgccgtttagtcaaactgatatcttacttggaggcaaatcttgatgaaaaatctaaactttatgaggacggagcgctgcagtgcatattttccatgaacaacacactctacattgtacaaaaggttaagga

SEQ ID NO: 28060 - DNA, 604 bp, Sorghum bicolor
  Clone ID: 7535257
gcacgaggcttccttcttccccagccgtgcgcgcttctccacttccccggagacaaaagagccccgcgatctcccgggccccacctcccgcctgcgcgcctgcaacacggagaagcttccggttcccagccgggccggctccaccgactcttcctttccctccggccgccgcggcgtcgaagcggattagcggggagcgtcggggcggcgagatgtgggtgttctacctgatatcgctgcccctgacgctgggcatggtcgtcgtcacgctccgctacttcgccggccccgctgtgccgcgctacgttgtcgtcaccgtcggatacgcatggttctgctccctctccatcatcatcctcgtccccgccgacatctggcagacattaactggcagtgcaaagggtggcattggattcttttggagctggtcctattggagcacatttatcctaacatgggctgtagttcctactatccagggctatgaagatgcaggagacttcactgttaaagaaaggctgaaaactagcattcatatgaacctgcttttttattcaattgtgggagccattggccttattggtctcatactactcttaatcat

SEQ ID NO: 28061 - DNA, 512 bp, Sorghum bicolor
  Clone ID: 7535259
tagcagtcgatactaaaggccacagcttgcttatcgactcaactcgccttcgacctcacattttcattctcctcgtcatatactctgttatctgccagtcatgtctgcctcggtccttgactacaccacagccctcgaggtgctgaaggagtacaagcagaaggatggtctcgacatccacgagcttatggatacaaccaagcacggcggtcttacctacaatgacttcctgcttttacccggctacattggcttcgctgcctctgaggtcaccctcgatgcgcccatcactaagcgcattactctcaagacccccttcgtctcgtctcccatggacactgtcacagagcacgagatggctatccacatggctctccagggtggtcttggtgttattcaccacaactgctctcctgaggcccaggccgatatggtccgcaaggtcaagcgatacgagaacggtttcatcctcgatcctatcgtcattgatcgcaacaccactgttggtgagg

SEQ ID NO: 28062 - DNA, 526 bp, Sorghum bicolor
  Clone ID: 7535261
gcacgaggcattatctcccttgtcttgacatttaccaattgcatcgcccaagatggtttcaaacggcatttccaacggtaccaatggtactaacggcactactaccaacggtactaatggcgtcaatgggcatgccgctctgtcacccctggaggttttagtccaagacctcaacaagaacaccaccaccttgaacgggtacctccgcgccaacaaacttcccgagcctagcttcgagcgggatgcacccatcatcaacttatctcctgatgcgcctgaggaagcgcaggttgccaaggagaagatccttgacagtgcgttgcaaatcttccagctcgtctctggccctggcgagtacctgcaaaatgtcatcacaggttaccattacatggaaatccttcgatggatgagccatttcaagatctttgagctcgttcccttggagggcaagatttcatacacagaactagcctccaaagctggtgtagctgagttaaggctcaagactctcgcccgcatgggcatg

SEQ ID NO: 28063 - DNA, 543 bp, Sorghum bicolor
  Clone ID: 7535264
gcacgaggggcggactcgcccgcggccgccgccgccaacgggggcacgccccgcccgtccgacctcaaacctacgcgaattccgcagcgcgcgcgctctccctccatcgcttcgcactcccactccggcggtaccggctggagcgcagccggcacaacgttgaacggccacccgaacggccaccacgactacccagcggcggacttgtgggagcagcagaagccgcagccatcaccgaccgttccggacgtagtgctccaccggaagaacagcgagataatgcgcgagcaagctccgttcaacaagtacggctccgccgccagccgggacacgattgagcaggtccccttcttcccgcgatcacgcgactcgtacgagagcgaggagcgtccgtttgagcattggtaccgcggcgacacatcccgcaacggtggcgttggagagcttcgtgtggggcggcggcaggagatgctcgaaatcgcgaactacggccacgccctgcgtgagcgtccatccttctcacgtggccccaccccggcaaac

SEQ ID NO: 28064 - DNA, 568 bp, Sorghum bicolor
  Clone ID: 7535265
ctggtacaatgctgtagagtcccagcttcgtgggtgtagttgggaaaccctttcatctgtggttttagagcgctttggtaaagatcaccatgaacttttgctgcgttagttgtttcaaattcgtcaatctggtacagtcgctgattacatagagcaattttctgcaattgttgatcagttaggtgcttacaatcataccatagatcctttgttctataccatgcgctttattgatgggttgcaagaaaatattagagtagctgtttctatgcatcagccccaaaattgggatactgcttgtgtccttgctcaattgcaggaggacctcttcgggcccaggaagccggaggttcgcaagtgggatgtgtcgtctgggaccaagccctttgcgtggccatcgcttcctctacctccaccaccaggtcgtcatgagagcggtctgtgggagctcctgcggtgaagccgatgcctgatattgggcgctctacatcagctgatgatcgctggcaagccttatgtgccttacgacgttctcagggcttgtgtgttcgttgtggcgccaagtggt

SEQ ID NO: 28065 - DNA, 537 bp, Sorghum bicolor
  Clone ID: 7535267
gcacgagggcgggccctgctgcgccatggcgctacagctgcaggccgccgctccgtgtccgcccctgccactcgccgcctcccgcggccgcatcgctgcgcctcggcctccgcctcccttcgtcagcatagctggcgccgccgcctccagcccgggcccctccgcgcgcctctcctgccgcggccccgcgcctcgctggcgacgtgcgagcgtgagggcgcacgctggtgccggcgggcggagggagtccccgtacgaggtgctcggcgtgtcgccgtcggcggcgcccaacgagatcaagcgcgcctaccggcgcctcgcgctcaagtaccaccctgacgtcaacaaagagcccgatgcccaggagaagtttctgcggatcaagcacgcttacaacactctgatgaactcagagtctcgatccaagtacgcgagcagcagttcagattcgtcctggtcctccagctccagggcgagcaaatcagctgccgcagaagagccgttctatggatttggtactgaattctctccttgctg

SEQ ID NO: 28066 - DNA, 554 bp, Sorghum bicolor
  Clone ID: 7535273
gcacgagggtcaacccaaaatgctcgcgcgcatcgtagccaccctcggtctgcttgccactagcgccagcgccgccagcctctacaccatccccgaccacgccaagccctggggtttcttcaccaataacaccatcttcgccacctcctacaacgacagtgttacctacccgcgctacgtcgagctctccaacggtaacatccttgccaccgtctcctactccggcccgtccaccccgtacttccccatcttcgagagcaaggacggcggtgcgacatgggagcacatctccgacctcactgatcaggtcaacggcgtagacttcgctgctcaaccggcactcgcacagctgccgttccaggttggcaagtaccccaagggcacgatcatcggcggcggcaactcgtggagtaactccttcacccgcatcgacatgtacgcatctacggacggcgggcgcagctgggagttcgtctcgcacatcgcggagggcacggcgcctaacaccaccaacggagccaccccagtctgggagccgctcttcatgccgtaca

SEQ ID NO: 28067 - DNA, 562 bp, Sorghum bicolor
  unsure (1)..(562): unsure at all n locations
  Clone ID: 7535278
gcacgagggttgggagttctcacgagcaggaggtgatgaatgggggtgaagagaggaaggctggggatgaagagggaaaatggggctgggagaggtggaagcggcactttgctctcgttgaggagagcgagcgtctcgttgatgagctccagctgcaactccaggctgctgtttatagagaagactacaggagtgctcataaactgaggctggctattgctgctacagcaaaaaatgacactgtgggcagagctatctctgacttaaatatggccatagacgaggagcgctacaaggatgcggcatatatcagagatcatgctggcgcaggactgctggggtggtggtctggaatttctggaaatttggctgatccatatggtcttataattcgtataagtgctgaacatggtcggtatgtggcaagaagttatgatacgagacagctggcttctgacagccctggtctccctatatttgaaatatactttgcagaggcaaatggtggatacaacctgcangcagtgcatctgaaaccagatgatagcgattctgaccaagt

SEQ ID NO: 28068 - DNA, 152 bp, Sorghum bicolor
  Clone ID: 7535284
tctagtttgacaaggggatctgtccgttctcctcttgcacaatgtcttcttattcgttacacaagccaggttatgcgtgagtcaagcatgaacactcaaaatggcgaccgcccattttttgattttctggaatcatccctcagacataaagc

SEQ ID NO: 28069 - DNA, 406 bp, Sorghum bicolor
  Clone ID: 7535294
tgcagagaagaaccatgaaggagcttggcctcaagagggcaagggagtttgggtggccaaacacctatgtgttcaccaaagccatgggggagatgctgctgggacactttagaggagatctcgcagtcgtcatcgtccggcctagcatcataaccagcatcctgaacgagccgttgcctggatggatggaagggatcaggacaattgactcgttcatcgtcggctacgccaagcaggctttgtcaatcttcttagttgatctcgacttgataatggacgtgattccgggggacatggtggtgaacggcatgatggtggccatggcagcgcactcggaggatcagacgaccctgagcatctaccacctgacgtcgtcgctgcggcagccggcgccgtacgccgtcct

SEQ ID NO: 28070 - DNA, 110 bp, Sorghum bicolor
  Clone ID: 7535295
gcgaggaggccgtcgcgatggacatggacctggacggcgaggtgcagtacgacttcttccctttcatccgccagtgcaagagcggccgcgtcgtccgcttcggcgccacc

SEQ ID NO: 28071 - DNA, 159 bp, Sorghum bicolor
  Clone ID: 7535298
cgttaagaacactcgttgggttaacgacaattctgtgaatctacagtactatagcgccgaagacgctgcggtcgcactcagcgccctgaccgatccagaagctggagaccccgctttgattgcacctcaaaccggtcgcaaggctcgtcccttctcgaa

SEQ ID NO: 28072 - DNA, 266 bp, Sorghum bicolor
  Clone ID: 7535304
gcacgaggcccacctcgctcggctcctcttcttcgcctgttctgctccgcgccctcaccctccgcagccagtttgctcgctcgctcgccgccgcgcgctgagccttctccacccttcttcctccaagtcctccgcagattggaccgcggcccgctgctgccccgtcggcggccccccgcaccggcccgatcatatcctcccaggtgaattgttcacgctgagttaatcggtggaagctgtgcattggctggggttatctcagatca

SEQ ID NO: 28073 - DNA, 348 bp, Sorghum bicolor
  Clone ID: 7535311
cagcctcgtctcatgtcattggagattgataggcagcgtgcaaccattggagagggcgacatgaaggagtttgtgcccaagaagctgccatctgtgcatcttggggtcgatgagattggcacagttaactatgagattggaaatcttattaagtggagaaagaactttggaaatgttgtgatgatcatgcatgttagcgggcctgtggatcgcacagcacttgagtggaggctgctttatggaaggattttcaagacgggcatcattcttgctgagcagagcaatgcagagctcgctgctgaacgatgcacattgtcacacgcttataagtatttgcccaaagttttt

SEQ ID NO: 28074 - DNA, 174 bp, Sorghum bicolor
  Clone ID: 7535313
gcacgaggcctctgacgaggaggcggaggatccgcagctctgcaagccctacgcctccgacatctactcctacctccgctccatggagtggcagcccaagcgccgccccgccgaggactacagggccgcggtgcaggtcgacgtcacgcctaacatgcgcgccatcctcgttga

SEQ ID NO: 28075 - DNA, 449 bp, Sorghum bicolor
  Clone ID: 7535318
gcacgaggcggcggcgtcgtggtcgccggcggctgggtgttcgccgccgccgtctcggccgccgtacttgccggctcccgggagtacttcgagctcgttcgcggcactgctggcggaggcgggacgccgccgccgcgctacgtgtcccgcgcgtgctccgccatctgcgctttcatgcccatccttgcgctgtactatggacgcatggatgctactgtgacattttctgcattcgtcattgcaatatcattgcttttacaaagaggaaatcctcgttttgctcaactaactagctcagtttttgggttattttactgcggctatctaccttctttctgggttaagcttggatcacgactggctgcccctgccttaaatacaagtatagcatacagttggccaattcttcttggaggacaagctcactggacagttggacttgtagcaac

SEQ ID NO: 28076 - DNA, 132 bp, Sorghum bicolor
  Clone ID: 7535319
ctgagggggctttggttattcctgagtgacaactattgaaaatggtggttcttgcagcctctgtagtatcaaagtctggaaaagcacttgtttcaagacaatttgttgatatgtctcgaagcagaattgagg

SEQ ID NO: 28077 - DNA, 377 bp, Sorghum bicolor
  Clone ID: 7535321
gcacgagggttgagccatggaacacttgtcactgcaagtccagagacagtaaatggcatgctggatagcctaggggatttgttgaagctgctggatgtttcatctgcagaaaatgttctgccaacgacctacggaagcttacaacctccactcgggaaacatcgcttaaagattgttgagttcatctccgatctactatcaattggtactgaagctgccgaaacgcgactgattcaactaggagcaatcaagcacgctatagatctattttttgagtacccatttaacaactttttgcaccaccatgttgagaatatcattgggtcatgtctggagagtaagcaggatcaactgatttaccatgtccttgatgagtg

SEQ ID NO: 28078 - DNA, 575 bp, Sorghum bicolor
  Clone ID: 7535363
gcacgaggaataattgatagtacttagttaagtataaaagtccacctcatgtacataatcagggtgagggtggtggttaagaaagtcatatagttcagcaagaggattcataaagaaaaggtggttactcatgtaaagaatctcattgcttatcttttttcagaggaggctctgtaaaattatgcttgctgatagattcctttctgaatttgatatcttatatctaatacaatataaggtggacgtaggaataagccgaaccacacagtctttgaagagaacattacttacgcctccaaagtgtaaggtcctttatactttgacacctattttctaaaacatgctatagataagctgacagcatcaagagctgctaaagtgttctaggttcaggtgaactattatgatttttataggaagtatgctctaaggaataaaatgtgcgttgctagctaaattttattttatatgataggtaatcaagcctttactgtatggatcatcattcaaattggtcatgtggtcaaattatttttatgctcacaggttatagctattttgcttgttcttgaatc

SEQ ID NO: 28079 - DNA, 556 bp, Sorghum bicolor
  Clone ID: 7535365
gttgccaatcgcgccgtgggatctcgtcgaacggagcgggcggcgacggcgatgtcaagggaggcgacgaggacgaggagccgggtcctggtggtcggcgccaccggccgcctcggtggaagcatcgctcgggccagcctcgcctcgggccacctcaccttcgcgctcgtgcggccccaccacttcgcacgccccgactcccccttgctcgagccgctcgtagccgccggcgccactctgctccaggggtcactggaagattactcgagcctgctcgaggcggtgcgtcaggtggacattgtcatctgcgcggtgcccacgaagcaggtgctcgagcagaagcccctgattcgggctataaaggatgctggatgcgtgaagagatttattccagcagaatttggagcagatccaacaaaggttcaaatttgtgacatggattatggcttctatgagaagaaaattgaaatccgccattcaatagagagtgaaggcattcctcatacctacatatgctgcaacttctttatgcgctatttgcttccttcactgggtg

SEQ ID NO: 28080 - DNA, 505 bp, Sorghum bicolor
  Clone ID: 7535368
gcacgagggttgatagtgtctcagtttgatacacatcacgtttaacattctttcatttttctttctcttctccaatttatataccacttcacactccttttcttcaacatcaatcatccatcgccatgatgaagtctcgacgaactcaacgatccaagtctctccctaacaatcaatcgcctaaaagatcattcttttctatcatttctcgccggctttctcttagttccagacgacgcgccaactctgttcgcttgtatgatgacagtgaagatgatgacaccgtccaagtgattccccaagagattcagccgcccacacaatctcgcttttctagacgagcctcccgcttctggtctacctcagctgccaaccaattcaatgatgatgactcttcgcctcaatcgccaacataccccccttatgggggcgcttatgtcccccgacatgccgcaagtgacttctcaaagacagcttccaaccgcctcaccatgatggcagaggc

SEQ ID NO: 28081 - DNA, 587 bp, Sorghum bicolor
  Clone ID: 7535377
ctgagccgcaggcggctcccgcaccaccgcatgcgcgacctttccctgcgccacggcccgctcatgctgctcaagatctgcgagcgcgtcgtcgtcgtgctctcctccgccgaagccgcgggggaggtgttccgcgacaccgccttcgagcagcggccgaccagcccggcgctcgacgagctctactccaggcatggcatggggatcgtcttcgcgccctacggcgaccactggcggctgctccggcgggtcctcgtcaccgagctcctcagcgcgcagcgcgtcgagtccttcaggcgcatcagggagcaggaggcggcccgcctcgtgtcgtctctgcagcaggcgccggcggcagcagccgcgtcgtctccgccgggccagctcgccaacatcgacgagcgcctcgccgtgttcgtcacggactcggcggtgcgcgccatcttcggcgacatggcgatgcccgaccgagccgcgctcctcgacacggtggaggaggctctggacttctcgtcgctgttcgacctcagggacctcttcccgtcgtcgtggctcgtgcggatgctgccgcgcaacggcaaggcgga

SEQ ID NO: 28082 - DNA, 651 bp, Sorghum bicolor
  Clone ID: 7535379
gcacgaggttcttcttgacgttttctactgcatcagttttgtccacagtattgaacattcccatatagactgccctattttgctgtctgcccaaaatgtccacattcactccatttagcgagcaaccttccctacacacaaaggctccctaccgcgccgcctctctcacacaacccgccaatcttcgtcaagcactcaaagatgctcaggctgatgccagcaaaagtctcattggaattgcgcatggcatccctagcacatttgtgactaagcttatcgcgagtacgaagccggatttcatctggattgatgtcgagcatgccatgttcgatcgtttggcgctgcacgacgctatacatgccgcccagcaccactcagagggaaagtcaatggtcgtttgccgtgtaccgaaacacgatgaaatcagtctcactactgcgcttgacgcaagatgtgcaggaatcattattccacacgtcgagtccgcacaagaagtcaaagactttctgaaggagatgtactttggtggaggaaagggccaccgttccttctccccatggaacttcactcctggtctagcccaatccctttatccaaatgatccttacaacgtcgcaaccgcaaacaaccacgtctgtctcattccgcaaa

SEQ ID NO: 28083 - DNA, 607 bp, Sorghum bicolor
  Clone ID: 7535383
gcacgaggtgctgtacttagcaacgcctccgctctggaagtcaaagctggtatcaagcctgctgatattgtcagtggaaacccacgcttgaacttgttgttcaccgctgctatctttaatcagtgcccaggtctcgacaccttgactgaggaggaaattgccaaggccgggttggatgaggatgatgttggagattctcgtgaagagcgtgctttccgtatgtggatcaactcacttggtatcgatgatctttatgtgaacaacttgtacgaggattccaccgatggtcttgtgctcctgaaagttctcgatacaatcagtccaggatgtgtcaactggaaacaagtcgagatgaagcctagcaacaagttcaagaaagtctcgaactgcaactacgctgtcgatgtcggcaaggctcttaaattctcgttggtcggcgtcggtggtgtcgatatcaatgcgggtaacaagaagcttattctcgccatggtctggcaaatgatgcgacttcacacacttaatgtcttgaaacaacttggaggtgcgaagggtgagattggtgatgatgccattatcagttgggccaacgagcgcatcatgacagtca

SEQ ID NO: 28084 - DNA, 517 bp, Sorghum bicolor
  Clone ID: 7535389
gcacgaggcctccgtctccccgccgcagcgctagccggaggccgccgccgccgccaccgttatgccatggccgtcatcctctcctccgcggcgccaacgacactgactcctcccgccgcgcgcccccgcaggcggccgaggagcgggggcctcgcggcgcgcctctccggcgcgctcggcctcgcgcacgccggggccgcactcgccgcgccgctctcctacgaggagacgctgcgcctctcgtccgactccggcggtgacggcggcgggttcgcgctcccggacctcgacctcaacgtcaacctcaacctcgacgggctcgtcggcttcgtcaacgagaaccctctcgtcgtcgcggcaggcgtcgcggccatcgcgctgccgcttctcctcgcgcagattctcggcggcggcggaagctccaagccatacgccgtcgtgtccgccagggcggcctaccagcggctgctcgaggagcccgacgcgcagctcgtcgacatcaggccgctcaaggatg

SEQ ID NO: 28085 - DNA, 467 bp, Sorghum bicolor
  Clone ID: 7535391
gcacgaggccaacatcacctgcacacgttcgccatgacgtgattgtcaacctctcgctcaagtgctttgtcttttccttcttgtatcctattctgtagcctcttgttgtatgcccgtgtgacactagatgccggcaacgccgcccatgccttccagtcgctcttcttatcgcgcatcttcccatcgctatcgcaaagtgcgccggttgtcatgatgacaatcaatcccgagctcgaggcttttgcgcgagccatatcacgcgtcttgggctgggcatacttccttgcttggtccctgtccttctaccctcaaccaatatcaaattacctccgcaaatctacccttggcctcgcaatcgacttccctaccctcaatgtcctcggcttcgtctgctacaccctctccacggcctcgtttctctactcgccaaccatcaaggcccagtatgcctacagacaccccgaagc

SEQ ID NO: 28086 - DNA, 563 bp, Sorghum bicolor
  Clone ID: 7535398
gcacgagggagttatggatctaaacaggccctaaaggaactcagccttgcttgacaagttgacatgattatgcatgttctgtgattttgaggatcatatgaaccacatttggtccagtgttaatttagtggctggcattaatatagtgttagctccatccttgattttggattagcaaggtggaagttttaggtacagtgtagaacttatgtttgggactttatgtctgccccaatggcaattgcatagtgcctgttggatgaacaggtccctgagatgtactaccatattattcactgtgagctgacgttatgttttctctaatcatcaagaataaggattggaaattcatacatagctttatgttccatgattcaatctgtactgatcattcacttgctgcagtttttgtgattcttaagattgaacacaaaattgcttatttaaccacccttgcttctaacttgtccattaagctttaagtttaacctgacatgtcatatatttgggacttttaagttgcccctgtgacttttatgctgtgcctgtgggatgaacatgtt

SEQ ID NO: 28087 - DNA, 473 bp, Sorghum bicolor
  Clone ID: 7535401
gcacgaggctggccttctctctatgtgaatccaaccatggccggactgctcgaacagatcgacggggccatctccgacgccctcaaggagtggaacatctacaccacactcatctccttcgccatcgtcggcttcctcgcctggatcatatacgacaatgctgatgccgacacgcatccactgctgctcgcacgacaggcacaagcttcgtatgtgagacagccaggcgaatccgccatcttcaggtccccggaaactccccatggctatcccctccgtactggacttgccgtgagacctccgggcactcccatgtattctgccggcaaagatggcgacctccgtgatatttggcgacgggtgacaggcgagattcccctcgaaaggggtgccaaatccagcggaaccgcacatatcatgaccgtcttcggcaaggacggagtcagcgagcatgcgattgaagacgtcacaaa

SEQ ID NO: 28088 - DNA, 535 bp, Sorghum bicolor
  Clone ID: 7535416
gcacgaggggttctgattctgctccgactctatgtgatattctgtggagtggattcaaggagtgggattcaaacagcattgtgtgggacgctctagcaaatagttatgctagagctcagatgaatcatgatgctctttatgttcttagtaaaatgagcagcctaaacatgcaaatctcaataaccacctatgacagtttgttgtacagtctaagaaaggcagatgtggcactggagatttttaaagagatggagtcatgtggtattccccccagtgattattcccatagcattctcatagatggcctctgcaagcaagataaaattggagaagctttatctttccttcaagagattaggaaagaggggaaattcataccattgggaatgacctttaacactctcatgtctgcattgtgtaattgggggttcattcaggatgcaaaatcagttttctgcctgatgttgaagtatggattaaatccgagcaggcacacatattcaaccattatacatgggtctatgtaaaataggtt

SEQ ID NO: 28089 - DNA, 576 bp, Sorghum bicolor
  Clone ID: 7535417
gcacgaggggtgaccaagcgctaaatataaacttttcaatctctcaaacatagtcatatttttctgctccttcacacatagatactgtagttaccattttattatgtctacaaatatttttaattatgcctaggattttgagttgcttagtaaaatttagtcatatatatggaactcaaaatacaagtaataatttaaacaatctggagtttgagcgttgcgaacactgtagaaacaaaaaaataatacctatagtgcttgcttgactaattacttttgcactaaatgcaactacataagttgtcgtccattaatatcgttgcaccaatttacatcaagttagaactgcactaaattattcatgttgttattaatcccatatttttttttgtaaacaccttgaaactgattactttccttcacatggtcatatgattgcctaggtatttaaattttaatcaatggcagcacgaacaggtttgtaccaagccaaatggtaaatatgcctcatactacacttatgtatattcaagtaagtgcctctgaacatgtgaaaatattcaagtaagtgcctct

SEQ ID NO: 28090 - DNA, 505 bp, Sorghum bicolor
  unsure (1)..(505): unsure at all n locations
  Clone ID: 7535418
gcacgaggagatagagagagggggagagcgagccggcagcggcggcggcggcgccatcactccgttcttctccgctgatctggggcgaggggagttgcaaatctatcaatggccactcacactacctattcagtccgcgtctcctcggagacccacaagattgaggcctgggtagtgtctgacgaagctctggccaggcaactgcaggaggaggagaacacgcatgacgctgctgccgacaccagagaattcgccggcaatgtgtccttggagttatcgtcaccggctgttgagtacaggcctacacagaatgcagctcaggttgcaagggaagacaatgtggacccagataatatgtcatacgagcaactacaagcattaggggaagcagtaggaactcagtccagagggttatctgatgagctgatagcttacttggagccatttaggaacaagtgcaccttcttctccagganaaagaacagcgaggaatgtgtgatctgca

SEQ ID NO: 28091 - DNA, 507 bp, Sorghum bicolor
  Clone ID: 7535419
gcacgaggctgcttcactcggatggtctaatcaaaagcccatcgaactttggaaacctgataaaacctcatccgcatccgctgctgccgctttagccaaagattacaagatggctccagcatgggaaccaacatccaactccgctggacacaaagccgcacttctagctgttggctctgctaatgctgccttgaaccaatccccaagccagcgcaagtcacacgaaggatggggaaactctgctgccactcaagcattcaacacgaatcgagccaattcaatgcgacagcctgacccaagagcatctgatacttcgctgcagggacaaaagtctctggccgcggccaaaggtgctatgtcaacaactagacgacgagctaaatcaacgccatcggcaccagactctcatgctccatcatcccccaagacaaacactcgacccgatgcgcttagcggagctgcacttgctcacaaagcaagcctcagggccaagccggcaacagaaaa

SEQ ID NO: 28092 - DNA, 492 bp, Sorghum bicolor
  Clone ID: 7535422
gcacgagggttccaattcacatcccccgctcgtgccctctctctctctgcgcgacgcctgggtgggctaccgccgccacggcgccaggtgcggaggccttcgtcggtcaagccggcgacgagcacccacaaggtggccgacaattttgcaacgctttataagatctgtgacagtttatattttgcagttgaagctccgtgattgtgctgtggcacattctgtttttgtcttatgatatggcagaatcatgtactgtttcgaattccgagaataagcgcagtctcccagcatggatgttgaaagcaacctcaggtaatcaagtggcaaagaccgaagatcagaataagcaggcactggaatctgatgagcagattggggctcttaatcagagcaagcccgtcaaaaggaataacagaaggccgttaaaaagcttggattcaggggctgctggtgaactgggagttttgcggcgatgtgagggtagagaaaagg

SEQ ID NO: 28093 - DNA, 415 bp, Sorghum bicolor
  Clone ID: 7535424
gcacgaggcgacagcatggtctaacgctgccctataggctggatcgatcgatggcgtcgtcgggcagcgacgtgccggcggcgagggcggccgtggcggtgaacgatctgatccaggcgcgcgacggcgcggcgaggctcagggccttcctgctgcagctggacgaccagcgcgcggcgtgggcgcagctgcagatcgacggcgtcctgaccaagctgtcgagcgcgatgtcggcgttggatgtaagcgatgccgccgggtcggacgacggtgcgaggccacggccgcagtcggggagctcgtgcgggaacaagaggaaacaaagctccagcagaagatcacagcgtccatctgacaaaaagatcactgctaacctggaagatggccacgtatggcggaaatatgggcagaaaga

SEQ ID NO: 28094 - DNA, 572 bp, Sorghum bicolor
  Clone ID: 7535426
gcacgagggtcaaagcaagtttaacacttggcatgctttattacatccacttgcttcacataatcatctctaagccttatccttatgctgtagatgatagatctatactaagaggcgtagcctgagaggtaggcgcatggggattataggggctcattgtccagccaccttttagccatagtaaatgattctttaggatttgtttctggaggaatatggctgccaccctttattgttgcaaacgttaggttgctagcatacatgatggtgaatcctgctgcctggttatctaggtgccaggccctccaatcatcaactatggagaaattgaaggatcctatccatgcttgtgtgcccgtaaacggtacgaggaggtcatggtctccactgcaccaaaacaagaacttgtagctaattattaagcacaaccttatggtggtatattcaaagagctgctaataacttgcaagtatattatatgtatactccctttggttgggagaagttgtcatttctgacaaaaaaatagaattgcaatttcgagagatgtgttgtatgaaacatcttgttct

SEQ ID NO: 28095 - DNA, 538 bp, Sorghum bicolor
  Clone ID: 7535429
gcacgagggagaaataaaatgctggaattgaagcataacaatgagaaaaatgtttgcataatctatggacaagcttctaaggcaaattatctaaaaatgggtcctacaatcacattcaatttgaaaagagaagatggcacctggtttggatatcgtgaggtggagaaacttgcctcattgtcaggaattcatttgcgtacgggctgcttctgtaaccctggtgcatgtgctaagtatgttggtttgtcgcactcagatctagtttccaattttgaggctgggcatgtttgttgggatgataatgacataataaatggaaaaccaactggtgctgtgaggatatcatttggctatatgtcaacatatgaagatgcagaggaatttctgaagttcctgcagtcatcttttgtgtccaaacctgtgggattgaaaaatggctacatggtgaatacggatacttttaatttagtagatgattggcgccagcaagctatttcagatattcgcttaaaatccataactatctatcctgtgaaat

SEQ ID NO: 28096 - DNA, 576 bp, Sorghum bicolor
  unsure (1)..(576): unsure at all n locations
  Clone ID: 7535430
gcacgagggcacggcggcggcgcttcggcacgaccctggcctggcgcgggagtggtcgccggaggagcaggccatcctcgacgagctgctggtcaagtgagtccgccggatttctgggttttgcgggtttgggagccccgcaaggccgcaattcgagttagacggttgcttttatttctgaattctgactattggatagaattgactggtaatttgagcaattaagcaacgcttgtgttatgtgattaccaattcagtgagattgtacctgcataggcatagatcgcaacactcgatggcctccttttagcaaacttatccctagccaatttctcatgctaatgcttctccttgcaacgtaatcctagttaatccaactttgactttttgatgcaagtggataatgtttgccctttgttcactcttcacacttgctttattctgatatactgcaaagcatgggaactcttgttagttatataacacaaatcttacgcgcaagtcagcgctcaaaatgactgtagcatcaggtgtacaggcttgcattntgatgttgcaagtagaatgtttggatag

SEQ ID NO: 28097 - DNA, 501 bp, Sorghum bicolor
  Clone ID: 7535432
gcacgaggcgcagatggcttcggcggcggcgtgggagggcccgacggccggggagctcatgtcagcgggggcggcggcgattcccggcggcgtgcgagtgaaggggtgggtcatccagtcccagaaaggctccatcctcaacgccgcctccctccaacgttttgaagatgaacttcaaacaacacatttacctgaaatggtttttggagagagtttcttgtcccttcaacatactcaaactggcatcaatttgcattttaatgcgcttgatgcactcaaggcatggaagaaagaggcactgccacctgttgaggttcctgctgcagcaaaatggaagttcagaagtaagccttctgaccaggttatacttgattacgactatacatttacaacaccatactgtgggagtgatgttgtgattgtgaactcaggcactacacaaacaagtttagatggatgtagcgctttgtgttgggaggatactaatgatcggattgacct

SEQ ID NO: 28098 - DNA, 520 bp, Sorghum bicolor
  Clone ID: 7535434
gcacgaggtattaatatatggttgtgttccagtattcaaaattgagcttcttggaaatgatggtgaactttacactatgttattgacatggtaccctattctttataccactcaccacgtaatgatggttaatatgtacatattccgaaattaatgacataaatgattaatattgcgatatccttcaaactttggaacctctagtgactgtattttgcatcgaaattgtttatctttttgtaattggtagaagatgtcaaagggttacttacagattgttcaaccaaagatccttctctcactttagtatttttggatttgaatttctcaactacgtttgtctttgttccatttggtcatatgttttcctttcacctgtccattgtatctctctttgtgacttccctgatataaaaggtctggtagtttatattttttccccctaaagacaatacattccattcagagatggaatctggaaatcatcagctagcatttcaaaagttcttattgcttacat

SEQ ID NO: 28099 - DNA, 453 bp, Sorghum bicolor
  Clone ID: 7535444
gcacgaggactggatggtgggggcacctggcccccatccacttacaaaatgtcatcatagcattttatgcacagtcgcagagtcctcaggaaagtgcaaagcaatatgttatcctctgtcgtgcgagtgatcaagataggcatgtcagttattggataatcagccttggcaaatatggttgcaatgctgcaagggaaattggccgtccaatgattattgggtcaccacttcagttggataaaatcctgcaaaggctcccctctgcttatagtggaccacccacaataataaatgggcttctggtctggctactgcctccgcagtttcaagtgaattatcttgtgacattcaatataatggtcgaagtctttggagttattgacattccagacacaaatggtcttcttccatatcagttgcttgtagttgagaacaggattgctatagccttct

SEQ ID NO: 28100 - DNA, 519 bp, Sorghum bicolor
  Clone ID: 7535446
gcacgaggctccccacgagtgagcagccaggtcggcggcgcgagcagcggtggccggcgcgtgggctggacagcggcgacccaccctgccgtcgaccagcgatggacaacgtgtgggtcggacggcggcgactcaccctcgctcccagctctctccctcttgttgtccgtacataaagcaggtgagaaatctatggccctttcataacctaggtttgttggggtggatttgatatcgataggagtggatggagatgagccagagcaataccagccatcgatgccatggtcagagctgctctccgtgcttcactgttgttccgtcctctctatcattttgtttctatcagattgtttagtcaatgtgttagagcgtagctcccaaagatctgctctatattttagccatgtacttcaccgtagtgagttgtttttacttcaagtggcaccttgtattactggatttcaacttgatttttgttgattactttctacgacttgtcttcttggccaatttatg

SEQ ID NO: 28101 - DNA, 600 bp, Sorghum bicolor
  Clone ID: 7535454
gcacgagggtcgacttcactggtttctgcggaaacgcacgatgtcaatcgtcgctctcatggcgagctttcgcgcatgatccgcaagcgcaaccctcaattgggtgtcatcggcgttggtctcacgccccaggacaatgctggaactgccaacgctggagccgccaacgccggagctgcgaatgccgccagtgaccctaacgccacaacagggaccacaacagcctcctctaacacggcgaaggtgacggacaccaacactgctacagccaagactggcactgcgacttcttctggcactgcgactggtacaggcaccgacactgcaactgcaactgacaagaccgcaacggatacaactgcaactggcacagcaactggtaccaccacgggtactggcactggcactgacaccacttcaacgggtacctcaacaacgggtaccacgagcagcagcagcttgtcctcttcgtccagctcttcgtcctcttcgtcttctgcatcgtcgagtgcctccaagtccacccaagagcagcaacagcctcagactcagaacaacaatgcccagcagaccaaggtacccgctgatcgcacccagacc

SEQ ID NO: 28102 - DNA, 612 bp, Sorghum bicolor
  unsure (1)..(612): unsure at all n locations
  Clone ID: 7535456
gcacgagggccaactcgatagtttaaccaaggcacgtggaaattataacaaagcatctaaagattcagaatctgccatgattgctgtaaacaaagaagtctctggtgctaaccaacctaagaaagttgctcagttacaacaaaaagctgcacaagcagccgagaaagcagctacagctgatcaagaatacaaagatacacttaaacttacaaatacaaaacagcaagacttttacatcacagaaatgccacactgcttgaatgaattccaacaatttgaagaagaacgtataactttcgctaaaactatgttaactaaatatggagacttgctattggaactcccaccagtttatcaacaaacctccgaatccgtttccaaagatgccgccaatattaatcctgcttttgataccgaaaaattcacacaagaaaataagacaggagttacaccacctcctccaatggaatatcaaccatatgaaattaatgcttctctccctaacctgnaccgttctgcttctcccaattctcctgctcgtattgcctcgcttgctcgtccagaacaagtaaaggaatgggggcttagtgcaagcgatgaatcattgtcagt

SEQ ID NO: 28103 - DNA, 224 bp, Sorghum bicolor
  Clone ID: 7535458
gcacgaggctgaagcagacggaggtggactgcgagctcctgaagcgctgctgcgagtcgctgaccgaggagaaccgccgcctgcagcgggagctgcaggagctccgcgcgctcaagtgcgccccactacgcccacaggcggcacaggcgccgccgtcgtccgcggcgcacgcggcgggcgtgccggcgccgccgcagccgttctacatgcatatgcagctgccg

SEQ ID NO: 28104 - DNA, 595 bp, Sorghum bicolor
  Clone ID: 7535461
tttggaaatatgacctcattgaaccatctagatgtgtctttcaaccaactcagtggccaaatcccagtacagggtgtgtttactaatgtaacagccttctcttttgctgataatgatgaactctgcggaggtgcccaggagttgcatttgccagcttgcccaaacaaacctttgtggcagagtcaaagaaagcatcatatcattcttaaagtagtgattccagttgcaggtgcactgctgttatttgtgaccttagcaattcttgttagaaccttgcaaaagaaatcaaaagctcaattagaagctgcaccagtgacagtagaaggttctctccaattgatggatggcgcgtatccaagagtttcctatgcagatttagcacgtggaacagatggattttctctaagcaatcggattggtacagggaggtatggatcagtgtacaaggggagcttggtgattaatgacacaacaactattgttgctgtgaaggtttttgatctccaacagtcgggctctttgagaagtttcatgtcagagtgtgaggcacttcgtaaggttcggcatcgtaacttggttagtgtcatcacttgtt

SEQ ID NO: 28105 - DNA, 508 bp, Sorghum bicolor
  Clone ID: 7535469
gcacgaggcgcattccaagacctcgcgtgtccctcgtcgacccttcgagtctgctcgtctggactcggagctgaagctcgtcggtgaatatggcctgcgcaacaagcgtgaggtctggcgagtcggtttgactctgtccaagatccgtcgtgctgcccgtcagcttcttaccctcgacgagaaggaccccaagcgacttttcgaaggcaatgccctgattcgccgtctcgtccgtgtcggtgtcctcgacgagtcccgcatgaagctcgattacgtgctcgccctgaagattgaggatttcttggagcgccgcctgcagacctgcgtctacaagctcggccttgccaagtccatccaccacgcccgtgttctgatccgccagcgccacatccgcgtcggcaagcagatcgtcaatgttccctctttcattgtccgtctcgactcccagaagcacattgacttcgccttgacctcaccattcggcagcggccgtgctggccgtgtccgc

SEQ ID NO: 28106 - DNA, 547 bp, Sorghum bicolor
  Clone ID: 7535475
ttttttttgtagcttcttttcacctacacaaacctgggctctaggcatctcttagttgtctttaactccagtttttcgattttacgactacggcggatccaaggcaagatgtttgtgctagaactcttagcctaagacatccgacatcgccctcgcttctcgacctacacccaaagacattctgcgaggccatcaacaacattccttcattccgatctcgagacaagaaccacgccaaacgctacgaggaaccaaaaatacctcgaaactttaccgcgcgagacatcctgatcccgcctgaaacacaactttccttattgtcgtcgccatcatggcgccggcaaccgatcaactctctgcacctggtgcagtgagttatgattcaaatactcaagccgtcggagatggaacgtgggatttcgacaaaaacacatttctactccccaatttacagggccttaaccatgaaaccatgcgttacaatggcatgggaaacagattttccacacttacacaataccatggccttgtacttgcacatgccgtt

SEQ ID NO: 28107 - DNA, 606 bp, Sorghum bicolor
  unsure (1)..(606): unsure at all n locations
  Clone ID: 7535476
gcacgaggaccaaaagaactatctatctcaaaaagtgactgttctagtcaagcactggattaatgaagctcagctccaccagagaggagaacgttgacgagctcttcatcttgagccctcactgctacttcaagggccgtcatgttggccgagtcccgggcattgatgtttgctccgtgattcaccaggagttcgagagcacttgcacgtcggaagcgtacagcgatatggaggggagttgtgccggagcagtcgcgcgagttcacatttgcgcctgccttgatcagcgacaagagaatccccgtcgtttcattgcgggcagcgatgtggagtatcctagatggtctactgttgagatcgctggagttggagtcggaggtgagtgagctcgaagacgccggcggtgctcgcggctctgggttagatatccctggggctgggaccgagactgagagctgacgcgggctaagcgtgtccactagtgaaccactaaacccaggccagtcctcatcgagagaagagggccagggcagcgcggtagggtcatctagggggccgtctagtgcccagacgccanagtcttctgacgcttcggcccgtagacag

SEQ ID NO: 28108 - DNA, 505 bp, Sorghum bicolor
  Clone ID: 7535482
gcacgagggcctactaccgcgatggccacaagtgctaccccaaggacgtcggctgcggtgtctactacgccgatggccagggatgtttccccgacgagaagggcaactacctgaaggccggcgagtggtgccccaaggagcgcgagtgccacgagcgatgcattcgccccgagcatcacaccacgtcgaccgaggagtgccccaaggagaccaccaccaccgagaggcgcaccaccacgcccaaggagaccacatcgaccaagaagcactacaccacctcgaccgaggagtgccccaaggagaccaccaccaccgagaggcgcaccaccacgcccaaggagaccacgtcgaccaagaagcactacactacctcgaccgaggaatgccacatggagagcactactacgcccaaggagaccaccacgacgcgcaaggagaccaccactacgcccatagagaccaccaccacggagaggcgcaccactcgcaagcacaccacgacaga

SEQ ID NO: 28109 - DNA, 464 bp, Sorghum bicolor
  Clone ID: 7535483
gcacgaggcgcagtccgcactgccgcctcgccatggaggcagcagcagccaccgccgccgccttgtcccctccccgcgtcgctctcgacgcccgcacactcttctccccgccccgctccctccccgcctcgccctcatcccagctccgcctcgccgcccgcccccgcgcgctcgccgctgccaagccgaggttcctgagcccccaccgagaacccgccgtagatggcggccgcggcgccagggatgtcgtcgcgatggtggtgccgttcctgagggggaccgcgtgggagcagccaccgccggatttggcctcgttcctctacaaaaaccggatcgtgtacctggggatgtgcctcgtgccgtcggtcacggagctcatgctcgccgagttcctctacctccagtacgacgacgccgagaagccaatctacctgtacatcaactgcactggcaccaccaagaat

SEQ ID NO: 28110 - DNA, 567 bp, Sorghum bicolor
  Clone ID: 7535487
tttacattcatcttgaatgttcatagtatgcattcatgaggcattcattctctggttctgtgaagaaacagccttgcaattgcaatactaatgtcctcataacagttattccaattcattaattcctactatcgctgccagaaagattccgtgtcatcatggcttagtgatgtcctgtcattgtcttatctggtaatacgttgcgtgattctacattttgtactaccctcctggccgcattaaaaaaaaaaagctgttcttttgcaacctctataggtgatggacaataggcaattaggcagcacctcttgtttaatagtctgtctacaaattaacataatgtggtggcacttggccagcccttctgcataatgtaaattctgcagtggttatgtaatattctaggatcctttcgtattgtttgtgtcattgtgtagacatcttcgtttttcttgtgatgctttgcacctggtggaatgttggctaacatttttttgactttgtctaccatttccctaagatataatgcttatttttgttggcattttgtcaaattatgttctttgt

SEQ ID NO: 28111 - DNA, 607 bp, Sorghum bicolor
  Clone ID: 7535489
gcacgaggccctcctgcatcatctttctttctgttttactgctttctgcgttgatcagtttctagaacatcaggagcatcagtttcaccagataaaacaccatgtcctactatccaggccaagggtacaacggaggaggaggaggctatggatacggtcctccgcaaggccatcctcccccccagcaatattattctggacctcctccccagcagcagcgttcgtacggtcctccttctggacctcctcagcatcattacggtcctccgccggggcctcctccgaaccattatggtcctcctcagcaacattatggacctcccggcggtcctcctcctccgacaaactacgatgcgtacggctttcctcttccacaaggtcgacaccaccatgcccaacacgctcgatccggaccacctccccccgatgttcctcagcagttcggccacggtgcccccgaaggctacactttccagtactccagatgtaccggtcgtcgcaaggcgcttctcatcggtatcaactattttggccaagaaggcgagctgcgtggatgtatcaacgatgtacacaacatctcggccttcttggtggagcgctacaacta

SEQ ID NO: 28112 - DNA, 498 bp, Sorghum bicolor
  Clone ID: 7535496
gcacgagggcctccccttccccttcctctccctctctacctctctcctctcgatgtggtggcgtaccggccgagcccggccgcagttgcctacacgcaggatggctgccgcagtgctgctccctcccgaggtgtttgcgttacagccaccacggcggcctccggcggcggccgtgccgatggtgacccccacgggtcgtgcgccggtcatcggccaattgaaggtctcagttcatctttatggaagtgctagggtcttctgatatgcatacactcttttcatgtatgcggcaattttggaaagggttcatactatctgaattgagagtgagtcgttcatctgaaagggtaaaagtttgcctcaatattaatatttacacatttagctgctcttataatctctatttaattttatcaaatttacttccatggttccatctattgcgctacagatacatgaaagctaatgcttatgtatttttttgtgctcctaacctgg

SEQ ID NO: 28113 - DNA, 605 bp, Sorghum bicolor
  Clone ID: 7535498
gcacgagggccacctttaatttcctcctctgctgctgctactagtttagcaagcttgctcagccacctttttggacgctcgctgctcccgacaagaccgccctccatcctgctgccatcacagatcgggatctcgcgggggggctgcgattcattcgccaatcgccaggtgcgttcttgctcatccttgactcactgactccatgcctgcaggtctgtaaccttaattctcccgtctatgtcatggtcagctctcgtcggctcgtgagcttctttgtttgtttcagttccttctggtagtggattggatggttgtgctattgattagctacttgaaaatctttttggtaacttggagtcctcggcccgttatgttggctagaaccgtccgggttctagttttgattatgttagctgagtctagctacttggttctgtggaaagaatgaatagctttgaattccctgacatctttagtccaattcccatgctccctggcgttgtccttacagaaaacttctgatgtgttcgttaggtactacttcctgttcaagtattcatgtggcatgattggtgcgcgtttgtttgaatttatgctttccaata

SEQ ID NO: 28114 - DNA, 532 bp, Sorghum bicolor
  Clone ID: 7535503
gcacgagggcgacatcaaaccagagaacatctttctcacgcagtctggcctgatgaagcttggtgactttgggcttgctactactgatgcttggtcttgggagatcgctgttggtagtgatcgatacatggctccagaacagtacgatccgaccagcgctggttactccaccgccaaggcagacatctgggctatcggtatttgcctgttgaatgtcttgttctcgcgcaatccgttcgctgttcccgccgagtcagaccctctctatgccgattttgctcttgaccgtcagagcttgttcgacgtcttccccaacatgtctcaggacacctttgaagtcctgatgcattgcctggccatcgatcctgagaagcgtgatcttacgtctgtcaaggatgcgcttgctcgtgtcatcagcttcaccatcgacgatgaaactctcgacgacttctgcactgaggagcgtgatagcgtcgttgccagtgccaatcgcgagcccctccgtacgccttccatatctactcctcagctc

SEQ ID NO: 28115 - DNA, 491 bp, Sorghum bicolor
  Clone ID: 7535510
gcacgagggacgagttccagccacggcttctctatatgctgagggactgcgcctcctgtcgcttatccctcccgtccgacgctggcaattcgacgttttgcgatcctctgtcggataatcagtctccttccatccggaagcgcaagctccgctggattttgtctgcttttaatgaggtaactagactggggatcgccggaggacggcttcgccgacgccgtgtaaaggcgcctcttttatatgggggactgggggtttctggaacgaagcgcaaagaagcccccattgcttcgctcgccgcctgcgctgcccgtcctttcaagtgctcatctggggcagcggcggcggcggcggcgatggaggtgcggagtgactgggcatcactccccccggaactgacggaactcatcgcggcccgcgtactggcggcgaacatggtggattacatgtccatgcgcgccgtgtgcgcgtgctggcgtgcttccacggcc

SEQ ID NO: 28116 - DNA, 486 bp, Sorghum bicolor
  Clone ID: 7535514
gcacgagggcgccgccgccccggcgttcgcgatggcgcagtgccgcccgtacgtcgcgggccgtgactgtgtcgcctgcttcgacgcggccgccgcgcgcctccgcgcctcctgcagcgccgccgccaacggcgggcgcgccatcctcgacggctgcatgctccggtacgagagcgcggccttcttcgaccagtccacgctcccgggcaacacgcaggtctgcaacggctccgccgtggaagccggcggcttcgcggacgcggcgcgggcgctggttgccgacctcgcggcggcggtgcctcgcgtccctgggctcgccgcggcggccgcgagcggcggcgtgtacgcggcggcgcagtgcgtggagacggtcggggaaggcggttgcgcgcagtgcctcaacgtggcggtggcgaacatcgatgggtgcccacccaactccgacggccgtgccgtggacgccggttgcttcatgagatactctga

SEQ ID NO: 28117 - DNA, 545 bp, Sorghum bicolor
  Clone ID: 7535523
tgcaaatgttcagtttcttgctttgacgctattagagactctaataaagaactgtggggatcatgtacattttcaagttgtagagcgcaatatactggaggaaatgatcaagattgtgaagaaaaaggcggatatgcaagtgagggataagatcctgatgctcctggactcttggcaagaagcatttggagggcctggtggaaagcaccctcattattactgggcatatgctgaattgaagcgatctggtgtcgaatttccaaagcgttcacctgatgctgcaccaatatttactcctccggtcacacgaccagagtctttgccatcatatcttcaagcagggtatggaatgccagttgattcttcctcaaggcttgatgaggcaatgtcatcaaatggagcttctctgagcatctcagacttggaacgaatgctgggggctgtggaactattaaatgagatgttgagagctgtcaatccaaatgataaagacgctgccaatgatgaaattattacagaacttgtggcccaatgccggtcatacc

SEQ ID NO: 28118 - DNA, 481 bp, Sorghum bicolor
  unsure (1)..(481): unsure at all n locations
  Clone ID: 7535525
gcacgaggagttggatcacctgtagtcttggtatccactaatgttcgtacgttttctgcaatggaaagaaagctgcaggattggaggggatagagggggattaatcccctacaagtcaaaaccccccatcaaacccctccaatcactttgattttgggatcaaacgaacaagggagactggtttccctttgcaagttcaatggagtaaaaagctctgcttatttgactgttcctttccagtgaatattctgacctcctctctcataatttaaaatatgttcaatatctttctttgctgttgctttttctcacgaaaggcatacggcgggtgtcattaggcatcatttaaaatattcttgatggttttgtctggtgaactgaaaccaagttccattttgcttgttgggattgagatgaacctanaatattgttgtcctatatttaatattgttgtcctatatttaatatggtctgtctctaa

SEQ ID NO: 28119 - DNA, 514 bp, Sorghum bicolor
  Clone ID: 7535527
gcacgaggcccaccgacattgagcctgtcgccaatttaggcctcagtcttgcaagctccctgcaagtacagtcagaaggtaacagaagagccagacaaaggcttcccaagctaatcaatctgatcaactcaactgcattgacgttgaaaaaagttgatgatcttgttcaagaaaatgcagatgtcttcacaaagccatgcctggacgacatcaccagcctgacagtcacgtgtgaaaagatctacagcggcactttgatgatgctggtacgtcagacagagaatattgtcggcgacaaggagatcaatgagatcccgcgggaggaaacgggaaagtatctgcattgcatcgctcacaccactgtctggcgttatgagtcttgggagttactcgaggttcagctcaggtactttcggcaccggttgacgcaactcaagtttgaactgacgctgcgctatcttttgggctgtatcgcgcagcaccagatgcgggcacagacccgagccccaggtag

SEQ ID NO: 28120 - DNA, 468 bp, Sorghum bicolor
  Clone ID: 7535528
gcacgagggttacacactacacagacactccagtccacaagttccgacagccgccgccaacatgagcaacattcccaccgagcaatgggcgcaggttattgagaagaccggcggtcctgtcgagtacaagaagattccagtccagaagcctggcccagatgaggttctcgtcaacatcaagtactctggcgtctgccacactgaccttcacgccgtcaatggcgactggcctctgcccaccaagcttcctctggtcggtggccacgagggtgccggtgtcgtcgtagcacgcggagagctagtcaaagatgttgagattggcgactatgccggtgtcaagtggttgaacggctcttgcttgtcctgtgactactgccaaacagcagacgagcccctctgcccaacaccacttctctctggatacactgtcgacggtaccttccagcaatactgtatcgccaaggctgc

SEQ ID NO: 28121 - DNA, 611 bp, Sorghum bicolor
  Clone ID: 7535533
gcacgagggcagcccggagcgcgcagccggatctgcagggagccgacgactccttgaactgcgcgggcaagaggcggcggaggaggaagaggagcggtggtcgttcttggcgctgctctttgaactgctgcggaagtcgctgctcgggtgcagaacggtgagcggcggcagcggcgaaggcgaacacggcggctgcgggatggagattgggttgcccacggacgtgcagcacgtggcgcacgtcacgttcgataggttccatggattcctggggctgcccgttgaattcgagcctgaagtgccccgccgtgctcccagtgcgagtgcaagtgtcttcggtgtttcaacagaatcaatgcagtgttcctatgattccagaggaaacagtgtcccaacaatcctcttgatgatgcagagacgcctttatgaacagggtggtcttcaggcagaaggtatcttccgtataaatgcagagaatagccaggaggagtttgtgagagaccaattaaatagtggaattgttccagatggcattgatgtccactgtttggcaggtctaataaaagcctggtttagagaaatgccaaggggggtactggactctatcccac

SEQ ID NO: 28122 - DNA, 579 bp, Sorghum bicolor
  Clone ID: 7535536
gcacgaggctaacgcgacgctgtcgtgcacccgtgccctgagcacttcgtcggttctccgcgactcgtcttcgggcaccaccttccacagccccttcaagggccagagcaaggccagcaagatcccggactttagccactatatgtccaagaactccaagaacagcaacatcttgttctcgtacttcatggttggtaccatgggcgccatcacggctgccggtgccaagtccactgtgcaggagttccttgtcaacatgtccgcctcggctgatgtccttgccatggccaaggttgaggtcgaccttgccaccatccccgagggcaagaacgtcatcatcaagtggcgtggcaagcccgttttcatccgtcaccgtacttcggacgagatcgacgaggcgaacaaggtcaacgttgcttcattaagagatccccaggccgatgaggaccgtgtcaagaagcctgagtggctggtcatgcttggcgtttgcacgcacttgggttgtgtgcctattggtgaggctggcgacttcggcggatggttctgcccttgccacggttcccactacgacatttctgg

SEQ ID NO: 28123 - DNA, 547 bp, Sorghum bicolor
  Clone ID: 7535558
gcacgaggctcaacaaggttctgtggttcttgatgcaaactggcgttggactcacgataccaagagcaccaccaactgctacgatggcaacacctggagctcaaccttgtgccccgacgatgcgacttgtgccaagaactgttgtttggatggagccaactactcgggcacttacggagtcaccaccagcggcgacgctctcacccttcaatttgttactgcgtcgaatgtcggctcccgtctttacttgatggcaaatgattctacctaccaggagttcacgctctctggcaatgagttctcctttgacgttgatgtttcccaactgccttgtggcttgaacggagcgctgtacttcgtttccatggacgccgatggtggccagagcaagtaccccggcaatgctgctggtgccaaatacggcacaggttactgtgacagccagtgccctcgtgacctgaagttcatcaacggtcaggccaacgttgagggttgggagccatcttccaacaacgccaacactggtgttggtggccacggaagctgc

SEQ ID NO: 28124 - DNA, 551 bp, Sorghum bicolor
  Clone ID: 7535560
gcacgaggggcaaatctgagttccacactcgcaccctactccctgattgagagctcccacaagcagtggacctatccatcatccactcgaccgctcgaacagacaccagtgtgccacagttagtcatctgaaagctccttctgccagtattcatggaaagacttgtaacctccaatgatgactgcgtcaagattctcaaacagtggacgaaacacagctactctcaatccctcggttcacactccagttcccagaatccccaccagtgtgaacattgtcgaaaagcgattgtgaccttcaaacctgttaacggaaaagaactcaggtcgtctccgcttccatacgagattggaaccgtcaagtttactctcctacaggtggttcgcgcagctcttgacaaatgccagctgcattgctacttgcttgaccttttgagtgaaaaagaggacgaggttaggtcggatattggacggatcgatcatgaagtaaagatgacggtgcagctcaagagttactacaactcaattctaatacccaacgcctacataggt

SEQ ID NO: 28125 - DNA, 504 bp, Sorghum bicolor
  Clone ID: 7535561
gcacgaggcttccttgggggtctcgtctaccgcaacgacatcgagggtctggtcggacgcgagttctgcaaccctgtcaacatcacggacgcctccaagggtcagatctgcgccgctcagcaggcaaccaacgtcgaccctcaggatcccaaccacagcgtcagcggcggcaacctgcagctgttcagcaccttccaccccgacgaggccacggtcgccggcaccagccatgcccctggccggtaccagaacatgggcggcttcgtcgaggagcactcgcgtgtgtacaagacgacagactcggccaagctgcacgaggtgattgactactatccgcccgagcacatccccgtcttctcggcgctggtcgagaactttttgctctttgaccactggttcgcctctgtgccagggccgaccaacccgaaccgtgcgtacctgacgtccggcaccagtgccggtcatggcagcaacgataacgctttcaacgtgtacggactcaag

SEQ ID NO: 28126 - DNA, 672 bp, Sorghum bicolor
  Clone ID: 7535565
gcacgaggatgaaagggaagatcatagttttgctttatttcagcaagatatagtactaaaaaaaatattgtacagtactataaagtcttgtttagtttcaaaaagtttttgatttagctactatagtatttttgttttatttagtaattaatattcactcgtagattaattaagtttaaaagattcgtctcgcaatttacagacaaactgtgtaattagtttttttgtctaatatttaatgttccgtgcacatgtccaaagatttgatatgatggataaaaatattttgagtgtggaactaacaaggcataacaattaccaatgtgtccatgattggaaaactcacacagtagtacttcgagcctgttcgtttttcttttcggccgtactttttctgttagctatgagtgtttttctcttacaataaattagtcaatagtaattcaaaccagcgaacagtaagtgtagtgaaccttagtgcatcctaaaacagtgtgtacaaatcgataatatttggatacatgtataaagtattaaatgtacactacttacaaaactaaaaacatagatagagaataatttgcgagacgattttttaaatttaattagtctatggttaaacactaattgatgtaattacaaatcctatagtatgtattaaactttagtgcc

SEQ ID NO: 28127 - DNA, 581 bp, Sorghum bicolor
  unsure (1)..(581): unsure at all n locations
  Clone ID: 7535569
gcacgaggcttcgctcaatctcgctctcctcatcattcgcgtgggatcctcaatgtcttatcccgccgaggaacgggcgctcctctggttgccaaaaccctagctacctatatgcgtgctacaaattggttacatgcttgttacctcctctgatctggtttcgttattgtttttcaggattgatttcagcttgttttctttccttcctcgtctatgattgttcaggtacaaagaaagggagtttcagcatgttcaagacaacatgtgtataattcctgttatttcctatggctgattccacagtttggttgaggtacattactgtgattacagacaattttagagatccattaattactgcgattacatagaattttagagattcaactttacttagaaaatacaaatttatgcaatagatagtacaatggcctaattggaattatttttgcacaaaatgaccaatangagatggctgtccaccttaatccggttgccatcaagtagccgggggggggaataaaaaaaactctacataattagttgttaagaacgtctaattcaataccgaaaatattcag

SEQ ID NO: 28128 - DNA, 574 bp, Sorghum bicolor
  Clone ID: 7535571
gcacgaggaatcgagaggactcgagggagattccgccaggccatcgccgggctcagatgccgccgccgcagtcgggcatggccctctgccgccttcccacggccaccgttggccttccgctttctctcccctgtttgctatctcggccccgcatgtccctcgccgcacgtcgcgccagggccgtcgccgccagggcctcctcctcctcctcctcctctccatcaccggactcttccttcggttcgcggatggaggattccgtcaagaagacggtggccgacaaccccgttgtcatctactccaagtcatggtgctcatattccatggaggtgaaggcgctcttcaagcggatcggtgtgcagccccacgtcatcgagctcgaccatctcggtgctcaaggaccacaactacaaaaggtattagagaggctgactggacagactactgttcctaatgttttcatcggtggaaagcatgttggtggctgtacagatactgtgaagctgtatcgcaagggggagctagctagcatgctatcggacttggatatcaacattaacaactcatgacaagt

SEQ ID NO: 28129 - DNA, 606 bp, Sorghum bicolor
  Clone ID: 7535582
cggagatgaaggcgaggagcaggcctaccgtcgtcagctacaccgcgtgcgttaagattctgttcgacgccgggagggcagaggaggcgcgtagggtgtttagagagatggtggctgaagggctgcgccccacctgcaagacctacacggtgctcatcgagcatctcgccgacacaggcaaatttgaagctactctagagattatggacaagatgaaagaagcatgtgtacaaccagataaagcactctgcaatattttagtacagaaatgttccagggctggtgaaacatcagttcttacttgcattcttcagtacatgaaggagcatttcattgttcttcgtcgacctatttttttggaagcactagaagctctaaaagctagtggtgatagtgatgaacttcttcgggaagtaaaccctcacctttcatatgaaggcattgagaatgatccaatattgtctgatcaaggctatcttactgatagaagtattattatctaccttaagtctgcaaacaaatggtctgctatagaacaaatggttagccaaatggccccaaagaatgtgaaaatggagacccatatcctgtctgatgttattgagg

SEQ ID NO: 28130 - DNA, 580 bp, Sorghum bicolor
  Clone ID: 7535591
gcacgaggctggaaaggtcccaccctgcaaagtcctcgtcatcggcgccggcgtcgctggtctcagcgctatcgccactgcccgacgtctcggtgcgatcgttcgcggtttcgacacgcgttccgcagcccgcgagcaggtgcagtcgctgggtggagaattcatcgaggtcgagatcgaagaggatggctctggagcaggcggctacgcgaaggagatgagcccggccttcatcgaggcggagatgaaactcttcatggagcaagcaaaggaagtggacatcatcattaccacggcactcattcctggcaaaccggcacccaaactgatcaccaacgcgatggtcgcagcaatgaaaccaggctcagtcatcgtcgatctcgcagctgaagcaggcgggaacgtcgaagccaccgtccccggcgagctgcatgtgcaccgtggcgtgaccatcatcggatacaccgacctgcccagtcgcctgcccacacagtcctcaacgctttactcgaacaacgtcaccaagttccttctatcgatgaccccgccgaaccaaactggccggttctatctcgatctg

SEQ ID NO: 28131 - DNA, 499 bp, Sorghum bicolor
  Clone ID: 7535596
gcacgaggcaaaaggctcctttcgaatatgcatatgcgctgtacaagacgggggacgcagcaaatgccgtgaaggttgcacaggcccaaggcccccaggggggtcgcggaactaaacatgtactggcccaggctgcataccgatcggagagcttcgcgcaagccatgaatatatatcggcaacttgcaagccaaggcattgacgatgaagaatacgacatccggatcaattctggtgcagtagatgctcaattggaatgggatggtcaaggtgagcttgcacagaagaagaagccgacaagagaagatctcgaggtgtttgagacagcctacaatgcagcttgtgggagtatagcgaggggtgaactggcgcagggtgaggtttgcttgaaaagagctatcactctttgtaatgcgctcgaggacctgtccgacgaggagaaggcagctgagatcatgcctatgacagtacagcacatctacattctaacgcagctggg

SEQ ID NO: 28132 - DNA, 554 bp, Sorghum bicolor
  Clone ID: 7535601
gcacgaggcatcgttttttccccaatgcccttcccttctcccttgctatccttgtttctctctctttaaattacctttgaacccttactcatattccatgtgcggacaagcaacaattgttatttggggattgttgtggtgaacgtaaaatggaagaaacaattaatccaaaaccagtgcaaagtttacgagaccatataaagaagctttttcagtcaaggcatggaatttatggtgaaaatggatttgatattgaatttagttatatagagaggaagactgaaaaggatctttattttggggactacaaaagtgctatccaaccatgcaatcatacaaaaaatagatactccaatgtcttaccacttgagaagacacgggtaattatatcaaaagatgaagatggttctgattatattaatgcaagctatatcaatggccaagtccctggcagtgagaaagcgtacatttgtactcaaggtccaacaaagaacactgtagatgatttttggaggatggtatgggaacaaaattcaacagtaatagttatgctc

SEQ ID NO: 28133 - DNA, 622 bp, Sorghum bicolor
  Clone ID: 7535602
cgactttaaagaggacgaattccacaaggcatttgatgatcttcttggtactctaaatatcaccgagcccttcttcttagttgtccagggctttcttgttggttcttatgggctgacatgggcactgaataactcaagcaaagtccttaagttagcaatccttaacagtccacttacagtttcttctccagtccctggattgtttcagcagctaaagtcagttatttcttcttatcttggctccttactattagtaggcattaattagctagtacatgaaaaatggaatctcctcacccacccaacctctactagcacatgaaaattccacttacaataaaattaagtaaccaaacacaatcttaccaaacacagcttgcatgtgcagcagggcaatcaaccctaacacactatatactcgtttgggttttcctgcataggacctagtgcaagcaaacctatcacaccctatatgactacacactaacaatgagcacaccacatcagcactaggactagtgccaaaaaaaatacaccctagcaaatgagcgcaccacatgagctaaaccatataatgggttaaatcagcagctcactaaacctttcatttcgcaccacaagt

SEQ ID NO: 28134 - DNA, 294 bp, Sorghum bicolor
  Clone ID: 7535603
gctaatcctcttcttctcagatcttattagagcttgtcgcacgcggccgtgccgcagccatctcctctcctcctcctcctcctcctcctcctcctcgtccacacaggccccggcgccagcggtgaccggccggtgagtcgacgcgagggtacggtatggatgagcaaagtagcggcggcggtgaggcggcggcgaaggtgccactgctggagccacgggcggcggcggcggcggaggaggaggagcaccaccaccaccacaacggggcaggaggaggaggaggaggggcggcgg

SEQ ID NO: 28135 - DNA, 432 bp, Sorghum bicolor
  Clone ID: 7535606
gcacgaggaaagtgttactttgcaaagcataaacttgtgtgggaagttctggaaggtggccttaagagtaagatagaaattcaatggtcagatattactgctttgaaggcaacttgccctgaaaatggccaaggaaccttggatgtggcgttggccagaccacctcttttctttaaagagacagatccacagccaagaaaacacacactgtggcaggctacctcagatttcactggtggtcaagcgagtatgcacaggcggcattttctgcagtgcccttcaaccttgttgagcaagaattttgagaagcttattcagtgtgatcagcggctatatcaattgagccaacaaccagagatcgcattacagactgcagcgtttgaacctaggtgctcaatatttgacgatccggttgaatcaaaatgtgctgcg

SEQ ID NO: 28136 - DNA, 498 bp, Sorghum bicolor
  Clone ID: 7535611
gcacgaggcagatacccagaaacccacggaatatctcacaactctcggacgatatacccttcgtgatctcctccttgcaaacctccagtcatcttcaacaatcactgcaacgaccgcccttcagcttctgaggaccattatcatcaaacatccacagctcgcatcggagcgcctaattatagggttcacagataccaccacaaggagttggtctgaccacaaggatacgataacgtctgatgaccccgatcaagaacaaccggaatctacatattcgactcatgagcgggaaatgggtctctacttcacccttatcacccgtgtagacccttctcatagtggggacgcctttagcaccggttataatcgatacctctgcgatgcattatcatcgacccagagccagctcgccactcgtcaggacctcgtaggcacggccaaacatcgactgagcttaagtgatcctgttttaacacttctactcgattcacttcgaca

SEQ ID NO: 28137 - DNA, 550 bp, Sorghum bicolor
  unsure (1)..(550): unsure at all n locations
  Clone ID: 7535613
tcgctgatcgaggcttcctacatcgaccagggccagtggggtggcaagaagctcgacatcaacatctcctacgtcaacggtttctccctgcccatcacctgctcttgcgacgctggtgtcattggtggctgcaacaagtacctctgggaccttaacaagtgccccaacgacaacggtgttggctcgtgcaagaacccccagcgcgtcaacgacaacggccctgccagccagttctttgccccctgcgctcacgctgcctacacctaccccaaggacgacggtgccaacactggtaacggtgtctgcggcggcagcctcatcacttgctgcgtcggcacttcgtgccccaagaacccccgccagccgtaaatggtggctactgcttcaggcggcactatcatgatgaattgtgctacatgcacatagcagctgctggagaatgatgttatgctctctttcttatccttcggtttgccaatctggcattcattntacccttctctgttgatacttggtcaccgtatatagctgtgcaaactgtccatatttt

SEQ ID NO: 28138 - DNA, 565 bp, Sorghum bicolor
  Clone ID: 7535614
gcacgaggaaggcctcacaaagcatctcggccgcggccgcgaggtcgaagtcatcgacctcgacaagtcagaaagtcgcccgccgctgggtacacatgcccagcaaccgcatcattcgcaaggccaagcccagcctttttaagcgctcgatgcgcaagatcctcatggacgcttttctccccgttggatacccacattctgtctcgggtgattacctcgcctatcaattcttcgactctctgcaggccttcttctccaccatcaccgctctcctcgcaaacagagccctcctccaggtctcggcgtcggagatgccaactcgtcggccacctttgccatgcttctcactgtcctcaaggatgccatgtctcgcgtcgccaccatcattttcgcccagcagtttggtcttcggatcgagcctgatgctaagcggtaccgtttcctggctgatctgttcaacgacacggccttctttctcgagctctacagcccttactttggtccctacggcaagatcttggccctcacttctggtgaagctcttcgcgccctctgtggtgttgcg

SEQ ID NO: 28139 - DNA, 320 bp, Sorghum bicolor
  Clone ID: 7535636
gcacgagggcctaccccgatgcaggccttggcgcgcgcctcctcctcggccaccttcaagagggtggttgcgggattctcgggcacggtcacgcggtcgtaccgcacgtgcagggggaagccacatgtggcgccgctgtccacgctggagccgccacccaaggggccgaaaagagttgcaaagcaggagaggaggattatgatagtggaatttgttcaaaagtacagggcatcaaatgaaggcaagtttccctctataacatatgttcgtcagcaacttggaggctcccactacacagtgcgggagataattcaggaatt

SEQ ID NO: 28140 - DNA, 634 bp, Sorghum bicolor
  Clone ID: 7535646
gcacgaggcttaactgggtatgatctgaatgttgatttgctagatgtccatgcagacaaaagcacatttcatcgttttgacaaattcaacctaaaatataatccatgtggccaaagtaggctcagagaaattttcctcaaacaagacaatctcattcaaggccgttttcttgccgagttgacaaagcaagttttctctgacctttctgctagcaaatatcagctggcagaatataggatttcaatctatgggaggaaacaaagtgaatgggaccaacttgcgagttggatagtgaacaatgaattgcacaatgaaaatgttgtctggctggttcagattccacgcttatataacgtgtacaagggaatgggtattgttacgtcattccaaaatcttcttgacaacattttccttcctctttttgaggttactattgatccagcttcacacccgcagctccatgtcttcctgaagcaggttgtagggctggacctggttgatgatgaaagtaaaccagaaaggcgtccaacaaagcaccacatgcctacacctgaacagtggaccaatgtgttcaaccctgcattttcatattatgcatactactgctatgctaacttattcaccctaaacaagc

SEQ ID NO: 28141 - DNA, 533 bp, Sorghum bicolor
  Clone ID: 7535647
gcacgagggatggcagaaagctacaaagctgctacagaagaattggctgatgtcagagagcttatcccagagttcatgtatcttccagatttcctgatcaatgccgataaattggactttggcaagcaacaaactggcaacagagtaagtcatgttgaaatgcctctttggagcaagaaaagtccgcatcgatttattgccatgcagcgtctagcattagaatcggagatggtgtcccgtagtctccacaattggattgatttgatctttggttacaagcagagaggcaaagaagctgagaaagccatgaatgtattcttctatttgacctatgaagacgctgttgatcttgattctatcaaagatgccggtttacaaaaatcattggaaactcaagcgattcatttcggacagactccatctcagctatttactaaacctcatccacaaagacctcctctagattattcgtggggttcatctcgactaatcgcagatccttcagcagaactgagagtttttagaccaagcac

SEQ ID NO: 28142 - DNA, 578 bp, Sorghum bicolor
  Clone ID: 7535648
gcacgaggcctcgtgccgaattcggcacgaggaagtgagagcgtgactagaaagcgggggagcaagcagcgcagcgcagagcgccgggccgccggctaagcgggaggcgaaggcgaggatgatggggtcgggccggtggcagtctccggctggcgctcctgcggccgccgatgccgcggaggaggacaccggcggcgtcgggggcccgtccaggcggccgctgcgccacgggttgcaccgcgcgtcgccctacgggggtggcctccgccgccggctgctcaagccccccgtggcttcgaggatattccccaccatgccacgcgaccgcgccgcctccgataatgatcaagaggttcatcgtgaatcactggaagttattcaggaaagacactccacacaaccaaacatcaatgctgcagccatcctaccaccaagatctgttagcaatacattcaatctgcttctggaaggtgacaggaatccaagtcatggtaatgggcttgctgacattgagaacataatcaaccagagctatttttctagggatgagacactacgtcttatagagatcatacggt

SEQ ID NO: 28143 - DNA, 577 bp, Sorghum bicolor
  Clone ID: 7535652
gcacgaggcctcaacgccgccggccggctgggagaacaagcaaaaaattgcatttcctcagagctctcaggagatcagttctcgccgtttcccagatctccagcagcaaagatatttatgcttgaaccttgacgactgcgtctccagtctattctcctcatctaaaccagatgacatggcaccactagtagtttcatactactagtagttttttactacagtcatctgcaaatagggccccgccgtatacttcttatgtaaatcaagtggctagattgccggacactcagctatggctgaggttattttatcacactttgcaacctctgttctccagaaggtcgcatccttgggcagaaaatgggctattaatgagatcaagtcagcctggaatgtcaagaaagaaatagggaagctagaaaggtcactaaggtccatttgtgctgttcttcaagatgccgagggaaggcagtcctgtcctcatgcccttcaagagtggctggacaatttgaaggatgcaatatatgacatagatgatgttttggatgatgtggctactagagacctggagcagaaa

SEQ ID NO: 28144 - DNA, 519 bp, Sorghum bicolor
  unsure (1)..(519): unsure at all n locations
  Clone ID: 7535653
gcacgaggcgcagtcgctgctcatcaacggccgcggcaggttcgtcaactgctccgccgccgcggcggccgggatgacctgcaacgccaccctcccggagtgcgccgcgccggtgttcgccgtcgtgcctggcaagacctacaggttccgcattgccagcgtcacgtcgctgtccgcgctcaactttgagatcgagggccacgaaatgacggtggtggaggccgacgggcactacgtgaagccgttcgtggtgaagaacctcaacatctactccggcgagacctactccgtgctcatcaaggccgaccaggaccccaaccgcaactactggctcgcctccaacgtcgtcagccgcgagcccggcacccccaccggcaccgccgtcctcagctactacggcggccgcagcagcccgcggaaggcgccgccgaccacacctcccacgggtccggcctggaacgacaccacgtaccggttccggcagagcgtggcgacggtggcgcacccggcgcacgtnca

SEQ ID NO: 28145 - DNA, 406 bp, Sorghum bicolor
  Clone ID: 7535654
gcacgaggcccatcgcctacgctggtacgccctggaccctgcagtgcctcccctcccacgacgcctgcaacgacggcggcacgatccgtggcacctgtctccgtcgatctcgggtaggaaagggactccactgcctccgtcggttgcgatctatggcgcccgtctcaacacagccaccatggacatcctccgcccgccttcggccacaagcgagcgcgagatccctgcgaccccacgcgctgcaagaggggagcaaaggagtgcgcggatcctaggggagacctaaatctcatgccaccgtcgcctcagcagggtacagatcgttctccccgtgcccgtaaccgagtggaagagcgcggccctctcggcatcgatgcacgctcctccctgctgcccccccgttggt

SEQ ID NO: 28146 - DNA, 598 bp, Sorghum bicolor
  Clone ID: 7535655
gcacgagggtcgcactcgcttcgatttcttcttctaatcactcttatattttccacaatgaactatagttctgcttctctctacgtcggagacttgcacgaagaaatttctgaagctctcttgttcgaccttttccatgaagttggtccaattatttccatccgtatctgcagagatgctatgactcgtaaatctcttggatatgcctatgtaaatttccaaaatccacaagatgccgagagagctctcgataccttgaattatgctagtgtaaagggaatcccaattcgtattatgtggtcacaaagagatccatcaattcgtaaaagtggtattggaaatatcttcatcaagaacttggataaatcaattgataacaaggctctttatgatacattctctgcctttggtaatattttgtcttgcaaagtctgtcaagcaacaaagaaaggtgagattgaaagcgttgaatctgctggttatggttttgttcactttgaaacacaagaagccgctgaaaaggctattgctaagattaacggaatgttgttaaacggtaaacaagttttcgttggaccatttgtaaagaagactgaac

SEQ ID NO: 28147 - DNA, 487 bp, Sorghum bicolor
  Clone ID: 7535660
gcacgaggggattcagcacgcaacgaaatgggtagagatgttttgatcttctcagaagcccatgagagtctgtacgatgacgttttaaccaagttctactccaagaaacaaggggactccaagttcaagttgaacccgaaaaagagtgacggcttgtcgggcaaggtcgagaagaaggagggatacgtcccgcacgaagaattgaagtaccctcttgagagaaatggtatgcccaatctcgactatgatcgatcggtcagcgtctactacgatatgccttccgtttcacaaacacacaagtcgatgctgcttcgtggggttcagcttccaaagcctgctctcacacaaagcgacattcaagatatccgaaacaaagccaaccgtggaggcaggaatggcggcttcggacgagggggccacaatcgaggtggctacaatggccctggtatgtcgcgtgggcctcagcatgacaggcaccaaggaggat

SEQ ID NO: 28148 - DNA, 424 bp, Sorghum bicolor
  unsure (1)..(424): unsure at all n locations
  Clone ID: 7535667
gcacgaggccacatagtccctccaccccccgactaagtacgaagcttctcctcttgttgtctctattataatggcctcgcccgagaagaagactgtcaagtgcgtcgttgttggcgacggtgcggtcggcaagacttgcatgctgatcagctacacaaggaatgagttccccacggactacgttccgactgtgttcgacaattatgaggccaccgtgctggttgagggcaaggaggtcatcttctctctttgggatactgctggtcaggaggcttatgccaggatcaggaccctcagctaccagaagaccgacattttcctgctgtgcttctccgttgctgctcgcacctctttcggcaacgttactgagacttgggtccctgagttgaagcaccactgccccaaggcgccaatcatcctgntc

SEQ ID NO: 28149 - DNA, 528 bp, Sorghum bicolor
  Clone ID: 7535668
ttcaaggtggcaatttggtctcgagccaacacaggaggaagcttaggtgtcttgagctatgccctgctaatgatcagctcgttgttaccagtgcgctggatggattggttactttatggcaagtggagacaagaggaccttctctctcatttcgtggcaaaacagatttcttttctccaaagcatagatggcctgaagatatagcttggcatccagatggcgagacgatttttgctgtatacactgctgataatgacgattctcaggtttcaatgacaaaccttatatcaggacaaaggaaagttactttcctaccggagaagcctcacacaaaaggaatcataaataacataagtttcatgccctggtctgatgcatgcttcgttactggaggaagtgaccatgctattatactttgggaggacaaagatgattcatggaaacccaagagagtgcataaggatttccattcttctgctgtcatgggtgttgctggattgcaacagaaaaaaaacaatattatcagtt

SEQ ID NO: 28150 - DNA, 468 bp, Sorghum bicolor
  Clone ID: 7535676
gcacgagggtcacccacacaaccgacaaaatggccaacccacgcattgaagagatccccgacgagcccgagaagaagaacgcccagatcgaggaggatgactccagcgacgagtctgaggctgaggagggcgaggtcaacgtccccgcgggctcctcggtcgctgtccactctcgcaacgagaagaaggctcgcaaggccattgccaagctcggactgaagcacattgagggcatcacccgcgttactctgcgccgaccaaagaacatcctgttcgtcatcaaccagcccgacgtctacaagtctccttcaagcaacacctggatcatcttcggtgaggccaagatcgaggacttgaactctcaggctcaagcctccgccgctcagcagctcgctcaggccgaggctcaatcccacgaccacgctggccacgaccacggtgacgagtccggcaagggcaaggctgtcg

SEQ ID NO: 28151 - DNA, 475 bp, Sorghum bicolor
  Clone ID: 7535677
gcacgaggttctcaaccacctcttgatctcttgcaagcagctcataactccaaagcttgtgcagcagctcagtcagatgggcaaggaggtggacgtgtccactctggaggccggcggtgtccgtgactatgcggaccctccgccggcgccgctgattgacatcgacgagctcggcaagtggtccctgtaccgcgccgtgatcgccgagttcgtggccacgctgctgtttctgtacattacggtggccacagtgatcgggtacaagcaccagactgacgcgacggcgtcgggcgccgacgcggcgtgcggcggcgtgggcatcctcggcatcgcgtgggcgttcggcggcatgatcttcatcctcgtctactgcaccgccggcatctccggtggccacattaatccggcagtcacgttcggcctcttcctggcgcggaaggtgtccctggtgcgcgcgatcctgtacatggccgcg

SEQ ID NO: 28152 - DNA, 537 bp, Sorghum bicolor
  unsure (1)..(537): unsure at all n locations
  Clone ID: 7535678
gcacgagggttgccacctgaaattctccaagaaatcgcgtcgtacctccacgacggctatgagcgacatcacttcggtggatacgaccctcctctaggccaacacgagatagcagggaacaagcgccgctcgtacctagcatctctacgtgccgtaaatcttctgttctacgatctcgtcacacctattcttttccagcacgccatcatctactctggcagtgtcataaaaagatggggcgtgaccgccgtgaccagcaacggcgttacgggtactgctcgacttgtgaaactgtcaaagaatcctcaacttcgcgaaattgtacgccgtctggagatctgcttaaaagtaaagggtccaaatgatttccaagaatacaagcctgcgattgaggagagaaataaggacctggagtatattgcacgaatgggctccgtgatccatagcgcattgcccagattcactaatctcaagatcctgaaactcaactntgagaatattccttatagttacaatcaggaacttgatgaccctggt

SEQ ID NO: 28153 - DNA, 369 bp, Sorghum bicolor
  Clone ID: 7535679
gcacgaggaaaacaactccatcatgtccaaaaagctcatcgctgttctgggtatcaccgggacgcagggcggctctgttgccggccgatttctctctcacgcagagtggcgtgtccgcggacttacacgcaatcctggttctgcgaaagccaaagactgggcaagcaaaggcatcgagatcgtaaaaggcgactacgatgatctagagtcactcaaggctgcattccaaggagcacatgccatcttcgcagtcactgattgggccgcgtgcttctcacgtgtttcggagaacaccaatctgcaaaacgaagcgaacaaggctggtctgtcatatgaagaatacgccagggagttggaacggcagcaggg

SEQ ID NO: 28154 - DNA, 531 bp, Sorghum bicolor
  unsure (1)..(531): unsure at all n locations
  Clone ID: 7535680
gcacgaggctccacactcgcttctccctccatcaacacccaaaccgccccttctccacaccagtctcaggggattgcttgcgcctacccactccgcatcatccattaccccggggaccctcattctcacccaagcagacgcctgaagccagtttacctgtttcggtttgacagctgcatcgcacttctagcatccttacacaacatcgctcgcctgcatatcggctgcaaacatggtcggacgaaccttcaccacggccctcgccgtggctgctcttgccggctccactctcgcgcaatcgggtaacgcaaaaggcaccagggacaagccttgcccggcagattcaccatgctgtggcctgtacggcgactgcggaatcggcgccttctgcctcggtggttgcgacatcaccatgtcccactccatcaagtcttgcgttcccaatcccatgtgcaaggccggtgaatacaagatgaactctctcgacgatgtccaggatatcggaaaatacctgngtgacaactccaagat

SEQ ID NO: 28155 - DNA, 525 bp, Sorghum bicolor
  Clone ID: 7535685
gcacgaggaagaagtaaagggtggcacccttggagaccaaggcattgtcccatacgacatcatgctgttctttctctcgctcgcatacattgcgatttccgtcgatgcttccggtctgatcagatggctcgcttttaaagtgttgcaaaaaggaggaaaagtaggccacaggctgttcttctatctgtacgccttcttctttggactcacagctctcattggcaacgaccctattattctgtccggcaccgctttcttgtcttacatgactcgcgtgtcaagcaacatcaagcacccaagggcatggatcttcacccagttctccgtggccaatatcgcatcagcaattctcgtctcatcgaacccaacgaatcttgtattggcaggagcgttccagatcacctttatcaagtacacagccaacgtcatcgttccagttctggtgacgggcattgtgctatatccgtttttgctgtacatcatcttccacgacgagtctctgattccaaccactatcaagatgga

SEQ ID NO: 28156 - DNA, 129 bp, Sorghum bicolor
  Clone ID: 7535693
ttttcgaggtaactcccgaaatgggcggtcaaacaggtagtttgtggaacttaaagcggagggatggcggaaaaacgaatgagttttttagcaaaactttggagtttgatcacccgtgccaaggtacat

SEQ ID NO: 28157 - DNA, 496 bp, Sorghum bicolor
  Clone ID: 7535696
acattggaatccacagatattcatgaaagtgccatcaggttttgggctgattttggtgctcagcaatgcttttttgtagtgaaataggaacgttccatgaagacctgtggaatctgcttgctcaaagcaggactttgcatcaattgaagaaacagcaaaatcagcgtgctttgagtttgttttgctggctgtgcttcgccattaactgtggaagaatattgcagctcagcagctgaagagacccacagttggatgtttgctccagttgatcgaaacttttccatcttttgagctgccgcgggagtgggtaggtcattcacctgaagactctttggctcaatgtgttgccctggttactttgggaagaaaacagtcaaactgcacacattatgtccaatatatacggcaatgtattccccgtctgttactgcctttttgcagtagatttgcccatgtttgggccgtttacaggagctacaggtttcagtttctcccc

SEQ ID NO: 28158 - DNA, 569 bp, Sorghum bicolor
  unsure (1)..(569): unsure at all n locations
  Clone ID: 7535697
ggtaatgtctctggcgttcttgttgatctcttgttcatgagacaagaagaattcgaaagcactctggatatcattgtagttagcattaagtgcttcttggacttcactgagaacttgagtcttgaaactgtaggttccaaaggcattagtccaatcaagttcagtgagataacccttcttgtgaggatcgagatcagcaaagagaacttgcaagagcttgtcagtaagatcaaacccagccaaagctctgctcttagcaatccattcagcaaagctcttataggtcatcttgacactgtgtccagagatttcttcgaaacttgccttcaaatcaacaaagtcctttgacaacaaaagaccgagttgctgtctagcatgaatcttccagctgaaagtggaagttcccatgagttgctttccgccgctaacaacagtattatttcctttttcgaaatcatcttggatgagtctcttgaaatcgctgagttgaagagagtttctcttgaacacatcgattaacttgaaaagtctctcgactntggtagcgttgacttcatcagctggtatnc

SEQ ID NO: 28159 - DNA, 430 bp, Sorghum bicolor
  Clone ID: 7535700
ccgcgtttgtcggttgtatattcgatatcattttacactcaaagctattttacgatttttggcaatgagtatacatatcacccgctttcgtgttgaattattttgcgcgcgggggtttttgtgttttttttttttggggttttcgcgacgtctaaacctctttgcttttttttttctgggccgacgtgttatgcatgatgggggaatgatggagcgtagaagccagcgagcaaaacattattgaaccagtgcgtatgtttgtgcgtgtgtctgcatgtgtatgtggattgttcagttttggtttttttggtcaaagtggtattagtctctcatttttttatggtagacagtttgggcattgaaacgggtggagtgtaaatgttcgttaaagtagggggggagagaagccccaataaaatggtaataattt

SEQ ID NO: 28160 - DNA, 297 bp, Sorghum bicolor
  Clone ID: 7535701
ccgagtacggctacgctggcggaaatcccaaggtcaagacaccggcagagcttggcatcaagacgccctctttggaggagtttttcaggagccaggattggagtgccgtcctgaaaggagaaatgtagttcctgtcgctcaatgatccgcaacctgtgaacctccgacttattgcgaccgcaatatcatcagcactcatgtgaatgcttgtagtcacttcaaagattacctactacaaaattcaatagaattccctaatcgttaacccagcgagaacagaaatgaaagttattcccc

SEQ ID NO: 28161 - DNA, 531 bp, Sorghum bicolor
  Clone ID: 7535702
gaagaccttgaggcgtgcgaattagtatttgcgcggatcgacgagaacatgcgaaaaatacacggggataaatacgatcaagcagcggctgagaagaagagggagattctgcatcaggatattattcggaagacagggtcgcttggggagttttgtagaaggttctttgcggagattgagcaggaggaggatagtgatgatgatgaggattctgatgagattgattctgaggaggatagggagaacatagctgagttccttgagattgcgtttggtcaacgggctggagatacttctgatgaagaggatgtttcttcggatgttgagtcgtcggattcagatttgtctgacgaggagtaggacttcactttctatggcttgcgttgacgggttctattctgtagccacaaggaggcaaagggggcgtaggattggttcgaagggaaatatataggagtctgatcttatatctcatttgtaataccacccttgaaagttgtttgacaactagaataatattaaatcagcgcc

SEQ ID NO: 28162 - DNA, 310 bp, Sorghum bicolor
  Clone ID: 7535703
cgaccccggtgacgagtccggcaagggcaaggctgttgaggccaagaaggaggaagaggaggaagaggccgatgacgaggagatcgacgactttggcctcgagaccaaggacattgagtttgtcatgcagcaggccagggtttccaggaaaaaggctgtcaagcccctcaaggagaacgacaacgacattgtcaactccatcatggcgttgagcatataaattgtcctgcgctgggggtttaggtgcgataggtggatgatgacttccaaggcgttgcagagttgaaagcccccctgccagttcatgtaa

SEQ ID NO: 28163 - DNA, 612 bp, Sorghum bicolor
  Clone ID: 7535704
agtggttcatgaaggacgaaatcatgaagtccgtgaacttgtacagaatgcagggctacaggtttatgcattgaaacgtgttcggattggcaggttcaggcttccggcagatctgggaattgggaagtttgttgagctcaaacaggctgacatcaaggcactagaaggcaacaagtagagatgacacctgggttcttttagtgaggatattggaattaatgtggataagcacatcttcgtccaaagatgcagcaatccttctgacagtcgcaaggcatgagctgctactcaactaagaaaacctgtgaatgttctcgatgtccattgggtgtggtggtggcggctaacgggcaaagtgcgacaaccatacttttttttttgaagaacttgtgaaccacttcgctgacgaatctccacatcagatgaaacagcagaacctccaagtccacgatgcagcagtcgtttggtggggatgaaacattgtcaaatagctgaactcctgacggcatatacgttgtacatatcaatgtaaatcgcatggtcttgtgcgaggacatgaaccatttgtgcaacagttagacaataattgatgacagacgaatgtgtttggcc

SEQ ID NO: 28164 - DNA, 360 bp, Sorghum bicolor
  Clone ID: 7535710
aaattgatggagtggggttgaaaaggaaaaggggaccctagcaagcttgctgatcctgaatcatggcagggcggtgagctttcagttaagcggacccgctacctggtgttgctagttcgctactgtgttttttcccctgcgttgttggttgttttttccgggccctatgcattaaatgtttgtggtcttggggttacgtggtcatgccaatggcagtagcagtttcccccctaaataataagctggacccagtcggcttgaagtgtaatgtaacttgcccatttacttgttacgtgagttgagctattgcaaatgtccaatcaatcgattagcaaacttggtgaccctaggcccctttgt

SEQ ID NO: 28165 - DNA, 551 bp, Sorghum bicolor
  Clone ID: 7535715
tgactcaattcatattttatctccacttattcttaaagatcttaactcgattgaatcccttgtttacggtaatgagaaaggggatatctatcaaagggaacttcctttcttaactctcagaaggaagatctcgggctcagtcgggtctccagtcttgtcgatgctcctcacaaaggatcgtagatttttgctttttggatgtggtgatggagacatctcagtcttaacagaaacaatgcaatcaagcaaatctgggccaagtagcattgctcagccttcttctgccggtgagaaatttagcaaagctcaagaaaaccaagaagagtctaaaggtgaatctcagcctttactaaaatcaaatagtgatagtgacatcaagctcaaagacagcaaaacagaatagaaatctgtatgcatatttcatgtcttaatagtcatgtgtaggaaaattctagaaatcttactgagtcttattcatactaaatatgcaaattgaaatatgaagaaggggaaaaacttcaaacttcattatctttaatagtatctaaccc

SEQ ID NO: 28166 - DNA, 539 bp, Sorghum bicolor
  unsure (1)..(539): unsure at all n locations
  Clone ID: 7535716
catctggtcccacgcaagccacaagcacatgcccatcaaaatcatgctctggaaggattccgaggcggttcatgccatcagcgcttggttcatggccatggagattgcctggcagatggataagggtaagggctacaccgagagactggaccgcattttctgtggcaaaagttcccgccctagcaactggaacactgagcccaagaaggacgatgatcagattgatcaagattaccagcaaaagtacgacgaccgcgagctttgggacgcgatgctcgccaaggggtggaacctggagtctcaggctttcgagaccgaagcacctgttcgcatggccatcctgcacgaagacaagaaggaccagtgaagatacacagactggtatgggttacacggagttttggcgtcaaggaacaagggtatcgcctcatgagcgcgcgatggatttgacatgtgtagagtaaaaaatacccagagatgcagctcaagagagctttcanaaatgataattggagatgttgctagagtcccccagactc

SEQ ID NO: 28167 - DNA, 432 bp, Sorghum bicolor
  Clone ID: 7535745
ccctctaacgctctatatctcgagagtaccgggcactcgagatgtcattctatcacctttcaaaccacaactaaaaaatgttaccgccgaggatgtcgccagctgtctctactatgttcacttcgaagcgccgtcactagaacctgtcgggccaccacgagatgacgagcaccgatcttcaagcgatgagagctcgtcgatacggaatattaagaggaagcctttgcctggtagcgcaaggccattgacgcctccttcgaccgatcatctgcctgtacctggctacggaaacgaataccaagaccctacgagaagacggggtctttcagtcaattcgacctttgatcctcgacaaacgtcagcacggcgtgataatgagcaagaggaagaaagcccagttctgccacctcgaccgaagaatgtccccagaat

SEQ ID NO: 28168 - DNA, 570 bp, Sorghum bicolor
  Clone ID: 7535752
gcacgaggctgagctccagccgctgtccccgattgccgacttgccgagcccagccaggcagcctctagagccgtgcctacccgccgccggccgtctgccgtcggcagcctctgcatccagtcccgcggcggcgcggcgcctctccctctgcttgttgctgctggttcgctccctgaaacgaaagaaagggtatagactgagtcgaaatggcgtcgcagctgccacgagtgtgcgtcactggaggcggcgggttcatcgcctcctggctcgtgaagctgctcctctcccgtggctatgccgtccatgccactctccgtgacccatgcatgtgatccaaagaatgcccatctgaagaagctggatagagccccagagaatctgcatctgttcaaggctgatgtgctggactgcgagactctgacgcccgcagttcaaggatgtcagggagtcttccatcttgccactccggtgcctgaagataagattcttcatcctgacctcgaagtactggaccctgctgtgaaaggtacctgaaatgttttaaaggtttgctcaactctgaaggttcac

SEQ ID NO: 28169 - DNA, 596 bp, Sorghum bicolor
  Clone ID: 7535760
caggagtcatacccatttacaaatttgaataattcatgtagttcctctacttttgagaatgtagttcctgctttcagttttggggcaacgaatgcagaaacagaaactgctccagatgatcatttttctgtcaaacaggatttgcctgggtattccagagagaccttatttggtttagacagtataaaatctgcatacaaggagaaaagggaagcacgtaaaggcaaaatgaaaaataaaaggccaactagtctgaagcaacatgctcagctccatcaggatgtttctaaggaagcctctaccaatggagaagcatcagatttagcaggtgactattcaccaatggattgttcgccgtatcctgcagaagctgaacatgtgccaacagaggcatatgtggcttctgatcagcctgttcacataggcgatagtgttatctcgaactggaacaccagttgtgctgaagatgatgtagtttctgcaaccgagcacttggttcttgatgcagacctgccgatgtttggagatgaaggtagaggaccgaaacttgatgcatctgagatcaattttggtagcagcttttctagttttgaagg

SEQ ID NO: 28170 - DNA, 491 bp, Sorghum bicolor
  Clone ID: 7535766
gcacgaggcttcaacctgttccaacggctgtagcagcccggaatcagggaaggctcctcggctggatccgttagttgccttgaccacgggcggatccggccggcgcggcgctgcgacaaagggcggtcgtgattcgcgacaccagcggtggccggtaactcctcgatccatggcggtagtgactggggctctgccaagcgtcctcgccaagctcggcgatcttctcatcggagagtataagctgcaaaagggcgtcaagggggagatcattttcctcaaagctgagctcgagagcatgaagggcgcactcgagaagctctccagtaaaccggcagacgagcttgacattcaggacaagatctgggccaaggatttgagggagctctcctatgatatagaggatagtatcgacacgtttatggtgcgtggcaaagccagtcagtcggccaagctgcatggcatcaggaagtttattgaccgaagtgtcggtt

SEQ ID NO: 28171 - DNA, 554 bp, Sorghum bicolor
  Clone ID: 7535769
cttgtaggctggtgttctgaaacagaggatatatatgttgaatacaatggaaaatacatttgtgctgagaagtcagaaaggttgctttgcttggagtacatgcctaaaggaaaccttcgtgggtatctttcagatgaatcttctggacttacttgggagacacggtacaaaataatcgagggtatttgttatggtttacattatctccatgaagaaaggcaacttaatgcccccattattcacatggatctgaaacctgcaaacatattgctcgacaacaatatggtgcctaaaattgcggattttggcatgtcgagactcttcagtgaggagaaaacttggacttgcacaataagtcgtgatggaacattgggttacatggcaccagaatacattaacaggggtttgatctcaacaaagtcagacatattcagtttgggtgtaataatcatagagatagtgacgggacagagggactatccagatgagagtgagaccggaatatcttcccaagaatttactgagcttgtactaaagaattggagagataggct

SEQ ID NO: 28172 - DNA, 574 bp, Sorghum bicolor
  Clone ID: 7535774
gcacgaggaaaacatctcgctgcactgcagtactagccttctataggccaattgcatcaattgcatttcatgcaacaggggagcttctggcagttgcatcaggtcacaaattgtttatatgggactgtaataaccgacgtgaaactttggaacctccaatcatactaaaaacccgtcgttcactgagagctgtgcagtttcacccccatggcgcgccatatctacttacagcagaggttcacaaccttgattctgaagattcaacgatgacccctgcacttctgagcaattattccttcagagacacacctctccttggtggttctggggtagataacttgattagtgaactatcgtacatgcataattttgagcaggttggtgcttcatcatcagttccagtcactactagcagtttcgatgggtcaaggctacatgatacctcaggccatcatctgacgacctctgtacctggtattgggagttcccttctgggtactcatactgctgaagctgaagctcctgctatctcattaagtgttggggcagaacaaactacatctctgcttggtgg

SEQ ID NO: 28173 - DNA, 626 bp, Sorghum bicolor
  Clone ID: 7535777
gcacgaggggtgatcttgccgaccgcatgggtcgcaagtggactgttatcctcggctgcctcatctacgctatcggtgttgttatccagatgatcactggtcacggtgatgccctcgcttgtatcgttgtcggtcgtcttgttgccggtgtcggtgtcggtttcgagtccgctattgttatcctctacatgtctgagatttgccccaagcaggtccgtggtgctctcgtcgccggttaccaattctgtatcaccatcggtctcctcctcgccgcctgcatcgtctacggcaccgagaagtacgacagcatgaagtcgtaccagatccccatcggtcttcagttcccctgggctgtcatccttggtggtggtctcttcttcctccccgactccccccgatacttcgtcaagaagggcagaatcgaagaggctattgatgcccttgcccgcgtccgtggtcagcccaaggactccaagtacgtccagtctgagatcgccgagatcgtcgccaacgaggagtacgagcgccaaatcattcccaacacctcttggttcggcagctgggccaactgcttcaagggcagcctctgggatggcaagtctaaccttcgccgaactatccttggt

SEQ ID NO: 28174 - DNA, 614 bp, Sorghum bicolor
  Clone ID: 7535783
gcacgaggcccacctgttgtttccttcagatacccaattccttttcacagccatgtctgagacatcagtaaagctctccactccccagacgggcgagtacgagcagcccaccggcctcttcatcaacaacgagtttgtcaagagtgtcgacggcaggacctttgaggtcatcaacccagccaccgaggaggtcatctgcaacgtcgccgaggccactgagaaggatgttgacatcgccgttgctgccgcccgcaaggccttcaacggcccatggaggaaggaaacaccagagaaccgtggaaggcttcttgtcaagcttgccgacctcttcgagaagaatgccgagcttctcgccgccgtcgaggcgctcgacaacggcaaggcctacaacatggccaagaacgtcgacctccccgccgccgctggatgcctgaggtactacggaggatgggccgacaagatcgagggcaaggttgttgacacaacacctgacaccttcaactacatccgcaaggagcccattggtgtttgcggtcagattatcccctggaacttccctcttctcatgtgggcctggaagattggtcccgccattgctaccggtaacaccattg

SEQ ID NO: 28175 - DNA, 571 bp, Sorghum bicolor
  Clone ID: 7535789
gcacgagggttgctggccctgctgcttctgctcccttccatctctgaggcgacgtcctcggcgctgctgggcatcagctacgggcgcgttggcaacaacctccctgcagcgacctcagtgccgcagattgtggcctccctgggcatcggccgcgtccgactctacgatgctgaccccaccaccatccgcgccttcgccaacacgggcgtcgagctcgtcgtcggcgtccctgacgagtgccttgccactgtctccacccccaacggcgccgcctcctgggtcggctccaacattgcccccgcgctcccggccaccaagatcgccttcctcaccgtcggcaacgaggtgctcaccggcgtcaacagctcctcgctttccaggtacctcctcccggcgatgcagtgcctccacgacgcgcttgcgcaggccggcctggacaagcaggtcgccgtcaccacggcgcacaacctcggcgtgctggccacgtcgtacccgccgtcgtcggcctacttccgcaaggacctcctcccgatgctctgccccatcctcgacttccacgcgcacgcggggg

SEQ ID NO: 28176 - DNA, 624 bp, Sorghum bicolor
  Clone ID: 7535792
gcacgaggcacagcgaggacacactcgaccaacacatcttcttctaaaatttccaccccccaaaccacacagcaaaagcagaccattgctgccaccgcacttccccaatcccgcaactactctcaagccgccgctgccatgcctcacgctactgagcccgagtcgctcaagctgaacagcgccaacttgaactcgttggagaactgcacagtccctacctacgaccgttctagcatcaagcatggtatcgtccacgttggtgttggtggtttccaccgtgcccacttggctgtctacgtcgacagccttcttgagcagctcaagctcaaggactgggctatctgcggtgttggcatgcagtccttcgatgctgagatgagggatgccctcgttccccaggacaacctctacacagtcatcgagcgttccgctcccggatccaaggctcgtgtcatcggcagtatcactgactacatcttcgcccctgacaactctgaggctgtcatcgccaagatggctcaccccgacactcacatcgtctccatgactatcacagagagcgggtacttctacaacgagaacacacaccagctcatgaccgagcaccccgacatggccgccgat

SEQ ID NO: 28177 - DNA, 498 bp, Sorghum bicolor
  Clone ID: 7535801
gcacgaggaagctcttcatccattaccatcttttctctttttcacaaagtctcagcagagcaactacccctccttcaatcccaatatacctgtaaaatcagtcaaaatggtcaaggctgttgttgctggcgcctctggtggcattggtcagcctctttctcttctccttaagacatcccctcatatcgacgagcttgctctttacgacgtcgtcaacacccccggcgttgccaccgatctctcccacatctcctcccgcgccaagacaactggctaccttcccgccaacgatggcgctaaggctgctttcaaggacgccgacattattgtcatccccgctggcattccccgcaagcctggtatgactcgtgacgatctcttcaacattaatgctggcattgttaagggtctcatcgaggttgccgccgaggtcgcccccaaggcattcatcctcgtcatctccaaccctgtcaactctacagtccctatcgctgccga

SEQ ID NO: 28178 - DNA, 507 bp, Sorghum bicolor
  Clone ID: 7535807
gcacgagggtcgctcggcgcgcccaccccgccgacctccgccggctccgcgccggcgaacccgccgccgctgtgcgagctggagcgcgtgcgtcgcatcgggagcggcgccggcgggacggtgtggatggtgcgccaccgccccacgggccggccctacgcgctgaaggtgctctacggcaaccacgacgacgcggtgcgtcggcagatcacgcgcgagatcgccatcctccgcaccgccgagcacccggccgtggtgcggtgccacggcatgtacgagcaggccggcgagctccagatcctgctggagtacatggacaggggatccctggagaaccaccgcatcgcggacgagcacttcctggcgcacgtggcgcgtcaggtgctgtcgggcatcgcctacctccaccggcgccacatcgtgcaccgcgacatcaagccttccaacctgctcatcgactccgggcggcgcgtgaagatcgccgacttcggcgtggggcgcatcctg

SEQ ID NO: 28179 - DNA, 537 bp, Sorghum bicolor
  Clone ID: 7535810
gcacgaggcgaagacggacttcccacggactccgcgtccgactgaccggccgcgacacgacaccgacggcaagccacgcccgccatggcgcccgcctgacttcgcctcctctcgctccttctctgctagacttttttttcgtcagtcccgcccagtcgcgcctcccgtccaccatcgtccgctctgtgcctccgacggcaacgtccacttcactgtgcccgttcgttgccccgcgcacgccgatacactggctcatcaagttcgattcgctcgtccgtctcctcgacgtttaccatcacctgcccgcagcaacaagcggctcgacgatcgcgcacccctcacctgcgcatgttttggacatccttttatttttcttcttcttcttttcttatcacctctcacgcccgcgcactgtttatttcacgtctttatgtcctgcatccttcctcactccccgtgcatgttccctcatcctcgctacccgaccctctgacgaacggcgcccttccctccccgtccgctctctccgcagggaaa

SEQ ID NO: 28180 - DNA, 588 bp, Sorghum bicolor
  Clone ID: 7535811
gcacgaggcgacatcattgtcatctttcagctatacctctttgcgtatgcgaaaccgggcacgacgccttcttgagcatctctttgctgctgaggctttagaatgcttggagacgttgatcgtatcatgggctcatgcaaaacaaaatgacgtccatgagacagctgtcatgggtcttctcaacgtgctgaatgggtcgagaccgaagctcaccattccagcaatcttcaacgctgtgtatagtcgcacagacccaaatgcacttgatgccaaccgaatgtccacgctgacatcggatctgtcggacacagatctcgtcactttcctcgtagattacactaaatctctcgaggacgatgcaatggatgagatctggcaagactgcacggttttcttgcgcgacgttctagccaaccctctgcctcatcgacaaatactgcctactctactcgagtttacttctgtcatcggtcagaaagtggataacacaacattcggtgagcagcggaggatgaggagagaactcacggacatattcgcacgcatcctcacagcgacattcacaacacgtcctatgggctataccca

SEQ ID NO: 28181 - DNA, 546 bp, Sorghum bicolor
  Clone ID: 7535816
gcacgaggcgcctcaccatgacccatgtcgaccttccctccaccccccaccgccgctaggagccccctcgccagggtgcgcctcgacgacctggccccgttcgacggcgcctcaaccccggcctacgcgcgcgccgtcgaagccatcgccgcttccctcacgcgccacggcgccgccgccgtcgacctccctgcggcggatgccgctgtcgtccggtgcgccctcgagtccgcgcgcgccttcttccgcgcccgccccggcctctatgtctaccgcgccgggagggctctggatgatggggagttgtcacctgcttgcatggctgatgctttcagatgtttgggtaaggcagcccgtgctgctctctgtgcaatagcacggaaccttcgcttacgttcagatgctttcagccatttgcttgatgacaacccattgcctcttgatgaggtttcagcttcagaattgacggtgtcattttctcatggacacccccaaagcagccaggcacctatggtgggcctcagatcatcaatggctgaagttgat

SEQ ID NO: 28182 - DNA, 469 bp, Sorghum bicolor
  Clone ID: 7535818
gcacgaggatacaatcgcattcatctctattacctaccaaaaatgtcctacctcccccccttcttggcgcgtctcgcccgcccattcacacaatctactcgtctctcaatcgctcccgatcaatccgctgcatctgtcatccccgagggcgctcagcgctgcaccgtcgctgcgggatgtttctggggaacagagcacttgtatcgcagacactttgccgataagggtctgatcgatgcaaaggttggatacattggtggtgatctcgacaaccctagctaccgcgccgtctgcggtggaaagacaggccacgctgaggctgcgcagatcatctttgaccctacaaaggtctcgtacgcacaactcctagaattcttctacaagacgcacgaccccacgacgctgaaccgccagggtcccgatactggtccccagtaccgctctgctatttatttccacaacgaggagc

SEQ ID NO: 28183 - DNA, 275 bp, Sorghum bicolor
  Clone ID: 7535819
gcacgagggcggactccttaactgaacacgttctcgttcgcgtcggattactttaatcccacccccgctccagctcccgcttccacttccacttctacgacgacgactgtggaagcgtagtaatttaatcccagatttggctcgccgttccagatctccgtcggcgtttgtttgtccccgtcaaggtggagcgagcgatggcggaagtggaggcgccgctcatcgccgaggtggagggggaggagggccttggcggctggcgggggggctccgcg

SEQ ID NO: 28184 - DNA, 580 bp, Sorghum bicolor
  Clone ID: 7535821
gcacgagggcttgacggctggaacaccaatggaggatattcctgtcgataaggtgtttattggatcgtgcaccaacgcccgaattgaggatctgagagccgctgccaatgttgtaaaggggcgtaaggttgccgataacattaagcgcgccatggtggtccctggatccggtcttgtgaaggcacaggcagaggaggagggtcttgaccagatctttgttgatgctggctttgagtggagagaagctgggtgtagcatgtgtctgggcatgaaccctgacattctggcccccaaggaacgatgtgccagtacatccaaccgaaactttgagggccgacagggtgctcttagccgaactcacctcatgtctcctgtcatggcagctgctgccgctattgttggtaagcttgccgatgttcgcaagctgtcacactacacccatcaatctgcctttaagccccgtgagctccctgcggaagagccacatgtggacgagcgaaccagggatgactctgaggagcgagagatgatcggagaccagcctcaggactctcagcctcacaccaacactctggccagc

SEQ ID NO: 28185 - DNA, 396 bp, Sorghum bicolor
  Clone ID: 7535824
cacaagagtcgcccgaagagactttgtgctcaggagcagtgagctcgccacgctcgccgccatcttccacttgagtggcaccaaaccaagctaccttggcgttcagaagagtcatccatcccttgctctgtgccctgcaaccaataactgtgtttcgacatcagaggaaataagtgatttgaatcactatgctcccccgtggaactacaatcccaaggatggccagaggggtaaacccataaccagagaggaggccatgaaagaactaattgaagtcgtggcgaagacaaagccagacagcttcactcctcgcattgtagataaaacagatgattacatccgagttgaatacgagagccctatatttgggtttgtacatgatgtggagttctggtt

SEQ ID NO: 28186 - DNA, 643 bp, Sorghum bicolor
  Clone ID: 7535835
gcacgaggttttttttcaacatgtgaaatacttgcaagttagaagtcgattttgtgcggtctacaggcttctgaggaggacaaccccaatggcatggtgttgcaggtcaggccgctgtcatcattgttgttggagcatctacctgctgatccggcagatcttctgaacagcatggtgttgatgctctgaaacagtagcttctcaaacaatggcaggagcagaaaggcgctcaacctcaacatcgaaggcctgttggtttcttttcttgatcatgatgcactggtgagacacaacaacaatctgctagctagctgttcgttaatttggttttgagaaagataaacttgcagcagagatgatatgttccatgtgcatttttcctacgaagagtccatgaaaaggatcatgtgattcattgtttcccaactgatatccggaagatttgatgaaattgcacatcaagcaatggttttttttctcaacatgtgaaatacttgcatgttagcagcagggcttgggttgggaaataacagtttggtttggaaaattacatgaacaatagatttatagtagcaagtaataaagacaaattgaatgcaaactgggacaaatgttacttactgtaaatgatttgactaaccta

SEQ ID NO: 28187 - DNA, 551 bp, Sorghum bicolor
  Clone ID: 7535842
caagggcgctgctgaaaccatcattaaggcttgcacacactatatggacatcaaggggcaagttaggcctattgaaagccacattcgcgtccaacaggaaatgttggtgaatgcctatgctgaacgctctttgagaacacttgctatcgcttaccgtgacgtcgaccaagctaccttcctttcgttcagccctgatgatgctcctattcataatctcgtcttactcggcatcgtcggtattcaagaccaacttcgtcccggcgtcatcgaatcagtccaagccttccgtcgtgctggtgtctttgttcgtatgatcacaggtgacaatttggaaacagcaaaagctatcgccaaagaatgtggcatccttacacccggtggtataaccatgaccggtcctgaattccgtgcgctcaactcacgccagcaatacgaagtcatccctcgtcttcaagttcttgctcgctcatcacctatcgacaaaaccatcgtcgtttctcgtcttcaggaacgtaatgaagtggtagccatgacaggtgatggtacaaacg

SEQ ID NO: 28188 - DNA, 513 bp, Sorghum bicolor
  Clone ID: 7535844
gcacgagggtgatcctatatttggggagttgtttgctcaaaaggccaaaggtcattcttctgctcctactgctactagtaaagtggctggtggtatgaaattgggcaaggcacagaagacagatcagtttcttgaatctttgaaagctgaaggagaactcatttctgaggatactcaacaaagtggaattcagtcaagactgccatctgcccctacaagtgatcctatcacagtggcaatcgaagaaaagatcagtgccactgttaaaagggatggtggaattcataattttgatattcaaggaacccttgctctccaagttctgaatgacaccaacggttttatccagttgcagatcgagaaccaagatctacctggacttagcttcaagacacacccttatattaacaaagagttgttcaatagtcagcaaattgttgctgcaaaagatccaaacaggcctttccctagtggtcaaaatgaaacccctcttgtgaaatggagaatccagga

SEQ ID NO: 28189 - DNA, 587 bp, Sorghum bicolor
  Clone ID: 7535846
tgggattcttcgaaaggctataccaacacaaactcgcctaccctcttttccaagcatcgcttctcaggctgccaaacgactaatggagaagcagcttaatgcctcccttcatcgtgctgctgagcttattaaagtagctaagcagcctatcatttacgctggccaaggcattatccagtctgagggtggaactgagcttcttcgcgagctagctgataagtgttctattcctgttacaacaactctccagggccttggtgcatttgatgagcgtgacgagaagtcattacacatgttgggtatgcatggcatggcatatgccaatatgtctatgcaggaggcagaccttattattgctcttggtgctcgctttgatgaccgtgttgtcctgaatacttcaaaatttgctcctaatgctaaagctgcagcagctgagaagcggggcggcattattcattttgatatattgcctaagaatattaacaaggtcgttcaagcaactgaggctattgagggcgatgttgccactaacctcaagatgcttatgcctatgctcacacctacaagcatggagcaacgaagcgaat

SEQ ID NO: 28190 - DNA, 580 bp, Sorghum bicolor
  Clone ID: 7535849
gcacgagggaatactccgcccacgataattacacccttcagattaaccctcactccggcatcaacccggagcatcttaattatttcaagtttatcggccgagtggtcggcttggctatcttccacagacgattcttagatgccttctttattggtgccctgtacaagatgatgcttggcaaggcggtgtctttggcggatatggagggtgtggatgccgatttccatcgttcattgcaatggatgctcgataacgatatttcgggtggcattctggagcagactttctcaaccgaagatgagaggttcggcgtcatgacaaccgaggatctcattcccgacggccgaaacattgacgttaccaacgagaataagaaggaatatgtcgatctcatggtcaagtggcgcattgagaagcgtatcgctgaacagttccaagctttcaaggagggtttccaagagctcatccctcaggatcttatcaacgtttttgatgagcgtgagcttgagctcctcattggaggtattgccgagattgacgtagacgactggaaaaagcacaccgattatcgaggatatac

SEQ ID NO: 28191 - DNA, 590 bp, Sorghum bicolor
  Clone ID: 7535850
gcacgaggctcggtcaggagtcaggacgacgcgcatccccgtccgcacgtccccgtgctctcgctcctccagaggcgactagggtttggaggctgccgagagggtgctacccgggccaacgcctccgcccgctcgcaggagaaggagctctccgctgcctcgccgtcgcctggtcctttcccatcgccacccgcgagctccagcctccagcccttgtgaatcggacgggttctggatttgggagccaagcgaccggcggacacgctcccctgtctctcggtctcttcctccccgagcggcacccccctgcgtccgcttgccgcttctagcgtcggggaggaaaattacagaggaaggacatgcgggatccatttgatgcaccggttgatctcattaatgcagaccataatggtgggagtcaactttccaggactggtgaggtgtctgctgggaactatggtttacaaaatggtggacccaaatcctttgctccaaactccgacactctagtcagacatcaactccagggtgcatccttgcacaaagatttagctgtggaagatcccaatactcgtatcatggatcctgag

SEQ ID NO: 28192 - DNA, 582 bp, Sorghum bicolor
  Clone ID: 7535857
gcacgaggaccaaccagaccttgatccgccttccttaccgtctccctgtgcagtaccgatccttaaatccggaggaacctttgcacgtacaacatgtccaagggcggcggtaagtttcagaggaagaaggagtacttcaccaagctctccaacctcctggtcgattacaagaaggtgctcatcgtcaccgccaacaatgtcggctccaaccagcttcagagggtgaggcaggagctccgcggcaaggccatccttctcatgggcaagaacaccatgatcaggaagtgcattcgcgagaacttgaccaagaaccccgatctcgaggcgctgctgccgcacgtcaagggcaacgtgggcttcgtgttcaccaatggcgacctgtcggacatgaggacgaggatcggagccgttaaggtcaaggctgccgccaagtccggtgccatctccccgtgcgatgtcatcgtgcccgctggcccgactggccaggaccccgcgaagacctcgttcttccaggccttgaccatctccacccgtatctccaagggtgtgatcgaaatcgtcaacgatgtgcacctcgttaag

SEQ ID NO: 28193 - DNA, 563 bp, Sorghum bicolor
  Clone ID: 7535864
gcacgaggccccctttgagcttccgtcgccccctccatacctccaactacgtaggtacctaccctgcctgcctgcgtagtctctcccttccactgaggcgttggttggtcaggggactcgactcgcgatccatcaactcgtcacaacccggcgcgacaaacacaactcgaccaacatccacggcgggcgcgcagccatgaacgatctttactgtttgtctcttcgagatgtttgagatgtagccaggtcgaacaaatatttgcgctatcaaaaaaagaacagactgccgcgacgtccacacccttatcatggacgattcgggtgacgatttggctgctcgagggcccagacgagtatcaaccgccactgtaccttcacgaggtcccacggaaccagaaacacccgactcagatcttgtcgaaacactctacagccatccaaatgtcaagattatatcctttacggccactggccgggcctatgcgaggagtcctggagggcccgccttgagcaacgttgatccaccaagttctttatcatggtcctcacagctcgagagaacc

SEQ ID NO: 28194 - DNA, 506 bp, Sorghum bicolor
  Clone ID: 7535865
tgcaaacaccatcctggccaagttggctgtggcactggcactggcacctgcaccacttatgagggtttactggttcattttgtggctgcaattagtgtgttctcagacaaccaaccaagagcaagaaaacagataagctctcgggcgtcctggggccttggggagctcttgatgctcctgattccatgctgcgccacatccattgggcttaatgaggtgattccaattgtttgagccatgcatatgggagagagcaagctgattgctgtttgggggttgtctcacactctcactgcctgaagacattgcagaaacactgatgtgcgcttgtgtaggttatttgatctgcacaaagccacagacatccgcaggcttacatatggagagatggaggccaagataagtgcaaggaaaatccttgatcacaaagggcaacagatctgaaatagtgttcaactcctcagccccacattgaattggagttacagaaatcttggccatcttgg

SEQ ID NO: 28195 - DNA, 657 bp, Sorghum bicolor
  unsure (1)..(657): unsure at all n locations
  Clone ID: 7535874
gcacgaggagatcgtccccggaccttctgtcgccagcaacgagacagctgtagaggagacggtcattagacaggatgtgactgtcattacaaccacagacgaggttacaggccccaattcagccttgagcaccatcaccaatcccacttcaccaaccactgctgccccacgaccacgactcaagaaggacaacagcacgcccaacatgaacgggccactctacatgcagactgccgggaacaagacagtgcttgtccgccgacttaagcgcaaggaggagagcacctggaagcatctctcgcgctggtttgtcgagaaccaaatcggcctctcttttaacctcctcgctctcatctttctcgcccagacctttatccccaaagctcgagaacacacacataaattcttccacctcagctacttgagctctcagtccggccagtatcgcatcggttacgatgatgcctatttcatcaccttctgcgttattctcttcaccggtcttcgcgccgccaccatggaatatgttcttgcacccattggtcgactccaaggcatcagcaaccgcaagaacctgacccgattcagcgagcaagcttggcttatggtgtactatactgtcttctggccgtggggcgtgtacatttactgcacttn

SEQ ID NO: 28196 - DNA, 406 bp, Sorghum bicolor
  Clone ID: 7535877
tgacgttgatgatgaacaaggtcatcgtggtgactttggtggccatttggtgttctggactcaacaacagagtcgatgcggcagggctgagtccggtggtgactttggcgaatgggggtggggttcaaggcttggaactcgactctgcctacgtcttctacggtgtcccatacgccgaacctcctgtgggtgctttaagatttcaaccaccagtggctgcacccgcatggaatggagtgttcaacgcgacttcgatattacccggatgtcctcaactctgtgctcttccaccgctcgggtgtccagtgacccaaagcgaggattgtcttggactcgatgtgtatgtgccgctgggaagcttaatcagcaacaacttgattccagttgcggtgttctttcctggagg

SEQ ID NO: 28197 - DNA, 518 bp, Sorghum bicolor
  unsure (1)..(518): unsure at all n locations
  Clone ID: 7535880
gcacgaggcccctttcctaccttggtgttgattgtctcttcacagaatgagatattcttccatactctctgcttcggcactcactagtgttgcgacttcatctgcccttggccctcgagacgccagagtcactcctcccaccaacgctcttgaatcatggaggcgcgctgccccacaagcccccaacggctacgctcccgctaaagtagactgtccttcgacgcgcccaagtattcgatctgccgataggctttccgaccaggagacagaatggctcaagaagagaaggcccaacacaatagagcctatgcgcgcattcctagagcgagtcaacattgacgggttcgacgtcggcaattacttcaatacccaccgtgacaatactaccgcgctacccaacattgccctctccttctccggcggcggataccgtgccttgctcaatggtgcgggtggtctggcggcatttgatgaccggactgcangctcgacaaatgctggtcatttgggaggcttgt

SEQ ID NO: 28198 - DNA, 473 bp, Sorghum bicolor
  Clone ID: 7535881
gcacgaggagaagtccatgtagctgcgagcaccgcccacctacgatgcagcatggtagttgaatagcgccgcttgctatggcggattccgctgtgcgcacttccaccctcagtgctcttcgacagtcctgtccttccgccgagtatctgccctccccgtcgccccctctcgcccacacccgcgcccccctcgtcactcctcaatacccctcctcgctcgcagcccccatggacgaccctttcaacgaagatcccgagtggtctgacgaagaagtcttgctgcccaagaccgtgcccaaaaccaaaattcaacatgtgcacccacccaccaagatggcttcaccacaggcagtgggagatatgtctgatgattccgactcatcgggctcaggtccgccttcggtgaacggatccccccttatcccgcccaagtcaatttcacgaccagatgtgcgggcaggaagcactcaggag

SEQ ID NO: 28199 - DNA, 493 bp, Sorghum bicolor
  Clone ID: 7535883
gcacgaggtcgcgctcaatgctgccgccaccgtctctcctgctccactccggcgcgccgcgcagcgcactccccctgcaggggcggcggcggcggagtctgtcagtgcgggcgtcatggcaggagctggcgggcgtgttggtgttctccgccatccccttcaccgccgtcaaggccctcgccaacagccccctgggcgcccgcctccgccgccggctcgaggacaggaaggccgccgcagctgccgaggccgacgctctccgcgctgccgcgcgcggcgcccgtaacaacagcttttggtacggcggagatcggccgcggtggcttggtcccgtgccttacgactaccctgagcatttgacgggagagtaccctggagattatgggttcgatatcgcaggtctgggcagggatcccattgctttcgcaaactactttaactttgagatcttacattgtcggtgggccatgcttgctgctctcggtgttgttat

SEQ ID NO: 28200 - DNA, 493 bp, Sorghum bicolor
  Clone ID: 7535889
gcacgaggcagcacctttgcatgtgtctcacaagaagctaggccggccgcgcatggagaatccgcgccggcattccggctcctcagcgagcaggcggctgcgctacctcctcgccctggccggcgactacatcaagtacctcttcatgaagcggcgccggctcatgcacaaggtggcgcggagaacgctcgcgctcgtccaccgccatggcggcgagcgcagcaagagccaccgccaccacccgtggcggcctcgcgcgctgacggagcacgagttctcgtgcgccgacagccccagccccgcgttcctcgcggcgaagaggctgctgctccggtcacggctgaaaggcagtggcgccgcggccgcagcggccggggctgtgtcttcctgcttcggctcgttccgagctcatccgttcggttcacccggcggcgacgagacgacgacggcatcagagacgacagaggctgtggaagaggaggatcagctggag

SEQ ID NO: 28201 - DNA, 475 bp, Sorghum bicolor
  Clone ID: 7535894
gcacgaggcttggctcaacaaccaaaagttcacctacagaggggggataactgaggagaaaaagataatgaggaggaaagttcttgccaagtggctaaaggagagtcttttgagattaggccccacattcatcaaaatagggcaacaattctccacaagagtggatattctcccacaggaatatgtggatcaactatcggagttacaggatcaagttcctccatttccttccgagacagctgtaaaaattgtcgaggaagagctgggggcatctgtaaatgagatatttgatcgatttgattttgaaccaatagctgctgctagcctcggccaggttcatcgggcacgtctaaatggccaagaggttgtgatcaaagtgcaacggcctggtctgaaggagctgttcgatattgatttgaagaatttaagggtaatagctgaataccttcagaaagtggatccaaagtcagatggc

SEQ ID NO: 28202 - DNA, 592 bp, Sorghum bicolor
  Clone ID: 7535911
caactgcggcacgcgagaggagaatgccgtcgtcgccgcgcacgcgcaagctccacttgttacaacatcctgccaagaacgcccttgcagataagaagcacacccgctcgtcgtcagatataagtgatccttcaacacctaagaaaattgaagatgccaagaacatttccatatacaatgacgtgattgccttcacattgtttgagctagagactatcacaaagagcttccgtgccgattatgttcttggtgagggaggatttgggaccgtttacaagggttacatagatgagaatgtcagggttggtctgaagtcactgcctgttgcagtcaaggtgctcaacaaagatgggcatcaagggcacagagaatggcttaccgaggttaacttcctggggcagttaaggcatccaaatttggtgaagttgattggatattgctgtgaggatgatcataggctacttgtatatgagtttatgtttcgaggaagtctagaaaaccacttattccgaaagacagctacaccattaccctggggtactaggatgtcaattgcattgggagctgctaaagggcttgcttgcctccacaa

SEQ ID NO: 28203 - DNA, 602 bp, Sorghum bicolor
  Clone ID: 7535912
gcacgaggcacggactctgtgtgtgccgtgcatacatacgtttctttttttcttccctcctgtttaatttccacactgcggccattgacctcataatgtctctcccaacacacacggcagaagccacgcatgagaagtctgcgaccgtgagctcatcacctacgggcgatgaaagctctaacccccctagcatctccctctcctctttccagaagctgaataatcgcatcgaaggcctcgctgggcttgaggcccgcggcatcgagcgtgttcttccagaggagcgtcaagagccttctagtgctgctgacttgcaggttgcggtgctatggttcagtgcgaatctgtcgctgaacaacctggcgacaggtctgtttgggcccatggtctttggattgggctttcttgatagtgcgttgcttgctgtctttgggacgattctgggtgcttgctcgacggcgtatatggctacttggggacctcagagcggcaatcgtaccatggttgttctgcgattcttcatgggttactggccatccaagcttccgacattcctcaacatcgttctcatggtcggatatgccaccattgattgcatcatc

SEQ ID NO: 28204 - DNA, 566 bp, Sorghum bicolor
  Clone ID: 7535927
ccgaaaaccacagtcggcgcaaaccccaagcttttccacgtccaaaagccatgttccgccagtcctcctcctcctccgcgtcctcctacagcgacgcgctcatgcaccaccacgccgcgagcttctccgccgccgccgcggcgctgtccgtcacggtcccggcgcagatcccccgggcaggcgggtacctcgacggcggcggcaatgttggcgccttctcgtcgccgccgtcgtccggctactcctcctcgttcccgtcgtcgtactacaactacaacagcatccagaggagcatcagctcgcactcgctcccgatgcacctccagctggccgacgtgtccctcggcggcgtcggcggtggcagcggcagcggcttctactcgccgtcttcgccgtccacgcaccagctcacgacgctgccgccgctctcgtcctccccgtcctcctcctccggcgaattctttgagttcacctcttcgtgccccgtccgccgcgtcttcagcaccggcgatctccaggggatgaacgggtcgtcgccgccacgcccggtgccgtcgggcgacggc

SEQ ID NO: 28205 - DNA, 620 bp, Sorghum bicolor
  Clone ID: 7535928
gcacgaggacaagcagagcggcaaaggagtcgtcagagtccataccagcccagcccggccatcacacctgctagcccgagcggcgaccctgtgcagggcaatggaagccaggcggctcccgctccagcaatgccagcacctaacggcggcgggtatggatacccattgctgactccgccgccgttgcagccctcaccatcggcaacttcaccaccagcagcgccatcatcacaggatacagtcttcaacgtggtggactttggagctaagggtgatggagttactgatgatactcaggcctttgaagcagcatgggcagcagcatgcaaggtggaggcatctacagttctcgtaccatctgaacatgagtttgttgtgggcccaatctcattctctgggccttactgtaaaccaaatattctattccagctagatggaactattttagctcaaaccagtgcaagagtgtggggttccggtttgcttcaatggcttgagttcacaaagctaactggaatagcaatccaaggcagtggtgtcataaatggtagggggcaacaatggtggacatattcagatccaaatgatgatgacaacgacgacgcatactatgtggagct

SEQ ID NO: 28206 - DNA, 411 bp, Sorghum bicolor
  Clone ID: 7535936
tcataatataaggcgcaggcgcgaatctatctacctacctacgcaagatgcgtagcatcggcatgctgcggccgctgctcctggcgctcgcggtggccgccgccgccaccaccgccgtcgccgtcgccgccgacaagaggaagacgtacatcgtccacatggccaagtcggcgatgccggccgagtacgcggacgaccacgccgagtggtacggcgcgtcgctgcgctccgtgtccacctccaccccggccgccaagatgctgtacgcgtacgacaccgtcctgcacggcttctccgcgcgcctgacgccgcaggaggccagcgacctggcgtccgcggacggggtgctcgccgtcaacccggaggcgcggtacgagctccacaccacgcggacgcccgagttcctgggca

SEQ ID NO: 28207 - DNA, 412 bp, Sorghum bicolor
  Clone ID: 7535946
cttgccaagggaatagaagcctacctggatccaatacctcgtatcattacacctactcaaatgattagctctgcaactgcgagttccaactgagaatatactgtatctaggaggaccaaacatcggctcagaaatttataacaaagaatatgcaaacgctcgaatctgtggatccaacaagtggaggaagcctcttgctaagtttttgaggcagccacatttcattgtctgggacaacagtgatcttgtcactcatgaggtgatgggtggcctgaacaatgtctatgcaattggcgctggaatggtggctgctttaacgaatgagagtgcaacaagcaaatctgtatatttttctcattgcacatcagaaatgatgcttcatgactcatttgctgacagaacaacctgagaa

SEQ ID NO: 28208 - DNA, 559 bp, Sorghum bicolor
  Clone ID: 7535958
gcacgaggtaaacaccctgctcggccgcgttgatcgaagagacaaaaccactgcggtcgctttctccggtgttgtgaccgcacttggccccgacgtcaagggtttcgcagtgggagatcgtgtcgttgcgtatgcccctcaccacctgggaacaggagttcgcgtcccagtaggctcggtgcagaaatgcttggacaacgaagactttacggctcttccaccattgctggttggctatgccactgctctgtatgccctcaaataccgagctcaactccgttccggcgagtctatcttgatccacgatagcaccaacacttttggcattgaggcggtcacactggcaaagaagattggcgccgtcatctacgccaccgtcaactccgaagctaagcgcgactactttgtgaacgagcttggtcttcctccgtcgcatgtttttagctcgcttgacgccaaatttgtccaggaactcaagcatgctacggacggtcgcggcgtggatgtagtcgtcaactcactcaccggtgacctgcttcacgacagctggcgatctttg

SEQ ID NO: 28209 - DNA, 553 bp, Sorghum bicolor
  Clone ID: 7535959
gcacgaggcctttcttgactttttcccattctgacgctcacctttctatagctgattccggtgatacttatcgaccccgtgagaggtcacgatctccccgcagacgatccagaagccctgaaaggtcacatcgacgccgctcctactctcctcgcagccgatccggaagccgggacgaatatcgacgaaaccgtgatcgctcgcccatgactagcacaggcgcaccaggtggaggacaaagtgctggatacggtggacaggcaccgcaccgatcttacgaagaaagagccgttgctcgagaacaaatgatgaataatattcgcgaaacctcccagcaggaccgccgggtctacgtcggcaacctctcgtacgatgtcaagtggcaccatctcaaggacttcatgagacagggtgaggctttcaatgccgcggaatgcaggtggaactgggactgacgaaatggtatagctggagaggtgctctttgccgacgtgctcttgcttcccaatggaatgtcgaaggtgggcttcatcgcatgattttcttttccctt

SEQ ID NO: 28210 - DNA, 510 bp, Sorghum bicolor
  Clone ID: 7535963
gcacgagggcaagcttgtcgacgaccccaacatcgttgctcccttcttgcccaagatgatgccaggtctccagaagaactacgagaacttggctgaccccgaggctcgtgacaagaccaagcaggctcttgacaccctcacccgtgtcggtaacatcaaggacggtgtcatccctgaggctcgtcacgatggtgccatcaatgtcatcctccccaaggtcaaggcggccctctcccccaagttcgccaactacgttgagaagatgggccccgttactgagtacatcgctgctatcgctggtcagcttgttgacgagaaggagaccgagtccatgatctgggtcgacaacctcaaggcctacgtctctgtcattgctggcattgacaactctgagtctctcgtcgaggccatccgcaagactgctctccccggtgccgtcgccgaggccgaggccgaggaggatgaggaggaaggcgaggatctttgcaactgtaccttctctcttgccta

SEQ ID NO: 28211 - DNA, 635 bp, Sorghum bicolor
  Clone ID: 7535967
gcacgaggcttggggcaagaggtatacgacacaaaaaaccgcccgccatgtcatacttcttcgcgactcccgtcgatatcgacgtcgtcctcgatgatacggatgagcgttctatggtcgatgtcaagttagacaagaaccgtcgcgagaaggcgcctctctttatggatggcgagtctgtcaagggcgctgtcactgttcgcccaaaggatggcaagaggctcgagcatactggcatcaaggtccagttcatcggcacgatagaaatgttcttcgatcgcggcaaccactacgaatttctctccctcaaccaggaactcgctgcgcctggcgagcttcagcacccacaaacattcgacttcaacttcaaaaacgttgagaagcagtacgaatcatacaatggcatcaacgttaagctgcgctacttcgtccgcgtcaccgtttcacgccgcatggccgatgtcatccgggaaaaggatatctgggtctacagctatcgcatcccccctgagatgaacagcagcattaagatggatgttggtatcgaggactgtctacatattgagttcgagtacagcaagagcaaataccacctcaaggatgtcattgttgggcgcatctactttttgcttgtg

SEQ ID NO: 28212 - DNA, 486 bp, Sorghum bicolor
  Clone ID: 7535970
gcacgaggcggcggcggggccatggggttctcgctgtaccccaccaagtcgtcgacgcgcatgccgtggagcaccagcttcttccgccacaagttccccgccgccgccgccgccgcgccctccttctgatcaggctagctccggccgcctggcgacctccgtgccgtgcttcaacaagaggacaagaggtggaggagcatactgcatacatacagacgttcagtacatacatagagtttctttttttttttggttcgtgttagtccttggtgcatggactacgctcgtagcatgatcagcagctccgctgtgccattccgtgctgccggcgacggcgatggcggcggacaggtgtttctctttggcggccgcggcggcggcggattccttcgaggattgccgttggtgggtggcgccagcgctgctgccggtgcggcggcggacggccggcgcaagcgggcgtttcaactaacgacggcgcacgag

SEQ ID NO: 28213 - DNA, 556 bp, Sorghum bicolor
  unsure (1)..(556): unsure at all n locations
  Clone ID: 7535987
nngggcctacggccccaacaaccccgcccttgaccgcatcaccaccacccagaccatctctggtaccggtgccctccgtgtcggtgctgctttcctccagaagttcttccctggcgagaagaagatctacatccctaccccctcgtgggctaaccacaaggccgttttcaaccatgccggtcttgaggtcgagcagtaccgctactacgacaagaagaccatcggccttgactttgagggtctgattgctgacgtcaagggtgcccccaacggcagtgtcttccttttccacgcttgcgctcacaaccctaccggtgttgaccccacccaggagcagtggaagcagatctctgacgtcgtcaaggagaagggccacttcgccttcttcgacatggcttaccagggctttgccagcggtgacaccgacaaggatgccttcgctgtccgctacttcgttgagcagggccacaacattgccctgtgccagtctttcgccaagaacatgggtctctatggtgagcgtattggtgccttctccctcgtctgtgccgatgcc

SEQ ID NO: 28214 - DNA, 639 bp, Sorghum bicolor
  Clone ID: 7535989
gcacgaggccgcgttcttctctcgagagacctcgagaacccccacatcaactctccgaccccatctgtctcgactatctaccacccacgactgcttgagcccttccgagtccagacccctcgccaacgccctcgcgggcccttcgatcggagaccgtccgacctcgtctcgaggtccagccaaccacaacaactacaacaacacagaagagagagagagactcgtttccaacgatgtatctccgccagccgccgacgccgtgggtcagcagccactcacctgccaagtcgagtcccgccgccgctcccgtggcgctggactgcggaaggctccggagctggcagatgccctccgtagccgccgcccaggtggcgccgctccggacgagctcgcccgtcgagtcgttccgagcgcggccgctgcatccctgcgtggactcagaggacgagcgcagcccgccgtcctccccctcgtcgaccacctcacacaccggagtcgtcccgcacgaggatgtcttgcacaaggttggcctcctgtcgaatgccatccggtacctgagccataaggcgcagaccgagggcctctaccccgaggagcgcgtcctgctcgagggccagctcgccacgctcgagtccatga

SEQ ID NO: 28215 - DNA, 572 bp, Sorghum bicolor
  Clone ID: 7536002
gcacgaggggccaatctcgccctgctcgccgtcgccctgcccaagaacatctcatcgtccccggacctcttcgcgaccgccgtcgtcggcgccgtcccggagcaggtctcggcgctctcgctctgccgcggggacgccaacgccacgacctgctccgcctgcctcgtcacggccttccaggacgtccagaacatgtgctccttcgacaggagcgccgccatctactacgacccctgcattctctactactccgacgacggcggcttcctctcctccggcgacaacgtcgcgtcagcgtcgacggaccgcatcaacctccggaacgtcacgtcggacccggcccggttcaaccgcctcgtcggcgcgctggtgaacgccaccgccgactacgccgcgtacaactcgacgcggcggtacgccgccggggaggccgacttcgaccaggagtaccccaaggtcaaggtgtacagctgggcgcagtgcacgccggacctgacgccggcgcagtgcagggtatgcctcgccggcatcatcgccgagatgccgaggctgttcacggaccgcgtcggcgg

SEQ ID NO: 28216 - DNA, 563 bp, Sorghum bicolor
  Clone ID: 7536003
gcacgaggccaccatctatcatatcacgagccctacgagcacttgaacgaagatggcgaaacaaaaggtgtgcctcgcttactctggcggcctcgacacgagctgcatcttgaagtatttattggaagaaggatatgaagtcatcacctttacggccaacattggccaggaagaggatttcgacgccgtcagagaaaaggcgctgaagattggcgccagcaaggtctacattgaggatcttcgcagagagttcatcgaagagcagtgcttcccggcaatccaatgcaacgccatctacgagaacgtctacctcctcggtacttcgctggctcgtcccgtgacggcacgcgcacagattgccattgcgcaaaaggagggctgcttcgccgtgtctcacggatgtaccggcaagggcaacgatcagattcgatttgaactcgccttctacgctctccagccctccatcaccgtcattgcgccgtggcgtgatcccgtcttctacgacaagttcaaaggccgcaacgacctgctcgactatgccaaggcaatggacattcccgtga

SEQ ID NO: 28217 - DNA, 649 bp, Sorghum bicolor
  Clone ID: 7536004
gcacgagggtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatccccgtctccttcaaccaggctgtcggcgccaccacccccttcttcaccgctgtctttgcctacctcatgaccgtcaagcgcgagtcctttctcacctatctcgcgctcgtgcccgtcgtcaccggtgtcatcatcgccagcggcggagagcccagctttaatctgtttgggttcatcatgtgcgttggagcaactgctgcgagggcactca

SEQ ID NO: 28218 - DNA, 598 bp, Sorghum bicolor
  Clone ID: 7536012
gcacgaggcttagctctccatcctcatcatccaccgatcggcgtcgacgacgtcagccatgcatgacgaggagaagaaggaacccaagtgggtgacggcggtgagcatcgccggccgcatcgcgggcatgggcctagcggtggcggcggcggtgctgatgtccacggcgagccagtgcaccgtgtactacgcggcgccggcggcgtcggcgtacggcggcgccgcgcgcgcgcgcacggtcacgtacagcgacttcccgcccttcgtcttcctcgtgggcgccgcctccatcgcggcgttcctggaggccatcgccatcttcctcgtcgtgtggaagaagggcaaggacaagacgaccaaggtgctcatgccgctgctgggcgtcgccgtgccggcgctgctctactcggcgaccggcgcggctttcgcggccgtgtccgacatgtcctactgctccgccaacggcaagcgcgtcagcatctgtgccggtagcgccgccgccggcggcggtgtcagcggtggcaccaacttctgcagccaggtgcatatcgccgtctacctctctctcgccgcggccgtcgccgtgtccgtcgccgag

SEQ ID NO: 28219 - DNA, 500 bp, Sorghum bicolor
  Clone ID: 7536014
gcacgaggaccgaactcaagtcacagcgattcgacttcgaaaagattgtatgccaagaatgcgggcagacgtctttcagccgggacgctgaattgaggcgccatatttctgagcaacatcgatgcccacatgaagattgtgtagaggtgaaattcgtgaactcgaaggatagggatgaccaccagagagccattcatcacaaccggcttgggcatagatgcggtaaatgcctactggaaggacagcctccaaacaacctgccgcgtctcgacaagctcagggaacactatcggaaagtccaccatctcaaaactgcttttgaatttttcaagtgcaaacacccttcctgtctccctagcaaagaatacggcgggttgttctttgattcgctagacgcactggaaaagcataagcagaatgcacacccaaatccagccgatcgtcctgccatgaaattctatgataaagatttctcggatgtcagcatagccaaacgggct

SEQ ID NO: 28220 - DNA, 439 bp, Sorghum bicolor
  Clone ID: 7536016
gcacgaggggcctgcagttcggcgtcaatttccagagttagcagtaataatagtcatgtcgtcgctattactctctttctttggcgttgtggcaattgcctcggccacggaatcactggttgctcgcaataatccaccgcagccaccatgcgtttacccatataccaaattcgtctactcgggatgtttcgtggactccgtatctagccgggcgcttcctttcatgaccgagctcgaattcaacaatgccacagtcgagcaatgcactgcctactgcaaggggaacaactatcgatatgcgggcctcgaataccatggccaatgtttttgcggaaccagtgtttcgtcttccgctgctgcagaaacagagtgcaatctgccttgcaatggtgatccaactcaagtctgtggaggagaagatcgcgtgtcaatataccaa

SEQ ID NO: 28221 - DNA, 630 bp, Sorghum bicolor
  Clone ID: 7536021
gcacgaggatcagttcacccagcaactgagcatggctcttgcagccaaagacgcgcaaagtcttgcgcgtctagtctcctctgatatcgatccagcgatctcacctatggctgggatcatgtttaataacaacaagcgtgttgaattcagtaggaaatctatggaaaaatactttaaaggatctattcaatcaccctgggatgatattgctattactctaacgcaggtcatagcctaccaactggacaagaacaactcacaagcacatctcgaacaagctgcactgaccaatcattattttcgtttcttcatcaaccagaccaagtggtcgcttcctgctttatttaccatcttaatagacctgcgaaccttggcagataaagcagatatagaagcatcacagaagatgcagaaatccgacgccttggaggatgcagctcgcatatgtaataaggcatttacaaactgtcttatagaccgtataaatcctccaaaccaaacccgaaaatggggtacgtatcgcacagtgggccttgttctcaaatgttatttcaaaactgagcgtatagcacttgctaaaaacgtccttcgtgcaatttctgcacaacccgatcttgcacctttgactag

SEQ ID NO: 28222 - DNA, 577 bp, Sorghum bicolor
  Clone ID: 7536034
gcacgagggttcggtctcccgtcggtctttgcccccctcattcgttaaagctacaccgcagccatgcgcttccttagtatcgctgcctttgcaggcctagctgccgcaacccatgtcgctggtcacaagctcgaggctcgtgactctcatctccaaggtcgtacctggtgtaatggtggtcaaggatggatcaacaaccgctgccaggactgcgcccccggccaatttagtccaggtggttataggccctcgtgccagacttgccctgccggttccacttcgagcacttgcgagtcctactgtgtctgcaagcccggttggtacatcaacggtggaaagactaccaacaatgcctgcagcccgtgctccgctggctggactagcaaccagggtgattcctcctgctcggcttgccctgcgaatacctactcgacccaaggcggaacatgccaggcttgccctgccggatatacctcgaaccgagcctccggctcttgccaagcccagtgcaacgctggttcttacctcgtcaacggccagtgcaggacttgcccggctggttcctactcgcaggctg

SEQ ID NO: 28223 - DNA, 605 bp, Sorghum bicolor
  Clone ID: 7536046
gcacgagggttcatagtgcagggcagtgtctggattcagcaatgtgatcatcgccggggtactggctgttacgagtatggatggttgttctcattcgatgacccccttttttgcggaataagtgtttgaccagcagtgcgttatccaatagctgatattgagtttcaagtttgaaaatttaaaaatggaaaactgcctggttgtcgcatagcctgtcaggacgcctgatctgactctctgtcttgctgatggttgccaaagatataataactgtcatctcacatcagtgaatttcccaagtaacacacagaatgcttgatgtgttacccgaattaaatgcttatgcgatgtttaagtttttgtgctatctgcctgatgatgagtaagtttggactcagttgagataatttttctggtgctgtggcaaattcttggggtctcatattactccactagcgtttcactattccatgtgtctaacagttcaaaagaaccctgtgcttggtggctggcgaggctgggtctacttgacgaataaggggcatcctatttcaaagatgctgcaaggtgcttctctacggattgcttgtctgatggcacgctta

SEQ ID NO: 28224 - DNA, 615 bp, Sorghum bicolor
  Clone ID: 7536052
gcacgaggtggcaaggtgcaggtcctgttgtggatctcttccagccgggagtggagggaattcccatggttgccgcgcgacgcctgcgacgactacgcgttgtgcggtgcgttcggcttgtgcaacgtcggcgccgcgtcggcgccgtcctgcagctgcgccgtggggttcagccccgtgaactcgtcggagtggtccaggaaggaatcctctggcgggtgccagagggatgtgcagctggagtgcggcaatggcacggcggcgacggaccggttcacgcttgtgcccggcgtgaagctccctgacacggacaacgcgacggtggacatgggggcgacgctggaccagtgcaaggcgaggtgcctcgccaactgctcgtgcgtggcctatgcccccgccgacatccgagagggtaatggcactggctgcgtcatgtggacagataacatcgttgatgtcaggtacatagaaaatgggcaggatctctatctgaggttggccaagtctgaatcagctacagggaagcgggggcgtgtggcaaaaatcttagttccagtgatggtgtctgtgcttgtactcacgggcgctggcctgtaccttgtttggatatgcaag

SEQ ID NO: 28225 - DNA, 561 bp, Sorghum bicolor
  Clone ID: 7536054
ggcgatggcttcaaagagggaagtggttgcaatggagtaggcacgctaacaattgccggagtcacgggactagctctgctagtgcttctctttattcttggtttctggacccattggcttgttaagaagaggaaacttgcaaagacaaaacagagatactttatgcagaatggtggcttgttgctgaagcagcagatgttttctgagagggcaccgctgcatatattcacctctagtgagcttgacaaagcaaccagtaacttcagtgatgacaatattattggcagagggggatttgggactgtgtacaaaggcatactatccaaccaagtggttgtggcaatcaagaaggcacaacgagttgatcagacccagatggaacaattcgtcaacgagttgatcattctttcacaagcgaaccacaaacatgtggtccaactattaggatgttgtcttgagactgaagttcctttattggtttatgagttcattaccaatggggccctttttcatcatctacacaatacatcatccccgatgtcatgggagaaccgtctaagc

SEQ ID NO: 28226 - DNA, 386 bp, Sorghum bicolor
  Clone ID: 7536057
gcacgaggcgccgccgcccggcgcccccctcagtcctcatcactgcgcagcagaccaatggtggatgcgatggcggcgagcggtgtggaggatgagagggtgggcggggaggtcaggggggaggaagaagacgacgacgtgcctcagctgagcgctgcggctatggaggcgctccgggagttcctggcggaacagcagcggccggaggagcaggatgaaactggaggaggggaaggcggggtaaagctggtcccggaggactggcggctgagccagttctggtacgacgagcgcaccgcgcggtcgctggtggaggaggtcgtccgcctcgtctccccttctggctcaggctccgcctccggcgccgtggcctgcatcacgtgccc

SEQ ID NO: 28227 - DNA, 539 bp, Sorghum bicolor
  Clone ID: 7536059
gcacgaggcgaccagagaccgtcctattcctactctgctgggatccgcgcaccgaggcgtggaggagtgatcgaccgagccggcgaggcgatgggcagcgtggcgatggactccgactacggcgcgccgcgcgagctgtcgccgctccagaaggcgcgcgcgctctaccgaccggaacccccgccgtgcctccagggcaccacagtcacggtggagtacggagatgctgcaatcgcggccgataatgatgctcacgtcatcagccacgccttcccccacacctatggccagccgctggcgcacttcctcggcaagacggccaatgtgcccgacgctagcatcataacagagcatcctgtagtaagggttggcattgtcttcagtgggaggcaatccccaggagggcacaatgttatatggggcctctatgatgctataaaggctcataactcaaacagcaaaattattggttttctaggaggaactgatggattattcgcacagaaaactatggaaatcaccgatgaagctctttcatc

SEQ ID NO: 28228 - DNA, 583 bp, Sorghum bicolor
  Clone ID: 7536064
gcacgagggggaaagcgatacccacgggagcacgcgccgaagaggccatgcaggacggcggcgaggtgctgttcctggacggcgtcggggacgtcgccgtcaccgtcggccgcaacggcctctctgtacagcccctccacccggaactggtctcttcatgttggtcatccattacactgcagcctaaattagacagccaaatcaagttttcagatctttatgccatagagatgcttgataagggtcctatttgtgggccttggagtacaaggactactattcaaggcaagaaaaatatcgagatgcaccgctttgttgtacatggtattaccagaagaaggaaacacccttctccatgggtaccttgtgaatatatttttggtcacaaagacttgaagatatgcacagattggtttgagcgtctcatttcatgcataaacaatgaaggcggtagaccaaagaacctaatggtatttgttcatccattatgtggaaaaggtagaggggtcaggaactgggaaacagtgtctccattatttattagagcgaaaataaaaacaaaggtgatagtgacacagagagc

SEQ ID NO: 28229 - DNA, 535 bp, Sorghum bicolor
  Clone ID: 7536067
gcacgaggattgaatccacaagaatgaaagttttagccgttctctttgcatttactgcctttttggcccatgcttctgcatctttgactcctctctttgagcgtcataccgttccacaaggttgggtcaaggcagcccgcgccgagccctcagccaaggttcatttccatgttgccatccagcaacagaatctcgatgtcttggagaagattttctgggaggtctctgatcctgagcatgacaactacttgaacttcatgaccaaggatgaaatcctttcattggtcgcaccaaagccagagcaccgtcagactgtcatcagctggctccacgagcatggtgtcaaggagttctctgacttcgttgactccattgagggctggaccatcgcagcaactgctgagaagatgttcggcactgaattctttgagttccgaaacatggagactggcaagaaggtcatcaaggcattcggccaagtcgccatcgactccgaggttcatgatgccatcgatagcgtcatgagcatctctga

SEQ ID NO: 28230 - DNA, 162 bp, Sorghum bicolor
  Clone ID: 7536082
gcccaaaagcaaaggcctaacattggggatatcccaagcaggttgaatgaaccagaaaataattttgagaattggccaggacttttgcctttgaaaaggagagcttacccattgttgtgacatttttacccaagaaattccatggaggttaaatgaagaaac

SEQ ID NO: 28231 - DNA, 372 bp, Sorghum bicolor
  Clone ID: 7536085
ccgcgcgctgccaccttccccttcgccccgaacagatcgccatcgtcggagccaccggggagatggctcgccctctgctcctccctccgcatgttcacgcacgctgctcatccggcctccgcctggttcctcccgtggtgccggtggtctgctctcccacagcgtgccgcggcggctgcagatggctcggctctacgcacggcccgccctacccagcgagcgcgcgcttctcgcgcgcatcggctcggggtgggcggaggaggttcttccttcccttgtgatcgaactccccctgcgcgggagggacgggccggcgtgagcgagcgagcgtgatcatcgagcagcggcgctaactatccctgcattcgtttc

SEQ ID NO: 28232 - DNA, 501 bp, Sorghum bicolor
  unsure (1)..(501): unsure at all n locations
  Clone ID: 7536090
caccttctacgactacaaccgaccggaggagctgccgccggcgatgaagcacgcctaccgcgtcgtcgttgccgaccctccctatctgagtaaggaatgcttggaaaaggttgccaagacagtgtctttcctcgcacagcctgaaggttcattcctgctgctgctcacaggggaagttcagaaggatcgagcattggagctgctgaatgttcgtccttgtggtttcaggcctcggcactcgaataaactaggcaatgagttccggctgttcacgaattatgatcctgctgacagacttggtggttgggaccaaagtgacggtgcttccatttaactgtacactaatacaatgtttcttccagagttgttccatctttttttttgtgaacagagttgttccatctttatgaacacactgtctttattttacagctcgttaacttattgctccaatttgaattgtagcgacagttatttgataaatntatgtgtttgtgattt

SEQ ID NO: 28233 - DNA, 572 bp, Sorghum bicolor
  Clone ID: 7536106
tccacctgcccacgcaacacctactcgaacggcgacaactgctcgccttgccccgccggttcgacttccaaccctggttcgagcagctgcggtcctcagccctcgcgtcgtgctcagcccgttctcacttcgtgcgctgttcccggtgaggtccgttgccccgtctggagcggcatgggcggttccgagtgtgtgaacaccatgtccaccaaggactcgtgcggtggatgtgttgctcctgaaggtctcgagagcgccgagttcaccggtcgcgactgcaccgcgatccccaacgtcgacaaggtcgactgccacgccggaagctgcaagatccacacctgccgctctggctacgagctcttgggcgaatcttgcgttcccaagccgggcgcgaagaacacgacttctcactcgaagcgtagcatgatctcccgccacgactcgttctgatcttgacggacctgttctcttgttgtgctcacaatggatgatgagcattctgtctcttttcttactttgagcttgtgtttgggtcggaccttgtgcttcatatacagatatccttctttttt

SEQ ID NO: 28234 - DNA, 450 bp, Sorghum bicolor
  Clone ID: 7536108
ggttagagttttttctttaatttctagaaatgtcactgatgaatgcgtgcatggtggtttccttgaaactgggcagcaccagtgacggcggcagcgccggagcctgaagcgccggcgacagctccacctgcggaacccacggccacggcgacgccaccgatcagccaggtacagacgaagccggcggttgtgcccagcgccgccgggagagcaagctcggacgtgccagcgacggctaggtttggactgctgcttgcaattggagctgcgctgatggcctgatttgtgaacgaatatttatgtgatatatccgtccttagcagtggttagctaaataactgagcactggggagtgtcttggtgaattttattagttgagtatgtattatttgtttgtttgtaaattgatggtgttctgaattggtagtacctgtatttgtcacttttttc

SEQ ID NO: 28235 - DNA, 536 bp, Sorghum bicolor
  Clone ID: 7536110
ctgtcatcgcgatgctatacggaaccaagaattgattttaacatatttaataccgttatctctcctcaatggcatcccaccttcttcaacccttctaactactttccctcgtcttggagaggtatacacaccatttgtgaacgctctacggcagggagatgtcaaagcttacgacaacgcccttgaatgggcagaagtcaggcttgcagaaagtggagtgacgatgtgtatggagaagagtcgagaaggatgtctcagaggtcttgttcgaaaaatatggcttgctctttcaaaaccaacacgtcttcctgttgcttctgctcttaaagcgtttcatctttcaggactgacatcatatactatggaagaagcggaatgtatccttgccatcttgatctataaaggatacatgaagggatatatcagtcatgaaaaacagattgtagttctggcaaaggttgatccatttccaaaattagggacgaaaggcgttggccaaggttagactatgtttctaaaaatacatatatataatg

SEQ ID NO: 28236 - DNA, 524 bp, Sorghum bicolor
  Clone ID: 7536112
gccctcatccccgacaaaatgctcgggatactattgcccgatcccccctccaggaaagccaagcatttccacttcctccccttttccttcaaagtccagtccctttacgcccaaaccctcaagcccaacaaaatgctcaggatattactgtgtggcgcctacgacgttcccccccccgacgcccccttcgccatggccccctgagatccccccctgtgagggcattttttgttggcctcccccgaacaatccatcccccagctgctggctcggtttgatttgcgccccggctactcccccgagctccttgaagccggcatcgtcgacgaagaacccgactacgactagtgctcagggctatccgcccgtgcccaacccttcgccctattaatgagtaattgagtttggttagttgatcgagatacgcgaataaaataaaagggatgttacggggagaggctgctccgagtgcaagtgggcaggtaatggtgatgtagttgatgataattaaatgcgtaatattt

SEQ ID NO: 28237 - DNA, 537 bp, Sorghum bicolor
  Clone ID: 7536114
cgtcttctgaggctgaaggtgcgcagcaaggaccatcgtcccccgcagagcctgaatacgacctggagatgaaacgcatgcctgtcaaatgtaaaggtcgcgtccttcccaagatctctgtcgaggactgggtagtattgcagggcggtgacatcatcaacgagaagctctctgctctcgaaattacggatgaagcttcggctgaccctctttgttagctccatcaatctgtgccaaaccctgcggacgtgcattcggtccaccgttatacttatcagtatatacatggaaagctgcggtggaaacgagaaggacatccgcgatagttagactttcacttgaacttgaattttgcgaaatcattgcctgtcgtatcctgggcataaatatacgttggatttcttatcgttttcacgcagtgtaccatcgttctcgataatgtttctcttgtctctttctcccccgtctctgaaaattatgctgcgagcagttacagactctcattgtttcccagagaatatacgttcattttgatgt

SEQ ID NO: 28238 - DNA, 610 bp, Sorghum bicolor
  Clone ID: 7536117
tggtccttgagatcgtgacgggaaagaagcacaacgtctgccgggacgacgacgcctggcgatcgcgtgatgaagacgatctcttgagcctcgtatgggaccactggacggccggggtggtgccggaggcgatcgtagacccgtgcctgggaagaagctgcttctgccggagcgacgtgctaaggtgcatccaaattggtctgctatgcgtccaggaagacccggcagaccggccggtgatgtcgtccgtcgtaatgatgctcggaagcgacacggtctccctttggaacccgtccaacccggcgttctacggcaggaacagggcgccggccacctccagctagcacatcgtccggcgagtataccgcgcgcgtgagagcaataatgcaatcatgcgtacatacaactttaatattaaaaatatcttcatttgacacaaaatataattttcgtgagacgacaagcccttgtgccctattaatatgctgctgaaattttatattattttctcgagcattttgacaaccttaaatgtacaaactaaaaactataaagttgtaaatatcattgaaacctacatctttggtataaaatgtatcttcatttgacc

SEQ ID NO: 28239 - DNA, 116 bp, Sorghum bicolor
  Clone ID: 7536121
ctcagaacactagcatggccttgagctctgatttacaagtaaatgtggatgccaacaagagagaagcacaattactctgactcgtccttgtgtcaaggggcatgctatacttccac

SEQ ID NO: 28240 - DNA, 665 bp, Sorghum bicolor
  Clone ID: 7536122
tctttatcagagcacaaaagaagtttaccccctgaaaaacataccagtgataggttgaacaaggagacagggaatgttagccgcgatgcttcacgggatagcagtcctggcatgaaaggaagaccttcggctcctggaaatttacagaggatagatcagagcccaaatttacctgtcccaacaatgcactctgagaaaacaaaagaaaatactgtgaaatcaagttcgaagaaaaaatcagataagatgcagaaaccatggcatggtatggatggtgactttgggccaggttattcacatggtgtagatcaccatgccaattttgatggctctgatgattcttccacaagaaaaaggagtagacatgggaatcctcttattgatgataaaatgcttaagcgctcgaaggacgttaatgtcaatgtaaattccatgaatttaaccaaagtttccagagaaattgttgtgcctgatgagataactgcttttcctgaatctaacgaaagtaatggtgagccatcaaattcacaaagagataatgttgagagatcaccttatggtaaaaaaaagctccagagagagctctctgatcttgagttgggtgaacttcgtgagacttctttggaaaatgatgatggaaggataaggaagcaatttgagagaaa

SEQ ID NO: 28241 - DNA, 420 bp, Sorghum bicolor
  Clone ID: 7536126
gcacgaggctgctcctggccctcgccgcgggcgcggccggcgcggcgggcggcggcacagactcggacgcggacgcggacgcgctgctcgccgcgaaggcggcgctatccgaccccaccggcgcgctcgcgtgatggggcgtcgcctcctccgaccactgcgcgtgggcgggggtcacctgcgcgccccgcgggtccggcggcgtcgtcgtcgggctcgacgtctccgggctcaacctgtccggcgcgctcccgccggcgctgtcgcggctccgcggcctgcagcgcctctccgtcgacgccaacggcttctacgggcccatcccgccgtcgcttgcgcgcctgcagctcctcgtccacctcaacctctccaacaacgccttcaacggatccttcccgcctgcgctcgcgcggctccgcg

SEQ ID NO: 28242 - DNA, 484 bp, Sorghum bicolor
  Clone ID: 7536127
gcacgagggacatctccacggaagaccccgaggccgtgttcgagttgcaggagaagctcgggaaggggtcatacggcatggtttacaaagggcgcaaccgcaccactaatgagactctggccgtcaaaatacttgccctcgacgacgaggctacgctaaaggctgtgcggggtgagatcaagatattagcgacgtgcaaccatgccaacatcgtgcgctacgggggcagctacttcaaggacgagaagctttggatctgcatggagtactgtggaggaggatcggtgagtgatctgtgcgtgattctggactcaggcctccaggaagaccaaatagctatcatttgtcgcgaggctctcaagggcctcaactacctccacaacggcaccaaaatccacagagacatcaagggcggcaatatcctcctcaccgaaagcggcgatgtgaagttggccgatttcggggtgtcggcaacgctgttcaa

SEQ ID NO: 28243 - DNA, 536 bp, Sorghum bicolor
  unsure (1)..(536): unsure at all n locations
  Clone ID: 7536133
aaagtcagctttcctttccttgcggagcttctttggctaagtttgagttccctttctcgcccttctcaggctctgtaaagtttttctgttgtctgttttgttttcctctattactttgtacagttgtttcttatttttaacaaaattcttacagtgggggcctcccctgctgtatttatggtaaaaaaagtaattcctttttatggcatggaccttcatgtgtgagcaatttgcagctagcatattcatttgttttccttgaaataggtataaaacagagtgtggtcaaaggttggagcctattgaagaagtgactgttgaggtggatgaagagcatgtgggattcgtcttggaaaccattacacacaggaagggtgaagtagttgacatgggcccagttcctgngacaactggaagaactcgaatcttcatgacctgtccatctangggtttggtgggtgtcaaaggaattttcagcagttttacacgtggaactggatttatgcaccgtgctttccaggcatatgctaaataca

SEQ ID NO: 28244 - DNA, 602 bp, Sorghum bicolor
  Clone ID: 7536135
gcacgagggctctctcgaaggcaggcacaagctgaaactatttatttgcacagagaaaaatgtgaagcttttcttcaattgtgtgcactgtcttgttggagcagaattttttggtggtccttacactctcaccgacaagttcagttctgctcaacgggagttagtggaccagctgatagaggatgcatatgctgaagttgataagctccctgaggatcatgtgatcacagaacactctcctaacccaattcatgtggataaatatactagcattggtgctggcccatcctatatgccaactgaacagcaaaactgttctgtgcgcctcgcatctgttcatggtatggcagcagctgaaagattgagccatgatcggattgagtcatcttgtctgaatgcatacaatgacccagttcccagctccagcattcctgatcaccccagcatgcataactatcaaggtggaagtattccagttgtaccacttgaaggcttgagccatgatcagtacaatgagttatcatgtgcaaatgcaaacaataatgatcctggacctagttcctccaatgctgatcacctctgcacatatgactcccgagaca

SEQ ID NO: 28245 - DNA, 490 bp, Sorghum bicolor
  Clone ID: 7536139
gcacgaggtacattctgacaatcccctagctatagttgagtccaccaaactccaagctcatggcggagatggtgaggtatgcagttgccgaggagatagccaagcaaatcgtctccggcatcctggacaagcacggacggaaaccaccgaacgacaaggagcagctggagcggctggagatggcacacatcaagctggaggccgcgctggagacctccgacaggtggcagatccgcgacgcgtccctgctccgctggcgcaagaagctcaagcgcgccgctcaggagtgcgacgacacgctgcgccggtgcaagcagcgcgccgtggccgtggacgaggacgaggacggccaagagaagcatcagcgtgtgccggtgatccgccgctcgtcctcgtccttgccgacgcggctcgtccacgccaccacgtccttcgtctcctccatcctcctcagcgcccgcaacaggaccgacgccgccgccgacgccga

SEQ ID NO: 28246 - DNA, 665 bp, Sorghum bicolor
  Clone ID: 7536141
gcacgagggccatcaacacgtgaggatgctgcagatattaggcagtcagggcggaatgaagatgattcagatcagattgatttatctgggttttctgggaatctacgtcgggatgaccgtgataacagccgtgactgctggagaatatctgatgggaacaatttcagagttcgaagcaagaattttgtatatgataaaagcaaggttcctgcaggaaagcctcttatggagcttgttgctgttgactggtttaaagacgcaaagcgaatggaccatgttgctagaagaaaaggctgtgcagttcaagtagcggctgagaagggactgtttgcattggctataaatctacaagttcctggcacaacaaactatagtatggttttctactttgttacgaagaaactgataccaaactccttattgcaacgctttgttgatggtgatgatgaatatcggaatagtaggttcaagttgataccatcagttcctaagggctcatggattgttcgccaaagtgttggcagcactccttgtctattaggaaaagctgttgacattacctatatacgtggctcaaattatttagaaatagatgtggatattggctcgtctacagtggcgaatggagtcttggggcttgtgtgtggtgtgataacaacactagt

SEQ ID NO: 28247 - DNA, 589 bp, Sorghum bicolor
  Clone ID: 7536157
gcacgaggctcaaaacgaaaacagctctacgccgtcaaggagttcaagcaacgaccgggcgagtctgccaaacgctaccagaagcgcctcacatccgagttttgcatatcctcgtccatgcagcaccctaatgtcatcactacgcttgatttgctccaggacgagaaaggcacatattgcgaggtcatggagtactgctcgggcggtgacttgtacaccctggtcctcgcagccggccagctcgaggttgttgaagcagactgcttcttcaagcagctgatgcgcggtgtagagtacatgcacgaaatgggagtcgcgcatcgcgatctcaaacccgaaaacctgctcctgaccgcccacggctccatcaagattaccgactttggcaacggcgagtgcttccgtatggcctgggagaaggaggcgcacatgacggctggtctatgtggctcggctccttacattgctcctgaagaatatgtcgacaaggagtttgacccccgtgctgtcgacgtctgggcctgtggtattatctacatggccatgaggacgggccgccacctgtggcgtgttgctcaaaaggcgagga

SEQ ID NO: 28248 - DNA, 610 bp, Sorghum bicolor
  Clone ID: 7536164
gcacgaggtgactgataatatgctgactggagatttgcctgcttggatgttgaaaaacaaggcgagcaataaagtaaacatggatatatcgtacaatgacttcacgggcaaccctccatctgaatgtcagcaagcaaatgtaaatatggtgtcaagcttttcatcttcaaataacaattcattgcaaccatgtttaagaaagaatcttccttgcacgaccagaccacgccattcctccctgttcatcaactgtggtggaaaaagtgttgtggtcgatgggaatacctatgaggatgactcgtctcaaatagggacatcaatgttttctgtgtctgatgataagaaatgggcatatagtagcactggtgattttgtgggcaacgagaatgctgactacattgctagaaacacgtcgaagctaaatctggcttacccggagctttacactgaagctcgcctctcacctctgtcactgaaatactatggcctttgcatggagaatggtgaatatacggtaaaacttcactttgctgaaattgtgttcacagaagatcatacttattccagcaatggcaagcgtgttttcgatgtcttcatccagggtgtcaaa

SEQ ID NO: 28249 - DNA, 523 bp, Sorghum bicolor
  Clone ID: 7536167
gcacgaggggagagcagccatggacgcggcggtttcgagcccctcgagcaagaggatcgcgctggtgaccggagggaacaaggggatcgggctggagacgtgccggcagctggcgtccaaggggctcagggtcgtcctgacggcgaggaatgaggcgaggggtttggaagcggtcgagcgcatccggtgggccagcggcgacgccgaggttttcttccaccagctcgatgtcaccgacccctccagcgccgcccggctcgcggagttcgttagggatcaattcggcaggcttgacatcctgatcaacaatgcaggaatttcaggtgttgatcgtgatccagttttgtttgctgcagtcaaggataaggttgatggcatggatgtagatcagagagtagaatggatgagagaaaattcaaaagaaacatatgacgaagctatacaatgtatgagaacaaactactatggtgccaagctggtcacagaggcactacttcctcttcttcagttatcctcctctgga

SEQ ID NO: 28250 - DNA, 624 bp, Sorghum bicolor
  Clone ID: 7536169
gcacgaggttcgcttttaggacttctttttctacacctagacacacaggcctcgaagccgtaaaccgcaatcatgggtctcgctttctcaaagctcttcgaccgactatgggggaagaaggagatgcgaattttgatggttggtcttgatgccgctggtaaaaccaccatcctctacaagcttaagcttggcgagattgtcaccaccatccccactatcggcttcaatgtcgagactgtagagtacaagaacattcaattcactgtgtgggatgtcggtggtcaggacaagattcgtcctttgtggagacactacttccagaacactcagggtatcatcttcgtcgttgactccaacgatcgcgatcgtattgttgaggcacgagaggagctccagcgtatgctcaacgaggacgagcttcgcgatgctatccttcttgtcttcgccaacaagcaggatcttccaaacgccatgaacgccgccgagatcacagacaagcttggcctccacagcctgcgacaacgcgcctggtacatccagtccacctgtgccacctccggtgacggtctctatgagggtcttgagtggctcgccaacaccctccgaaaggcgggtcaccagtag

SEQ ID NO: 28251 - DNA, 555 bp, Sorghum bicolor
  Clone ID: 7536175
gcacgaggtattactcctaccacctcccgtcctatgacaatgcgaggggattccggcggacatgcccagcccagcctcacccgcccggcgcctattccctctgttcctcgaccattcccaacccgtcgtcttcgcccgcccgtccaaggtctccgttcaaacatcgcgacagactcactcgccctcactcactgccaaccaactagtccgcctccactagctaacgacgttactaactaacggacgacccgcctgacttgtccaacaaaaccaaaaccccagacatgcccgttgcccgtcgcgacccccggcctcaaacacgtccaaccgccaggccgccggcccaagacgagaaaacacgaacaagtggcagcccagcttgcactcatcgcacgcatgccacatggcctccctctactcaagtattgtaccatctgcgcgagtgtctggtgtggtgacacacgactcagtccgaccgtgaagacggttggatcgacaagtaacgtgacccggcggcattgcttagcagccccattccaatttccctgcatccgt

SEQ ID NO: 28252 - DNA, 515 bp, Sorghum bicolor
  Clone ID: 7536178
caaaaacagcaaattgcggggagggagaagtcagcaattcgcacgagtcgagggctgaagagatcgatgaagaataagcacttcatgatgcccacatagcagcaagatcacgatttaatactccaacatcgaagtcgtggactttgtttttatttgtcttgtattggttcctgcccttacatcgtcgatggtgactggtggggatggttacacatcactgcttggcgatccactcaatttcaatagcgtggatggagttgtcaaccttgaaccaactggctgattcgtgggcgaagatgcgcattcagctcatgcacgtcttccacttttcagcactcgacatgaaatgcgctattgaagctatgcagatctcctgtcggcggggttcagagactgtggaatacaggcaaaaattgcgatggacaaatatcacccgtgttttcatgcgagcattagtacccattgggagcgtacatttctctgaacacgattcggctctgatcaagactggccaa

SEQ ID NO: 28253 - DNA, 618 bp, Sorghum bicolor
  Clone ID: 7536182
gcacgagggcgccatggaggagctgggcccgttcagggtgaagagcgacggcaagacgctgtaccgcaacccgtacgcgtggaacaacgcggcgaacgtgctgttcctggagagccccgccggcgtgggcttctcctactccaacacgacggcggactacggccggttcggcgacaacaagacggcggaggacgcgctgcagttcctgctcaactggatggacaagttccccgagtacaagggccgagacttctacctcgccggggagagctacgccggccactacgtcccgcagctcgcccacgccatcctccgccacgccgccgccaccgtcggcggcggcaagccgtcgtcgtcgtcgcccatcaacctcaagggcatcatgatcgggaacgcggtgatcaacgactggacggacagcaagggcatgtacgacttcttctggacgcacgcgctcatctccgacacgacggcggacgccatcggcaggtactgcaacttcagcgccgccgccgcgggctccgacaagtgcgacgaggcgacgtcggaggccgacgaggccctggaggacatcgacatctacaacatctacgcgcccaactgccagtccgacgacct

SEQ ID NO: 28254 - DNA, 535 bp, Sorghum bicolor
  Clone ID: 7536191
cagatctgctccactgccacctcctctccctctccccagccgcctcccatggcgtctccgagcggaaaccctaaccctaatcccaacccaccattcgagatcgggaagctcttcaggccaccgaaccccatgcccacccccacccccaacaccatcttccccggcgtcgccggaggcccggctggcccgccgccgccgtccggtccctactcctaccctccggtgaccccgcccttccaccgcggaccctacatccactacccgcaggacccccacgccatgccccgccccgttgtctccttccccatgccaaacccaaacctcaaccccaacccgaacgctaaccccaacgccgccgccccgggccccaaccccggcgcgcgcctcatgcagctactcgggaactccgggccgacccaactcgagaccgccgtctccatgcccccgcccacgtcggagttcgcgcagccgcagccgctcccagcgatgccatccgcgccgccggccaggatgctgagcagcaccagcagcaagg

SEQ ID NO: 28255 - DNA, 528 bp, Sorghum bicolor
  unsure (1)..(528): unsure at all n locations
  Clone ID: 7536194
gcacgaggtccacattggattccagattctgggacaaaaacaagtttgttatttgaaacttacagagcagcgcctcgtcctcttggcaatgctgtttcatatgtaaattgtgctttcttggggcatgcttctgtggatgaacaatcagatactcttgtattgagtaatctgcgcttggcttttggtgcatatggaacagaacatgctattagagcaaagaaggtggaggacttccttactggcaaatcactcactgcatcggttgtacttggtgcaattcaattacttagagaaaccgttgtaccaatggagggaacatcacatcctgaatatagagtcagtgcagctattggatttctcttcagttttctatctccgctttctaaaggcatcccagagcctggaaagtctctgaccagtagttctgctgattcagcagttacagatgatgtctgtaacatgccattatagacacgtcgagaaacagttntcagtgatgaatataaaccagtcggcgagccgattaag

SEQ ID NO: 28256 - DNA, 605 bp, Sorghum bicolor
  unsure (1)..(605): unsure at all n locations
  Clone ID: 7536197
gcacgaggccattcttcactctagctgctgctactcttccaaattcgacccacaatggccaccggcacgttcacccaactgtttcccccagcaccaaccttcacagaaaagacgcttggtgatcttgcggggaaggtctatgtcatcactggcgcagcatcaggtgttggtctcgagcttgccaagatactctactcaaagaatggcaccgtctatgtcgctgcgcgatcacaaaagcgcgcagaaggtggcatcgccgccatcaaaaaggccgtcggcaaaactcaaggctctctgaaagctatggtcgttgatctcgccgatctaacaaccatcaagcctgccgtcgatgccttttcagcacatgaatcccgtctggatgttcttttcctcaatgctggtgtcatgacaccgcctgctggtagtaagacagtgcaaggctacgatctcgagctgggagtacattgcatggcaggcttcctgctagcacgcctcttggagcccatccaaagcgccaccgtggctctacccgatacgcccagcggtagcgtccgcgtcgtgtgggtgtcctctctgctgaacctgngggcacctcccggtggcgt

SEQ ID NO: 28257 - DNA, 524 bp, Sorghum bicolor
  Clone ID: 7536205
gcacgagggtttttataaccctgacccaacgcaaggccatggcgacaagcttgctgttacctgttagcaccattgcagagcaccaccagagccagagggaggaagaaggagagcaaggcgaggaggcggcggcagcggaatcatggactgctgcatctgcagccccatggcagccgtgtacaggcttccgaggaacgccatctgtgctccctgccatgagggcgccaaggccatcatcggatttctgaacaaggatgatgagcatcagcatgaagaagagggcagcctgagccatggctctgtgctcaagtccagagggtctgtcaagcctaacagcccaaccaaggggatgagagacgcgtgggagcaggtgaaggagatgagaggcagggaggaggaggcccaccagagagccgccttcctggcgatggcgtggaaggagggagtccacaccgacatcgtcgtgaaaccaggcactgggcccccaattccggcccacaaagccatcctggccgcgaagtcgg

SEQ ID NO: 28258 - DNA, 615 bp, Sorghum bicolor
  unsure (1)..(615): unsure at all n locations
  Clone ID: 7536206
gacggcgcattttccacgtacgtggtgcgggacaaggagcgaccccggaaggagggagcccccgcgggtaccgtacggacctactccacgcttcgccgcaaggttgccgacgacccgactcgcggcttcggtctctctgacaagttgcaaaacatctacggccgaggctgtaccatccagattccctttctcaacctcaactacatatcgccggaatggctgctgcgccaggacgacgccaatggagaagccgtggcagacaccatgcacgagctcgctctcgcaggttctgccgtcaccgcctcgccgctggtgctcgtgccgtcgagcccgacgctcggtaatctggtcaagacgctcgggtaccacaagcagtgccagaagtacgtgcccatgacgcccaaggagagtgagcagaatgctcgcatcgtcaacgagctatcgtccaccctcaagacgatcttcaaggtgtaggcagagtggtggtcaccaccctacaccggacgtgtacagtgatgacgtcgtaagcacgcgtcgcgttccccccccccaacctctggtcgcctgtggtacgctagccctcncgcaagtggaggcgcaaccactattatcacc

SEQ ID NO: 28259 - DNA, 445 bp, Sorghum bicolor
  Clone ID: 7536210
aggatcaccatgctgaatttgatagtcatcacggtgaagtggaggcaaggacagttcaaatatcaatgacgttgctggacacctccgatgcaatgcatgggggagacagccctgattcatcactcggggaggaagtgatgtctgaggaagcgaggaggccttaaatcagcagttttgcagctagtttggcgctgtgaccgggtggttctctttgtagatgttttgtatttttttgttaaccccctgtgaagggcgagatctctcctctcctgtcattgtacatcactttgtattagtgtgatccaaactgaagcaaattgctaactgtgtacatatctgtagtgccgatagagaagaagtctgtagtgccgatagagaagaagttttgaaggagggagagaaaactcttacttttttatcgcatacatcaattccttaatgttgc

SEQ ID NO: 28260 - DNA, 197 bp, Sorghum bicolor
  Clone ID: 7536215
aagacggaggcgatggcgtaccaaatgctttggaaatccaagcatggcgcggggtaccttcaggtgaggaagacgacgccacgcaagaattggaagggagataacaagaacaagaggctgttaatgcagcgatatcatcaagacccaaagctggagagatggacacatgtcctcacaaactttttgaatttgtgggt

SEQ ID NO: 28261 - DNA, 411 bp, Sorghum bicolor
  Clone ID: 7536220
ccctggactcatgaagacggagcttcagcgatacggtcccccacctatgcggttgatcatgggcaccattttcaagggtcctaaatatggtgcctataccgagttgtacgcgggattgtcgcctgatgcgaagaacggcggctattacatcccttggggccgtcggggatttgcccctcctcatgttgaggcgtcgtgcaagtcagatggaggaaagccaagcattgcttgtcgcttttacgactggtgtgagcgtgaaacggcccgttttgcctgatcgtttacgtggctgacggtggaatgtgtcgcgtgggggagtttgtgtcagcttgacacctaccagagattttgagatgtagatacctatcatcacccctgtgttgactctccaatttgatcgttttttattcg

SEQ ID NO: 28262 - DNA, 151 bp, Sorghum bicolor
  Clone ID: 7536225
catgtaatggaacccaaaaaaatgggaacctgggaaaaacttgttttttgcatgggagggaacccggaaaaaagggaatttggaaaaggtttgtccagaaacccaattttgggtgggaaagttttgagttccctcgtttggaacccagtaa

SEQ ID NO: 28263 - DNA, 558 bp, Sorghum bicolor
  Clone ID: 7536235
gatcttgtccatacggacgaacggatgatttccagtttcaatgcgggggaatttgtttaactggccgtaaatggcatcgaatgcaatccacggataaattatgtcatgaaggattgcagattacccgaaatccgtagacagaatgcacaggtaagacaatttgaactttgagagccctgcatgcagagatgccgggtaatggccctgtcaccatctcgcaaattctagataggatctgcataaacaccgcgtgactcaaaggtaccactcatagcgaagaaattaacagccccatgtggggcatatgctcagtcgtgtcccgatttaatctttcctctccgtgtacggcagacaagcctcgtagatcgcccgatgacccgggtccttcataagcctctgaaataacccctcatccaccattttagcgttctgaatgtagcccgcaataaaacagtcagtatagctgaattgggcacccagtacaaaaggcccatcggccttgtttgtctgcatcagttccccaattgtacgaattgcctctgcaaccgagttccaaca

SEQ ID NO: 28264 - DNA, 585 bp, Sorghum bicolor
  unsure (1)..(585): unsure at all n locations
  Clone ID: 7536237
cggngcatcagtgatcacctaaaccctcaggctcgcgaaacgtcagccgtcgcaatgccacggcccacgacactcacgacactacttgtaacgcgccgacaggggcccttcgtatcgtccctcgccaaggggccagccagggaaaaagaaaatctttcacgtcccccagcaatgtgatgacttgttgaaccagcacattttttcatcactagtctttgtttgtttctgttgagagtccagtatacaaaaggtacaggcatggtattcaccgccatgtgagcattcacattttgcttactgctacccacctgctgacccacctacatgcgtgagtacagcacatacaatacaagtcctttattttcataggtaggtacgtttacgtgtaagtcagcacgcagatacgaaggaacgtcagcttgggtatacacgttccggctattgatttgttggacattgctttttgtcaagaaagtcccgtgtaccgtaaaccacgtggtaggacaatcgcatctttgcatcaaaataaaatatgcattgttttggaaagtaggtaaataaaataatcaagtacatcatatacgt

SEQ ID NO: 28265 - DNA, 637 bp, Sorghum bicolor
  unsure (1)..(637): unsure at all n locations
  Clone ID: 7536238
gctggtcacagaggcactacttcctcttcttcagttatcctcctctggaagaattgttaatgtttcgtcaggctttgggttactgagaaacttcaacagtgaagaccttaagaaagagtttgatgacattgacaatcttactgaaaataaactagaggaactgttgaataagttcctagaggattttaaggccaacttagtagaggcacatgggtggccaacaggtggatcttcagcctataaagttgccaaagcggcacttaatgcatatactaggattcttgccaagaaatatcctacattgcatatcaattgtctgacacctggttatgtcaagactgatatttgtatgcacatgggagtattaacacttgaggagggtgctcgcaaccctgtgaaggttgctctcttgcctgatgatggaccaactggtgcgtattttgatctgaatggcgaggcgtcctttgtgtgatgatatttctcttttgagcttcagaataaaacgaagagctataaaatagttagtgccaattattattatagttgagacttgtgtactcaaactagcacgttgagcaaaccgtagagctcaactcctggattcctcgtcttctgtataatatncctggtgatgatt

SEQ ID NO: 28266 - DNA, 181 bp, Sorghum bicolor
  Clone ID: 7536240
atggcttcccgggttacgacttttgatggaccctttgcaattcccgatttagttttcggattgaaaggcgcaggtgtttattttggtacgagcccttgtttccttgggcaaatttgttgcagcagcattttgatggaaaaaataaaactcggtattgtaaaacgcattagttggaaagctt

SEQ ID NO: 28267 - DNA, 442 bp, Sorghum bicolor
  Clone ID: 7536241
ttatttttttagctatcattttagtttaaaacctttaacttcagcttagttcataacctttagcttagctgtttgcttcccttggttcagtccagtagtgcagttcagcagcaaagcagttaggcccctttcattttgagtaattgtcccttttcgttaactgtggtcatacaagttatagaaaaaggttttccattagttacccgtggtttttttcccttttggttgatccgttgtaatgtccaaaatgtttaatactaacattttgtatttttatgcaggataaataaatgcccctctgtttgatcgaaggatgatgtatattaaagtttactatttttgctatcaagtatattgtattttttggcctataagtttgtaaatgttgaattcattgtgtacatcaactcattattatatgaataaataaatgtttatttgt

SEQ ID NO: 28268 - DNA, 542 bp, Sorghum bicolor
  Clone ID: 7536248
gactcgaggtttcggttgtaatttgcaaagttatcggtcaaccaatcgaagataaatccttgaaccaaagtcacgtttattcacgttttctgtttaagcaaccttttttaacgcttccttcctctttcaatggtgcttcactgtcagtgttttggtcaacaatatttgcttgccatcgctagcgtcagctcgcttcctgaggactacagaacgtactttttcttttttttttggaggaaaagtcgggtgatgatgggaggcgttttatggggatccccgggatatttgtacagtcgtcaatcgggtgttgtttgctctttgaaaagaatgcatcctcgctgattttacaatcctctcgcaaaccgtggcgcactggtacatccatcgtttgttaattttttctttcccatgtcacttaccctggggaacatgaccatgatgagcaactcaagtaacgagggttataaacgaggcatgaattgggcccccgcaattttgggctgttgtagagattctatatgttttattccaaacctttagtg

SEQ ID NO: 28269 - DNA, 601 bp, Sorghum bicolor
  Clone ID: 7536252
gcacgagggtggttacggcggtggtggtggtggcggcggcggttacggccgtgatgacccttaccgttaccgtggctacgaccgcaactacgagcgacgctatgaggaccgtggaggtggttacggtggcagcagcggtggaggtggtggtggtggccgcgactatgaccgcagctatcgtgatgagcgtcgttacgaggatcgaggcggctatggtggccgcgactatgatcgaggctatgaacgccgtgaccgtgacgagggctacggccgtgatcgctacggaggaggaggcggcggaggcggtcgtgaagagcgagaccgctatggccctcggggaggccctggaggttctggctatgaacgtggtggtgaccgatacgaacgcggaggcgaccgagatgctgctcgaactcgcgacccagccgccagtgctggaggagctggttatggcgaatccgcctctcgatctgagacacgcgatgcctatggaggcgctcccgatcgtaacattcagtaaacgcctgatgtttgccacgactcgactgaaagaacagtctttgggatcacacctccattctcctttgctctactaaccccg

SEQ ID NO: 28270 - DNA, 606 bp, Sorghum bicolor
  Clone ID: 7536254
gcacgaggcgctcctcaatcttgttccacggcttcggctacttcccgttggaacttgcgtgcgcagctccgccaaaccaagacagatacgctctgcttcctgccgagcgttgatatcctcgacagagaaaccctcccttcaggcttataagcaatcagaaaaggcctgcgcctctcttcttcgccatggctgatgaggagaagcacgtcgtggatgccaccccccaggtggctcccgtcgacgaatacgcctccgcccagaacgagtttgttgaccgacccaatggatggatctacaagggctacaagatctttggccgtgaggtctactacgcctcacccagagtccagctgttgctggttgccctggtgtgtttcctctgccccggcatgtacaactctctgagtggtctgggaggtggtggtcaggtcgaccccaaggcccaggaccactcttccgtcgctctgtactctacttttgccgtcgttggtttcttctctggcacctttgccaaccgtctcggtctccgtctcactattggaattggtggtcttggttactgcatctacagcgcctctttcctcagctacaaccacaacaagaaca

SEQ ID NO: 28271 - DNA, 459 bp, Sorghum bicolor
  Clone ID: 7536262
gcacgaggctacctttatctccccccatcttcatcaactagcgcaacgcccacgaacagccaagcatgtcaacgccatacaagctctccgcgaccctcacggcacactcagccgatgtccgcgccctctgtgcccctacgcctgacctcgttatctccggctcacgcgacaccactgctatcgcgtggaggcggaccggggctgccgacagcaagatctgggatccagcgactgtctttcgtgcaagcggaggttatatcggttcggtgacatacatcaaccctacgcctgatgctccacaaggttatgcggtcgtcggcggtcaggatgcggtcatcaacgtctataatatcgctaccggcagctcagagccagagcgtactctgttgggccataccggaaacgtgtgtgccttgaacacctcgacggaaggcacgattatctcgggctcttgggaca

SEQ ID NO: 28272 - DNA, 455 bp, Sorghum bicolor
  Clone ID: 7536272
gcacgaggccctcgcattggtatcaacggatttggccgtattggtcgtctctgcctccgcgctgctctcaagagcaagaaggtcgaagtcgtcgctgtcaacgatcctttcttggaccccacctacatggtctacttgttcactcacgactctgtccacggcagatggcccggtaccgccgaagttaagcctgccgctgagggtcaagctccttccattgttattgacggtcacgaaatcaaggtgttcactgatcgcgatcctgctcacattccttggggttctgtcggtgctgactatgtcatcgagtcctctggtgttttcgccaacaaggaaggtgctagcaagcacttgcaaggtggctgcaagctcgtcgtcatctctgctcccgctgacgtccctatgtacgtcttcggtgtcaaccacgagaaatacaccaacgaccagaaggttat

SEQ ID NO: 28273 - DNA, 562 bp, Sorghum bicolor
  Clone ID: 7536274
gcacgagggtaaactgagaaaagattaacttcatcgtgctcactgctcagcctagtggcgtagtgctgccctgccgaatgccgcccgcctccatcccgtagaagacaaagagagaaggatagaactggacggcggcggcggagacgacgatgcagtggtacttggtggccgcgctcctcaccgtcctcaccagctcccagggaatattgaccaccctttcccagagcaatggcaaatataagtatgattatgccacaattccttttttagatgagctcttcaagttgtctgtctcaggcttcttcctctggaaggaatgccattcttcatctccaccaaggatgacaaaggaatggaggagtgtgcgactatatcttgttccttcagtcatatacctcatccacaacaatgtccagtttgcaacattgacttatgttgacccatctacctatcagataatgggaaacctgaaaattgttacaactgggattttgtttaggcttgttctaaaaaggaagttgtccaatctacaatggatggcaattgttttattggctgttgg

SEQ ID NO: 28274 - DNA, 618 bp, Sorghum bicolor
  Clone ID: 7536285
gcacgaggcaaccatgcgcgccgtcactcttctcgccgtctttgcggccctcttcgtggcttccacccttgctgccactcacgacccgctcacgggcgtgtttgccaagtggatgcgcgagaacaccaagtcctactcgaacgaggagttcatctacaggtggaacgtgtggcgtgacaacttccgcttcgtcgaggagcacaaccgccagaacaagtcttacttccttgccatgaaccagtttggcgatctcaccaacgccgagttcaaccgcctcttcaagggtcttgctttcgactactccaagcacgctaagatccgtactgccgcgcctgagacccctgccacgggcattcccagcgagttcgactggaggcagaagggtgccgtgactcacgtcaagaaccagggtcagtgcggttcgtgctggtcgttctcgaccacgggctctactgagggcgccaacttccttaagactggccagctcgtctcgctctcggagcagaacctgatcgattgctcggtctcgtacggcaacaacggttgcaacggtggtctgatggactatgctttcgagtacatcatcaacaaccgcggcatcgacactgaggcctcgta

SEQ ID NO: 28275 - DNA, 550 bp, Sorghum bicolor
  Clone ID: 7536294
gcacgaggctccagccaagcaagagcgaagccgcaggccggcgcacgaaccgtcccccttccccctggcggcagcaaacatggggctggacgtgccgccggaggagtccaaccggtgcgtgcgcgggtgctgccgcagcgccaccatcccgctccacctcgcgcccgcctccttctccctcctctcccccatcgcgcgaggctcggagagcactgtgtacgaggcgctgctgggcggcgagcgcgccgcggccaagaagcctgtgctgtccaccgccgaggacctcgacaagttccactaccagctccagctcctctgcgagctggagcaccctgggttggcaaaactgatcgcagcacatgcacgccctcctaattacttgatgttctttgacttcttcgagcctccaaacctcgcagaaaagatacatgttgaggaatggatcccttctacccagcaagtggttgcgattgccagtgatctagcgaaggctctccagtacctacaaatccttggggtagtacacagagatataaaacctgcaaatatt

SEQ ID NO: 28276 - DNA, 482 bp, Sorghum bicolor
  Clone ID: 7536301
gcacgagggcctgtcgttcgttaagacaagaattccgcttcagactttcgctttgagattcatctcgattactttgcactactaattctaatattaacaacctcgaaatctatcaacatgcgtttcacctccatcttcgttgccggcgctttcgccaccatggccgctgcccagagcaagactgcttctgtttctcccgctcaacagtctcagcttgactgccttgacgcctgtgatgctggtgatgtcaagtgccagtcttactgcatcactgtcccctctcccgatgagaagaacatcaacgccaccactgagtgtgttgccgcctgccccaagggcaagggttctgcctccgacaccgagaagtactctgtctgtctacaggactgtatcgccgacaactactggaagacagtctccggtactccccgtgagaccggcgctgctggttcaaaagacgaggcttcctctgctgccgagtc

SEQ ID NO: 28277 - DNA, 564 bp, Sorghum bicolor
  Clone ID: 7536302
gcacgagggttatgtatgaacatgcttgtgaagcaagtgcattgctatctggattcaaacatgtatcacaggaccgcactgctttgacttctgaatgtggttccttgctcgaggaggttttagctatagcagatgggttgcatgatgtgtacactctggggaaggaagctgctgcagtgcacagttcccttatgaccaacctttccaaggcaaatacaattttatttccacttgaagcctgtctatgtgctgatgtaactgttatgtctgaagcgatttcaaaggaaagagagaagaataatgctagtatgcctcttattcatggaaaggcattacaccaatcttataacattaaagttagggaagcttgcaaaactatggaacctctggtgggtccactcactgagaatgcgaaggaactgcattccatggtaatgaagcttggacacatctcaagtcttcatgctgggaatcttcacaaggctctagaagttccaggagaaagggaatctgtgagatcccaggatatgctctcaacacatcctgatcttttgcaaagtgatc

SEQ ID NO: 28278 - DNA, 538 bp, Sorghum bicolor
  Clone ID: 7536310
gcacgaggagctggacgagctgctgaggtcgtcggcgtacgtgctgggcaagggcggtaaggggatcgtgtacaaggtggtggtggacaacggcacgacgcccgtggccgtgcgccggctcggcggtggcgccgcggcgcccgagcggtatcgggagttcgccgcggaggcaggcgccatcgggcgcgtgcgccaccccaacgtcgtaaggctgcgcgcctactactggtccgccgacgagaagctcgtcgtcaccgacttcatcaacaacggcaacctcgcgacggcgttgcgcggccggtccgggcagccaaccctatcatggaccctacgactgcggatcgccaagggtgcggcgcgcgggcttgcgcacctccacgagtgcagcccacggcggttcgtccatggcgaggtgaagccctccaacatcctgctggatgccgactacaacgcgctcgtcgccgacttcggcctcactcgcctcctcaccatcgccggctgcaccgacgtttactccgtggcggggtccggcggcatc

SEQ ID NO: 28279 - DNA, 588 bp, Sorghum bicolor
  Clone ID: 7536313
gcacgaggcgatattttcgaacgcaatatgcggcattgagggatctaccccgcaccatgcggacacgtttctggtttaccattcgcgagctcgaacgcatggaggatgcatcgtggacgaggaaaagacgcaccgcggctcaggaggtgagccacgtcctttcggaaatccggacactgccaaagttcgaacgcttcctactcccacctcttcttgaagagatcactcgagaattgcgtatacgagatggcttcgcggttgtcatcataccaagcggcacgcagtgcgatgttgtgatgatcggaggaccaaatggcccctctcatattcagattgagacccttaacactacgcgggtaagggaccttgctaggcggctcacgtctacatgcttgaatgcccggaatatagccaaaatgaagacaagaggcatgcaaaaggtcgaggtcacttcttcggaatcatcacatcctcattcttccaatgaggagttggatgttctttctgagttgtggcagagcctcgtacaccctattcttcaatatatgaatttactcagcacgcctcccacaaattcttactcgagaa

SEQ ID NO: 28280 - DNA, 592 bp, Sorghum bicolor
  Clone ID: 7536316
ttcaaaccaacgagaacgaagcactagaattagaagaaaggctgctgtagcaggtggccaacatacctcattattagccatgaaagaagcattagtagtactcctgatgctcatcatctccccagtgaaggcagcagcgctgtcatcagccactccatctgagcctgctctatcactgccagggtgtcccgacaagtgtggcgacgtgaccatcccttaccccttcggcataggcgatggctgtgcagcgacaagtcggaaccccagctttgccgtgacctgcaacaacaccttccagccaccacggcctatgatctatgcccctgccagcaacacttcaacaccaatggaggtcatcgacatctccctggagcgtggcgaggtgagcatctatgcccccgtcggctatagctgcttcgagccaaacaccaatactctggacaactacaccggcgagtttagcctggaaggcacaccactcatcctctcaagcacacgaaaccgcttcatggccattggctgcagcgccctggggctcatcggagccagtgaccctgaaccttctgtggctggatgcttctcatactgcgag

SEQ ID NO: 28281 - DNA, 569 bp, Sorghum bicolor
  Clone ID: 7536317
gcacgaggcttgctggtcgtcgtcgcaaggtgctgtccatctatggctttggtggtttgggaaaaaccacgcttgccaacgaggtccggcgtaagattgggaagcaattcgactgtgaggcggttgtgccggtctcgcaaaagcccgatgacaagaaaatcctctggaatatactcactcgcgtagacaagaaccgtactcttgtccatgaaagagagatatgggacgagcaaaggattatagaagaaataagagacctactggaacataagagtcggtgagcattacttcggtgatcaagatcagagccttggaagcaagtaatttcagcaggaccagtaggagcaattggatcaaggagaagtattgggcttgtgatcaaccagtcagttggatcctgtagagtgagattaacacccgaagtttggagttcatttccgtgtttgctgcccaaggtactttatcataattgacgacatatggtctgaacgagattggaatttgctgaagtgtgctctgccagagaacaatatgggtagtagaataattactacaacacgtatcgagtc

SEQ ID NO: 28282 - DNA, 621 bp, Sorghum bicolor
  unsure (1)..(621): unsure at all n locations
  Clone ID: 7536319
gcacgaggggtgcgtctagtttcccagtatggccttcaatgccatgatgctgcctaacgtggcagcgacaacaacggagttatggccttcgattacgaatatcgccatggctccctggcggcatatgacttcagtcacacacagtcgatcggtcccttccataaatggcatggaacagacaaaggtgacggaagctcaacgagtgaccgaattccgaatccccgaatttcttcaacaagttgactttggttccctctctcgctcacgattctctcccatgactccgatgactgctcagacaactctttccaatatgggccgcatcggcctccgagcggccaaccccatcttgcgacaccctcaatttcagccccgcgtatcgacccagtcgtctttcctacgctcgttttcgcagtcttcttccggtattctctcatctcctcttggtatctcaactctcggtgcattttctgttcagcgcagagcattcggcagctccaatggcatttcccgtaaccaactggcgacattggaggaatccgccaatcgaaaccccggtaatgcgaacgcgcaaaacgctntctaccagctccttctccgcgccacatgcctgctattctt

SEQ ID NO: 28283 - DNA, 484 bp, Sorghum bicolor
  Clone ID: 7536335
gcacgaggaaaggtcgcactttgggaggctcatccgcaatcaacctgggcttgatggtctacccatctcgatcggggctgaatgcatgggaagcattgggaaatcctggctggaactgggacgggttggcgccatatattcagaagttccaaagatcgacgccgccgtcagaatccaacagggatttcttcaaaggaatgaaatatgacgaaaagagtcagggcattgatgggcccgtgcatgcgtcgttcggcgatcagtatatgccgttccattctgcgtggctggagaccttcaagggccttgggtatccacaagtcgaggatcccatcaatggtgctgggactggcccgtttgtcccacctgctacaattgatcctgtcacccatacaaggagtcattcaggagcggcctatcttggcccagacgttcagtctcgagcgaatctgcggattgtgaccggtgcattggtcgagaaggttgt

SEQ ID NO: 28284 - DNA, 539 bp, Sorghum bicolor
  Clone ID: 7536336
gcacgaggctggaaagtcaaatttgctggagcatgcgctcgactcaatacttgaaagaggagagatccctgatgtacagctgattactgaattgatatgccagtctattgctcatagagattatagaaggacgctgcagctcttgaatattatgactgaggcttcaataaaaatgaaagaagtcgagtgggtttacctactacagaaaaatgtgtatcaattcaacattgatgcccttgagggctttataaagtacctcagtactagtggtactatcaatgctgatcctgcacttggtttagtaagagcactggagtcccagtgtgggataactttagtgaaaggcccatatttgctaacagatgataccactactcaacagtgtggactctctttgcttgagagtgaagacaaatatgcaagtagcagtttggccaaacaagatcagctcacttgcgagaacttgtgtactgatataattcttgacgtccctgattctgatagagagatccctcagtttggtgtcagtgttgtcatga

SEQ ID NO: 28285 - DNA, 543 bp, Sorghum bicolor
  Clone ID: 7536361
accccacagcgcaacactatcgtaggacttgttttacgggctgccgcgaatgccttgatcggcgcttctgcaagtgaggcagctgagatcctagcggtggtggatgcggcaccgtatgtggctctgaataaggcttctcgggtagcatatgccgccatgcttgtcaacttctcgatcaccggcctgacatcgcccattgaaggctcctcgcgatccaagcacctatatctcatcaacaacatactccagcaagaaccgtccaggaagcctgaagatgccgcggaccgtgtgcccgatccggaagtgatctaccgggcccttgtgtcgctcggcaatgtggtgcaggccgtgaagacgtatggtcagcctctgacgtctatggaggcgcaacaagctcgtatcgggctccgcgaagcgggaggcatgtcggatccacggatagcgactgtcatttcggacacgaggttgttgatgcaatgaaagggctgagcatgtagatgcatggtcaattgtatatttgccaatgcaaggatagttcatcgc

SEQ ID NO: 28286 - DNA, 481 bp, Sorghum bicolor
  Clone ID: 7536366
tcagctttttttgggcattatcatttgtataatttccctgcaaatgtattttatgcctgtgcccatgcttgttgaattgccccaaacattgcctgtagcatcaaagtaggttcccggcattgttagctaacccattgttcaggaaagtagggcaggcagtgttgattgaagggttaattgactgtttgcagcccagctttatttgagtcatctgtttggaaatttatggttgtaatttcaacagctatggagctatggttagtttcatgttgcagaaaaggggaatcagttgtgaagtgagcatgtaatgccaatgccaccaattgaaagttaatatgtccagtttttccaatttttatccaggtaaaaaatggaggctgattggttttgttgtttagggaaaagaaatccatgcaaatgcaaaatttttcaaatagagcaaaactactcattccccttgtacccccaattttgcattaat

SEQ ID NO: 28287 - DNA, 501 bp, Sorghum bicolor
  Clone ID: 7536368
cgtggtggtcgtgctgctgccatcaacatcatcccctcgtccactggtgccgccaaggctgttggtcaagtcatccccgagatgaacggcaagttgcctggtatgtccttccgtgtccccaccgtcgatgtttcttgcgtcgacttgactgctcgcttgaagagccccgcttcattcgacgacattaagaagaccatcaaggaggccgctgctggccccatgaagggtattctctcctacactgaccaagaagtcgtcagctctgacttcattggtgacactcacagctccatcttcgacgctggtgcttccatcatcttgaaccccaccttcgttaagcttgtttcttggtacgataacgaaatgggctactccaacagagtcatcgacttgattgcttacgtcgccaccaagcagtaaatatgttcagctggggagcgtaaaaggtgcgagattttgagtacttccaacgagatgtagctctttggtttttgcaacctt

SEQ ID NO: 28288 - DNA, 241 bp, Sorghum bicolor
  Clone ID: 7536370
tttcaatagcatatgatcccaaattccccccttcctttttaacactttttgaaaggaggttttaagaatttgaattgaaattccttttactttgtttttgttgagccaaatgctgtattgtaaaaaggaaatgtgaatttgtgaaatttgccccagtgagttgtaactgccaaccctgttcattgaaaagccaaaaagggtatttttatttccctattggacaaaacaaaatagttttttg

SEQ ID NO: 28289 - DNA, 599 bp, Sorghum bicolor
  Clone ID: 7536371
ggcttttgtcagtcaccatctaaccgacaagagtgatgtctacagctttggagttgttcttttagagctaattacaagaaagagggctatatacatcgacaatcataatgaaaagaaatcactatctcatactttcatactaaggttccaccagaatgagctccaggatatcttggacagtgaaatagtagataatgaggttatggttgtactcgagaaactagcagatctcatcatgcagtgcctgagttcaacaggagatgagaggccaacaatgaaggaagttgctgagcgcctacaaatgctgaggagactgcagatgcagctagtcacaaaaacaaaccctatctgagctcattactcttatggaggaccagcgacaactgtcacttcggacacggagacagccaaactggtgttggatgttgatcttgccagataatatgtgcaaggttgttctttctaatgtaatccaatatgtataaaggttttgttgtaagtagtggttgtaagttctgacaatgatgttgtgtgggcatatatatgtatagttgcacttctaaattattatgtctactgcaaagtataagtgctttctc

SEQ ID NO: 28290 - DNA, 112 bp, Sorghum bicolor
  Clone ID: 7536372
ggtttgttggaatggataagggtcatccaaataaaggtttcaatttggccggtgcaatggttttcgctgggttcaaaagtgtgattgcaattttatggccaatggatgccat

SEQ ID NO: 28291 - DNA, 207 bp, Sorghum bicolor
  Clone ID: 7536379
cctgaagggtgtttttttgccccttcagatcagtggtgccgctgctcccgctttgttggatgtcctgcaatcatgcaaataagcttgttgagtttttgccctactgaagtttttgcaagagcgttcaagtttgcgggtagaaaaaatagaattcccaggaccggttggatcagtgaattttaatgttaattattttttttttaaccc

SEQ ID NO: 28292 - DNA, 202 bp, Sorghum bicolor
  Clone ID: 7536380
ggctgttaactcgcaattttttttattcgatttacatcggtccagaagaaaagaagatatccattcatttttgtgtttgtaaacagtccgaaaaaagaaataatacccagatagtagccttttttgcaattttttttgtcggttttttgcaacattttttttttggctgtaaaagcagaacccagaataaatattttttttt

SEQ ID NO: 28293 - DNA, 458 bp, Sorghum bicolor
  Clone ID: 7536384
ccgagtctgctgcttccaaggccaccggcactgcctccgatgaggacaacaccgccaccgcctctgccggtgagtttgatgccaccgctaccgacgcctttgagacctctggatccgcctccggtactgcttccggctccgctgcttcgtctaccgagactggcaatgccgccaccgctctcgttggcggtgtttctcttctcggtctcgttgccgctgtcttcgctctgtaaattggatcgcctcttttggacatctggttgatagaataggaggacttgaatggaattgctctagggcggtaatgattggagtttgattccagatgtgatacatgttgggcatcatgacgaaggctttttcgggccggatcgacttttcatggacaaataatcgggacaccttacgcgttcacatacggctcgacccgagcatcaatacaatactttttttttgcg

SEQ ID NO: 28294 - DNA, 396 bp, Sorghum bicolor
  Clone ID: 7536386
gcacgaggacggtgtggcgcaagtcgctgctgttcaacggcaggggtttcacggtgttcgacgcccgcggcgacctggtgtaccgcgtggacagctacgcgtccgactcccgcgcggaggtggtgctcatggacgccgcgggctgccccgtgctcaccctccgccgcaggaagctgatcggcctcgggctcgggtccgaccagtggctggtgtacccgggcgaggagacccggcgcctgccgccgctctacgccgtgaagcgggcggcgccgcagtacatgcgcggcggcttcggcggcggcgccaagtccatggcgcacgtcgcggcgtgctctggcggcggagccgccgccaaaaccaccggcgccggcgggtacgaggtggagggctcgtacc

SEQ ID NO: 28295 - DNA, 580 bp, Sorghum bicolor
  Clone ID: 7536398
gcacgaggccacgccccaagcactcaaggtcgtctaaactccatctaaccccccacaccacctactgatacccttcacatccgcattgctgcgtcaactgccactctttgtcctgcaaacccgagtaccgcagcacactacatagactatacacatcagcaacatgtcggctgaaccagaccacaccaagccgaagccggatctttcaaaaaacccggatggcgctgagcccaaggagaacgatgagaccgcgaccgccattctcaagaagaagaagaagccaaactctctaattgtcaccgacgccgtcaacgatgacaactccattatcgcgctctcgaacaacaccatggagacactccagctcttccgcggagacacagtccttgtcaagggcaagaagcgaaaggacactgttctcatcgtgctggctgacgacgatctcgatgatggctcagcacggataaaccgtgttgttcgccacaacttgcgggtcaagcacggcgacgttatcaccatccacccgtgccctgacatcaaatacgccaagcgcatcgcagttctccccatcgccgacacg

SEQ ID NO: 28296 - DNA, 644 bp, Sorghum bicolor
  Clone ID: 7536407
gcacgaggctggaacagagaatcatttcctcgctccaaaaatgccgaaccctctcaaagcaagttaccacttcctaacatggatcctggaccatgaccaagtccccaacgatatccgacgcagtctagagctcgttcgaacatgcgactctgatctccggcatctcatagagctcagaaacgactgtctacctcttctgcaacgtcgcccaaaggtccttcaacgcgtacacaccattatagaatccgcccaaaagggccttcaggaagtctgtgagattgttgagagatgtcgtcctgagaatgatagaggcactaggacgaccttctctaagcgtatggcatgggtacttgttgagtcttccgagttcaagagtcaggagcctatcgttagtcggcatcatgctgctgtactggctgagttgaacttcttgaggcagattgctctcatggcgcctgtttctgaaccggagaagcgagaagaaaaaaagggaatcgtgaaggaggctgcagtgtttgataacgttgctcttcttggagatcttctgggtgatatgaaagtcgctacagagaaacaaccgtcagtcactcagactatcgtatcaccaccacccattatagtcttcaacgcaaacacagagccga

SEQ ID NO: 28297 - DNA, 502 bp, Sorghum bicolor
  unsure (1)..(502): unsure at all n locations
  Clone ID: 7536412
gcacgaggcagcctggnagaaagcattactgatcgcgcctaattcctggaatattcacgcccggattggcgaattactttttgtctgctcctcctccgcctcctccgagggtgattcagccggacttgctggcaagtcggtccaacatttttgccgcagtattgaactctgcgatgattatctgcggggtctctacgggttgatcttggccacctctcgcgtgcttgatcacaagtatgcccctgaaagcccctccgacccagccgttgcctctcagaagaccatccagcaacttcgggaattcgcacttcagcgtcttgggcacattgttcagtcccggtcggtggacgatcagcgttgggcatcgagtcgaggtgagctagttgcagccaaggagctgctcaatcgcttcgcgccgccccaaaaatagtcgttccattattgctcagctgttcttcggataccctaattaaacctatcaacatgttccttgcgacaagga

SEQ ID NO: 28298 - DNA, 466 bp, Sorghum bicolor
  Clone ID: 7536415
gcacgagggggctgggcatcccgacggcgctcatgttcctggcctgcgtgctcttcttcatgggcacgcgcctctacgtgcgtgtgacgcccgaggggagccccttcaccagcgtcgtccaggtgctgtcggccgcgctcaagaagcggtcgctgaagcagcccaaggacccgaagcaggacctcttcgacccgccgcacaccagcgccatcgtcaccaagctcgcgcacacggaccagttccgatgcctcgacaaggcggccatcgtggcgtcccaggacgaggtgcgccccggcggcgccgcgcctgccgacccatggaggctctgcagcgtacagcaggtggaggaggtcaagtgcctcatccgcatcgtgcccgtctggtccacggggatcatctactacgtcgccgtggtgcagcagtccacgtacgtggtgctctcggcgctgcagtccgaccgccacct

SEQ ID NO: 28299 - DNA, 610 bp, Sorghum bicolor
  Clone ID: 7536416
gcacgagggccatctccgtcttctccgccgtctcagggctcgagctctccttgtccaaggatcagcatgaatatgccgtcattccgataacatgcgccatactagtattcctgtttgcgctccagcactacggcacccaccgcgtagggttcctcttcgcgcccatcatcctcgcctggctgctctgcatgagcaccatcggcctgtacaacatcatccgctggaatccccagatctacacggcgctcaacccctcctacatgatccgattcctcaggaagaccaagaagtctggctggatgtccctgggaggaattctgctgtgcatgacaggatccgaagcaatgttcgccgatcttggacacttctcctacagctcgatccagcttgccttcacttctttagtgtacccttcactgatcctgggatacatgggccaagctgcttatttgtcccagcaccataaccttgacgcaagctaccaaatcggattctacattgcagttcctggtacgctacactgctacctgctttgtttattctcacgtcgcactacgctttcagactttcagacattcacatgggctttgcctatgtgatgaatgcagag

SEQ ID NO: 28300 - DNA, 473 bp, Sorghum bicolor
  Clone ID: 7536425
gcacgaggatccaccggcgggctgcaggccgattgggctaaagtgggtctacaaggtgaagcgggatgagcgcggtgccattgtcaagtacaaggcccgacttgttgcccgcggttttgtgcagcatgagggcatcgacttcgaggaagtctttgctctggtggcgcgaatggagtccgttcacttgctattggctatggcagcagcgaaggattggcgtgtccaccacctcgacgtcaagtctgcattcctcaacggcgagcttgcggagacggtcttcgttaagcaagctccaggcttcactgtcaagggtgctgaccacaaggtgctcaagctgcacaaggcgctctacaggctgcggcaggcccgtcgggtatggaacgccaagctcgatgctaccttatgtgagcttgggttcactcgctgtgtcacagagcacgtgctctacacgcagcgatggggaaggaagagct

SEQ ID NO: 28301 - DNA, 548 bp, Sorghum bicolor
  unsure (1)..(548): unsure at all n locations
  Clone ID: 7536430
gcacgagggtgatatatcagagtcatttgataattttccatattatcttagtgaaaataccaaaaatgttctcctgtcatcagcatatgtaaacctatgctgcaaggaatccaccaagtggacaaaggatatatcttctctttgtaaaagggtactattatctggtccagcagggtccgagatctaccaagaattactggttaaggcacttaccaaatcctttggtgctaagctgcttgtcatagattattcactgctgtctggtggacagccttcaaagtcaaaggaatcagaaccatacaaaaaaggtgatagggtgaggtacattggtcctcctcgatcatcagggtttatgcttgagggaccgagagctcctgattatggttcacagggtgaagtgaggctttcttttgcggaaaatggatcctcaaaagttggagtcaggtttgataaacagatccctgngggcattgatcttggaggcaattgtgagcttgatcacggcctattctgttcggttgattctctatgcctcgatggtccaggat

SEQ ID NO: 28302 - DNA, 588 bp, Sorghum bicolor
  Clone ID: 7536439
gcacgagggtgaagacgttatgctgaccaagtcggtagcaacgccgctgttggcgctcttgtcgcttgcatcgcaggctacggctgtgtcgaagaaacattggagcaagcgcagtgatgcagtctatctgccaaaggaagtacatgactacaagacggctactgcaccaaacaatgtcactattcgatacaagaaccctggtatctgtgagacgacgcctggtgtagacagctactcaggatacgtggatctcgcacccaatgtccacgtcttcttctggttcttcgagtctaggaacaatcccgcatctgatccgttcactttgtggttgaatggcggtcccggatcagattcgctgattgggctctttgaagaaaacggtccatgcatgattagtgataatctcacggctgagtacaacccctacagctggaacaatgtctccaacatgctatatatttcccagccggtcggcacgggattcagctaccaggaacaaggcgtcggcagtttgaatccagtcacaggagaattccgttacaactcgagtgaattaccggctgatgggcggtacccgctcttggatcc

SEQ ID NO: 28303 - DNA, 498 bp, Sorghum bicolor
  Clone ID: 7536442
gcacgaggcatccacctactctacggccttctctgtccacaacactacccatatactaccgattaaccacgggattaaactcactcttaaaacatccacgctcaactccctagcagaaacaaatgtcgagtatgattacagcctgaatcgagaggccagtcgattaggtggtgtgcgaagcttcactggacggacagtgccctcctcatgtccatgaaatgaatctcaacaactcagcactttaggaccactaagaaagcgaaaatggtgcatggtgggccaggctggcgcccaaatgacaatgacattatcgcaggtatcaaaacttgttcatcagacacccccgaaacaaatccacgaacgcgccagggacaactacctgcctgcctgctgtatctctgctacgtgtctttgttcgtcaagggatccgggctcaatgcgtctccccgatcataaatgcgaaatatacgacaacaaaatccttcttccacgacggct

SEQ ID NO: 28304 - DNA, 580 bp, Sorghum bicolor
  Clone ID: 7536444
gcacgaggcccatcaaatacccttccaccccttcctccccttcccattctttcggtcctctccccgattcctacttcgcctgtaacgtgttcgaccgtcgcaccgtcaagcgctatctcaccaccaacgactacacccgctacatcgataccatcaccaacaacaaacctattgatgcatccaccgctgatgccatcgcctctgccctactgaggtgggcgactgaacgaggagccactcacttcactcactggttccaaccgttgattggattgactggtaccgcagagaagcacgacacgttcattgacacgttgagggatggtgagactcctctcatccgcttcaccggtaaacagctcatcatgggagaacccgacggctcatccttcccctctggtggcctgcgcgctactcatatcgccagagggtacacagcgtgggatcctaactctcctcccttcctcctcgataacaacaacggctccactctctacatcccttcctgcttcttctcctgggatcacggtaaagccctcgatgaaaaaatccctctcctccgctccgaactcgctctcca

SEQ ID NO: 28305 - DNA, 533 bp, Sorghum bicolor
  Clone ID: 7536447
gcacgaggcgctcccctaccagctcaccgcgcccgcgctcgcgctcctcctcgtcttccgcaccgaggcctcctacgcgcgcttcgacgagggacgcaaggcgtggatgcgcgtgctcgccggtgccgctgacctcgccgggatgctcatgcatcatcctaataatcttcatacccgtaccgggggacgacaggctcaggctgacgacgacccgctccggcgcgcgctcatcaactacatcctcgccttccccgtcgcgctcaagtgccacataatcttcgactccgatgtaaaaggggacctccagggcttgcttgccgaagatgacctgaacgttgttctagcatcgaaacatcgaccacggtgtattatcgagttcatttcacagagtctccaaatgctagatctcgacgaacagaagcggagcatcatggagtctaaactgtcttgttttcttgaaggaatcggtgtttgcgagcagctcatggggattcctattcctctgtcatacactagacttacttcgagattcc

SEQ ID NO: 28306 - DNA, 540 bp, Sorghum bicolor
  Clone ID: 7536449
gcacgaggggcagtgtgtcatcattccctcactttaaagaaagagtgatatttccttcttctctttgtatacacctctatattttgacttgactgtatacttctctatcattcatattaagcatggcgaatatcgagaacgaagagcagcagtatcagcaggaggttgaagatgttaagaagtggtggtcagactcaaggtggcggcatacacgaagacctttcacagcagaacagattgtacaaaagagaggtacactaaagctgcagtaccctagcaatgcgcagtcgaagaagctctgggatatcgtagagggtagattcaaaaacaacgatgtgagcttcacatacggctgtctcgacccagtgatggtcacccagatggccaagtacctagacactgtctacgtatccggctggcaatgctcgtccactgcttcgacgacggacgagcccggtccagatctagcagattaccctatgacaaccgttccgaacaaagttgggcatctcttcatggcacagctcttccatgatcgaa

SEQ ID NO: 28307 - DNA, 609 bp, Sorghum bicolor
  Clone ID: 7536450
gcacgaggttcgaaatcagggcagggcgcgctgtcttcggcgactcccccagtgcctctattcgcctcaagtctaggagcaaacgtgggagcttgtaccccgaccaggcttcgcaacaaccaggctctggtccccaggccttctctactcgctatgactttggtgcctccctttcagccgccctttcaaacgcccaaaatgctcttggcgatcgtagtggcatcaagactaatgctagcgcaaaaggatctgacggccgttttgataacgaggcaggtgctccaggttcaaattcggtttctggctctacgcccgcttctgccgcccctctcgtccctggaactcgtcctgatggcacgtcctcagcgaaaccgggcttgcaatcggccgaatataacgaattgattcagaagttttgcttttatggtaccccttctagaggctctcccaaggctactactcctgccacgaagaatagtcacacaggtggcgtggtggagtatgttctgggtgagagatctggaaagcatcagtcttctgcatccaacagtcccccctctcctcaattgccaacacaggtggatggtgccaatgatgtaacgtcggcgt

SEQ ID NO: 28308 - DNA, 171 bp, Sorghum bicolor
  Clone ID: 7536455
gcacgccgccggccgctggtgatccccgtcgccgtgggaccagcagcagcagccatgtagtgctcccacctctccaccgtctgatcctcctcggtgctcgccagcagcgactgcaccacccagcggcgcggaagctccgccccgcgctcgggcctagtggtgcggtgctcc

SEQ ID NO: 28309 - DNA, 506 bp, Sorghum bicolor
  Clone ID: 7536461
gcacgagggttcattttcctgggttggtgggctttgacaagaattctttgtgtattttgattacttgtttccttattatcctatttaaatatttgttgtttctgtggcctgtctccaattttgataattacaactaacatactaacaccctcttggaatatccccttttaaggtctgtttggaacacagtattgtttccctgttcctgcgtttttcctatgaaattgaactgattcctgtgaaattcctatgaaaatctccaccatcctaccatccttcccttctctgtaatgtctattctgcatgcagccttctgtaaggagcatttaaatattttagcctgatttacgttccatatgatctgcaagcaatgtgtaatcgacgaacaaggtcattgtactgatgtgtttttggacataactgtacaaatgatgtctatttgctgatcatcttttttgcttgtgtaggtgctcataaaagaacacctgtgatgcctagaaggaacc

SEQ ID NO: 28310 - DNA, 522 bp, Sorghum bicolor
  Clone ID: 7536462
cacgaggattgggtcgtgcaagtacttaatttgggatcttatcttctgtgaggtgacactcctgctgctcagctagcagtaatgggcgttggttgacctggactttcaaaactaatggcccttcacttgtttcaaacacacctaaaacaggccaacactacagattggtattttatcagaaaaaaagggttgctagtaaaagaaacctctattttgtcccaatcagaactagcttccctttgccaccccattggcccgtaatttctttttgtgtcatttttcttatcaagcatctcaaagggaaaaagaaaagaaaaaattgactgacagagacatggttctgacgatggcatatccttacaaaatatttttctgtcaatagatggcaacgttcctgatttgttctgttttgttggtagatatttttagattttttgtgtacgtgcccacagtttagatttttggacaaaattccagatccgaaaatttatctgtatgcaaatgaaatctcatggaagtgaa

SEQ ID NO: 28311 - DNA, 533 bp, Sorghum bicolor
  unsure (1)..(533): unsure at all n locations
  Clone ID: 7536469
ttcggcacgaggggaaaagggatccccttctcgcagcgccgacgctcatcttctgctccttcccccactcgcgctcgcggcggcgctcaggctcgggccctcagcgacggaggggcagtccaaggctcggcggcggcgtcagcggctccccctcccgcctctcgccagtcgcctcgcgccctcgcctccgtcctccgcgcaccggccggcgaccccgagcctgctcagctgacctcacctggacaatcaagctgaagagattatcatagcgtgcatggttatttttcaggaatgaagcgttttgtctacataaatgatgagtcttatcaaaacgactactgtgataaccggatttctaatacaaagtataccttattgaacttcctgccaaaaaacctatgggaacagttcaggcgcttcatgaatcaatacttcttgttgatagcttgtctgcaactatggtcacttattactcctgntaatcctgcaagtacttggggcccacttatatntatatttgcagtttctgcaac

SEQ ID NO: 28312 - DNA, 539 bp, Sorghum bicolor
  Clone ID: 7536475
gcacgaggggcacaacaggagtccctccttcccactgccgaacatccgcaacctccgcccgccacacaggcaaattcgcatttctccgccatcatgtctcgcttcagcatacccatcgacgccctcacctcgcgcatgaacctctctgggcgcttcgatggcctccgctcgacgtctgtctcgtcccgctttgccaacctccgccccatctcggagttcctcgacgtcaagcgcatctccaagcccgccaactttggcgaagtccagagccgcgtcaactacaacctgggctacttctcgagcaactatgccgctgtctttgtcatgctcagcatctacagcctgctcacaaacctgctgctgctcttcgtcatttgcttcattgtcggcggcatgttcggcatcggtaagctcgagggcaacgacctgcagctaggtagcgtgcgcgcaaccacctcgcagctatatactggtctgttcatcatcgcgatcccgctcggtctgtgggcatcgcccttcacaactgtgctctggctcat

SEQ ID NO: 28313 - DNA, 579 bp, Sorghum bicolor
  Clone ID: 7536477
gcacgagggtatcgccttcctatactctggtcttgcccgaagaaaatcagccctctccatgctctgggttgttatgatgtccttctccgtcatcgtcttccagtggtacttctggggcttctctctcgccttctctacaacttccaacaaccccttcatcggtgatctcaagcatttcggtctcatgaaggtctggggtgctccctcagtcggatctcctcttattcctgctcttctgtactctttctatcagatgatgttctgcgctgtcactggcgctcttacagtcggcgctgtcgccgagcgaggccgcgttgtgccaagcatggtcttcgtcttcttttgggctactcttgtctactgccctctcgcgtactgggtctggaaccctaatggctggggcttcgttaacggcgttctcgactacgctggtggtgttcccgtcgaaatcggctctggcatgtccgcattcgcctattcttgggttctgggccgccgcaatgagaagatgatgatgaacttccgtcctcacaacatctccctcatcactctcggtaccatgttcctctggttcggctg

SEQ ID NO: 28314 - DNA, 560 bp, Sorghum bicolor
  Clone ID: 7536478
gagctgcttggtatggatgatgatcagcacggcgagttctcttacgactacgttgaggtccgccgagacttccttgcttggagccctcaccgtggtgagcccgctgaagatggtgatgtgcttgagcctactcatggcattcaggagcaccagtctatgatgaacccaagcgaatcagatgacgtacgcaagactccttctcttaacgcacccgatgctgttgcacccgatgcggtgattaacgagaagaatacttaaacttgcttacggcaatgttgtatttgcgagtcatattagccttgtttgatatagaggggttattttattggcaggatttctttttatctacctgcgggttgctgggagtagcaggtaaaggcgttacggattttagcatctcttcgacgtatctgccttggattgttttaatacccgctcggtagatgtggatggctttggaaaagcgatgcaggtcattggatacgtacataattttgtcccaggtgtgtggtcttgtagaaagttacaaaatcagatcactatatattatcttattctct

SEQ ID NO: 28315 - DNA, 641 bp, Sorghum bicolor
  unsure (1)..(641): unsure at all n locations
  Clone ID: 7536480
tgcgtattatggcagcaacgagcccttgcgcagtggagcatcaagccaattcctgcgagacgtcccaggagcctttccgagtgcatggggtatgccttctcatggctactattatgaaggctatccttcgcagagccgtgtggtttccaccgagcaccagcaagaacccaaagaccctactcctccacctgaacctccgaaattagtcccttttccagttgagccctaccagtaccaaagtttcagccctaccgactcttcatcctcgcaagcctctccacagctccagtatatccgcagacctagcgcaccgccttctgaagtcagctatacagccatgccacgacgtgttcctgtgcctgttcaacgtactattccgacaacaactgatcatgttggcttctctgatcctattaccgcgaccgcgcaaccttctgatgcacaatctgtggttgatgttacgccgcagccagttgcggtcgcagccggagctgctgttggcaatggcaaggatggggagagaagacggaaggctgggaagaagaagaaagtctagctctcccgtagctcatggtttacaagtattcaatttaatttgccattctaaaaaaaaaaaaaaaaatccgagggggggncccggt

SEQ ID NO: 28316 - DNA, 698 bp, Sorghum bicolor
  Clone ID: 7536487
tggctacagtgaggagtggcaggtggaggcggcgaggagagggttgcctaacttcaagtcgactcccaaggcgttggacacgttgaacagtgcaaagaatgtcgagctgttcgagtcgttgaaggtgttggacaggacggagttggaggcgagacagacgatattgtttgaggattacgtgaagcggttgtgtgtggaggtgaaggtgttgattcagatgtgtcaacagtcgatcgtgccagtggtggtgcagtacgtgagggaagtgagggaggtggtggaggtggggaaggggaaggggagtgagaagttgttgaaggggctggtgaaggagttggagaagatgttggaaggggtggaagagttgaaggcgaggctgcacgaggtgcacgggaaggcgacagtgaaggagagtgcgcactattgtgaggatcagttgattccgttgatggagaagacgagggcagcggccgatgagttggagcagatgctgccggctgagaagtggcctttaccgacttaccacatgatgctttttcaccaggattgaggatcgagggacagggagaggagtaggggacagggagaggagtggagaagggatgcaacgagagtgagtaccggtatgaagggactgtatcgagctcaaggctgactgagccagcagagccatgacaatacactgctccatgtttttt

SEQ ID NO: 28317 - DNA, 508 bp, Sorghum bicolor
  Clone ID: 7536488
ttcttccacgacggctaacaccaagaagccatcagtcttagaatgcccatcctgtctcactccgaacgccatactcctcatgatgtagcgtcacgcgtacatcaggcacatatcactataccagtggctcaagtgtaagtccgctggcgcttttctggtgggctttggccatccattcgcccttggctgctttgtgagatgcttgttgggaaactagctcggctcgcactggtgggcgtcaggccgtattggtttgcgccatttaccatgccgtagccttgatccatccctacggtcatgggagactgctgcggcatctgtcccggggaccaagtggcaccagtcgctggcggcgtaggcgttgtctcgaacttgaaattcgttccgccgggagtgttcaagttgctcggcgggttcatgtaacctgcgccaccgactacatagcctgagcctgattcttgttgagtcgaagggtcataacccttaagaagatagctcaagtattttc

SEQ ID NO: 28318 - DNA, 580 bp, Sorghum bicolor
  Clone ID: 7536492
acacagcgtgctgtcaagcttgccattaagcagtcgattgcgattgacattgagcgccgcaaggctcgcgaggctgctggcgaggacgttgacatggaggtggatgaggaggacccagtaccagtgttgaccaaggcgcactttgaggaggccatgcgctcggctcgtcgctcagttaccgatgtcgagatccgccgatacgaggcgtttgcgcaatcaatgaagaactctggcggctcgagcttcttccgcttccccgatgcggagaacgcggctgctggcggagaccagaacacatttggtgctggtggcgaggacgaggacctgtacaactaaaggcagtgctgctgcatggacgactgaatgaagcgaaggttgatatgaggaagggagacattatatgaagaacggaaacgaaatttttctctctctctctcttaacatcaagaccaaggcctttgttgcagatctggatgtggagggatgaagaggcggtaattgaaggatgtctgatgcgagacgagacatgggtagagcagtacttgccatggacgcaatgcttgaatgaatgagaatgcat

SEQ ID NO: 28319 - DNA, 591 bp, Sorghum bicolor
  Clone ID: 7536498
atgttctctctcatcgtaactttattatccatatggttagacccatatctgagcgaggcaaacacaaccagtgtgacgtacgcggtggtggctgtacaggcaaccgatgggcagacattatcgcgaattgctgacgaggagctgcgcactccaattcacagaaaggacgtgttgttttggtccagaagattgtatcaagttacctctgcgtgggtagggttgtccttctttcagttggcatcatctgttgagctcgttggtacagtgtagtacttccgtgaagcatggctgcttgagatcctcggcccttctatgagagacggttggacgttgattgaggggctgtggacgctttgcaggaggctcttatcaggtaccccaaaagcaatgcgggctggggccttggagctacggcgaaccctaaattcctttctatctcacccttcgattattgatcctaggcagacaggcaagaaagagatttgggctcgatggatgcaggatgagtcagagttaggctgatcgcaagttgcagctattaggttagatactcaggctgtcgagataatgaaagcacaaggatgtataact

SEQ ID NO: 28320 - DNA, 562 bp, Sorghum bicolor
  Clone ID: 7536502
tacttctccataccaaagggttcccttgtccggccccctgagctttaacaatagctggagtggtcagaagttggctgtacaggtgaacacagcgcccgtggagctctcagcggaagagaaaccgacctccaagcccagtttgcgtcgtcaagccatgcgtattgggtcgagtcgatctgggcgtgcattcagcgagccatttcagcaacacaaacgtcgacctcccgaagccgtaacaagatcaacagagactggaacttttatgatgcaaagtcaaaactcaacgtggtagctggatgttgagagcagacgtgtgaagataacaaggttaaatgatgtgtaggctgctgctgggccgaagtagtgagatatgaatggcggaactgccaggtatgctatggatgctataaataatgatttcacctatcttgtatagttcattagtataacagcaagttcgaactgcctttccttgtatatgcgagagtcacggaccagaaatgatgagagagtttgaaacatattcaatactgttttggcggttcagtcctaactaattcct

SEQ ID NO: 28321 - DNA, 643 bp, Sorghum bicolor
  Clone ID: 7550349
aaaattggaaactggatacactttatgcgaattgcggtcaaattactactagctggggaaagaactgcgagaatccttgaggcttgctgtagcggaagtcctgttgccagcctatcgatcttttatcaaacgctttggcaatcttgtggagaacaacaagaacccgcagaagtacgttcggtacagcccagaagcggtggaccaacttctaggccagttcttcgaagggcagcaatgggcggagcaaaagcgctgagcagcagagagtgagagacacggcatgagtacagccagatagatgccagtaagttcaacagcacagatttctttcgaagcaaccaccagttcttctcgcgctgcatatataataccctataacatatgcagagcactaccaaattttcttttctcagaaaaagcacgccaaagtttcttttcttgccattcgggtggctgacacggaaagctaacggcaaaaaagtgttggtgccattttgttgatggaggaggttcctcaacttactataccatggtgttgacctaaaaggcaaaagaaacgagacctacgttgtggtcttgtgggttcacaaccagcagtttcaaaactaacctttttttttggttggtgctgtagagtatgttt

SEQ ID NO: 28322 - DNA, 229 bp, Sorghum bicolor
  Clone ID: 7550350
cccacaagggacccgtcgagcttgtcactcctcctgcggaccccaaggccggtgcccgtgtttggttccagggatgggagggccaccctgagggtgtttttaaccccaagaagaaggtttgggagactttccagcctggcttcacccccactgatggttttgaggttgctttagatgctgctgcggttgagcaattgggcaagaatggaactggtccccttgttactga

SEQ ID NO: 28323 - DNA, 663 bp, Sorghum bicolor
  Clone ID: 7550356
ctgttggaatcgatcaaaccatcggtgagcatggtcggcggctcgagcatggagctgcgatacgcgaacgtgatcttgaccgccgagacgttgctcgcggcgctgaggccgccggcggcaggtgacagcgaggaagtgcaggaagggatgatcgacctgtcgacgagagacgcgctgtacaagatgctgcccgtcagcatccgcgaggccatgaacacgaagctgagagagagatggggtaaaggacaacccgtggacgaggtggctgcggcggaatcgagggatgcggtggagcgtctgctgcgatggttgagcccgatggcgcacgacactctgcggtggaacgacgagcggagtatggagcgggcgcagcggttcggcatgcagccgcgcgcgctcatggtgcagacgctgcactttgccgaccggcagaagacggatgctgctattgttgatgtgctcatcgacctcagctgcatatgctggtacgacgatgagcggcgacggctggagtctcatgactgggacgccgagtagcacctacagatttagctgtgattgtatcgtgtgtgaatatcatggtatggagtaactgcaagtcacaggtacatagagcaaggtcttgtttggtttggagagttaaactttaactctcatcatatc

SEQ ID NO: 28324 - DNA, 647 bp, Sorghum bicolor
  Clone ID: 7550360
agcgctacttaaggctcccaaggttctgcttatggacgaagccacagcttccattgattacgccaccgacgccaggattcaagagacaattcgccagatcaaaaacactactatcacaatcgcgcatcgtctccagactatcattgactacgacaaggttctggttctcgacaagggcgaggtcattgaatacggtcatccgtatgatcttgtccgcaaagacggtggctcattccgttccatgtgccagaccagcggcgagctagattcgttgattagcactgcaaaggcggcatacgaagccaagactaatacagcagctcaatagtctgacagttttctttacacaaatcatgcaatgctctagcaatactaagaaagaaagaaaaaagaaaaagagaaagtgtggcatcgtgtatcttcaggagtttgttggaaaaggaccgcataaagcgaggtgggatggcctatgtcgcttcaatttctcaatgtgtgtccatatcggttttcaggaatcctggtatacaggtacgcgagggaaactctattcgctttaaaaggggtgtttagcgtagacgttcaatatataccaaccaagttttggtcataatctcaggtcatagtccgaagctatggtcgaaatcgtt

SEQ ID NO: 28325 - DNA, 652 bp, Sorghum bicolor
  Clone ID: 7550369
cggcggagcgcccgcgagcgcgacgcccggggctccaagacagcacagagcacgccccggtgcgcctcccacgactcctcgcctgccaggagcgtcgagcacagcctggccggcacgccacggcggcgcggcggcacgcagcgggaccgcgacgcgctcgtcagcccgcggtacatggccggcaccgcgtcctccgcggccaggacgcggtgccacagcgcgccgaggcagcggcagacgacggacgccgagcaggcgccgaggacgagcgtcgctagcagagatggggcgtcgaggaggtcgtcgtgctcgcatgcgcacggcggcgggttctgcttccagtgctcggacgtgacccggacgaccggcttctccgggatcagcgtcagcgacgaggtggccagagactactacctggacagcttctggtgatcaggcgatgtgagttggtggtctgtttgtgtttagattgtagtagaagacgagtgcacgggatttgtacatactcgtagtcatagacgctaaaaacatctagcaagtcacggagtggaagataacacgggacagccggactgcaagtcagcaagtcatagtctctcagaagtgtacaaatgctgaaagtctgaaacatacttgggtgttgaagtgttct

SEQ ID NO: 28326 - DNA, 692 bp, Sorghum bicolor
  Clone ID: 7550371
gtgccgtgattcaatacgactacgagaaggccgaggacaacgaaatcgacctgatcgagggcgatgttgtcaccaacattgacatggtggatgaagactggtggatgggcactaactcacgtggtgagagcggcttattccccagcaactacgttgaattggtgggggatgatgattcagagcaaccggctgctgcggcggtgcctcctccaccaccgcccgttgctgagcccgagcccgagcccgagcccgagactcaagctccggctgctgctgctgctccagctgaggccggccacacggctgttgccctctacgattacgaggcggctgaagataatgaattgagcttccctgaagatgccacaattaccaatttggagttccctgacgaagattggtggtttggtcactatgctggacaagccggtttattccctgccaattacgtgcaactcaaccagtaatcttcgggcgtgctttgttatcaatgatgaggcgaaaggaatgcattaagcttgtggggtggggaaaaaacttgacggtagatgaaagagcgctatcagctcgcgaacagtttcagaacaaataattcactgttctatattcatgtcaattggttatgtcgatagtatgatacagtagctatcgccgtgtacgtggtaaagacgagctacgcccatcgatcagtc

SEQ ID NO: 28327 - DNA, 668 bp, Sorghum bicolor
  Clone ID: 7550377
caattggacaatgaaattgttttcaatgaagctataattgaggaaagagagcaagccatccaagatatccaacaacagattggtgaagtaaatgaagtgtttaaagatcttgctaccctcgtacattcccaaggaattataatcgaggagatcaacatgaacattgaaaaatctgaagtgctgaccaaagaggcaaagaaagaggtaaccaaagcagcaaagactcagaaatcgaactcgtccctaatttgcttgcttatggtcatatttggggttgtgctgcttgttgtgattatagttttggcagcttgagacatgcaatctttcctcttacagaaatattctgtggagttcagaattgaagagtgttcatggttcttgtctaaccatcatatcatgtgcaaaaaaactgccaccaacggattttagaagtctcccttttacatttcatggtttgcgagtgcatgttccctttgtcatgcgtgagtccttttttcatggcttgccttgagtgaacactgttcttttgctcctttggttttggaagttcgcttggtgtgtttttgtaaccctgtaagtatcccccatcataaagcaaagagattattacgcaatatagaatttgtttcttggagcccctgaaaataaattgattgaaaagcttgttt

SEQ ID NO: 28328 - DNA, 598 bp, Sorghum bicolor
  Clone ID: 7550379
cttctcaactcatcagctaataataaccatccggccggccagcacacacgccgttcgtgcgtacgtgcagatgcagctgtgagacacgcacgccgccgctaaccgagaaggaaccaaaagactggacgacacgccccggcgcccgtggatcttgacacctacgagaccagcaaccaacccaccattatactgttagcagctggtccggcccaggtcaaagccgcgcgcggccgggcgaatggatcagacacacggccggacaccattaattggcagcagaagcttaattagagagcatcatcaggcagggactacgtactggcatcaggagaaagaagaagtgtcaacctaggaccattttttcttcttcaatgacgacgtatggcagatgttgacgggtcgaaagatgatgcagacgatgacgacaaattattattattattaattacatactttctttattttaaattataagatgttttgatttttttttagatatttagctttaatttactatgtatttagatgtatgtatatcatgtatgtctagataaaggtaaaatcaatgtataaaaaaaatcaaaacatcttataattt

SEQ ID NO: 28329 - DNA, 535 bp, Sorghum bicolor
  Clone ID: 7550384
cgtcgtctttgtttcttccatctttctactccaagcactctgggatgcgagtagtacatgtttcttgggtgacgaaaccccaactcctgctcctatcaacccacgaaacatgcatctcgcggcacaactcaaggagccatttatcgagcaatggacatggctagaagagaagattgcagcgtactggatcgacaaggactgggacttggaagcgtcacccttgatgcgtaatggccacacgtacccggtatacggcacgctgcctgttaagagcgggaataatcgccagacgaaacgccgcatggttagactgacgctgattgcaattgtgagcatgttctttctctctgttgcccagtggttgttttggcttggcttcattggcctccctgcagacgattattgcaccccgatgctcggacttttgaccgttacgtggacattgtcttccgtagctgcggttgtcggtgtgtcaaagtcgtgaaatgggtcctggcttgggatacttgaaaaaaaaaacgtaatgttctgggat

SEQ ID NO: 28330 - DNA, 616 bp, Sorghum bicolor
  Clone ID: 7550387
catgcagattagatgactaaatcagggatagacattatataataatatgttcatggctagtaactagctatgagtaaagttttattttttctgtagtagttgctatcttaccaaatagactactttcttacattttcttgctcgaggcttggttaatattataggtttaactagctcctagttattctgaaaagtgtagcaattacactggaggagtcatgcagttacgcacatgttgctggtctaattgcttatatactaacctactgttcttgtgcaggcaaaagcacatatgcaaagaaagcacataaccaagaggagttcaagaacaatcaggaaagatgacaagccatcctttgcatctgtgagacggcagcagcaattttgctctcttcgtctctgtttgaagtcagagtactgtggtgtttatgaaataaacattttcagtacttgtaatagcaaagcagtacactatttagtttagttcagcaattgcagtttctttctagagataaccacaggtcatggttatctaagtttcgtatttggtgtgctatctatatgctgtacttttttattttagaaccagcaacacttagcttgtatatgctgaatc

SEQ ID NO: 28331 - DNA, 552 bp, Sorghum bicolor
  Clone ID: 7550393
cctagtcgcgttccgctccagccgcggcggcagcacgcgccgtggcgtcagcgtcaggaacggggccggggccggggccggcggcgaaggcagcagccgcgccgggaggagcatccggctgggccagtcagggcggtggccgtcgttcctggcgcggacgttctccacgaggcttcccgcgtgggggtcgcggtcgacgcgcaggggcgtcgagacggacgggtccagcaagggcggcagggcggccggcgtcgtcgccggcgcgaagtcagtggaacaggacgaccaggcgggcgcgccaggacaacgtgtttgaccgcttctccctgtcctggtcaaacggtggctgctaggaaactcttggtgctttcgtcgccgtcgcggaggaaatttttttggcagttgaatttgggagagaacgtgcttgatcgcgctgctccttcggtccttcttctagaatctggacgcgtgttgtattcatttttttttgttaagaaaacatgtacataaaattagtactgtaattttttttcttgaggatcaagatacaga

SEQ ID NO: 28332 - DNA, 271 bp, Sorghum bicolor
  Clone ID: 7550395
caaatatgtccacgggcccatggatgtgatcaccctgcgcccaaggcacgggctccccatgctcatcaagcgcctgtaggtttgatggtgcgctcacaatgtgacataggaatactgtatttgtttgttatatttcctttccttttgcgacttgtatcaatgtaccctacataatgtatgccccacttttttctgtcctggtgtatggtatacaccaattccgccatatatgtaaatgtttaggtagattcagatacctgtaattttgatt

SEQ ID NO: 28333 - DNA, 451 bp, Sorghum bicolor
  Clone ID: 7550471
cccaacagcctcagtttgtccttgtatgatttttgtttgcccagtgaacaccatggctgagcctattcgaaacaagcgttccgacgtgtcgactgcgcctacaccgcagaacactccggcgaccaacgcgcccatatcctcccgagcccagcagcccggcgtggccagcatcaaagaagatgacatggaaagggcggctgctgcctctctcctggcgcaaaaccccaagcttgttcagatgatccagggacgacttggttctctcattggacaatcttctggatacatcgagtctctccccgcccccgtccgccgtcgggtttcgggtctgcgagcaatccagaaggaccatgccaaattggaggctgaattccaggaggaagttctccagcttgagaagaaatactttgccaagttcactcccctttacgagaagcgatctgccatcgtc

SEQ ID NO: 28334 - DNA, 425 bp, Sorghum bicolor
  Clone ID: 7550482
gcacgaggctaccgcctcgcccacgacgctgacgtcgaagccatcatctccaacctccggagctccttgcacaaggccctcgccgccttctacccgctcgccggccgcgtccgcctcacccccggcacgtccgaccgctacgagctgcactaccgcccgggagacgccgtcaccttcaccgtcgcggagtgcgacgacgacgtggacggcgacgcgcacttcgacgccctcgccaccgacgagccccgggaggttgccaagatcgccgcgctcgtgccgacgctgccgcggggcggaaggctgctcgccgttcgggccacgctccttcccgcgcgccgcggcctcgccatcggcgtcaccctgcaccacgccgcctgcgacggctcgggctccacgcacttcctgcacacctgggcggccacctg

SEQ ID NO: 28335 - DNA, 441 bp, Sorghum bicolor
  Clone ID: 7550498
gcacgaggagcaagtcgacggagggcttccagtcggttccctacgtggttgccctgttcagcgccatgttgtggatcttctatgcactgatcaaatccaacgagacgttcctcatcaccatcaacgccgccggctgtgtgatcgagaccatctacatcgtcatgtacttcgtctatgcgcccaagaaagccaagttgttcacagccaagatcatgctcctcctcaatgtcggcgtctttggtgtcatcctcctcgtcaccctcctcctcttcaagggtgacaagcgcgttgtcatgcttggatggatctgtgtcggcttctccgtcagtgtctttgtggcgccgttgagcatcatgagacgcgtgatccaaacgaagagcgtggagtacatgccgttctccctctccctctcgctcaccctcagcgctgtcgtctggttcc

SEQ ID NO: 28336 - DNA, 374 bp, Sorghum bicolor
  Clone ID: 7550522
tcgatatcatcatcagtccagcttctggacgtcctaccttcccaccttaacaatggctgccaagctcgtccgctcgtcatcgagcctcctcctcctcctcgccgtggcgttgtggacgtcgtcctgcctgctgcttattctgccagcggccatggccgatcacaccgtgccgcagccggcgtcgtcgtcgtcggcgcagccgagcatacctgccacagaaccgacgactaccggcacgctaccaactgcaccatcgacgtcgtcgtcatccgccacggcggagccggcaggtatcccaccagcgacaccagcagcagcggcggcggcggcgtctgaacccgcaacaaccggcgcggcagccaccaccacggctc

SEQ ID NO: 28337 - DNA, 449 bp, Sorghum bicolor
  Clone ID: 7550523
gcacgaggcttactaaatatatcaggatttcagcattagaagcataagatagatgaaaccgaacaccataactgtgttgctctgatgaataccaatgcctcagtctatgcctaattccctatgttcaagttacatgtagaaaacctgtttttaattctattgagttttaaaattgaataatatcttaaaatttagaataatttgtgtgaccatcaatgtgtctacaagggactgcaaacacactgcttccagccacaaagtgaatgtacaatttattaacagatgtggctgaatagttgtgcagaaaacatatttagttatttctattttgcagaatctcaagctgcaccaaaccaccggtaaaaagcccgagccacatagttgtttatttcagtgctgaccataaccatcggtcaatcaacctcaacgagcacgacgatggcaagggc

SEQ ID NO: 28338 - DNA, 244 bp, Sorghum bicolor
  Clone ID: 7550527
caatttcgccttcgccttctcttctcttcccgctcccgtcccgaaatccgcccgcccgccgaattagtagcagatcgaagccctagccctagccgcatggccgccgcgaccgtgcgctgaggcggcgcgggctcttttccatggggtgaaggaggcggcgtgcccccccgaggcgtggggacgaataaggatggaccctagcttgaaggaggaggtgatgaaggcggtggaggaggccaagagg

SEQ ID NO: 28339 - DNA, 508 bp, Sorghum bicolor
  Clone ID: 7550535
gcacgaggcatcgagcagcatgtacgccggcggcggcggcgtgaggcgtgcggcgacggcgctgatctgggtactggtgcttgcggcggcgggtggcggcagcgtcgtctgcgaggcgcagctccggcgcgggtactacgccggcgtgtgccccaacgtggagtccatcgtccgcggcgtggtggccaagaagatccagcagacacccgccaccgtcggcgccaccgtgcgcctcttcttccacgactgcttcgtcgagggctgcgacgcgtcggtgatggtggcgtcgacggcgaacaacacggcggagaaggaccaccccatcaacctgtccctggccggcgacggcttcgacacggtgatcagggccagggcggccgtggacgccgcgccgggatgccgcggcaaggtgtcgtgcgccgacatcctcgccatggccaccagggacgccatcgcgctgtcgggcggtccgtcgtacgcggtggagctgggtcggctggacgggctg

SEQ ID NO: 28340 - DNA, 455 bp, Sorghum bicolor
  Clone ID: 7550537
gcacgaggctgccagggagtgcagttcgacaggatcttcggcgtctggctcggcggcgccgagctgctacgcagctgcaccgcggagccgcggccgaacggcatcgtctggtccgtctccaaggacatcaccaagtacgcgtccctcctcgccgccggcaactccaccctcgccgtttacctcggcaacctcgtcaacagccagtacaccggcgtgtactacgccaacgtgacgctccacctctacttccggcgcgcgcctgctacgaggacgccgccgccgccggcgacggcacccgccgacctcatcgtgcccatgtcgagaggcctgcctctgaacgacgggctttggtaccagatccagaacgccaccgacgtgcagtccacgagcgtcaccttgccacccaacacctaccgcgcggttcttgaagtctacgcctcgtcccacggcgacga

SEQ ID NO: 28341 - DNA, 396 bp, Sorghum bicolor
  Clone ID: 7550539
gcacgaggccaaggatggccagacccgtgagcacgctctgctcgcctacaccctgggtgtgaagcagctcatcgttgccatcaacaagatggacactgccaactgggccgaggctcgttaccaggaaatcatcaaggagacttccaacttcatcaagaaggtcggcttcaaccccaaggctgttgctttcgtccccatctccggtttcaacggtgacaacatgcttcagccctccaccaactgcccctggtacaagggctgggagaaggagaccaaggctggcaagttcaccggcaagaccctccttgaggctatcgactccatcgagccccccaagcgtcccacggacaagcccctccgtcttcccctccaggatgtctacaagatcggtggtat

SEQ ID NO: 28342 - DNA, 457 bp, Sorghum bicolor
  Clone ID: 7550541
gcacgagggctcctcgctgatcaggcacggcgtcccgctgcacgagctagagtccgctagagagcacggcgccgacggcgccttgccgcccagactgggacagccggttccatggtcacgctgccgcgcagagtgaatgcgaaagcggtttgcgggaccgtggcacgctgcgaagcaggctggctggccacgccgtacgagcgcctgtccgttggtatataaggcacacgggccggacgctcttgtgcgactgctcctcgttgcttgcggtcgcgtcatctgtgcggcgtctttgtcaatttctgcacttggaaatacccggcgtataagtcttggaggccccagcgactacttctctttgaccgactgtgaagtcttttgcgactgtctgacacccaaactttttgaatctctcgactacctctctcgaattcgctcgactacacaatgccttctc

SEQ ID NO: 28343 - DNA, 453 bp, Sorghum bicolor
  Clone ID: 7550572
gcacgaggctcctccctcatcctctcccaccctggctactcctccccaacaactaaacatggccatggctgcctctctgccaccaccgctggcctcatgcaccccggcgcaccttcctcctccaccacctaggcatctccttccctcacacggcagcgccatccatccacctaggggtgctcgtgcccgacgtgcctcctacacctaggtgcgccgtttcccaacctcggctgcggtcatgggtggccttccgatggtagatccatggagcggtggcctccctgtggtggatccatggagcacgatgcagatctagcggtgtggtggtctcctccatccagaaggcaatgacggtccatcccccatccatggaggcggctcaatttgtacctcgacggcgccccagtcccatgtaatttcgtggtgttgcaacaatctattttgagatgttgc

SEQ ID NO: 28344 - DNA, 404 bp, Sorghum bicolor
  Clone ID: 7550573
ccgcaaccaattcgtgtcaaaacagctacgcagctcgaaaatgcctgcttttactctttatggcgctctcggttcgaccaacaccgatcgcatccgcctgactctcgccgaaagtggctttacggattacgaactggtgcatgtcaaccttcagaagggcgagcagaagtccgaggaaaacctaaaacgtcacccgtggggtaaaattcccgcgataactttctccgatgggttcactctctacgagagtcgcccaatttgcaaataccttgcaagaaagtacgcctttccacttctatctccggactccgatcttgaagctacagcactgttcgaccaagcgcagtcggtagaaatgctttactttacagagcctgcaggtcgaattggattcgagaaatttg

SEQ ID NO: 28345 - DNA, 139 bp, Sorghum bicolor
  Clone ID: 7550576
cttcccccaacttgccttttccttcccggaagagacgggcagacggcagagagccgccacggccatggaggacgccgcctcggagatcagcgactgggaggtgctctctgccacctccgcctgcgggggcggcgacgac

SEQ ID NO: 28346 - DNA, 370 bp, Sorghum bicolor
  Clone ID: 7550582
gcacgaggctttgatgagcgcgagctggagcttttgattggaggtattgccgaaattgatgttgacgactggaagaagcacaccgattatcgaggatataccgaatccgacgaggtcgtgcagaacttctgggcaacagtacgctcgtgggatggggagcagaagtctcgtctactacaatttactacaggtacttctcgaatcccagtcaatggcttcaaggatctccaaggtagcgacggcccacgacgatttacaattgagaaggcgggagaaatcacaaatctgccaaaggcgcatacatgtttcaatcgacttgacttgcccccttacaagagtctagaaatgcttcaacaaaagcttaccatcg

SEQ ID NO: 28347 - DNA, 461 bp, Sorghum bicolor
  Clone ID: 7550586
ctccatcatgtctgcccccgcccacaagttcaaggtcgccgacatcagtcttgcggcctttggtcgccgcgagattgagctcgccgagaacgagatgcctggtctgatggagactcgccgcaagtacgctgaggaccagcccttgaagggcgcccgcattgctggatgtctgcacatgaccatccagactgccgtcctcatcgagacgctcaagttccttggtgctgagctcacctggacttcgtgcaacatcttctccacccaggaccacgccgctgccgctattgccgccgccggtgtgcccgttttcgcctggaagggcgagactgaggaggaatacgagtggtgcctcgagcagcagctcaccgctttcaaggacggcaagagcctgaacttgatcctcgacgacggtggcgacctgactgccctcgtccacaagaagtaccctgagatgctcaagg

SEQ ID NO: 28348 - DNA, 326 bp, Sorghum bicolor
  Clone ID: 7550593
gcacgaggccctaatcccccaccccaaatgtcgtcgtcctccgagctctacaaccttgtccccgcaccccaaaccctaaaccctcccgcacctgccgccgccgatctctccagctccaccgccgtcgcggcggcggcggcggcggcgccgggggacggcgccctccgcggccgggttcgccgtccggtggggtcctcctccgtcgaccggcacgccaaggtcgccggccgcggccgccgggtccgcatcccggccatggtggcggcgcgcgtcttccagctcacgcgcgagctcgggcaccgcagcgacggagagaccatcgagtg

SEQ ID NO: 28349 - DNA, 420 bp, Sorghum bicolor
  Clone ID: 7550600
gcacgaggctacgtctcctgtggagggtgccccgacacgtggcacgggttctcgctcgaggccttcgccggcatgtgggagttcgtcaagctctcctccgcctccggtgtcatgctctgcttggagaactggtactacaggatcctcgtcttgttgaccggaaacctaaaagatgcagctattgccgtcgacgctctctccatatgcatgacaattaacgggtgggagatgatgattccattggcgttcttcgcgggcaccggagtgcgcgtggccaacgagctcggcgccggcaacgggaagggagcccggttcgcgaccatcgtgtcgtcgatcacgtcgctggtgatcgggctcttcttctgggtgctcatcatgggtctccacgacaagttcgctctcatcttcacctccagctcc

SEQ ID NO: 28350 - DNA, 455 bp, Sorghum bicolor
  Clone ID: 7550601
cggcgacgaaggcggttcgccgcccccgacgtcgcgagaagtccattgaaccttatcatttagaggaagaagaagcagagcaagaagaggtcgtagtagactttgtgttcgtggacccagcagagatagactatcacatggtcaagaacttggcgacagatctgatcgacgatcccaccttcaacaacagagagctggctgagctcgtggtgagcgagaacaatcctgtcggcagcatcatcaaaattgagggcgaggatgatggtgtgggctacattaccgcgctgccagtgcacaagtaccgcgaccagcagtgcatccagcagatcttgtcgtttgtcaaacagaatgcgcagcagcacggtgtgttgacagacagcaaacagggcgcactctggcagaaggtactgagctctgaacgcgtcggactggtgctcaatcagcggctgctcaat

SEQ ID NO: 28351 - DNA, 355 bp, Sorghum bicolor
  Clone ID: 7550612
gcacgaggagagaagagagaaccagggccttgttcagccatggtggtggacctctgctgccccccgcgcctgcaataataccaccccccaccccaccaacaacgcccgttgcccgttgccgttggctgtgctgccaccggccaccgcccagcgcccaggctctctccgctccgctctcgccgcagctcgtatcccagctcgtcgatgcccctcgccgacgccgccggccatcatgggcaagaagggcggcacgtcgtggctcaccgccgtcaagcgcgccttccgctccccctctaaggacgacagcagcagccccaccaggaaggcgtcgcgtctccgcgaggacgccgacggc

SEQ ID NO: 28352 - DNA, 434 bp, Sorghum bicolor
  unsure (1)..(434): unsure at all n locations
  Clone ID: 7550620
ccaagtactgcgagaagcacatgcaccggggcaagaaccgttcaagaaagcctgtggaaatgtccttggccacaccggcgccggcctctgcggtgtcctccgccacaagcgccacagccgccgccgccgccgccaccaccaccacctcgtcgccagcaccgtcctaccgcccagcgcccacctcgcacgacgcctcgccgtaccacgcgctgtacggcggcggcagtccgtactcggcgtcggcgcgtcccgccggtggccccggcccgtaccatcatcccgcgcaggtgagccccttccacctccacctcgagaccacccacccgcacccgccgncgtcctactactccgtagaccagcgggactacgcgtacgggcacgccaccaaggaggtcgtcggcgagcacgccttcttctccgatggcgcggccgag

SEQ ID NO: 28353 - DNA, 396 bp, Sorghum bicolor
  Clone ID: 7550622
gcacgaggctctcctcgtccagtcagacagggcatgaaaccctagggcgcccggcttccctccgcaatccgccattccgctccgcgatgcaagcgtccgcgcgcttctcctcctccgccgccttcaggaaagtgatcgcgggtgtctctagcgccaccacacggtcgtgctaccggacctcccggtggaaggcgcatgcggcgccgctgcctgcgcaggagccgccactgaaggggcagaagagggctacaaagcaggagaggaaggttcggataatggaatttgttgagagttatagggcatcaaatgaaggcaagtttcctactataaaaaatatccgtcagcaaattggaggcggacattacacagtttgaagtcactgagcaccccatgcaa

SEQ ID NO: 28354 - DNA, 438 bp, Sorghum bicolor
  Clone ID: 7550627
cggagctccactcctcccccatagcagccacgggtcggtccgctccgatcccacctcaacctcatggagaaagctgcgcacgttgccgccggcgcgacgcaggactggtgtccgcacaggcttgacacagtgaggcataacgactcagctgaattgattcccgaaagactcgcggtggtcacaggaggaaacaaaggagttggcctcgaagtatgccgccagcttgctcacaagggtgtgacagttatccttacagcaagggatgagaaacgaggaaaatatgctgctgagacccttcgccgtgaatccgaactcccaaacataatcttccatcagcttgatgtcagagatgatgatagtgtcaccacattggcccggtatgtcgaaagaagatatgggaagctcgacatcttggtgaacaatgcagctatttcagga

SEQ ID NO: 28355 - DNA, 360 bp, Sorghum bicolor
  Clone ID: 7550634
gcacgaggatcatcccctctgctccgctccccttcccctccttcgcagcccaccgcgcccgtggagttcttcgatcgagtcctcggagcccggagcacctcgtccaacgatccgggcccccccgccgcgcgaggaagggtgggagagagagagagagagagagagagagagagagagccgaatctgagcctcgccacaagttggtcaagattccgctcgatctgctgcggggcatggagctggacagcatcgagtgcgtgtcctactccgacggcatggaggatgacgacgacaccgccgccgtcacctcgtcccagctcccccgccccttcctcaaatcctcctccaccgccggtaccg

SEQ ID NO: 28356 - DNA, 411 bp, Sorghum bicolor
  Clone ID: 7550661
gcacgaggctcctctgccttgcctgctcattcctcgagctgccctgcacactgcaaatccatccattttgcagccatcgtcgtcagatagtcctgtttgtttgcgattgcaccacttgtgtgtgcgtgagccaagtgcagaagaacggccatgggtggcaagctgttgctgggcgcgaaccagagccacgcggcggcggcggcgtcgcctgctcccctgtcgaaggtggccacgtccggtctccacggcgaggactccccctacttcgccgggtggaaagcctacgacgagaacccctacgacgccgccaccaacccgggcggcgtcatacagatgggcctcgccgagaaccaggtctccttcgacctcctcgaggggtacctcagggaccacccggaggcggcgagctgg

SEQ ID NO: 28357 - DNA, 453 bp, Sorghum bicolor
  unsure (1)..(453): unsure at all n locations
  Clone ID: 7550665
ccgattcgagaagcaagtaattcgagctttgctcacgaccagcgtccatatcacttgcctcgccgctcaccccgctccttttggcattacgacgtgcgtacgttgaatcgattagcaagcgttcttgcgcgacgactgcgactccttcatcatcggctgcctcaccagatacgagacgcagtcaacctcgctgaggcctcgttctgacggctattgcattctgctttgacggtccatactccagtagattgtcgacatgttcgttctgccaccccctccgcgatatcccgcaggcgcctatggcgtcggcctcgggggcgtcgtgcccctgatcgagaccaacaatacactgtcgaacccgagcggacccgagtatcggntcctggtaggagagggaacatacgtgctcaaggaagacttgaacctgggcacaccaccaccccacccgtccga

SEQ ID NO: 28358 - DNA, 481 bp, Sorghum bicolor
  Clone ID: 7550687
gcacgagggttcgatcctggctcaggatgaacgctggcggcatgcttaacacatgcaagtcgaacgggaagtggtgtttccagtggcgagcaggatttgaaggagatcgcagccgccccagacattcatctcttgttccaaacccacccgtttgcatgtgtgtgcgtgtgcgtgtgcgtgtgtggcagcgcgcaatgcgttggctggaccatttcccgtcagagccagcagcaaaacctttttgaggggttcaaaaaatttgcgcacagggtctgtcaatcttcagaagttttgagtttttcaaacgtctgaatgtctgaaaaccgcagctagctgtagtggtttaattaagcggcctgaagtacctgcgggcacgcacaatggatccaacatacaggagttactagagtatctatggtacagtagttgtaataacgggaaaaaaactgtgagatgtgtaatcttttacctatacaaggat

SEQ ID NO: 28359 - DNA, 475 bp, Sorghum bicolor
  Clone ID: 7550690
gcacgaggctcgttcataaccaaggtcctcgttatagtgaactatgtggcattcaaagtggctgttgactctacttgcggctggggttcaagctgcccctgctagcacagccaaagatactgtctcgtctgtcgtgaaggatggagtcacatacaccgtttttgaacatgcggcgaccggagccaagatagagttcgtgaagaattcgggcatctgtgagaccactccaggggttaatcagtactcggggtatctctccgtgggctctaatatgaacatgtggttctggttcttcgaggcccgcaacaacccccagcaagctcccctggctgcctggttcaacggcggccctggctgctcctccatgatcggtctgttccaggagaatggtccttgccacttcgtcaacggggatagtactccctcgttaaacgagaacagctggaacaactacgccaacatgatttacatcgac

SEQ ID NO: 28360 - DNA, 407 bp, Sorghum bicolor
  Clone ID: 7550692
gcacgaggctgctgctgacctgctgctccagtgcccccacacggccacacacccactcctcgctcgaggtcaaatggcccccgccgcagccgtcctgaagcgggcccacctcgctggcgtccactcgttggccctccgccgccggcagccggggccgccggaccgcgtctcggtgccttctctggcgatcccgtcgccgcgcgtttcttggcagcagggatctggagtggttgctaagaggcgcttctgggcgagtgcgagtggttccttggcgaaagataacactggggaggacgcggcatcgccttctcagctacagggagtggaggagagtaaagtagatttgttgaagattttgaagagtgctaactccattattccccatatagtgctggggagcacaattc

SEQ ID NO: 28361 - DNA, 413 bp, Sorghum bicolor
  Clone ID: 7550713
gcacgagggctcgaggcgtccaaaatttcccccaccctctcttcccctcctcgcactggtccgatggaatccgacgccgaggaggaggcggcggcgaccccggcggccgcgggggcaccaggcgctgggcggctgaaggggagcccggagctgactgtggacgcggacatgcgggagatggcgaagaccgccgcgtggagcgtcagttcctgcaaggccggcaacggcgtcgcggccctgcgcgacgacaacctcgacacctactggcagtctgatggggcgcagccgcacctggtgaacatccagttccagaagaaggtgcagctgcagcttgttgcgctctacgtggatttcaagctcgacgagagctacacgccgagcaagatctccatccgtgccggggatggcttcca

SEQ ID NO: 28362 - DNA, 284 bp, Sorghum bicolor
  Clone ID: 7550723
gcacgaggctcaagcatccctcctcctcttctctctctcccagtcttcagttctcttctccggccaccgcgctctacaggaccccggcgtagcttgctcggacaccgaggggaaaggagattagttagccagcagatggatccatggatcagcagccaaccttctctgagccttgacctgcacgtcggcctgccgccgctcagcctccaccaggcgccggtggccgccgtcgccttggcccggcccaaggtcctcgtcgaggagaacttcctgcctccaaagaa

SEQ ID NO: 28363 - DNA, 384 bp, Sorghum bicolor
  Clone ID: 7550730
gcacgaggctccaattccagcgggctggggtcatcccacttcgcttccgctcgtgacgcgccccaaacggatatagctcgcgcatactctctccggcactcgctccccaattctcaccaggagtgacggtgaccccggcgcgccgctgcgggcgacgcgcctcgcctcacctcttcaattgcggcgacgctggtcgagcgacggagcgcttcgctaggtcttcattgagcccttcgccggcgagaactcgcaccagtgtacacgccctgtcctatactggaacagccactgctgattagcatcaccaggcatttcagaggtttgtaactttcagttaagctcatcaaggtttccttggttagagccatggctgctcctgctgga

SEQ ID NO: 28364 - DNA, 338 bp, Sorghum bicolor
  Clone ID: 7550736
gcacgaggcagcatccagagctgcaatgtttgactcctccctcatctgattggcccgtctctgctctttgcgtgcccaatttggcttgctgtagtgaccatgagcttcactcgtttcgctgcagtcctttggtgtcttctctttttctatgggtcggtgtggaaggcatggattcttgccatggctttgtgccatctggacggagcatcttcttctactaggtgcattgggacttgtattctggagaccattgtgtaatgcatgtgatgagataatcatccggctttggatattataaaccatgtccatcgtgcatgttactccaatcctagcgtatg

SEQ ID NO: 28365 - DNA, 326 bp, Sorghum bicolor
  Clone ID: 7550756
gcacgagggtggagaccgccacgggcgggttctcgtccaaggtggtcggccgcggcgggttcagcaccgtgtacctcgcctcgctctcctcgtcgcggctcggcgccgtcaaggtccactgcagcagcgagcgcctccaccgcgcgttccgccgggagctggacgtgctcctctccctccgccacccgcacatcgtccgcctcctcggctactgcgacgagcgcgacgagggcgtgctggtgttcgagtacgcgcccaacggcgacctccacgacgcgctccacgggcacggcggcgtcctcccctgggcgcgccgcgtggccgtc

SEQ ID NO: 28366 - DNA, 387 bp, Sorghum bicolor
  Clone ID: 7550781
gcacgaggcaaaggtctggacactttgcaaaaacaggctaattgaggtacggaagtcggttgaagaccatcgccaccacagttcatctgtaacggtgatccatctccgaggaggcatcaacctagcttaatgatagtcttctgctaattgaggtacgtatgtgctaattaacctgtgaattagtctgttcatgtctttagactagcgatcataatgggctaatcacgattaagaattctaataagatataactaggaaagtctcgacgaactttctttatctgcatgcctgcactggtcaccacgctagcctttttttcacaccatttctgtccacggataagcaactgatgaactgacagacaacgagcaacatatatgcaaacta

SEQ ID NO: 28367 - DNA, 384 bp, Sorghum bicolor
  unsure (1)..(384): unsure at all n locations
  Clone ID: 7550785
gcacgaggcttacagaacatagagaagagagagaaaattggaggaggcaacgccagccggccggccggcaggctcgcctgctcacgcgtgcacggcgcgcggcgcgtgcgacgcggcggcctcgcgcagctgtggccctgagcgctcgcgcggtggtgggacctgcggcttggcgcggctgcgtgggcgcgggctcgcctacacccagcgcggccccaggcgtggcgctcggcggcgtgcacccctggtgctgggcatgaagcgcagcagcagccagcggccccgggtggagcgcttggcgcgaccgcggccaccggtccgacgtgggtggcccggctcggccggcgtggaggcttgtggcctcnggcgcgagcggcaggcggc

SEQ ID NO: 28368 - DNA, 494 bp, Sorghum bicolor
  Clone ID: 7550787
gcacgagggctaggcaagaattagcatgcattaagatctctctatttcatctctctatttcatcttcaatagatgtcgacgatcatggcatcttacaccaccccagtgagaccatccccagcattgagaccgcaggcttgctctctcttgctagcacgtggatcctggaaaccctctgtggcattacggccttctgctacggtgaagtgccgacggcgggcactcaccgtgacctgtgcgctcccggagaaagaacggccaccggcattcagcatcccacccacagctatgctgtgccccgtgccgccgccggacggcaaggagcggtgggacatcaaggacgaggacgaccgcgtcacgctgtggctccaggtgccagggctgtcggagagcgacatcgaggtgaccaccagcgaggacgtcctcgagatcaagcgccgggtcaccgccacacaacagccggcggcgcccgtggacgcgcacggagtcggcgc

SEQ ID NO: 28369 - DNA, 332 bp, Sorghum bicolor
  Clone ID: 7550807
gcacgaggggggaatccaacgatcggtcgatggcagcatgaacacacgggtgcgcgcgccggtcactcagggtcagaggtcctcggcgatgcaggcgaggtgcggctgccacggcgcggcgtggctgccggtgctcatgcgccgccggtgctgctgcgcggccgccctcttgtgttgctgctgcttcttcttggctgcctccttctccggcggcgactcggccccgccgagctgccggtcggtgatggtgatggcggcggcggcgacgacgctgccttccgacttgctgcgcacgtgccgggtcggcgtggcagcaccgcctccgcctccgc

SEQ ID NO: 28370 - DNA, 510 bp, Sorghum bicolor
  Clone ID: 7550827
gcacgagggccgtaccctttccgattacaacatccagaaggaatctactctccacttggtgctccgtcttcgtggtggcatgcagatctttgtcaagaccctgaccggcaagaccatcacccttgaggtggagtccagcgatactatcgacaacgtcaagtcgaagatccaggacaaggagggcattccccccgaccagcagcgtctgatcttcgccggcaagcagctcgaggacggtcgcactctctccgattacaacattcaaaaggaatccactcttcacctggtgctccgtctccgtggtggtatgcagatctttgtcaagactcttaccggaaagaccatcacattggaagtcgaatcctcagacaccattgacaatgtgaagagcaagattcaagataaggagggaattccccccgaccagcagcgcctgatttttgctggcaagcagcttgaggatggacgcacactttccgactacaacattcaaaaagaatcgacactcca

SEQ ID NO: 28371 - DNA, 450 bp, Sorghum bicolor
  Clone ID: 7550828
gcacgagggtcaaactcgtcggctctcagcgtggtgcaccggcacggcccatgctcgccgctgcaggctcggggcggcgagccgtctcacgcagagatcctggacagggaccaggatagggtcgactcgatccaccgcctggccgccgctcgcccgtcgtcgacggccgacgacccgtccagcgcctccaagggcgtgtcgctgccggcgcgcaggggcgtgcctctcggcacggccaactacatcgtctcggtcggcctcgggacgcccaagcgggacttgctggtggtgttcgacaccggcagcgacctctcgtgggtgcagtgcaagccgtgcgacagctgctaccagcagcacgacccgctcttcgacccgtcgcagtccacgacctactccgacgtgccctgcggcgcgcatgagtgccggcggctcgactcggggtcctgctcg

SEQ ID NO: 28372 - DNA, 483 bp, Sorghum bicolor
  Clone ID: 7550835
gcacgagggttgatcacacagaaaaacaggcatatgtggtacttcgcgtccagactccgcgccacatagtagaagaccttttcctgcggtggaataaagcaaagaagaacgacgatagcagtgacgaggagggggaagaggaggaagaggatcctgttattctgcactgtgcctatattgacttcgatgggaagcaatttggccctgtgtcgaaaaagttcaagattccgcaatttggtgagctcaaagacgtcaggtcccttcctgtatatcccttccgttatgcaaaaaagatcaaactggaagaggacctgatagatcgtggtaagatgcttcttgatgtttctaggttcaagcccatgtactacatgggatataccctagatacacgcgatgagatcgacagccaggtcgtggtggacttcaatgaggctctggcagatgagacgaggagaaagaaatgggagccgacaattgcaccaa

SEQ ID NO: 28373 - DNA, 379 bp, Sorghum bicolor
  Clone ID: 7550838
cggcgagctcgtctacgggctcacgccggcgtctcagctcttggctggcggctcgtcaagcctgactcctttcatgtccctggcattgcatgggatcttcgtgtcccctttccttggcctcggcacgtggttccagcaagagcactcagacccgtccctgttcgagatgacgcatgggcagactgcgtgggacctgaacgaccacaaccctgccttcggcaagctcttcaaccaggggatggtctgcgacagcagcttcatcatggacatcgtcgtcaaggactgcggcgatgtcttccgggggctgagctccgttgtcgacgtcgctggagggcttggaggcgcagccatggctatctcgatcgcgttcccggatgtc

SEQ ID NO: 28374 - DNA, 513 bp, Sorghum bicolor
  Clone ID: 7550839
gcacgaggctctgtttctagtcatttccatgattccatctctgggaatgtcaagaggcggtagataaagaagttgcaacctccgtgaccacactcctcaagtcctcatatacatacgtcttccaagttccaacacaggcttccatagactcagagcctcagagctacacagagagagttttgcagcaatggaagagttcacattccccagcttcccactggagcaatacaacgccaagaaggtccctttcccccacttcgcctccgcgtcgccgtggctcgtcgtccccggcagcggcgtcgtcgacacggccgtgcacgagcacgatcaccggaggagcttctcggccgtggagcagcaagcaaacaccggcagcgaccaccaccacggccacagccacggctcggctcggttcgccgtggaggacaagatggacatgctgtgggaggacttcaacgaggagctcgcccgggccgcgcagccgtgcccgctcaccaaggggacgccgtcgtg

SEQ ID NO: 28375 - DNA, 451 bp, Sorghum bicolor
  Clone ID: 7550846
gcacgaggcagagataaaagctgtatcgcagctacttgtatagttatatgcttcacttgtgccatacagcatatctgtcgccagagactgccagcatccactctggatcgcttgggcaccacgagccgtccccgatcttcatgcacaacttatcgtcgatgattgctgagtacagatctgacctaacctccagaattttgattgatgaacggctatgtatgtcttggcatttcctgatttgcatcagtttagcaatttcatcatggagaggcactccctggtcatagaagtgatcatagaacaccgtggggatgccagggtgggtgagtatataagcatatccctccataatatgatcagatggaaaaggccaatgaccctgagtggacccagtgtcatgattttcaataaatgtaactgatcttgaaggccaccatcccatcacaccagg

SEQ ID NO: 28376 - DNA, 469 bp, Sorghum bicolor
  Clone ID: 7550868
gcacgaggcgcgtcacactgcaacggccgccgcaccaccaccaccaccacggcaccaccctacccaatccccatccccaccgccgggcggcgctgcctcccatggcggacttcgacgacgagctcttcctcgacgtcggggacgacgggttcggagacctctcctacgtctccttctccgagtccatcgagctggatctcgactgcccacgtcacgtcctctccccgggcttcgatcccgaaaccctaacccccaccccggggtctcccatctccttcgactccgaccccgacctccgcggcctctccccctcgctgacccgctccccgcccttctgggactgcctcgaggacgacgccgctagcttcgagtgggaggagatcgcggacgctgcccccggcgtcggcagcgggggcggcggcggcggcagcggcggacggggagtgggagggggaggactagaaggaga

SEQ ID NO: 28377 - DNA, 134 bp, Sorghum bicolor
  Clone ID: 7550882
gctgtttgcccgttttagcgccaggaaggatttgtttgtggccccggcgaggtcaatggccccggccccggaaaaaaagtagtaatcctgcctgggggcatgccccagtaggaattaattgtttgtgttccttt

SEQ ID NO: 28378 - DNA, 480 bp, Sorghum bicolor
  Clone ID: 7550896
gcgctccggtcgtcgttcgcggggctcatgcgcaggtacagctacaagcgggcgcctgcgctgtccatcctggacacgtgctacgacttcacggggcggaacaaggtgcagatcccgtcggtggcgctgctgttcgacggcggcgccaccttgaacctcggcttcggcgaggtgctgtacgtggcgaacaagtcgcaggcgtgcctggcgttcgcgtccaacggcgacgacacctccatcgccatcctcggcaacatgcagcagaagacgttcgccgtcgtctacgacgtggccaaccagaagatcgggttcggcgccaagggctgcagctgagactactagtcatcaatctgcgtgggcgtggcgtgcatgcatacgcccgctggtgattcgatatacgattcatagtttcatacgtatataataggcaagttgatgatcacgatccgatgacaaatggaaataaaaatgatcaaaccg

SEQ ID NO: 28379 - DNA, 226 bp, Sorghum bicolor
  Clone ID: 7550900
gcggcgccagatcggacgtcccctttatcctactactactactaggtattattagttgcttttccgttggacctgtgtgctccaactgctcgagacgatgagatgtttactgttcctgtgtataaagtaagtgtaatgtggatcgaaagttggaaacgatgttagtatgtccctgctgtttgtgtgtgagactaaagacccttattacttctgttattctcagtcc

SEQ ID NO: 28380 - DNA, 485 bp, Sorghum bicolor
  Clone ID: 7550902
gcctcagccatataacgcttatgctccacaacagccactgcaaccactgcagaaccattaccagcagcagcagcctgtgcttccgatggacaatccggctcataacatgccacctggcttggggtacccgggacaaggtcagagtgaccctcatatgatgcaaagtcaacagtcaactactcagcacactcattaccagcagggaagtcaagggcctcttcaaaacatgaatgtgaattcccagggctctccgattcctcacaatagctttcaaggccagcttcaggcgcagagaatgttatagatgctaaacctagaaagacagtggcgtttccagttattctaaatcaggtcgggttcgcctcctatgtttggagagacagagaccttcctactaatttgtctttgctctctatagaagaaggctattaaaggcagttaaatggtatgatttacttaaggctaaaatatacttagtattactt

SEQ ID NO: 28381 - DNA, 128 bp, Sorghum bicolor
  Clone ID: 7550904
ttgatctcttcatcatgtttgtcaacggcgtcgagcgatccgagcaaaaatggaagaagatcatctttgaagccggatttatcgattacaaaatcacacctgtttttggtgttcgatccatcaattag

SEQ ID NO: 28382 - DNA, 517 bp, Sorghum bicolor
  Clone ID: 7550905
gcgcagccgtgcccgctcaccaaggggacgccgtcgtgggcgaccgcgaaggagtcctggctcggcgacggcgacggcggctacgaagacagcgccttcgagacgcgcaagcacgccgtcgtccggcggcggaggatgggcctgctcatgatgctccggctactcaagaagctcttcctggcgcacaagtccggcgccgccccgtcgcggaaggcgccgccgatctgacgcagctgaaaaaaaaatcgagtctttgatgagtgcatcatgatgtatcagcctatcatcacgtgtatatacggaggtggtcaattgatcaacaatacatgcttctctcggtagcacaggaccaagaacttggttcagagctgtcgtcagtgggagtgaccttttggcttttgctgatgaactgttatgttttagaagtttctctttgtgtagctgtgtggttgttgagagccttgggttttgctagaagtttgacgagctgcaagatcttacttgaatcagggcagct

SEQ ID NO: 28383 - DNA, 240 bp, Sorghum bicolor
  Clone ID: 7550908
cctgatcgtataattttttttaaaaggctttgcgaatccccggagggcaatttcagtcgacccctgtatgcgaaactgtgcgttttgtaaaaggccaatttgccatcaactatgcaggctgcatcccctattgttcgatatgaatagcaaagtccctaatagtgcccgttcgtgattatgagtttgagctagttttttgggctctattgtatcccgatgataattttcccctgatggtcc

SEQ ID NO: 28384 - DNA, 555 bp, Sorghum bicolor
  Clone ID: 7550919
ccagtgttatctatccaattaataattttctgcctatggctatcttgattatagttcagtcggtagtcaggggggctatattcacagctatcccagtattccccaactgcaaaaagaggttttgattcctcaatgtattctttcacaaacttggctgcgtaacctttcgtgaaatcaaagcgaaaatcttgaaaaccaacagattttcgaagccagatcaaccattcgataatatctttgcgtacaaatggttgtgtatgatctatgttgggaaccccatcaaagttatccccagtgctcttgtttcccttcccaccagaacaagatgtaacagcatgttcatcccatgatattgggatgccatcataacgattatacatgccattggatccttgagtagtcccaattcgatggttgagaacaacatctgccatagcccttacattgtgttcgctcattttatgaagcaacgattttagctcgtggagggaaccataacatgagtcaaggcagtacaggttctgtggtagatagcctttacgagggggggcccgg

SEQ ID NO: 28385 - DNA, 213 bp, Sorghum bicolor
  Clone ID: 7550922
aataggttccttcaggttgtcagtcaggtggggaggtttgggttagtagtgtgttagttggggggtggggtggggtttttcaattgggtctatccttttcctttttatcagggtttcattttttcgattgggtaaaaatgtaaaaaaatgccctattcaaactgtaatttaatcctattgcttcctaattactattaccgattgctggttttt

SEQ ID NO: 28386 - DNA, 395 bp, Sorghum bicolor
  Clone ID: 7550970
ctccatatctcttgctgtgcgtgactagctagcgcagtacacgtaacacagctcatcactggtcagcctactgtacaccgccatggctgctcagagcatagctctctggctcctgacgacgacgatggccctgcaggccggcacctcgtgggcgcagctgtcgacgggcttctactccagctcctgcccgggcctgtacagcgcggtgaagccggtggtgcagtctgccatcgacagcgagaagcgcgtgggcgcctccatcgtgcgcctcttcttccacgactgcttcgtccagggatgcgacgcctcgctgctgctggacgacacggccaccttccagggcgagaagatggccacccccaacaacggctccgtcagaggcttcgaggtcatcg

SEQ ID NO: 28387 - DNA, 497 bp, Sorghum bicolor
  Clone ID: 7550999
tgactttccgtgttgttgctgtcatcatggggttaatacttctgccggctgtggctttcgccatattcgtcgtctactatgtcttagtcccgaagaagaagacaggtcttcctcttccacctggacccaagcctctccccatcatcggtaacctcctcgacctccctcccaccggaacggcagagtacaagcactgggccaagcacaaggagctctatggacccatcagctctcttaacgtcatgggccagcccatgatcattctcaacagccctgatgccatgcatgagcttctcgagaagaggtccaccaagacttcttctcgccccagcgccaagttcggaggcgagctttgtggtttcagcgtgatgcttcctcttattccctacggcgacaagtttcgatactaccgcaagttggtgcaccagcagatgggcaccaagctgatctgctccgaattccgagacacccaagaccttgaatcccttcgcttcctt

SEQ ID NO: 28388 - DNA, 414 bp, Sorghum bicolor
  Clone ID: 7551000
gcacgagggagagagagaaatggctcgaggagtacaacatggatgagaacagattcagtaccggcagaattgcgcgcctcaacttgaaacgcgcagagaaagcaaggcttatcatcaccaagattccagccgttgttgacaacctgatcattcgaacactcgcatgggagagcgaaagaaagaagccgttcctgtacgacggggctcgcctggttgcagtcttggaggagcacaagcaagccaggatcaggcaggaagaggagaggaggcgactcagggagcagaagaagctgcgcaccttgctgagcgagaaggaggcgatgccgcacctgaagcggcccggcagcagcttcggcagggcgaccgagccctgcaacgtgaaccggaaacgggtcgacgcggcgggcaggttcg

SEQ ID NO: 28389 - DNA, 489 bp, Sorghum bicolor
  Clone ID: 7551002
gcacgagggttcttcgatccgtcctggtaccacttgcaagtcgtttatgagtttctccttaggtttgtgacttcgccgctcgtcgatgctaaggtggctaggaagtatgtggatagccctttcgtctccaagctgctcgatctgtttgattcggatgacccaagagaaagggactgcttgaagacaatattacatcggatatatggcaagttcatgggaaatcgaccattcatccgtaaggctgtgagcaatatcttctataggtttgtgttcgagacagatcatcacaatgggatcgccgagctgttggaggtctttggcagtgtaataagtgggtttgccaagccattgaaggaggaacataagttgttcttatggaaagcattgataccacttcataagccgaaatcagtgggagtgtatctgccacagctgacatattgcatcacacaatttattgagaaggaaccaaagcttgctgggactgtg

SEQ ID NO: 28390 - DNA, 489 bp, Sorghum bicolor
  Clone ID: 7551003
ccagtacaaggtgtcattagatcgaatagagaagtttcttctcgaagacgagatcagagaggaggatgtgaaaagagtgccttcagataactctgatgtcagagttcaagtccaagatggaaatttcagctggaaggcaaccggagctgatttgtcactgaggaatgttaaccttcgcataaatagaggagagaaggtggccgtatgcggcccagttggctcagggaaatcttcgctcctgtatgcattacttggggagataccaagaatatcaggatcggttgcggtgtttggttcagtggcatatgtttcacagagctcgtggatacagagtgggactgttcgtgacaatatactctttgggaagcctttccacaaggaactgtatgataaggcaatcaaatcttgtgctctggacaaggatatcgaaaattttgatcatggagacctcacagagattggtcagagaggactgaacatgagtggtgg

SEQ ID NO: 28391 - DNA, 550 bp, Sorghum bicolor
  Clone ID: 7551018
tcttgattcagggctagacatcctcgtcatctcagtgccattgaccgacaagaccaaggggttgatctcaaagcctgaatttgaaattctcggtaagaaggggactttcctgattaacattgcgaggggacccatcgttgataccgatgatcttatcgaggcgcttgatgtcactgatcctgagcctttgcctgatcagcatccactgtggagtgcgaagaatgtgactattacgccacatatcagtgctgcttcttcattttactatacgaggctgttggatatttttagattgaaccttgagaggctcagtcaaggacgaaccgatttcatcaacaaagtaaaccggaaggaaggttactagaggttttcgaacgaaatctgaggaatcattgaatgtgtttcggtggaaagaaacggatattggaaatgaatacacacgtcatccagagaaagtaggagtgctgttgagctacacgtttactgaaccatcttcgtttccatcaatactctaatcctctgcacctcagcagaaccatacgtttcctcc

SEQ ID NO: 28392 - DNA, 423 bp, Sorghum bicolor
  Clone ID: 7551026
agcggcccggcagcagcttcggcagggcgaccgagccctgcaacgtgaaccggaaacgggtcgacgcggcgggcaggttcgcgtcctccgccgcgccgtccgtgcgcagcggcgcgtccagcagcagcagcagcagcagcggcagcggtggtggtggtgcaagtgcaacggagctcatcaggccgcgctcgtcggcggcgggcgccggacagtgcggcgagttcttcaagggcgcgaggcggctctcggcgccggcgccgttcaactacgtcgccgtgtccaagggcggcagcatgtcctcgtcgctggctctgtcctgaactcgcaggtcgaattcgcatgagtaggcaagtagcaaaggcgtgtacatagagtaccattgtcatttgtagcggtgttacttgtgtaattgtctttccaccc

SEQ ID NO: 28393 - DNA, 501 bp, Sorghum bicolor
  Clone ID: 7551053
accactgaagagctcgagtacaacggctaccatatccccaagggcacctacctcattccctccacctgggctctccttcacgatcctgagacataccccaacccatctgcttttgaacctgagcgatacatcgcgcctcgcaacgagcctgaccccagtgactttgctttcggatacggacgccgaatctgccccggtcgttacctcgctgaggacagtgtcttcatgacctgcgcgcgactcttggctgtgttcaacatgcgcaaggctgttgatgagaatggaaaggagatcgacgttgtggttgacggtacacctggactcatcagccaccctgttgactacgcttacagcatcactccccgaagcgacaagcatgtcgagatggtgcgagctgctgagagaatgaacccttgggaggagagcgatgcccctctcttgcctaaggactctttggtttaagatgtatagcttaggcagaaaagaataaaaaaagttaat

SEQ ID NO: 28394 - DNA, 181 bp, Sorghum bicolor
  Clone ID: 7551057
tggcattggcaaagcgaaaacgattgtttttggggaagccagtgacaaaatgatccattttctggttggttcattgaactgggcaaggaactgagcattggaataaagaaaagttaactgtcgcccggtagaattggaactataatgagaatcaaagctcgtttcgagctaaattattgtc

SEQ ID NO: 28395 - DNA, 524 bp, Sorghum bicolor
  Clone ID: 7551064
tgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggattagaccgtcgtgagacaggttagtggatctgctcgtgatgggcaacaagttcgagcggtgatatgagaggcaccgttcggcgtgtacaacagtacaagtgtacatgtacgtattacgtagtcgtacgtatacaaggtgtgttaataggccctcgagagaaagaaaaaaaaaaggtttgttttgaagaataaagggcatggtcagagggtggtccaaaggagcacctcaactgatgagaagaggaggcaaagctgctccttcgagcccagctggtggttgtacgtgtaatcctgtaggcttcagctgctgctagctccagtagcggccatatatgtgaaacacaagtactcct

SEQ ID NO: 28396 - DNA, 540 bp, Sorghum bicolor
  Clone ID: 7551075
tcacatccgagtcacccagcatttgacgaagggaattttcataggccggcagagcaggcacaagagtagaagacggatgcatggaacacggtgcagagttattgggactctatgccatatcacgcattcatgctgctgctatcttccatgttgcctcgcactaatccttctagtcataacgccatttcatttcatctgacggtttttcccctgcaattgcaagggccgtatgctgtgtaaatctttgagaaatttattttgttgtatctactttcagaaacaatggcttgttttttgtcaacagaagtaaatttttctgctaattgtacgtgacggacttatacggtaggctcttcgttttttgcttggttattaataataacaccataaccatgtacgagcctataacttggctccaatatatcctcctgtacaatccgtttatcatatatccggatttatgtacactaatagctctgtggacaatcttttccatgtaactagtggtatatatctatttaattctgcttattagtttcc

SEQ ID NO: 28397 - DNA, 417 bp, Sorghum bicolor
  Clone ID: 7551080
tttgagaacgactactacaagaaccttgttagcaacatggggctcctacactctgaccaagagctcttcaacggtggcgccaccgacgcgctagtgcaatcatatgttagtagccaaagcgcgttttttgcagattttgtgactggcatgatcaagatgggtgacattacaccgttgacgggctccgctggggagatcaggaagaactgcagaaggattaattaactgagaggattgggagaatattgaggctttttcttcagtcatatgtacgtgttgagcaacttcatggctttatttctcttatttctattcttttttttctttttgcaaaattgtgaagtcattgtgttgtatcgatgtgttctcatcacatgtcggtttgtttcatcaataataaatgtatcacttttgtct

SEQ ID NO: 28398 - DNA, 532 bp, Sorghum bicolor
  unsure (1)..(532): unsure at all n locations
  Clone ID: 7551098
gtacgaggcaaagagctgtcagatgtttgtcgtgaaaaactggcaccctctgggtttagatcttctgaatttactccaaaagtttcaagaaatgtgaataaggattcaatatctatgaattttatatctatgaattttgttgatatgaacaagcaagggatgcggcatgaaaattatattccttcatcagatgccttcaaggatatcgagttgcggatatttgggaaattagttgctactgcaactaggagccccaaatgcgattgcattgacaaatcggatgtggaagatcacattcatgtgtatcttgttccgaacgcagatctatctgatttaacgcaagggaatcttctcctgngcacaattactggattagccaccactggtgaggaaggatcttgctgtgtctatgatggtcacggaataaagacacatgtcattatgaagcaccggacgttgatggttaaacacatgcactggtatcaggttggagataaagtttcaccctgcgagtgtcgatgtagtagggctc

SEQ ID NO: 28399 - DNA, 536 bp, Sorghum bicolor
  Clone ID: 7551101
gcacgaggagcgagcgatcagcggcgtcgccgcgcggatccgaagcgcgcgcgagaatgcagggcggatccagcggcatcgtctatggcggcctcaagtaccaggcgcggtgtatcgccgacgtgcgcgcggacgccggctcgaccaccttcctcgccggcaccctcagcctcaaggaggagaacgaggtgcacctgatccggctttcgccggcggagggcgagctggtgtgcgatggcctcttctaccaccccgacgagatctgggacctcaaatcatgccccttcgatcacaggatcttctccacagtctacacgtctggtgagggctatggtgcgtcagtttggaagatgccagaggtcaatgggcaatcaaactcaccgcaacttgaccagctctttgagcttagtgggcataggggcaagattagacgtgtgatctggtggccacttggaaagcatgataaactaattagcattgatgaccgaaatatttttctttggagcatagacacgtcaaataaatcagctaaggtg

SEQ ID NO: 28400 - DNA, 488 bp, Sorghum bicolor
  Clone ID: 7551105
gcacgaggcgcagtcatcactgcaacagaaacgcgaccgagcacacgcaagagacgagaaaggaaggcgaaccagctagcgcgagagatcgaagaggatggaagggctgatcccgttcgtgatcgacgtgatcaggaggagcaacgggcggagcgggtaccgctccgtctcgtcggacggcggcagctcacgcggcgggggcagcaggcgccacctcatcgactactcggagctgcccgacgcccccgctgccgcggcgaacgtcggcgtcgactggacgtccggcacgctgcaccgccgggcgcggccggagtacgcggacacgatggccgggcgtcgcaacgaggagtacgccaggccggcgtccgctgtcgccgcggggccggcttatcgccggaaatgaggggcgacgacgtgcatgcagtgcagtgcagcctctgaactttaggaggattcatcgtgagcatctgcagtgttcagcgtgttgg

SEQ ID NO: 28401 - DNA, 445 bp, Sorghum bicolor
  Clone ID: 7551107
cttccctccgcccactcggatccggaaaaccctaaccctagacatcgcccggctgccgccatggaccccgacggcgacccggcgttccaccgcaacgaggccatctccgcggtccaggacgtcgaccagtactacggcgacgacgacgacttcgacgacctctacaacgacgtcaacgtcggggacggcttcctccacgcctcccaccaggcgccgccgcctccgactcagcaagcacctccgccacagcagcaccagcaccagcagcaacagctccctccgccgccccagcagccgcagccgcagcagcagctgcatccgccggcccacaccctcccgccaccgccgccgcaggtcccaccgccacagcagcaggtacgcatcccgggggtggccgtccctggtcctggcattcctcccggccagaccagcctccctccgccgc

SEQ ID NO: 28402 - DNA, 483 bp, Sorghum bicolor
  Clone ID: 7551126
cacaagctcaagcacaagaagcacaatcgcaagaagctcaagaagctgaggcaagcagcgagcccaagaagaagaagaagaagaaagccaagaaggagagagagagagatgggaagcgaaggcagcacaagcccagggggaggaggaggcgccgcctgcgcggtgtgcggcggcgccgcggcggtgtactgcgcggcggacgctgcggcgctctgcggcccctgcgacgccgcagtgcacgctgcgaaccttctggcgtcgcgccatgagcgcgtgcccctttccatggccgccgtggcggctgcgtccggcgtgtacgacgacctcttcgcgcccgacgacatcgacgcagcgtcgtcgtgggcggccgcggcgcacgcgagcccccagaacggcagctcgtcgacaagcttcaccacaagcgacggcggcgccgagggcaggatgagcctgttcgacctgctgtccgacgtcgacctcgcg

SEQ ID NO: 28403 - DNA, 494 bp, Sorghum bicolor
  Clone ID: 7551133
gtggactgtaccggcgagggcgtgtggttcatcgaggcctcggccagctgcaccctggaggacgtggactacctcgagtacccgctcatggtgcccaaggacgagctcctcccgcaccctacctatccccccgaatctgaccccctccctgaggactcgctcatcctccttgtccaggtgacgcagttcgcgtgcggcggcttcgtggtcgggttccggttcagccacgcggtggcggacgggccgggcgcggctcagttcatgacggccgtcggtgacatggcgcgcgggcacgcggcgccgctggtggccccggcgtggggccgcgaggcgatcccgaaccctcccggcgcggcggtgggcgcgctccccgtcccgacggagctccggctgcagtacctggccatggacatctcgacggactacatcgagcacttcaagtcccggttcctggagcagacgggcgggcagcagcggtgcagcgcgttcgaggt

SEQ ID NO: 28404 - DNA, 571 bp, Sorghum bicolor
  Clone ID: 7551134
gggccacgtcggcgcagacgctggggaacgtggtggtctccatcgtgggcaccggcgtgctcggcctcccctacgccttccgcgccgccggctgggtcgccggctccctcggcgtcgccgccgccggctccgccacgctctactgcatgttgctactcgtggactgcagggataaactcgcagaggaggaaactgaagagtgctgtcatggtcattacacatatggggatttgggtgacaggtgcttcgggacgataggtcgatgcttgacagaaatcctcgtccttgtttcgcaggctggtggttctgtggcatacctaatattcattggccaaaatctacattccacattcagccagttgatgtcaccagctggcttcatctttgctatcctcctgcctctgcagatagcactctccttcatccgttcactgtcttccctttctccattcagtatatttgcagatgtgtgcaatgtccttgcgatggcaattgttatcaaagaggatcttcagctttttgaccatcccttttcacatagaagtgcttttaatggactttgggcagtacc

SEQ ID NO: 28405 - DNA, 475 bp, Sorghum bicolor
  Clone ID: 7551139
cgccaggcggcggcgcggccagtggccacggcggtcgttgcgtcagggccgtaggcgccgaagcgtgcggtcgacgcgacgggagacgagggaccgcggcaacggggaacaagccggccaaacggagggactagggaggcgcgcaggtggaggcggcgtcttccgggcggcgggagcgtgaccggccggcgagaaccccacttcggcagtttcgaaggcgaagctgcagacactaatctgaagaaaatcagtggttcttaagatgaattctaaggctaatgggagcataaagaaggcagggaggggtgatcatctccatggagggccaaactgggttcttgttgctggaggcattttgctcagcacactctcagtcagacttgggtgcagattgaagcaactgtttgaaaccaagcagcaaaacccttctaccaaagccaaaagaaggcctggggcatttgaactgcattccaac

SEQ ID NO: 28406 - DNA, 264 bp, Sorghum bicolor
  Clone ID: 7551143
cacccagcaccagacagcgaggaggcggtgacgacgacggcagctgtgacattttcaggggcgagtgggtgccggacccggacgcaccctactacaccaacgacacctgcaaggtgatccacgagcactacgactgcatcaggtacagcaagcccgacctgggcttcgtcaactggcggtggcgccctgacggctgtgacctgccccgcttcaacccatggcgcttcctccacatgatgaggggcaagtcccttgccttcgtag

SEQ ID NO: 28407 - DNA, 490 bp, Sorghum bicolor
  Clone ID: 7551153
cgacaatcccggtcatcgacctcgccgccttttcagcagccaacaacaacaccaacgacgccgctggcgccaaccaccaccagcagctggtcgcccaggtcaaggcggccgcggagaccgtgggcttcttccaggtcgtcaaccacggcgtgcccgcggagctcctcgcccgcatgctcgcgtccgtgcgaagcttcaacgaggagcccgccgaggcgcggcggcgctactacaccagggacccggcgaggcgcgtgaggtaccagagcaacttcgacctcttctactcgcccgccgccagctggcgcgacacggtcttcatcgagtccgcggcggagacggagacggaggagatgccggcggcgttcagggacgtcgtgccggagtacacgcagcaggtgcgggcgctgggcgcgcaccttctggcgctgctgtcggaggcgctgggcctgccgcgcgccgactacctgcagcgcgacgccgggtgcct

SEQ ID NO: 28408 - DNA, 421 bp, Sorghum bicolor
  Clone ID: 7551154
gtacggccccttacctgacctcgtcaagccgccggaggcaccgcggtaccggagtgtcaccgccgcagagttcctcggctactataggcagaaaggtctcgacggacgatctgcgcttgaccacttcaggctgctgctttgagcctctcaacccaattattccattccatcactactatatgtcgctttgccagtccattttataataaagagtcttttaaaatgaaagtcaagaaatagtgtatgaacaaagattttaaatggtggctaaatttaataaaggagaaagatttttaaagagttcaaacactgtagaatttctatatgtattccccacatctctctataaataaggagtcactttcccctttgtaaagcaattaagaaagagtgaaatatagaacaagctttttcctcctcc

SEQ ID NO: 28409 - DNA, 424 bp, Sorghum bicolor
  Clone ID: 7551165
ttcttccgcggcacggcgctgctgcgcaccgtggacccgtcgcagtacgagggcggggagtggaacggggatggcgactgcgtccggacggcgccgtacgggcgtggcgagaagagtgtcgagggcttcgagcgtgatttccgcgcgctgcaggtggaggagttggcgtcggcggcgaaggcggcgacggacagtggcggcaaggtgaggatgctgctgatgcacacgacggaagccatggtgctgcgtgcggacgcgcacccgagcaagtaccggggatggacgccggagaagcacttcaccctgcacaacgactgcgtgcactggtgcctgcccggggccattgatacttggaacgacatgctgctccatatgttgaaatagatgatcatcaatcatttgaacaactaataaacgccaaccc

SEQ ID NO: 28410 - DNA, 478 bp, Sorghum bicolor
  Clone ID: 7551166
ggatcgccgtcagcccccggcgaaacgctttcgtcatcaacctaggcgatcagttacaggcgctgagcaacggcgcgtacaagagcgtgtggcaccgtgcggtggtgaacgccgcgcaagagcgcatgtcggtggcatctttcctgtgcccgtgcaacagcgcggtgatcagccccgcggcggcgctcgtcggcgaaggggacgcgcccgtgtaccggagctacacctacgaagagtactacaagaagttctggagcaggagcctggaccaggagcactgcctggagcttttcagaagcacccagcagctccagtaaaggcaggaaatgtattgcacgtacgtttgagggctttgcttgaactaagtttatttgcttttggttttgtttcctgacataccatttccttgtgttgtgtaataagcttgtcccagcaatctttcttgtactttcaagttagtaaaacttcgccttcccgt

SEQ ID NO: 28411 - DNA, 451 bp, Sorghum bicolor
  Clone ID: 7551172
tggttactcttactccacagctaacaagagcatggctgtaatttgggaggagaacactttgtatgactacctgcttaatcctaagaagtacattcctggaaccaagatggtattccctggactgaaaaagccacaggaacgtgctgatctcattgcatacctgaagaatgccactgcctgatgagggtgctgctgactgctgtggctctaaagatgaagagcagcaattctttttgcagttaaaataatgatacaaatttactttaatttgacaggttggatgaacaagaaagttaagaactccaggtagttctgtaactgttttgtctattgttggggaaaaacgccccagacgagcttttgattagtggttgaaatgtgacaccaccataatacttttgacctgatgagcattcaaacacacatttcggaaggttaagatacctttatt

SEQ ID NO: 28412 - DNA, 458 bp, Sorghum bicolor
  Clone ID: 7551183
cgacgaggacgaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccaccgcgctcctgcttttcctcagcgggacgctccggtatcgctatttccagcccggagggaacccgatcgggaggatttgccaggtcgccatcgccgcgtccaggaaatggaaggcgggcgcgtcgaccaccggagtggtcagcctgtacgagggcgacgagaaggcggatgccgccggtggcaggaagcttttgcacacgcaagggttcagtttcttggaccgcgcggcgcacgctgacacggactccaagctcggcgcgcgcgacccctggaagctgtgcacggtgacgcagg

SEQ ID NO: 28413 - DNA, 500 bp, Sorghum bicolor
  Clone ID: 7551197
gcacgaggatatccccggccgcctctcctcccctactaaccaactttcttatatctctttcccctcttctatcgcatcctctctcttccttaccccgccatcgcctctccacaaaacaacatggcggtacccacacctcccatcccgcctgtgtcgccggactcgggccctaccgaccctaccctccccaagcttcctgctggatggatagcgcagtgggataactcgtcacgaaagtattattatgtccaaatcagcaccggcgtctcgcaatgggaactgcccaccagcgaagcccccgtaggcggctcctccaaccacagcaccccggcgcaatcaacgaatccatacaacgtacccggcacatcaggtccagacggcgcgggcgatggaacaagaggcatgggcgacggcccgactggagacagggcaggcggactgggtggctttgcgatgaacgcgcttatgggaaacaagcagagtggtagtggaggccatgg

SEQ ID NO: 28414 - DNA, 418 bp, Sorghum bicolor
  Clone ID: 7551204
gcacgaggccatccaccaccggcggtcaccgcgcaccgcactgaaacgaagcaaacgaacatggcgtccgccgcgcctgcgcgccacgtccacatcgaggccctgcagacggcgctgccgacgcgcgcggtggagcccgggcgtgcgcgccccgtgtccgtggccgcagccgcggccccgctccccgccgccgcgctgcagcgcagggcccgcgtggtgctctactaccgcgcggccgccgacgcgccggcgccgtggagccaggaggaggcgctcctggtgaaggagtcgctgagcgaggccgtggcggaccacccggagatggcaggccggctccgtcggagcgggtccgggtccgggtccgggtccagctgggaggtgaagctcaacgacacgggcgtcaggctcgtgctggcca

SEQ ID NO: 28415 - DNA, 525 bp, Sorghum bicolor
  Clone ID: 7551235
gcacgaggggaacgacacgctcgtctcctccggcgccggcagcttcgtgctcggcttcttctccccgctgggctccaacaacacctatgtcgggatctggtacgccaaggtgcccatccgcaccgtcgtctgggtggccaaccgcgccgcccccgtccgcggcgccgccacggacaacgccggcgccacgctctccgtatccagccaagaatgcgcgctcgccgtcgcggacgccaacgccacggtggtgtggtcgtcggcgtcgtccccgcggcccgccggatcctctgcggcgtcgggcggcggctgcacggcgcggatccgcgacgacggcaacctggtggtgacggaccagcgcgggcgcgtggtgtggcaggggttcgaccatcccaccgacacgctgctccccgggatgcggctcggggtggacttcgcggccgggacgaacatgacgctgacggcgtgggcgagcccgtccgacccgtcgccgagccccgtggtggcggcgatggacacgtcggggga

SEQ ID NO: 28416 - DNA, 477 bp, Sorghum bicolor
  Clone ID: 7551242
gcacgagggaacggtgattgggcattatgcacagtacttacaacctctggtgatgagtccgttctaaaggtttctgaaggaaaagtactgcgattgaaaacagacagtcttcaacctgcaaatcctgaaattcttgatggagtggatgatcttatgcagctaagttatctaagtgaagcatcagtactatacaatctgcagtacagatactcccaggacatgatttatactaaagcaggtccagttttggtggctgtcaatcctttcaagaaagtttcattgtatggtaatgagtacattgatgcatatagaaataaatcaatggacagtccacatgtttatgcaatagcagatgcagcacttcgtgaaatgaaaagagatgaagtcaaccaatctataattataagtggtgagagtggagcaggaaaaacagaaaccgcaaaaattgctatgcagtatctagcttctcttggaggt

SEQ ID NO: 28417 - DNA, 501 bp, Sorghum bicolor
  Clone ID: 7551247
tgccagtgtcactactactcctcactagcacgcttgcagaggttgcagctccagcgagcaacaaggatcgatcaggtccatccatggcggcccccaggaaggtcctcatgctctgcggcgactacatggaggacttcgaggccgccgtcccgctctacgccctctccgccctcggcatcaccgtcgactgcgccgcgcccggcaagcgccccggcgactcctgcctcaccgccgtccacgacttcctcggcttcgagctctacacggagctcacgggccaccgcttcacgataaccgccgacttcgcggcggcggcggcggacccgtctcgctacgacgcgctggtcatcccgggcgggcggttcacggagcagctgagcgcggacgcggccgtcgtggacctcgtcgcggcgttcgcggcgctgcggaggcctctggtgctcacctgccacagccagctcctgctcgccgcggccggcgggctcagcggcggcacgcgct

SEQ ID NO: 28418 - DNA, 519 bp, Sorghum bicolor
  Clone ID: 7551251
gcacgagggttcacacttgatacctccaaggtcttcaccatcattacacagttcaacacagacaatggtttgccttccggtaaccttgtgagcattacacgcaagtatagacagaatggcgttgacgtcccgagtgctcaatctggcggtgacactatttcatcttgcccgtctgcttcagcctacggtggtctcacaaccatgggcaaggctctggcaaacggcatggtattggtattcagcatctggaatgataacggcggaaacatgaactggctggacagcggcaatgccggtccctgcagcagcacggagggcaacccgtccaccattgttgccaacaacccgggcactcatgtcatcttttccaacatccgatggggagatattggttcgactactggcgcaaccggcggtaaccctcctcccagcacatctagaacctccaccacgcctcctcccagcacaaccctgagaacttccacttcaagcaggacaactacctcgactgctgcaggc

SEQ ID NO: 28419 - DNA, 526 bp, Sorghum bicolor
  Clone ID: 7551274
cggaagatatcagcacgatatttccgtgttgcagcagcgcaaggcacgatcatgccaaccatctaacacgcgcggccatatcggcatatcgcgtggtgcacgagggcaaagttggccagggccaagagcgatggtgaccacttggtaaggtttctaagggaccatgacacacaataatgccatagccaacgtatttgttagaccaatgagtcagcaatgtctaaatcagtgcatgaggttgctgtgttaaccgccaaacatgaggaacgatagaaatgtttcgggtctctttcttgtttcttctcattatgagtcaattaaacaaggaaacaccccaagctaagaaaggcagaaaagaggaaacacccttcctgccatggggatagggactaaagtttttttagctatatattgtgaatgatattcaaattcaactagaggagaaacaaaaaacactagccaaattttgcaatgcatgctgcatgactgaaagaaaaatgcattggatttataaaggataaacctg

SEQ ID NO: 28420 - DNA, 493 bp, Sorghum bicolor
  Clone ID: 7551288
ggcggccgcgcgccggagctgctggtgacgcacgacagggcggtggcgctcgtgaaggagttcgcggacaagggcaaggtggtggccagcatcggccatggccacctgctcctcgcagcggcggggctgctcaggggcaggaagtgcgccagcggggtgcccatgcgggtcgtctcgaggctggcgggcgccgaggccgtggaggccgcggcggccgtcgttgatgggaggctcgtgacggcggcgagctggacggacctcgcgcagttcgtggctcgcgtcattgacctcctcggcatctccgtctccttctgaatgcctgttgtgtctctgctcttcaactctgggagcactgaacactctgctctgaatgttttgttcttatttcattgttcatgaggtctgagaatggcacaataagttacatcagtcttttttttgtgtgccacaataaaatgcatctttctgaataaagcgcatcaccgaatttcgt

SEQ ID NO: 28421 - DNA, 444 bp, Sorghum bicolor
  Clone ID: 7551310
ccaccacatgggggtccaccaggtggctatggacaacaagctggctacggaggccctgcttatggtgcaccaagcggtccctatggcggccctggcaactatgatcaacatcagcacaaccagtatggtggtgctcctacgcatgctaaccaatatggtggtggaggccagcagtatcctcctcctcctggtcagcaccaggctggctacggtggccctccaggtggtcaccatacaccgcagcctggttggcagtaaactcgtcgtatcctggtttgctgagtcgtgcgccgatacacggacgaaggatacacaaaacttacggttgcgacagagtgaggccgcgatgcgaacaacaggcgatgcttggtggctgaggttttcggaggttgctagagatacctttctgaactgtgtagattcaatgactttgttctcttcctg

SEQ ID NO: 28422 - DNA, 106 bp, Sorghum bicolor
  Clone ID: 7551325
tttttccctgtttgggcttgcccggtgctgttgttttgttctgcacatgtaatgtgagtttatggacacgcccttattattgggtgcttttggttgggaaccagta

SEQ ID NO: 28423 - DNA, 409 bp, Sorghum bicolor
  Clone ID: 7551326
tgctggccgtcgcggacttcgcggtgtacctcgtgtgcgcgagccgctacgggagcggcaaggtggacgggaggagcagcgacgacgaggaggagggagcggccggtcaggtgacatccctgccggcttacgcatgaccatcaccggccggccgccgggcgtcgtacgtatgccgttcttgtcttcttgaggtggaggctggcaggctgcaaatcttgagggccattggttgacggagttcttccattgatgacgatagcacaaccataggggtgggcacggtgatgatatgactaaagaataagcactaaagcaggactagctacatactacatgtgcatcaagctcgcgtttttttggccaatgtaacaacagaccacgactgtcactgaccaagactgttctttct

SEQ ID NO: 28424 - DNA, 600 bp, Sorghum bicolor
  Clone ID: 7551369
gcacgaggctaaggcaaaggcgcgctccctccatggaagtggaagaagcaggagaattggagaccgccggcaaggacgtggcggaggcggagtaccattcgcacgacttcgagtgggaggaactcaaggaggaggtggaatctggacctgccttctcctaccacctctccccttttcccgagcccgccgcgagtaccacctcgccgccgcagctctcgtcggaggcctggagaagcttccaccgtcgccacgcgtccggaaagttcttcaaggaaaggaggtatttgcttaaggaatttcctgaactttgtagcagcaaagatcatgctaaggtcttagaagtggggtgtgggaatggaagcactgctgtttccattctacggtctagtgaaaggatcactgtctttgcttgtgactgtagtaaagacactcttgagagggcaaatgaaattatatccaacacaaaagggattgatatcaaggataggttccacccctttttaatggatgtttctaaagaaactttcccagattggttattctgcaaagcctgtcaatgttcgctgggaaaagatgctgcacttttacttggttatacat

SEQ ID NO: 28425 - DNA, 206 bp, Sorghum bicolor
  Clone ID: 7551389
tccagttcgtttgttcaggattgtgttgaaccctgcatttacctggggaaaaggagaaattgacgttttacctggacatgattttttttttgtttccacttttaccataacttttgggcaagtaagcgccagcttttgttggttgtatgttgcaaaaatttgaataatgtgtataagatttttcaaagtttttccccaaagatagt

SEQ ID NO: 28426 - DNA, 574 bp, Sorghum bicolor
  unsure (1)..(574): unsure at all n locations
  Clone ID: 7551420
tnttcagatccaagtcaccatggaattagaaaagagcacccagtcttccttagagagaaccaatgttgtgctggtggcatggattttattaccatgatattcacactgtcagccatacccttcgacataatgccaactactatagaacaatgtgtttctgttctgaaaccaggcggccttcttctgtttagggattacggtctttacgacatgacaatgcttcggtttttacctcatcaaagagtagggtttcgggaatatatgcgatcagatggtaccttttcatatttcttctcattggatactgtgagagaactctttcatgctgctgggttagtagagttggagctggaatactgctgtgtcaagtccgtgaaccgaaagaaagggaagacgatgcagcgggtatgggtgcatggcaaattccaaaaaccacctacctgacaccagttagctgtggaggtagtagcaacataggccaggtagttttctcggccactttggtgttgcaacaaagcgctgtaacagttttgtaaccacaaactttaatgccatggaaattctgttcccctgc

SEQ ID NO: 28427 - DNA, 468 bp, Sorghum bicolor
  Clone ID: 7551441
ctccgccgagcaagtcctccggcacccgtggatccagagcgtagggggagtccgagaggtggttcggccaacgccaacctgaggagcccacggggctcctcaggtttggaacgagaccggaaccgatcgtgtatcatcgtagcgatgcggtgtgttgtccccgacgagttttgtgcagacgcctctgtatatccagcaagtaggcggcggcggcggcggcggcggcggcgaggagtgtgagacactgagactggagatcgtcgctccgccgcgcggcggcggcgcccgggtgtgtgtgtgtgacggtgacctgggccgttttcctcttttcctttttgggcttttttttttacccgcgccgaccctgtgtgcttttgggagtataaaagtgtagtgcgacggtgatgtatgcacgtctgtctagtctaaccgtgcatgtgttatgtgtacaaatgaataagtactact

SEQ ID NO: 28428 - DNA, 222 bp, Sorghum bicolor
  Clone ID: 7551456
aagcttattggttgctttgactgataatgaggctccggtcggttgttttataacccgtattttttgtaccagtcagtagtatttttttttcccaataaatcagcaaccaatactaccagtacatatggaaacccgcagatggccaaatgcattgcctccctcggatcatcaggtcccatgccatcatgcactttgttgaatcgctatttttacatgtactgc

SEQ ID NO: 28429 - DNA, 658 bp, Sorghum bicolor
  Clone ID: 7551539
cgttaggaagtgcgtagttatcatggagggtaatcctcatccaggagctataaagggtcggatgtcattccaaaatttcaatccatctatcgataaactaaatgaagaggcaagaggtgaccgtcaaacagaatcagcttcacctagtaactccagcagaggggatgaagttccagcgtcgagatctagagattttgacattcccagttcagaaagcatatctatgaatgaactgaagaggaaagagcccgaacttgatatggaaacaccggcatcttacaaggaaccaaaaaccaatgttgacagtaggtcatcttcacaaagcaatggtcgcggatcacacaagtccaacaagcgtgaaaagctcgacttcaatcatctaagaccaaagaaataaaaatggtgtcttgagttaccataaccatgagtagctcttgtactctgtttgtagttgtacccaattggccatctgccgtgttttgtcgattatatctagagagctggtaaccatgcctatgtggcatgcatgttcttaacttagtgagattttgtggtgttaatcattatctttctattgatgtgttctactccactactctgctgtaagatgtgaggctctactgtagagcagtgatgaatacagttctgcttatgtttt

SEQ ID NO: 28430 - DNA, 433 bp, Sorghum bicolor
  Clone ID: 7551551
gcacgaggctccaacggagaaggatggcacgggcgggctcagcggttgcgcaacgatgagacaaggctacgtgcgtgagctatcggacagagggcaagcgagagcaatgaatttctctggcgactggaggagcatgacgccggagctgagagggaaaaagagagagacggcagccagcgtagcttaaaacagcacgggcggctttgccagcttcatcagcacctgcttgagtgtgcctccacgaagcaggtgcacgtcgcgcatgcttaaggaggcgcatgctgtcggcggcaagcagctgcatgcgtggcagcgaagctgctgctggcgaggctactgttcatgactaaaaccctaacttcccgtcccgtctcttgttcatgtgatttgtcaactaaatgtgatgagatcccttaataaaaattgttcatct

SEQ ID NO: 28431 - DNA, 554 bp, Sorghum bicolor
  Clone ID: 7551559
tctctcaagctttacagaagcatccagtcagattcccttgctgggaaatgaaatgcagagccaagtagcatcactagccagcaacggtcttccaatgccgttcactcaggaagcggcgcccttcgcatatggaagcagcacgaactcaagagagatgctgaataacaaccttgcacttagtaattcaggcatcaactcttcattgccgaaccttcgcatagacggttctgttgttccgaggcagacactggacggtggtaattcaggtggagtccccttcattgatggggactgggaactggtctagcaggcttcagttccctacatcaagtttttccgcatttgtgggggttcggcgcttgattggtccatgctaatttgcctgctcaaagttgtttatagtagcaagtttgcatcacaaatgccctttgcatttggttttttcagtttagcgaccaggttccagtgtcacgtccttatatcaactatgtggtatttgctaccttaactcgtatggctatgttttaagtcaggtgttaactgtggttatcgtg

SEQ ID NO: 28432 - DNA, 530 bp, Sorghum bicolor
  Clone ID: 7551600
acagggagccgaccgcgttcgacatcctgagcttctccccgggctccgacctgtcggcgctgttcctcggcgccgggaaggagcgggtgttcgtgggcgagcccgtggcggccgtggtggcccgcgtggaggctgccgggaggaaaggagggtaccgcgtgcggagggacgggaagagggccaccgccgtgtacgtggaggaagaggagagcggcgtggtggttgcgaaagtgagcgtgtttaggatcgccgacgccgtgtccgtggtggaggtggtaaaaggcgacggccccgacgccgtggtgttctggagcgagctgctggagccggccgtgaagcccccggcgctgagctgctgaggaggtgaagccgtgcccgcgcgcggcggggagctgtgcgatgtgattattttgtttgtttgtttgttgttgtcggtccgcctcggcgaaatcatcatctgtaaaaccattatgctatgcatcgaatcaaatcaaagcaaggacgaagaagaatccttgcgatgttgattg

SEQ ID NO: 28433 - DNA, 582 bp, Sorghum bicolor
  Clone ID: 7551635
ctcgccatcgccgagcgcctcggcctggagggcgccgccgtcgtcatctcctcccgcaagcagaagaacgtggacgaggcggtggaggggctcagggccaagggtatcaccgcggtgggctccgtctgccacgtctccgacgcgcagcagcgcaagagtctcatcgagacggccgtcaagagctttgggcacattgacattcttgtctccaacgctgctgcaaatcctactgtagatggcatacttgaaatgaaagaggctgttctcgataagctgtgggatattaatgtcaaggcttctatccttcttcttcaggatgctgctccccacctacggaaggggtcatctgtgattatcatttcttcaattgctggttacaatccagaacaaggattgacaatgtatggtgtcacaaagactgctctctttggtctcacaaaggctcttgctggtgagatgggacccaatactcgtgttaactgtatagcccctggttttgttcctacacggtttgctagtttcctcacagaaaatgagagcattatgaaagagcttaacgagaggagcaagctcaagagattg

SEQ ID NO: 28434 - DNA, 567 bp, Sorghum bicolor
  Clone ID: 7551639
gcacgaggctcaagtactgaagtacacaacgatcttcttctcactcgccatggcttccaagagcacaatgcattcccttgtcctcctcatgggattgctgctgctctcatgcagcggcacgagcagcgcggcgcggctgctggaggaggtggcggcgcccaaggaggagtacccgcaccctgaagtgccagagctgcccaagcctgagctcccgccgcaccctacggtgccggagtttcctaagcctgagctgccgccgcatccggtcttgccggagctgccaaagcccgaggtgcccgtgcaccccgccgtgccggagaagttgccgaagcctgagctgccgaagcccgaggtgccggagcaccctgctgctgtgccggagttgccaaagcctgagctgccaccacatcccactcccaccgtgcctgagctgcccaagcccgaggtgccggagcaccctgctgccgtgccggagttgccaaagcccgagcttcctcctcaccccaccgtccctgagctgccgaagcctgaggtgccggagcaccctgctgccgtgccggagctgcc

SEQ ID NO: 28435 - DNA, 483 bp, Sorghum bicolor
  Clone ID: 7551662
gcacgaggctctctctctctctctctctctctctctctctcggttatgtgtgcaaatagagttgtttgtttttagctagccttttcttaaataatgagttgcttaatttccaaattagaatttgagtgcttttgggattgtgtgatgacctaaggtcattaacattaatgacctttagcacttaattattgtttgatgttaatacttaattactgccattaatatttaattaagaattgattaaaagaaatagaaaacctaatcattttaggttttgtttgatctttgggattgattgacaaccagtggttgcttagcatgatatgttccctggttatagattatttcatataaatgatctttgttgcctgatagctacacaaccttgcttaatgaagatgataaaatttgcttagtagtaatctatgctttgttcactaagttagtttgtttctctaccatgaaggtaagttgtactcgagg

SEQ ID NO: 28436 - DNA, 655 bp, Sorghum bicolor
  Clone ID: 7551679
aaagagctgaacctgcaaaatatgggcaaatcgagatctggtgctctgacaactcccatagaccaagttgcagtaattgaattgctggttccttcaatatttagagctgtagtgtcattgcatcctgctggatctactgatcctgatgcagtggcattcttctctcccactgagggaggaagctatcttcatgcgaggggcacgtcggtgcatcatgtgtttaagcatgtaaaggagcatgctgacaaggcattgcagtacttcatcagtgtggagccgaataaagcactttctctgcttttgcgttggattgccagctatcagactctgtttacaaaggtttgcagcaaatgcggacggcttctgatgatggacaagtccttggctttgctattgcctcctgtccaccgcccctatcaccagacttctagtattggaccagatcttcaagaggcttatcacattggatgttcttcctatgatggctagctgatgcttcgaagaaacacccgagactatttagatagcacaggatgtttgacattgtcactgacaaagtacgagtaccagagtctttctgtgtaaaacagtgttctttttctggaatgtatgcaatccatcaggtgacttcgtacagaaacgttaccgattgctt

SEQ ID NO: 28437 - DNA, 300 bp, Sorghum bicolor
  Clone ID: 7551688
ccagtcccgcggcgaaggcggcgccgccggtggttacgaagccggtggcggcggttacggcgccccccgtaagggtggcggttacgaagaaggcggcggcggttacggcgggccccgcaaggaagaaggcggttacgaagccggtggttacggtggcggcggcggcggttacggcggtccccgtaagggcggcggcggttatggcggcggcggcggttacggtggcaaccggggtgactccggcggcaattggaggaactgattgtgtgggccccccctggtttgggccaagttatccta

SEQ ID NO: 28438 - DNA, 496 bp, Sorghum bicolor
  Clone ID: 7551694
agtcgtcgaggcgctcgccacgtcggcgtcccggtcggggaaggaccactgcgtggccctgctcgtctcgttgtgccggcacggcggggacaaggtggtggccctgctggggaggatgccggggctcatgtcgtcgctgtacacgatggtggccgacggcggcagcccgcacacgtgcaagcgcgccagggcgctgctcaacctgatccaccgccattacgagatggatgggcagccggcgtcagcgtcggcggcgtcggaggccggcgagcgtgtcgttcgcgtgctatagccgggagccgcaggaccgggaacctgccgtaagtacagtaaatagtaggtgtagatctttacagtgtgccgccatttgatttgagaccatttgttgtttgtgttcgtcagctcgtgttttagaagagctgggaacgaattttgctgcttcttttttgaagactgctgtagacacagatacacgcacgaaagtatagtatagttt

SEQ ID NO: 28439 - DNA, 473 bp, Sorghum bicolor
  unsure (1)..(473): unsure at all n locations
  Clone ID: 7551699
ttcgtggcagccttctcctgcagcgccttggcgtcccgctcccgccgctgctccggcgtgagcccgtcgtcgcgccccttggccgcgggccgccgcgcctgcgccctctgccggtagcgctccctttggtcgccgcgtgcagcccgccagctcaggtcaaggacaaaaacagcaacgtcatccgaaacacaccggttctacttctactttacaacagaaaatatcaaaaggaaaaagaatctggcagagacgaaaagaaaagcccctgcaagaatcgatagaacgacaggaaaaaaaaaaaaacagagggggacaagaaaatcatgtgtggccaaggatatgagtcattgtgctgacttctcaactgtgttgggaggaagggagggagagagacggggacgcgggctgatgggagagggggagtggggggggaggaagctatggaagcagggcaagcaagggggggncccggt

SEQ ID NO: 28440 - DNA, 130 bp, Sorghum bicolor
  Clone ID: 7551723
cggtggaggccgggcatcccgaccaggggcagcaggagaacaacccgacggaaccggtgccccagttgtggcccatttaccggcccaggcccgtgtaccccccgctccgggcctgcaacggtttgggcag

SEQ ID NO: 28441 - DNA, 281 bp, Sorghum bicolor
  Clone ID: 7551729
tgaggtgccggagcaccctgtttccgtgccggagctgccgaagcctgaaatgattgagcccccccccgtgccggagttgccccctttggttgaacctgagttgccagtgcccccaaaggccgagagccactacccggagccaaagaccaacccgtgatcggccggcctatatatgcattaatgaacatttgatgtataatgtgtgtacgtacgtatggtttacactttgatgtttacctgggatgttgttggccgcccccccggtgccccatgaacactac

SEQ ID NO: 28442 - DNA, 600 bp, Sorghum bicolor
  Clone ID: 7551731
caaggcttctactaagaaggaatattccaaggaggaggaccctggtgtccagtccgtcaagaccatcttcaactactacaagaagtacggttacaacactatcgtcatgggcgcctctttccgaaacactggcgagatcactgagcttgctggctgcgactacttgaccatttctcctaacctgcttgaggacctcctgaactcgaatgagcccgttccaaagaagcttgatgcttcccaggcttcttctctagacatcgagaagaagtcttacatcaatgatgaggctctcttccgctttgacttcaacgaggaccagatggccgttgagaagctccgagagggtatcagcaagttcgctgctgatgctgttaccctcaagagcatcctcaaggagaagctcgcctaaatctcttgcacggttgatgatttaagagacaatgtttaaaaagttaaatgggacagtgttaacgtgggaatgcagaaagcactgaagctgactgcgaacaaccaactataatttgttcacaatctttgctggggagttgtcgttgcttataccacacatcttctatagttcatatccatctagtattcctc

SEQ ID NO: 28443 - DNA, 149 bp, Sorghum bicolor
  Clone ID: 7551737
cttgtacaggttgtcatttttttaattgcgggtaagtaaagggtccggtgtccccgtaaataatgggtttattttaaaagggattttttggggttcacatttaatgtgttgtgcgtgctgctttggtaaacatttgggaaaggtttatg

SEQ ID NO: 28444 - DNA, 250 bp, Sorghum bicolor
  Clone ID: 7551748
gagatccagcaggccatggaggactactattatggcaaaaatggatttgaaagggccagccagtggagctcctcctccccctgattgtgatcggggaggcaatcgccccaaatttaatttcaggtgcaaaataaacatttttaattaaattttttggcttgaacgactggccatttgtttgttggggaagggtaaaacgttccccactctgattttgattatttttttttttagcaaccattgtactagt

SEQ ID NO: 28445 - DNA, 475 bp, Sorghum bicolor
  Clone ID: 7551757
gcacgaggggggtgctgattgggaacgggaacagctcgatgcgtcgggaaattatggggttagttaggatttggattagatgaatgaataacgctggtttgccttggtgtagatagatctcactgagactgagttttggtgtggttggattggattagctctcggtgttgccagcctcgattgatttggtttgatctccctagattcctcctgcctgcgtcgcatgtgttagttttgggggtagcatctgtacataggctcgagctgtgaactgtgtgtgaaggcgtgaagcaggagctgcttcctagactcggatcgagatcacgagactctcttcatccggcgaggtgctactccgtccgtctagcgtctaacctttttctcctgccattttgtaatgctgagcttagcatgtaggagtagcaaacacatttggagacactgacaatcatgttgtaatgatttttttgaccct

SEQ ID NO: 28446 - DNA, 481 bp, Sorghum bicolor
  Clone ID: 7551766
gcacgaggccccaaaccccctgctcctctgcggacttcggattgagtggcgctgaccgcgtttgcgggtatcagatatgaagagggcggcgccgtcggtggagccactcgatgtgtcttccggcgactcctcgggctcggattccgaccaattaggcgggaaggagaagggcgggagcgcctccaaacctgctgccgcgggagaagatacgaagagggtggtgctgcgtaaggaatcccataacgtatcttccgatgatgacttgagctcggattctgacgatgatgctgggaaggggaatggctggaatgcctttgggctgcccaattcctccaaagcttcttcggtggcagaagcggccaagtcaaagaagaagaaaactggtgtggattttagtgctttgagccggcatggataccatggtggcccctctgtcttgacagttcgtccagtagaggaagctaactggtcttggtccact

SEQ ID NO: 28447 - DNA, 504 bp, Sorghum bicolor
  Clone ID: 7551772
gcacgaggctcaagacgtacctcgactccaagccctgggacctcaccggcttcgttgaccttatcctggcacagacgacagtaggcacggtcgtcaagttggctgatgacgacgacgaggaaggggaaggaaacggtgctgagaaggccaattccagtaacaacactgacgatgatgatctgtttggtctcattagtgtgctcaatttgggacgacacgctgagcaaaaatgcattaaggaccttaaggagtatctgcttgctgtctgtgccgacaagggtactaagaagcagctcaggtctctgctcgaagataaagcatcaagtgtgggccttctggtgtgtcgccgctttgtgaatttcccttatgaactcgtgcctaagctgtatgacgcactcttcgacgaggtttcctgggcaacagaagatgagccaacaaaagaacttcgggactccttccggttcaagcagtacctgttggttgtcagaatgctcgagaggaaaa

SEQ ID NO: 28448 - DNA, 629 bp, Sorghum bicolor
  Clone ID: 7551800
cttctattagtggtgttgagcttcgagctgcagcttctgctctcaagagacttggtgatggacctcgtgctcatagtttgttgctcagtgcacatgatcagagacttcaattaaacatgcaaacaatacaaccatctagcacatcatatggtggggaatacactgcttctcttgcacagcaaatttttcctgttatagctcaggctctcaacgactcagctgaggtctttggtgacgaaccagcatacacatctgaactagttacttgggctactaaacaggcaatgtcattttcgctgcttgtaaagaggcatgctttagcctcttgtgcggctggtgggggcttaagagctgctgcggaatgtgttaagatagcaattggttattcagacttgctggaagctcgtggtctatcacttgcgtcagttctgatgaagcaattcagaccctctgttgagcaagcattagattccaatttgaggagaattgaagagagtactgctgctttagctgcagctgatgactgggtactcacctatccaactggtatacgtccattggctagatcatctgctggtaatctgtcactccagccgaagctctcaagcagtgctcaccgtttcaattca

SEQ ID NO: 28449 - DNA, 503 bp, Sorghum bicolor
  Clone ID: 7551818
gcacgaggcctcctcacccgatgcttggatgatgttgatgacgaggtccgtgatcgtgctgccctcaacctgaagctcatgaatgaggaggatgatgagatggccgctcggttcgtcaagaacgaaaacatgttctcccttccctacttcgaacagcagcttgtcctctacgtcacatcagacgacaagtccgcttttgatagtcccttcgatattgctaagatccctgtggttactcgggagcaggcggacgctgaagaccgatccaagaagctgattgccactgcccctacactcaaggctcccaaggttggccccaccaagcctaccggagccgaggctgttgcttctgcttctgctcaggctcaacggtatgcccaggagctgctcgagattcccgagatgaaggagtttggcagtgtcctcaagtcctcgcctgttatcgagcttactgaggccgagactgagtacgttgtcagcctggtcaagcacatcttcaagga

SEQ ID NO: 28450 - DNA, 435 bp, Sorghum bicolor
  Clone ID: 7551833
gcacgaggagagggagagggagaggaagcgacagccagcagccgaggcggccagcgcaccgcaggcatggccactcccacttccagtggcgacggctcgcccccgggctcctccgatctcgtgcccccctcctaccccgagatgatcgtcgccgcgatcgccgcgctcgccgaggagaacggctccagccaggccgccatcgcgcgccgcatcgaggcggaggcccgcggcgacctgccggcctcgcaccccgcgctcgtcgccgcccacctctcgcgcatgtccgccgccggggagctcgtcgccgtcgcggggggaaagtacgcgctgcccccgcccccacctccgccgccggccccgccggcgctggagtcaccggctgacgacgaagaagaagaagacgactgcgccgacgacgaggaggaggaggaggag

SEQ ID NO: 28451 - DNA, 528 bp, Sorghum bicolor
  Clone ID: 7551849
ccactgggaaagaccgcaatgacaaagaagatgcacctgagtcctatgaagaacgcgagcgaaccagggctgcagtgactgaaggagagaagcttatcggtctgcagaatgccccgcccaaccagttattattagagaaagacaagaaggatgcttccttctcacagaaggagaagcggaagagggaccgggggcaagccagcagggggaagaactatgttgaggaggagaagcggctcctgagggggagtggcgtgtactctggctttgatacttaacagtaccaggtacaaatacagcactatttctaacatgtatgcgtactgaggattagctttcatggtgtgctttggcttttgttgtgtggctggtaagttgacccttggtcggtgagtgtggactttggagatggttagggttgtgtttagtttgggctttggatatatggctatatgtattgcggtcaaatagtaccctgccatattctgtatgtcatgtcctgctgcatttgcgagctgccacaatccc

SEQ ID NO: 28452 - DNA, 634 bp, Sorghum bicolor
  unsure (1)..(634): unsure at all n locations
  Clone ID: 7551880
ttttttttttttttttttgattcattcacgcctcatcgccaaattgctccttggtactctccaccggttgcggttagggacaaaattgtattgtgttgatgtacaaacaattacaggttacaaaacttgatggtcgcaaactcaccgggagaccactcaaatcggattctgaactcacaatgcatgaaagaattcgagtgacatctccagggttattcctcctcttcgtcatcctcctcttcagcttccttgagccacttaataaaggcctctgactgtttaacaaagactttatcagactcatctgcatgttctttctcttccgcccatctcaaaattgcatcttcacttacaacctctctgtcatagaggtatggcaagatcgttggaaacagcggagaaaactcttttgtggtctcttgacacatttcctcaaactttaaaagtatctccatctcctcatcaactgtcttggtgtaattgcgcaaaagatccttccacttgccaagtgcatcagcagttgtctttagaagagtatcattagtagattgtgcagccactaatgcactcttcatgacagaatagaacacagctccagcacaatctgcatgttgaaggctgtaggctaanccct

SEQ ID NO: 28453 - DNA, 373 bp, Sorghum bicolor
  Clone ID: 7551886
tgcatcaagtcatattggccatcattgataaagcgatgagagcgttttttgcaacagggatggcccctgatagggtccttccaagcgacgactggttcatcgacgttgcccaggagagtatcagtaggatcagcgggaacccccgattccccaatggtgcccgggacagggaggtgaacagccccccaccctccgtgtcagcacagtccgtgtcgtcagttagattttttggcagctcctagggtgcaggttagacattcaaagtttttgtatcgatactgtaaagctttgtttggatgtgtttgtgctggtaaaaatgtgagtaattgtatgcatagtccaagaaaacccttgtagctgattttgttgattt

SEQ ID NO: 28454 - DNA, 640 bp, Sorghum bicolor
  Clone ID: 7551899
cgtcccgctcgacggcgacgaggcggccggcgggaaggggctcgtggacgtcgacgtgctcagcctcggtccgcgcgagaggcgggcgctgctggagcgcctcgtccgcgtcgccgacgaggacaacgagcgattcctgctcaagctcaaggaccgcatcgacaggtgaggtgacccctcgcccgctccgcgacgagccgcgcgcggttgcactcggattcggtgtttgacgatttccggtcgctgcagggttgggatcgacatgcccacgatcgaggtgcggttccagaaccttgaggcggaggcggaggtgcgcgtcggcagcagcggcctgcccaccgtcctcaactccgtcgtcaacacggtcgaggaagcggcgaacgcgctgcacatactgcccagtaggaagcggatcatgcccattctccacgacgtcagcggaatcatcaagcctcgcaggtagttgaataaaacaatggctcttttattgggttttttttttttgtcctcaagaaagtcaaactattttccatctacagagtcgatgagctgtgttttgttttttaactagaagatagagtaattcaatatccctgttggtttcgcttgcgttggtgactggattagtaatcgtctcctc

SEQ ID NO: 28455 - DNA, 456 bp, Sorghum bicolor
  Clone ID: 7551902
tctcggcaagacagtcggtggaggccgggtggttgccaacgtacggatggcttactcatcaaaaactggtgtcacgacaaagatcacggtgcgaagcgaagaggagaatgtggctgcgctagtcatcgcgtcggtcgcttagagatgaacaacagaagcaaagcgggcgttgaaaggatcatgatgtatcgaaagctttgtctcggttttagacataccgtacaattgtggcagtaatgtgattatttacgattcgtttccttgtcctggaatcatgattgtcgcttgggaggggttagaggctcgtaaaagtgatgggagatattcattgggtggttagagggaagcgaagaaggtataagagcatgtttttatcggatgcatggtttttggggcccatgttatttgttgcaaaaagatggaatttacctaggtagccaaacctgaggctgtggt

SEQ ID NO: 28456 - DNA, 617 bp, Sorghum bicolor
  Clone ID: 7551915
ccgcggcccgcgggcttcccggccggcgtgcccggagctgcccccatcggcgcgcctggagctgccgcgtcccccgccgcagcgccgcgccggcgcggccgcccgcccaagccgcgggacccgcacgcgcctcccaagatcccgcgcccgcgcggccggccgcgcaagaacccgcttccagaggggatggtcccgcggccgcgccccggcgcgccgacgtcggccaaggctgcgcgcccgcagttcgccgaggtcggcttcgtgtgatgccgaggagctctcgcccgccggctggccggccgaccggcccaggggcggcggcgagctggcgcaagctaacattttgcccttgttccagctcttgtctgtctgatgatgtgggtttcgtctcagttcgtgtggttgttgtctaatccggggagcgtgtaggggcaggagtctgagtggaggcagcttcggcgtcggtgccggcggccggcggtgtgtcgtgtttcgtggtgtttctctaccttactattgggtgggtggtggccggagtggtgtggctccggcggtgtatcctgtgtctccttgtcgcgctcgcgcaatgcaatgcagttagtctgatcgtttcattt

SEQ ID NO: 28457 - DNA, 551 bp, Sorghum bicolor
  Clone ID: 7551979
gcacgaggacaacataagaacttcttcaaaaaacaaacaacataagaacaggaaaacaggcaagagccttcctccccctccttctcagtagcaactcagaaaaccatcagaattgctggtcttgcttggtactacgtttgccatggttcagatcaaagagttccggatcgtcatgcccatgtcgatggaagagtatgaaataggcttgagctacaccatcatgaagatggagcagcaaaacacaaatagcaaggagggtgtagaagtactgcggcaagtcccatttgaggatgagaagcttggcaaggggcaatttacctcaaaagtttatcatttgcagagcaaaattccatcatggatgaagggctttgcaccttccagcgctctcacagtgcatgaggactcttggtgtgcatttccaaagagcagaacagtgatcaagtgcccacttttcagcaaatgttcactcaccattgacactgtaaccagacctgacaacggttgctctgaaaatgtgcacaatttgaccagtgagcaattagccgcaagag

SEQ ID NO: 28458 - DNA, 191 bp, Sorghum bicolor
  Clone ID: 7552010
aaacgaaatagtgcccgtggggagctgcacgtagtgctagactgctagttttatgtgacggcccattgattccgttgacaccctatccccgttgggggcggggtattggcggcaaaagcccgacgcgctgtacatgggatgtcagtactcagtagtatgtcatagattaggcatgtgtaatgtgtccccat

SEQ ID NO: 28459 - DNA, 641 bp, Sorghum bicolor
  unsure (1)..(641): unsure at all n locations
  Clone ID: 7552013
ctttgaagcaagtaagtcacccaatcttcaatagtattatttgccgattctccgagtataaactaacttattttgttttccttctcaggagcaagattctcccgacaacctattctccttcgccatcgacatttcagaacaagaaggtgaagaagcaagctcttcctagacagttggcatcacatcggcagagatcagggccaagctggaagaactgtcagctctccttcaccaagacacggctcaactagtcgatgatctgatccgaccaaggttctgttcaagactctcagaggccagattcctgctgatgctgaagaaatcctcttccaggccgcacatttggaaagccatcagctgcagtaccaaaaggctgcccgatgtctcgccgatagaactgcccagacccagctctctgaagaaatgaggaaggagaaactcttaaccgatgagaagcacaaaaatatcggtgctttgaagtcttcagaagatgcactggagcagaagatttctgatctatcggcaaagagagaagccctgttggcagaactcaaacaagtggaggatgctttatcccaagcccaacaggagaagaaccaattgccggagaccatcaagctctccgagggggggncccggta

SEQ ID NO: 28460 - DNA, 223 bp, Sorghum bicolor
  Clone ID: 7552022
agctgcagctgccccaaaaaaggcgaaaaagttaagtgatcaaaagcattggctttttggtaccaggacttagcctaattttggagccccttgtttcttttgctgtcaaaaatttaagctgtcatttgaaaaatttggaacatcaaatttcgtttgttatgttggaagatttagtaaacttgtttattttaagggcctttggaactaattatcccaggaaatg

SEQ ID NO: 28461 - DNA, 150 bp, Sorghum bicolor
  Clone ID: 7552088
tttttttctttggcccagtgaaggaagtcaggaaacccgaggcctttttcaaaggccgaatgttggagttttaaaaatgttcccctttgtgacccatgtttcaactgctttatattttttgaatgaacgcaaaaggggggaaaaatacaa

SEQ ID NO: 28462 - DNA, 250 bp, Sorghum bicolor
  Clone ID: 7552107
gagaactagtctcgaggttttttttttttttttttttttttttttttttttttttttttttggagacgacgattccatttcattccaagcacggtcacacacccccgagctcaccttcaccatcagatcagcacaaacgtgaacaaaagagcaccccacccaacatgccatgccactacgtacgattctactgctactctgctacactgccagcgccgaccgacttctaggcgatggtgacctgcacgga

SEQ ID NO: 28463 - DNA, 303 bp, Sorghum bicolor
  Clone ID: 7552123
attcccctagtaacggcgagtgaagtgggaaaagctcaactttgaaatttggcagcttcgctgttcgagttgtagtctcgagaagtgttttccgcgctggaccatgtatgagtctgttggaatacagcgtcatagagggtgagaaccccgttcatgacatgccttccagtgctttgtgatacactttcgatgagtcgagttgtttgggaatgcagctccaaatgggtggtaaattccatctagagctaaatattggggagagtccgatagctaacaagttccgtgagggaaagatgtaaagac

SEQ ID NO: 28464 - DNA, 579 bp, Sorghum bicolor
  Clone ID: 7552149
tcatggttctcatcggtataatcatgagctttcgtttcacacctcattactccattcctcaatatgtcatttcagctctcatcacatttgtatttgctgaggtgcttgaaggagtgaatctgtccttgctctcacgagtaatgtcatcgaggctttcccgagggacctacaatggtggactcctttcgacagaggctgggacgttggcccgtgtagttgcagatgccacgattactgcagctggttatcttggcacggacctccttctcaatatcactcttgtcccatctcttgtgatctgcatagtctccatcgcagccacactctacacttacaacaatctctattgaagctcttagctgtacaagtgtacaacaatgttcctaagctaaagcgattcttgcccacaatgggtttgtatacgattcctgcccacaatgggtttgtatatctgttcaagcatggtttgtaaacattttgatcaagttggtatgcaaaatttcttgtatttagtgtatttatgtaaaaattcatcctgtaaataattatgaactatgagcctctattgctggcttatgt

SEQ ID NO: 28465 - DNA, 526 bp, Sorghum bicolor
  Clone ID: 7552153
tcggcgtacgacgaggtggagatcgaggacatggagtggaacgcggagctgaaggcgtacacgtacccgtgcccctgcggcgacctgttccagatcacgcttgacgacctccgcctcggggaggagattgcgcgctgcccctcgtgctccctcttcctcaccgtagtatacaacgccgaggacttccccgacgccaaggagccgacgacccagaagccgtccccgagcccagtcgccgtcgcctgatgtggcccgtgcacggcgagatgatttatgaggagttgaggacaataagatggatgttggcaaacttaaagaattccatcagatgcatggaatggatctcagagcaggaaaaggaatgagttcaacacgccactacgggagcatttgtactatactacttagatgagtgaacccgctgcatattttcaaagctcaggttgttaaactttttttttttgtgggtgacattgttgtaaggtgacatggacaactcatgctatgaaaaattttgttcgtccct

SEQ ID NO: 28466 - DNA, 113 bp, Sorghum bicolor
  Clone ID: 7552164
catcgatgcagttgatattgagctccgatcaagattgggagccgagtgagcttacaagaaaccttgtgcatggggacttgaaggcttcatcgccgatctgctccagtcatctt

SEQ ID NO: 28467 - DNA, 266 bp, Sorghum bicolor
  Clone ID: 7552167
gaggaggtgtgcggcccgatcatcaagcaggtgtacgagaagtcggccgggtcggacgccgccgcggacgaggaggatgacgtgaacgagctgtagagtgttcgcgacgagctccacgtagagcattccggctgacgagctgtagagctctctgggtgttcgactgttcgcagggggatcatgatgcgttgtaaataacttgtcgctgtaaagtgaagaccttgctattggtagcagtaatagtaagaatcaatcatttccctttt

SEQ ID NO: 28468 - DNA, 497 bp, Sorghum bicolor
  Clone ID: 7552185
gcacgaggcaggcagagccgccctgtcgccggcgcggcctcctgctcctcctcctcctctgccaccgcctcccaactcccagcgcgcaggggccgacggcgacgggaggggagaagcggcagaggtagtccgaggaggggcggggccgacggcgacgggaggggagaagcggcagaggtagtccgagggggggcggagagaggctgcgccgtcccactccgtccggtgcctcagcccccggagccccttcgcgaaggttcgggaatggcgcactgggttagcgacggtgatggcagtgacagcttcgaatgggatagtgatggcaatggggaggaggcagggagcttcaacactgctggtgccaggtcatcagcaatggcatcaacgaacactgacgctccaggcccatcgagacgggtaagccaggttgctaatggcaatgggaaggctgggccatctgcctctttggttcagaggtatatagacatgggtttcgc

SEQ ID NO: 28469 - DNA, 282 bp, Sorghum bicolor
  Clone ID: 7552186
gcacgagggcaaaccccccgctccggccgccattgctggcttgctgctgctcgtggaagctccgcccgtcgctgggccatggacccggacccgaacctggacatggacatggagatggatatggagatgctggccgacgacgccgacgcggcggtcgccggcgacagtggcggcgagggagaggccgagcgcaacgaggccgccgaggccgaggctgaggccgagcgatacgaggccgccgaggccgaggccgacatcctccgcgaccgtttccggctcgcc

SEQ ID NO: 28470 - DNA, 496 bp, Sorghum bicolor
  Clone ID: 7552196
gcacgaggcacatatccttcaagatgaccaagcgaacaaagaaggtcggtgttaccggtaaatacggtacccgttatggtgcttccctgcgaaagcaggtcaagaagatggaagttacccagcacgccaagtacacctgcactttctgcggaaaggtcaccgtcaagcgacaggctaccggcatctgggattgcaagtcttgcaagcgcaccattgctggtggtgcttacaccgttgccacacctgctgccgccgccatgcgatcgactctgcgacgtctccgagagattgctgaggtttaaggatagactctagcggaagaagaaaacggctttgcttttcggtatggtgtacgggggatatggatttcgtgcctacactacgagttgacgatctggacgtcaacacccgatattcgatcacatagaagccgatcgattagcaatgaacaaaaaagaattgcaggcttcagacccaaaaaaaaaaaaaaaaaaaa

SEQ ID NO: 28471 - DNA, 491 bp, Sorghum bicolor
  Clone ID: 7552256
ccagcctcgtcgcacgtcggagggtcatggcgtcccgcgcaagctgcagctggcgccccagctggggttcaggggtctcccgcgctggagcagcagtccccccgggcgtcctctcgctcgttgctccgccgggctcgtgagcctccggtgtctcctgggtcgcgcgcgcagaggcctctactccagctcgtagttgtgccccgttctgcggcgctgcaagcggctgaggatgccctgggccaagctctggtggctctcgtgctcggcactcggcccgcgcttgcgcctgctgacatcgtccaccacctccgcagccactacgggattcctgaggagcgggtgaccgtccgccgcacgcggccgaacgatttcctcgtgcgattcgccgacaacgacgacctactccgcgtcctcgccaaccagcggcctgtcggcgcccggttcctgctgcgttggcgtcggtggtccaggcttatctctggctccgccgg

SEQ ID NO: 28472 - DNA, 425 bp, Sorghum bicolor
  Clone ID: 7552279
gcacgaggaagaccgccggcgcggatcagcagcaggctgctgcctgcaggaccaccgacaagtttcagagctacctggagactgccaccaagatcgcactctcgctgccggacacgtaccatgaaatcgttgcgagcgtgcccaagggattggaccccagcattatactctttcgagtgtgattattagatattattaattggtgctaaataaatcgaaatcgatcgacaagtatagagagtttccgacaacggaaaagaagaacaagtttttacgactagctccttacagatgaaacgaagcctgcattatatttgtatcatgtgtattagagtccagagatggactgaacagtacatagtagactgcttggaaatttgcagttgcattatctccctaaataaatcaatttgtagagttgtttc

SEQ ID NO: 28473 - DNA, 230 bp, Sorghum bicolor
  Clone ID: 7552313
tgcctcaagaaccccgcccgtggcatcagcggcctcaacgccggcaacgccgccagcatcccctccaagtggggggtcagggtcccctacaccatcagcccctcccccgattgctccagggtgaactaaccctaaacgatgatcgatcgatcgatgatccattccccccccccccccgttgtcgtcgatcggccccggagcatcgcccatggatgagtatctatttaccc

SEQ ID NO: 28474 - DNA, 117 bp, Sorghum bicolor
  Clone ID: 7552319
gcacaaggcaggggagccccctcaaggcttgggttggcaagaaggaaaacgtggaaaaggccagggttcccttcctccccaggggcaaggccaattgggaggcccccctgggcaaaa

SEQ ID NO: 28475 - DNA, 427 bp, Sorghum bicolor
  Clone ID: 7552336
gaccgtttccgcctcgccgtcatcagcatcgccaccgccgaaggaaagaaggccggaatgacggtcgccgaccctgttgttgcctgcgtcgccgatttggcgttcaagagcgcagagcagctagcaaaggatgcagagttgtttgcacagcatgccggtcgcaaatctgtcaggatggatgatgtgatactcacagctcacaggaatgagcatcttatgggcctgttgcggaccttctttcaggagctgaagggaaaggagcctgccagttagaggaagagaaagaacccttctaagaaggatgagagggtgatcgacgtctgattgcagatatctgtgatcttgtttagcgaggaaaggcatgcagtgttctatctggcgaggtcctcctgacttgtacagcttccttgtgtaccttgtgtaccat

SEQ ID NO: 28476 - DNA, 446 bp, Sorghum bicolor
  Clone ID: 7552530
atcagagggctgcttgtgaaagagccagagtgccggctcggcttgtcgagaggagccgctgagattaaacggcatcccttttttgaaggcctaaactgggccttgatccggtggactgcgccaccagagaccccgaagaacattgatactgcagcagcacttgcgacacgcaagaaaaaggaaggcaaatgtttggaattccggctgaatggcgacgacatcgagttcgagctcttttagttgtagctgtagtggtatcactgctgtagtcccaaggatatatcagtatcatgataagctagcaagagtagttttagtccctcttccctgcagttttttgttgaaagttagttgtttcggatgttgggaagtgaggtaaggttggctgttcagcctgtaactttatgccttgttaataccatcaaatattagaagacccggttggg

SEQ ID NO: 28477 - DNA, 702 bp, Sorghum bicolor
  Clone ID: 7552547
cagtccattactttcttcactaagcaggcaagcacactggacaggaggataggtagcatagtagtcccagctgcttccctgcaaaacttgatcagtgcttcagtcatggtctccctgccaatctatgaccggatcctcctgcccatggccagaaaatacaccaagaacccttcaggcatcacaatgctgcaaaggatcggtgtcgggttggctatttcgacagccatggccgtcattgctgcactcgtggagacaaggaggctcaaggtggctagtgactatggcctactggataaccctcaagatgttattcctatgagcttcatgtggattgcccctcagtacattatggttggattctctgatgctttcgccattgttggattgcaagaactgttctatgaccaagtgcctcatagtatacgcagcttgggcttgggtttatacttcagcatagttgggacagggaacttcatcagtagctttcttgtgtacaccattgacaaggtgaccagtagcaccggaggaagctggttctccaacaacctaaaccgagcgcatctggattacttctactggtttcttgccgtcctcagtgcttttggcctggctgcttacatgtactttgcacagatgtatgtgcataagaaaaaggcttctatttcagcacaataactgcacagagctgataagtcttgcttc

SEQ ID NO: 28478 - DNA, 589 bp, Sorghum bicolor
  Clone ID: 7552552
tcccgcgcatttccaccccattttcttccccatcggcaacttcgccaccggcttcttcgtcctcttctccctccttgccggcgtcgtcgggatcgcatccgccatcgtgggcttcaaccacctccgcttctggaactaccacagcctgcagcccgccgcggcgttgggcctcggtgcctgggcactcacagtcctagccatggggctagcttgtcaggaaatctctttcgaccgaagaaacgccaagctgggcaccatggagaccttcaccatcatcctaacagtgacgcagttcttttacgtgctcgcgatccacgggggaagtcacggacccgccgtcccggtcgagcgccgccgcaactttgcaggatgaacgaatggaaacatatatgcatggcacggatctgaggcaaagggagaaggacaaaaaaaattaagggaaggaaggaagaagccgggtgcttaatttgtttgtttcttttggccacttcattcaattatccgtttgctggattaatttattgtttgagtgcattcggagacatactgtatgtgttgacaatttcaattacaatattcatatggatgg

SEQ ID NO: 28479 - DNA, 663 bp, Sorghum bicolor
  unsure (1)..(663): unsure at all n locations
  Clone ID: 7552557
atcccaccctgacactcntaagatctatgaagagctgaggtacttgttggctcacatgaaggaagctgggtatattgctgacactcgatttgttcttcacgatgttgatcaagaaaccaaagaggatgctttactggctcacagtgagaggctggctatcagttatggtcttataacaagtgctccccgctcacctattcgagttataaagaatctccggtcctgtggagactgtcacacggctttcaagataatctcgaaacttgtcggccgtcagatcattgcaagggatgcaaagaggttccaccactttgaaaatggtgtgtgctcttgcaaagactactggtaaacaagatgatagaagcccacatcttggtcaattttgatctgcccaagaccgctataggttgtttatatgctgaaggtaggctgatgcctatctaacatttaggtagctgatagtttcatgtcagggacatgatgtatgatgtcgtcagggacaagcaggccctaagcccctctattttgcagttcatatgatataagcctgagtttttgctttaacgactgttgtctccgatttgttacttgccaccaaaataaaacagtagaatgttattgggttgtggtcccctggcatgtaaactttgattcagcttgact

SEQ ID NO: 28480 - DNA, 613 bp, Sorghum bicolor
  Clone ID: 7552566
gagaatttgaaaactatggctagattctgtgctttccagatcgcgaagatcctggaagataacaaattttcctgggacagtataacgatgttgaggttctactactcggtagatctctccatggcggcagatgcattacgtggagctttttccgaggcatttgctgagcttgcggaagacaacagttccatgagaactgacaaaattcctttctacaacattgtgcccgtagccggatctggccgctctgcatgtacgaacgatataatgacatgcgagttattggcttccaacatttcgagtgcatagtccaaacccagtgtacacacgctgattgaattgttcgctgtgatgtctgctgggatgaagctttccttgggaagaaattggatgtgggtacatgttggaatttctgccagctggacgacgacagttaagcagctttttttagggttggcagcggtagctttttgtgctgatgatcgataaaaaaattcgtagggtgatcatagataccccatacttgctgtattctgtttctgcttttgttaccacgtcctatacattggcttgacctgatgcttgcaatgacattggctcagtatacaaggtc

SEQ ID NO: 28481 - DNA, 646 bp, Sorghum bicolor
  unsure (1)..(646): unsure at all n locations
  Clone ID: 7552586
acatttcaggaattaatgaaggatcagtntggtaactatgttgtacagagagtccttcagacatgtgatgacaaatacctagagatgatcctgtcaagcatcaaattacatttgaatgaactgaagaattacacgtacgggaagcacattgtggcacgtgtcgagaagctaatcgttacaggagagaaacgagcaaggatggcgtccctgagtggccaacatcagcagccaccgaactgtacagctgtagacgcacactaatccctttttatgcattggcgtcaaatacgactacacactaatcccctttcacggattggcgtcaaatacgacgagcaggtggcataagtgacgcggaaagtttggttttactacatggtttaaatagggtacttgcagataatcaaggatttatgttgccttgcctgtatataaccaggtgtggtgttttcgggaacccagtagttagatgagaagttaggttttcggcactgtaaatccttttggccatgtacaagtttattacatacagtggataatagatgtacattgtgctggagcgttagcttttggtagtaggtgagagcggtgctgtgtaatatatctggtgctgctcttctgatgaagtcggtagagagagctaaag

SEQ ID NO: 28482 - DNA, 308 bp, Sorghum bicolor
  Clone ID: 7552624
gcacgaggctcaagaagtgcagcagatgagcttggatggggatctggggaacaacatcctccccaaccaggcctgcagtagctcagacggcgggaacgcttggcgggctcgctgcgatcagaactctgttaacccttctactggttcatatgaccagtttgaatgacctaacttgccggtccatacatgccggatcacaattaggcgtctcctgagggatggcaggtgcagaatatttgtagatgtgtcgccagttttacatccgggagagcaaatggctccttggattgctagtgtttttgttcata

SEQ ID NO: 28483 - DNA, 215 bp, Sorghum bicolor
  unsure (1)..(215): unsure at all n locations
  Clone ID: 7552625
gcacgaggctccctccccctattaatacagctcagcagctcactgccatttcccattcccactcagaaacacaagctcaagcacaagaagcacaatcgcaagaagctcaagaagctgaggcaagcagcgagcccaagaagaagaagaagaagaaagccaagaaggagagagagagagatgggaagcgaaggcagcacaagcccagggggagngag

SEQ ID NO: 28484 - DNA, 216 bp, Sorghum bicolor
  Clone ID: 7552678
gcacgaggcccagaccgaatcacttgaggacccatatcagtgactccccatttgtatacggttgggagttttcttgcaaaagctgaatttgactgcatcctgcacagcccaagatgctgcgatacatctatgtgtggcacgcacactttgcaaaaacacacacacaaaaataaagaatatgactgggagcttcgataagataatgtgtgtgggggg

SEQ ID NO: 28485 - DNA, 235 bp, Sorghum bicolor
  Clone ID: 7552681
gcacgagggtatgatgctatctcacatttgaagacattgcaaaagaagaagccaaagccttccaaaggaaaagatgatggtcaaggggagcaggcttatgttgttgtggaggcatccaagttcaagagggttggcaggaagactaccttgcggcaggatttggccaatgctctagatataagggccttcgagaggatgacgaaactaggccactgtgatgttgagcttcttacaa

SEQ ID NO: 28486 - DNA, 261 bp, Sorghum bicolor
  unsure (1)..(261): unsure at all n locations
  Clone ID: 7552697
gcacgagggcggaggcactcctgctgcggcttctgcgcgccaaggctgacgagttcatgcggcaatctgatggtgtcagctggatggctgatgaccctcctcctggtggcaatgagtatgcgaacgaggtcatcatctaccttgagacgctcacatcaactgcacagcagatccttccccttcccgtgctccgccgtgtacttgtggcagngcttgcccacatctctgaaaggatgatcgagctcttcttgaacgattcag

SEQ ID NO: 28487 - DNA, 187 bp, Sorghum bicolor
  Clone ID: 7552705
gcacgagggagcaaccaccgcgccgcgagcgatggagaagagcgccggcaatggggtggcgacgtctgtcccggcctcgtggaacttcgagcccaacgagaccctgctgggcctgacggcgctctcggtgcgcggcgtgctgggcagggtcaaggccgggatggtagaggccgacggcggcgggcgg

SEQ ID NO: 28488 - DNA, 440 bp, Sorghum bicolor
  Clone ID: 7552726
gcacgaggctagtctcgagttttttttttttttttttttacacaaaactacagtttctttcactgacaaagaaacaatcagttacactcagaaacattccactatttatccaaagagccccccctccaatacaagtgagcacgcctagatgatcaataagttgagggctgacaaataagtagcaagcttacacagacaagtaagaaatgcatagcaaccccgcagtttgttcaaggttttacatccaagcaattcctgacagtctgtaaagaagtaaatatattacctagcatagcagaaggctcctggtaagcatatcctcctcaaaaagaaattaatcagtagccaagcaactctggatctccagtgtattctgcctctggtcatatctaacacgtacaatatcctttgaatctgcatcctccaccaatccgatctgt

SEQ ID NO: 28489 - DNA, 610 bp, Sorghum bicolor
  Clone ID: 7552753
ttatatctggaagaccattaatgcgattgtgggctccgtatctgtgacttttgtatctgcctgtgctcatgtatctgcagtaggtggagaaactgtactgcagcactacttcagaagcctttttcagcgaaagaataatattttctctcacgcatttcaccatcaccataagccaaatttcagttgtcagagtttgcaatagaggctcagactacgaaatcaatttgggacccaaaaaaaatgacagtgcaccatttaccattacgatactacttttatggtggaacaaccttcgtggtgatcggaacctcaagttgcgtaactgcagaattgaaccatcgttccgagacaccaaattttgcttttgaggctgctgtgttgcctgcagtttcgggataaacgtggacaccactcgccggtaggcggtagcacagtaaaggacttcggcccctgcattggcaacgccgatgatagacgtgtacatgaaacggactgttacactgttactatctttcgtccatcaacatgtgctgcaagttatgttgcacaagtattaaaatttccgtggataaacttagtagcaattaataaaattattttcttattctct

SEQ ID NO: 28490 - DNA, 273 bp, Sorghum bicolor
  Clone ID: 7552804
gcacccacgaactaccaagccgccgccgcctcccccagcgcccccctactcggaaaggaatcggcagaaagaaccacttggcagttggcaccgcccgcctctcccttcctcctccctatataaagcagccaccgcaccgatccgagcttcaaattcgtccctcggaatttttaagatcagccaaccaaagcatccaccagattctcacctccgctagcgaacacgagacgagacgcgggcctgattgatcgatccccttttccttcgattcaa

SEQ ID NO: 28491 - DNA, 341 bp, Sorghum bicolor
  unsure (1)..(341): unsure at all n locations
  Clone ID: 7552871
tcggagaagtcgtcggcgcggtcggtggacggcagaacggtggaccagccggtggcgtcacctacctggtgcactgaccaccgtgtgtcggtccgcacggcgcggggcgttgagtttgagtttaagttcttcgcccccgtagatccatcgatggatcgagtagtctgtacagctcgctactgcctgatagtataataattaatttacctgcaaggtagctagtgtagtatctgaatgatctaacgctgtatgcgaacctggaacgcgtttgtcgaattttgtaacttaaaagaagctatataaagattcctttttattgcaagcgagggggggncccggta

SEQ ID NO: 28492 - DNA, 286 bp, Sorghum bicolor
  Clone ID: 7552874
gtggatcccccgggctgcaggggccccggcccggccccggcgggtgtgcggccccggctttaggcgcacgccccgcgtggtgcgctggttgcccggtacgaccggattgctcccatttacaacgacgcgcgagtcacttgtacttggtcaaactctcggatggttgtaaacttgtattgtaagattgtgtcgtatcttatctagtattagtacttgctgccagtactttaattagtactacgaggaaatggttaccctgaaaaaaaaatccgagggggggcccggg

SEQ ID NO: 28493 - DNA, 221 bp, Sorghum bicolor
  Clone ID: 7552948
gcacgaggcgaacgccaggcacgcgctcttgcagcccaccaccgcgtcgtcgtcgtccttcctcctcgccgctgacgacggcggcggcggcggcggcgctgctgccgcagcagctctcaccgccagctcgctcggggcacacccggttgatgtccgcggggcacgacgtgctccggcatcggcccccggccgcgggctcgatctccacgggcaggttgaag

SEQ ID NO: 28494 - DNA, 259 bp, Sorghum bicolor
  Clone ID: 7552959
ctgattgccaagaagctgcgggagtttcacgatctcgacatgcctggacctagggatgtgtcattgtggcagaggctcaggaggtggcttgaggaggctcgtggcaggtgttctgagcaagagtttaaccaatttcagctggataagctaggcgatgagattgcagtgctggagaagacgctctcgggggtcgaacagtccgtaggattttgccataatgatttgcagtatgggaatattatgatagatgaagagaccc

SEQ ID NO: 28495 - DNA, 306 bp, Sorghum bicolor
  Clone ID: 7552968
gcacgaggctcggtctgaacacgggcggtaatacggtgccgtggatacatcctttaccgcttaccactatccccctttcgatgctttgctttgccggctttctctggtgggaagggaaggcgaaacagcctattatacccgtggcccttctcagggaccgcacagttctctccgcttgcagcgccagtctcttcatctcgatgcttcttatggccaccacattctacgtgcccctctaccttcaggtactcggcgactctaccacaaccgctggcctcaagtttctgccgtcgccattgggtgggt

SEQ ID NO: 28496 - DNA, 178 bp, Sorghum bicolor
  Clone ID: 7553003
gcacgaggcttcgatcccggtttccgccgccatggaagaggaggtgggccccggcgcggacatggaggcgctcgtccgccgtctgaggctccaccgcccggccccctccccgtacgaactctcagccgcggtggcccctgcccctgctcctggcgccggcgagctgttccggacacgg

SEQ ID NO: 28497 - DNA, 484 bp, Sorghum bicolor
  unsure (1)..(484): unsure at all n locations
  Clone ID: 7553023
tccttcctcctcgccgctnacgacggcggcggcggcggcggcgctgctgccgcagcagctctcaccgcggggcacgacgtgctccggcatcggcccccggccgcgggctcgatctccacgggcaggttgaagccgtcgacgttgctcacgtcgtagaagtccttgttgccgccgccgccgccaccgagggtgaactcggccagggtagccggcggggcgccacccgcagtcgccggactcgcaggagaaacgcgcgccgccgacgggggaggtggtggctgtgcagcggtagcggccccacatacggcccgaccacgtggcacccacgccggagaaggacagggaggctcccggcggctgggccgctggaggtcagcgtctccggccagacggtctccgggcagttgttgcggaaggtgaacttcacccccgtcgcacctgcatgtgtcattgtcattagcgtgcacaaatttgatacttatat

SEQ ID NO: 28498 - DNA, 509 bp, Sorghum bicolor
  Clone ID: 7553027
cccagggatagttccaggatctgatcaaggacaagaagtggtgggagaactgcttccacaagatggcggaggggatcccagccgcaggcatgctacatggcagaggccgatgtcatggtgggacggtgtgccaactcctgaagtaaccttcagaagttcttgcgccatgctggggagtatgtcgctgcgcaagtgattggcatagcgaggtcacattatcccttcatcgagctcaggtcagacctccgtgcaggcggacgagctgcaggagtcatcatgggcggccgctgttagaatcgccaaggacatcgagctgatggacgaggccggagagggtggtgccgataaagatttggcctgatagtgttgtttaatatgaagtaatgcgtgttgaactatcaaagtattttggttgctttaggttgacaatcatgttgtctcttatgttcttcttaagttgagacttggtgcatatgttaaggatgtttgaagttatctttttatatttt

SEQ ID NO: 28499 - DNA, 422 bp, Sorghum bicolor
  Clone ID: 7553044
aatctgcagcctatcagagcaatttaaaagaaatgctatgggacatcttcggagacagagtgggtggacctgaggagatccaacgtattctggacgggctagacgagttaaagcatctcccagaaggttggtggcatggtgtcatggccacgtttaatggtttgctgggctgttctggcccttttcagcatctcattggtcaaacgacacacgctgcactcaaagatggataggacatgaaacacggggttgggggcttgatttttaaactctagtgacctttttgcattccactcgctccttggccttgatcccttttctcttagctagttcgatgactgattttcggctgcaccattcagaataatgttgttcaagcaacaggttcgggatggccccccgctaattataagaaagatctt

SEQ ID NO: 28500 - DNA, 478 bp, Sorghum bicolor
  unsure (1)..(478): unsure at all n locations
  Clone ID: 7553047
atagccgccgccgcgggagtactcgtcagtagtgtagacggcggtctgccacagtcgtcgtcggcgtacacgggcctcatcctgatgcggtcgtcctgcacgttgtcatagtactcgtcggtgcgcgagtaggccttcatgctgccgccgccgtgcctgccggcgtcgtagcagtcgtcgtacatgctggccctgccgccgtgggccggcccgggttacaattaattacacacaatggattgctgctagctcagctcatcgacgttctgagggcgattccggcctaactccgacaccaaatctcggctagtggtgcccgagacgaaggccaggatgatcggtgcgctgcttcgagaagcgtcgagcgtactctcggagagtttctcctgacttctacttgcacttgctgaggtcccacgagttgccaggccgtatgtaggtccccttgaagttaccctcgtatacttctggttggcnc

SEQ ID NO: 28501 - DNA, 468 bp, Sorghum bicolor
  Clone ID: 7553072
gcaccaccagttcagaagcatataagagatatagctcagtacttccatcttccactccgagatgcatcaaagacactcaagatcggggtcagcatactgaagaggaaatgccgacaatatgggatagctcgttggccgcaccggaaaatcaagtcacttgactccctcattcatgaccttgagtacgtgcaccagctgcagaaggagaggctggctgctgcgataacggccctcgcaaagcggaagagcatgctggaaagcgagaaggaaaccatacagcagaaaccgaccatggacttgatggctgaaaccaagctgttcagggaagatagttcagtcatggatgatatggatttcggtatggtttagcatttctatttagctgataatagctggtgtaaaaagatatgggctggctgaacctggttgtaaagagataatctctccatgtgtatcgccatctcttct

SEQ ID NO: 28502 - DNA, 238 bp, Sorghum bicolor
  Clone ID: 7553075
gcgttggatgcaagcttgcaatatggtgaaggtgttttgaaatatgaacatatttttgaatggttgcccccccaaaagacaaaatattatttttgctttcctgaaaaatatgtggcttgtaatttgctagggcttgttatgtttacttgcctcaaaaaaatgttagcctccagggtggttacctggacgccaatttggttgacagtatggccaaagtaaggcaacccctcccctaact

SEQ ID NO: 28503 - DNA, 515 bp, Sorghum bicolor
  Clone ID: 7553085
ccactccggggaagttgcattaccaggtggaaaggccgaggaaggtgatgctgatgatgcagcaacagcattaagggagtcaaaagcgttacatcgcttgaacatgtcttgtccaaacatcttctggtagttgttcctattgttggcatactttcagacataaacacatttaagcctgttcctaatgctgctgaggtggacaaaatttttgatgtgcccctggagatgttcctcaaggatgagagggcaggagtttacaatccatcacttcagttatgcgaaggagaacgagaagtacatgatttggggtctgacggctggcatcctgatccatgctgcttcagttgtttaccagcgaccaccagactttgcagagaaaagggaatgccatggccagagcctgagcactaatctcgacagtaccagctcagctatatcaattgtaacatatatactgcatacaacagactatacattgaattgaattgttgtagaatctaatggaacttcaagtc

SEQ ID NO: 28504 - DNA, 218 bp, Sorghum bicolor
  Clone ID: 7553112
gcacgaggatttgcggaaaaactccaattgcggcgggcaaaaaaaaaaggagaaaaaaaatatttctccgatttttcacccccaattctcactcgccgccgccgccgccggcccgatctcgccggaaccctagtcgaggtggggggcagcttcgggccgtgctcgggagctcgcttctcggacgccgcgggtcgctggagcccgtgggcgtcgtcgtc

SEQ ID NO: 28505 - DNA, 190 bp, Sorghum bicolor
  Clone ID: 7553128
ctgacaacaaaaaagcacacacacacatacatacacctactagtcttcgtggctgccaagcttaagctcgagaaggattaacaatggcggtagtctcgcggtcgaggagccgcgacgtcccctcggcgcttctgctgctgctactgctcctggcggtggcctcggcggacgcggtgggcgtggtggccaa

SEQ ID NO: 28506 - DNA, 263 bp, Sorghum bicolor
  Clone ID: 7553134
gcacgaggcttccttgcgcgcctcaagccgtcccacccggcgcccggccgccggggcccccctatcgccatcaagaagttcaagcagtccaaggagggggacggagtatcacccaccgcaattagagagatcatgctcctgcgcgaaatcaaccacgagaatgtcgtcaagctcgtcaatgtgcacatcaaccacgctgacatgtccctatacctcgcattcgattacgcagagcacgacctttatgagattatcaggcatga

SEQ ID NO: 28507 - DNA, 188 bp, Sorghum bicolor
  Clone ID: 7553139
cgcgaccacggcgtgaagtacgtgtacgtgtggcacgccatggcggggtactggggcggcgtgaagccggcggcggaagggatggagcactacgagagcgcgctggcgtacccggtgcagtcccccggggtgatgggcaaccagccggacatcgtcatggactcgctctccgtgctgggcctggggct

SEQ ID NO: 28508 - DNA, 218 bp, Sorghum bicolor
  Clone ID: 7553144
gcacgaggaaacagcaatttatcctatagatttagtaaagactcgtctacagacgtattcaggtgagggtggtaaagttcctagaattggtcagctctcaagggatattttggtgcatgaaggcccccgagctttttacagaggtcttgttccatctttgcttggtatcgtaccttatgccggaattgatcttgctgtatatgagactttgaaagatg

SEQ ID NO: 28509 - DNA, 365 bp, Sorghum bicolor
  unsure (1)..(365): unsure at all n locations
  Clone ID: 7553190
ttcggcacgaggagaactagtctcgagtttttttttttcatttgtaaacaaactggacgagtacaagtgttgcttatacatgtaggccattcaaactgaaggctctaaatttggaacacaattttgtttcagtaacatcatgctgctcacacagtgggcgacgacagcgacggcgggaagccaagccctgccggcgcaccgtgcccggcagatcttctggaactcgaaactcttgacgtcgatcttgaacagctcggcgtccctgatgcggtggctcgccatgaacaccggtttttcctcgctgacttcgatcggaggcagaaagggcggtggtctgtctgccacggcagcgggatcgtcttctn

SEQ ID NO: 28510 - DNA, 455 bp, Sorghum bicolor
  Clone ID: 7553208
ctggattctacaaaggaattctaccaaatctccttaaagtggtgcctgctgcaagtattacctatatagtttatgaggcgatgaagaaaaatctgtctcttgattaaattctggagttgttggggaaaaatcagccatcattattggcatggctgaactggttgaatagttcctttttgaagtcaaagatggtgccttcaatatagaactggaagcagtggtggcattttcgtcctaattttgattcagcagaaatgaagtgataaacatgagatcatcgaggcccatgcctggcatatagctgttcaccgtgaatttccgaaggcttgttttaccccccgtctggggcgagttttgttagactgtaacacacacagggaaactctcctaacttaattacaattccttgtgctcctcaactcagactggattgcccggcaaaaagggtgctggtt

SEQ ID NO: 28511 - DNA, 170 bp, Sorghum bicolor
  Clone ID: 7553239
aaagtgtcctagtttaaaaaaccccgtccaggttggtttggatttctctctttctcttttttggtttgttctgtggaagggaaaaggttgatgtattacccctttattcctttcgagctaataattagtacgagtaatttattcaactaaatttgaggaatgggctcgtc

SEQ ID NO: 28512 - DNA, 564 bp, Sorghum bicolor
  Clone ID: 7553242
tcaaaaatgcttgagtatgatccccgaaagcggataacagctgcacaagctttggagcatgaatactttcggatggaaccactacctggacgaaacgcgcttttaccatctccagtagatacaacaacagattttgaaggaacaacaagccttcaaccaactcaaccgccatcagggaatgctcctcctggaggtcaatctgtagcaagacccatgccaagacaaatgccgcagcaacctatggttgggggaatgccaagagtggcagctgcacaggctggcatggctgggctcaatcctggaaacatccctatgcagagaggcgcaggtggtcagtctcatccgcaccagttgagaaggaaggcggatcaagggatggggatgcagaaccctgggtatcctcagcagaagagccatctggcatctgactgatgtgtagtactgtctgttgtgacgtatatcaggtgtttgaaacacgttgcctgtgtaaaagctggctgctgccgcagtgttgtaattttgttatcagcttccgaatgcgaatcagtttagacttcagactcg

SEQ ID NO: 28513 - DNA, 522 bp, Sorghum bicolor
  unsure (1)..(522): unsure at all n locations
  Clone ID: 7553269
ggccttcagttcacaaccattcctcaacagatctgccagtgccagtgcaagctcccaaagcctctgacctccattgtttcctcaccacttcatagcttatttgtttttttccctgctttgcagcatcaggttgagaagggcaagaatttcatcacttacccaaacaactcttctacaagggcacaagttttcttgtgcactaattataccttctcagaatactggcagggaacgcagggacccgagggcgtgcagtggtatgaggcgttcccctgcgcctccacgaagccgagcagcgatctccgcgctccattggccgtcgatgcggctgcggccgccgccgccgcagcagcgatcgccggaggaatccagcatagggcggccacgctgacgagaagtagcagcagaagccgccaccgccaggaggtcgccgccgtcgccttgttcgccatggcttccgcggttgctgctctcgcggtctcgccgacctccctgttgcggtggcgagagaactaggtngag

SEQ ID NO: 28514 - DNA, 461 bp, Sorghum bicolor
  Clone ID: 7553270
ctgcagtttgtgtgcgagtacgccggggagtttttgacaacggaagaagcgcggagaaggcagaagctgtacgatgaacttgcctctggtggcaacctctctcccgcactgattgtcatacgagagcacctcccttctggtaaagcatgcttaagagtcaacattgatgcaaccaaagtgggaaatgtggctcgctttatcaaccattcatgtgatggaggcaacctgcaccccgtgctagtgaggagctctggttcgttgctcccaaggctctgcttctttgcttccagggatattgtcgagggagaagagctcaccttcagttatggtgatgctagggttaggcccaagggtttgccatgcttttgtggaagctcgggttgttctggtgtgcttccttcagaagaaacctaagagctgacaccatcacctgtggtgtcttacaaatgagagtttgattc

SEQ ID NO: 28515 - DNA, 472 bp, Sorghum bicolor
  Clone ID: 7553305
accaaaaaaaaaaaaaaaaaaaccgagactagttctcgagaagggaatccccgccggcgccggcctccaatccatcccgcagcctctcctccatcctcgagcatctcgccggccggcctgtcacctccgatactgctcctacctccacgtcaggagcctagctagctagctagtcgcgggagctaagagatgacgtggcctacgccgccgttcctgtacgcgccgtcgccgttggtggcgggggcgtcggcggcgggcgccgtcgtgttggccttcctggccatctccgagttctgcggcgacaacctgacctactccaagttctggggccccgccggcggcggtggccggaggcccgcggcgctcctggtgtcgagccaccgatctaattaaatgagtggctcacagttatttgggtgtaccacagtaaaaccctctatcattaatactattccgtctgtaagtttggtgc

SEQ ID NO: 28516 - DNA, 357 bp, Sorghum bicolor
  unsure (1)..(357): unsure at all n locations
  Clone ID: 7553362
cggtacnggtatatacccttgctagggtttcgtggagactagattctcttgtaagccgccgcaggcgtgtaacccaaaaaaaactcttgagatagtgagatcgttgctggctggtgcccgtggtttttccccttcgcattggaggggttttccacgtaaatcgtgtgtctgtgcgttgattgatttcatactccatacgtcgttcataacatttccttcctccatctagcctggagatgtatatatgcgcaacctgctgctgatctacagataagtggctggcataattagaattacattcagtgagctgcgctagcttgttttgattgccctacccagccagtggtttgctgtctt

SEQ ID NO: 28517 - DNA, 337 bp, Sorghum bicolor
  unsure (1)..(337): unsure at all n locations
  Clone ID: 7553425
cgctttcgagcccaaaagcagtcctcatagtctgaagctgcctctccttctgttccgcggcatggtggctctgtgtgtccgtgaacccttggcgctcctccgctgccgcctcggcctcggcagctttgcgcgcctcgtcaacgcgtgcctcgatctcggcctccgtgtacccttgctcctcgagcgcgtccctcagcacgagcagccgcagctccacctgccgcttnccggtcgtgctcgaggatgtncttgttcggcttccgcatcccgccggcctcagagggggagggggagggggaggagggagagggccgaggcttggctaggaacttgcttg

SEQ ID NO: 28518 - DNA, 141 bp, Sorghum bicolor
  Clone ID: 7553427
ggagctggaggtggaaaagttcatcccccaaagggggccgttcccggagatcaacaaggcctttgccctaatggttaaaggaaagggcatccgttgcatcatccgcatggaaaaataaattttgctttttttctctggttg

SEQ ID NO: 28519 - DNA, 288 bp, Sorghum bicolor
  Clone ID: 7553440
cgcgggccgtggcgctcccggaaaaggtgcgggtggacgggatcagggcccccgtggagaacggggtgttccccgttgtggtgcccaaggaggccgcaccggcccggcccaagcccaggcccattgccgtttccagcaaattttgaaagtggcaaaagtgcactgaattttgatcgagcatgtgtccgtgtcccctaaacaacgtgtgtacccgtgtaaattgtgaaacagtttcatcatccattcatggaagtaatccaaaagtgagtgaaaatggccgctagccaa

SEQ ID NO: 28520 - DNA, 453 bp, Sorghum bicolor
  Clone ID: 7553457
ttctcaagacatgggagaatcataatgattcctggttcagaagatcgagaaggaaatgcatcatgaaacaaggtcatgggcggcgatctgacggcgattagagaggacggatctccgagctcgtggtagacgtaatggtgaagaactgatcagggttttgtctcgcttcattagtgggacatgtgtaagctagctagacacagctactgttgtacggcgactcggggaggaaagggacaacatgctattgtagatgaatatagaaatgggtgccaatttagtctcacttatggccactcattgccaacacagaaagaggggaaaaggagtggaaaataccaaaaagatcattgatctgctagctatatttgctccctccatgcaagctagtgtggtttacgttcaaaaccaattatattcagtaataatgattttaacttttgcagaggttgc

SEQ ID NO: 28521 - DNA, 125 bp, Sorghum bicolor
  Clone ID: 7553458
tttgtgcacgggaggaaaattgctggtcctgtgctgcttagtttattgacgcccccgctaaaagcggcaggggcttttcccccaagcatgaaggtggccccggcaggaaattaacaaaagccccc

SEQ ID NO: 28522 - DNA, 202 bp, Sorghum bicolor
  Clone ID: 7553482
ggacatcctccatgaccccaccagaagggaggcgcgcggaggttgatcggccccgcctgaccagggttcaccattcaccagttgtttccctgggaccctgatttgatttgattgtacggaacatgcatgcatggtggtgttgtaaacacagtgttgagtggccgaaccccccaacttattttatccactagttaaagttccc

SEQ ID NO: 28523 - DNA, 174 bp, Sorghum bicolor
  Clone ID: 7553488
gcggccccgggaacaaaatggacgggaaggtgcccgtgtacaaggcccgcagcggcgggggaagcatggcgctggaggtttgcgtggcgcctaacgcgctcgccaagtttgtcgccgacgaggagttcatggacgcggtgagcgcccccccggcgtgaaaggtgtccgcctctt

SEQ ID NO: 28524 - DNA, 171 bp, Sorghum bicolor
  Clone ID: 7553497
gttgacccgttttaccccgggggcagttttgacccactgggcctcgccgaggaccccgaggcctttgccgagttcaaggtgaaggagttcaagaacggcccccttgccatgttttccatgttgggattttttgtccaggccattgtcaccggcaagggcccgtttaaaaac

SEQ ID NO: 28525 - DNA, 624 bp, Sorghum bicolor
  Clone ID: 7553508
aaccccgacttccgggaggggcgcatttattagataaaaggctgacgcgggctctgctcgctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatccccggcgtcctctacgccgtctacgtcatctgctccgtcgacccccaccgccaccgcgaccccgacgacgactacgtctacgtcgcctgaccgacggacggagagatccccgtgcctccgctgctacctccgtccgctgtgctgtgtgcatctctttgttgggttagtagactaaatccgtcatgtgcccgtctgtaaactgtaaattcgtgtgtccaatctgacaatctggacgaattcatttcataaagatcttgtgtcatgggatctgtgcagttaattggggttacttcgctaccacgatcagttgtgctcgtgaatgaaactgcagatggttattaatccctcgc

SEQ ID NO: 28526 - DNA, 607 bp, Sorghum bicolor
  Clone ID: 7553554
accgcgggcgcacggagccagccagccgcgaccgagaacaggcgagaaagaggaggaggattccgttgcgtgcgtgcgtggagcgcgaggggatttgggcgggcgatttggtgcgggagacgggggcgggcgatcaggttctcttctcgatcccccggccgcggggccccggctctcggaggtgaaggaatccgcggcgcgataagatgggacccgggccgcccggaaggggaaggggaaggccggaaggaaaggaaaggaacatggccattgcctgcccgacgtgtcagctgcagcccgtcgagtgtcgcggtcgcgctacagccaggcgctcggctcggcgatggacggggaaccacacgcacacacagtggcgaggcctattgcacggcggtccctaccgtccacttgtgacagatcgagacgtcgagttgccacataaacagcggccggggctgacgcatcttggacttttcttcgcgggctgcctctacgtactgtcaactctggaactagctgaaggttggagagtacggtcggccggggagaagctgcacagtccgaacatgatgcggcgccagcggcccatgcatagctttggtttttg

SEQ ID NO: 28527 - DNA, 505 bp, Sorghum bicolor
  unsure (1)..(505): unsure at all n locations
  Clone ID: 7553563
gagagctccgagacagacgagatgggcgtagcgttgctccgcgagctcgtccggctgtggccggtggtgtgcccgggcacgagcgggtgcgacggcgacccgttgatcaatccgatggcagagggcgcccccaatctctctaccttggggtgccggcgcgtgctggtgtgcgtcgggggaaaggacccgatgaggggcagaggaaggctgtattgtgagaagctgaagggaagtgggtggcgcggggaggtggaggactgggaggcggacggtcagggacacggtttccatctctcgtgcgccatgagcgcagaggcggaggcgcaagtccgggtcatcgctgagtttctgagctatggatgacatctccgtttatccactccttcacgcggccatggtgcattgttctcgaatctgatgtttggttacatttttgtttcgagttttgattaaggacatgcatgttttgaatttttttcatagatttgtctagtctatatagtnt

SEQ ID NO: 28528 - DNA, 222 bp, Sorghum bicolor
  Clone ID: 7553585
atggaatcgggagctccaagtgggccatttttggtaagcaaaactggcgatgcgggatgaaccggaaaccgggttacggtgccaaattgggcgttaacctagaacccccaaagggtgttggttgattaaaacagcaggacggtggtcatggaagtcgaaatccgttaaggagtatgtaacaattcccctgccgaatcaattagccccgaaaatggatggcgt

SEQ ID NO: 28529 - DNA, 535 bp, Sorghum bicolor
  Clone ID: 7553592
gcgacaccgtgctcccgcacccgtggttccgcgccatctgcctcgagtccggctccggccgccccgtcggcgcggtgtccgtgtcgccgacgggggacccgtgccgcgccgagctgggctacgtgctggcgcgcgcgcactggggccggggcgtcgccacggccgccgtgaagcgcgcggtggccacggtgttcgccgaggtgcagggactggagcgcgtggaggcgctcgtcgacgtcgccaacccggcgtcgcagcgcgtgctggagaaggccgggttccgccgcgagggcgtgctgcggcggcactactggcacaagggacgcgccagggacatggtcatgtacagcttcctctccgacgacaccctccccgagtgatccccttcgccctttggcgggcgaatcgtccttgcatgcatcatctcgatcagctcagctgcaaatctctttcgcaatccttgttactacatacggaaaaaatatgtatcgatgcaatcatgtaaaagtggaccgtgctatcatgtgttttggct

SEQ ID NO: 28530 - DNA, 547 bp, Sorghum bicolor
  Clone ID: 7553599
agctgtgtccaagttgatggatgagggggaggctgcagaggagatgaggatgagagcaaaagaatttggtgctaaggcaaggaaggctttggaagagggaggttcttcgtataatagtataaatctattgatacatgaaatgggaaacctgggcaaaggcatctagctaatacagagaagggattaagctcccccctctcctggacgaaaactataatgcatgacagtactaaagcttaatcactactccataagagttatcttgaaattaacctgtaacctgaatcaggcagactctaagttaccgcacaatcagttccaacgtgttgcttagcttcctcttttacagatgctaacccatgttgatgacccacccctgcaggcatgggcacaatggctggccgcctcctccaccttccatgggaggagcagaaaacatcgtctatgggctggggcgagagggggcaggggcaggggcaggggctggtgggcacatttagttaggcaattcctcatgtcactaaaatacataaataaagactgacta

SEQ ID NO: 28531 - DNA, 705 bp, Sorghum bicolor
  Clone ID: 7553604
aacgggagatgcttgcgaggcagatgcagaagcggctcacagcagaggaaagggagcacctgtacaccaaatggggcatttcactggactccaagaagaggaagctccaggttgctcgccggctctggaccaataccgaggacctggaacacgtcagggacagcgcctcccttgttgccaagctgatcggtctccaggagccagggcaagtcctcagggagatgttcgggctcagctttgcgccgcagcagcagccgccccctcgcagacgatcctccaatggctggagatatgggatcccttcgttcggctgatcggatgaacaaccacttacaacaatgacacggtgcaagcgactgaccaaagagatgtaactaccctcctttttttttaatcttggtgtggtgtactgatttctgtaggcttttaggaatatatccaccggggccatttgtttgtgcggctggcttcgtgcatgcttttctgcctagccgccgcccgttaggcctcaattctatttcctgactctttagggttgacgtgcgctgcaatggtgcaatagtaatctgatgttccatgtcatcagggggaaaaaaatcactgggacagtccctatggctaaccatggtcatctactgtgaagtgtgaactcatgatatgtatctgcatattgaattattgcataaatttagaagtaatagttgg

SEQ ID NO: 28532 - DNA, 218 bp, Sorghum bicolor
  Clone ID: 7553608
tgctcacggtccccgtgcccaaggctgaggtcaaaaagcccgaggtgaaaagcatccagatttccggttgaaaacccatgggggcggtgaaagctcccggcgtcggatttccggtttcagtttcagctacgcgacttgtgtgtgtgtgtgtgtgtcagtgcgtggttactttgagcttcagtatgttttgggagtgaataaataaaaaaaaattaccc

SEQ ID NO: 28533 - DNA, 165 bp, Sorghum bicolor
  Clone ID: 7553618
acagtggtccaggacccaaaatttggacaggtcattcaattccagggtgatcaaaggaaaaacgtttttaatttctttgtccaggccggcattgtgaaaaaggaacccatcaaaattcatggtttttgagcaaccccggggtccaaagcaagccctgcatgcaaa

SEQ ID NO: 28534 - DNA, 620 bp, Sorghum bicolor
  unsure (1)..(620): unsure at all n locations
  Clone ID: 7553621
catcgaccgctccaaccctgctgctgcaatccactccatgaaacaggtcgcccgtgcagtggtaaagaacaacctgtccctcatcctgttcccggagggcacacggtccaagaacggcaggctgctgcccttcaagaaggggttcgtgcacgccgcgctgcagacggggctgcccgtcgtccccatcgtggtcaccggcacgcacctggcctggaggaacaacagcgtgcgggtgcgcccggcgccgctcaccgtcaaggtcctgccgccgatcgggaccggcggctgggaggaggcgcgggtcgacgagcacgtggaggccgtgcggtcgctgtacgcctgcaacctccccgactcgcagaagccgctcgacgctctggccgcccggaagagcgactgatttgtcaccgccctgatgatgattcttgcaagcagtgttgaatgttgatgagtatatattctttctgcacacaaatatgttgatgagtatatattctttctgcacacaaattgtcctggggggacgcaaagcaaaagttttttgcacagcataggaaacttctgtgganaaatatgtaacatttcaagctgaaatcccatgtgtgttatttggtaaggtg

SEQ ID NO: 28535 - DNA, 189 bp, Sorghum bicolor
  Clone ID: 7553641
gtagttgatcaagggtagtaggggatgtgaccgagccctttgaacccaacaaaggagggaaaagccccggacaaagctttttgctttcctgggtccatgcaaatgcaggggtatagtcccgtaggaaatgatgaacaaaagtaaagattgtgtcttttttttacccctctttttttgttaaatcttttt

SEQ ID NO: 28536 - DNA, 543 bp, Sorghum bicolor
  Clone ID: 7553649
gaagcgcgcccgcgactacaactccgacgatgaagaggaagatgacgacgatcagcggcaggagcacccgccgaatccacgccgccgccgtgacgacggcgacgatgatgaggccctctcccactccgagccggaggaggacgaggacgaggacggggaggacgaagaggagggggcctccagctcggccgtcacgaggttcgagcaaggctgcagggcgttccgcgtcgccttcctcaagattatggccaagaaactccccgacaatcccctgggtccaatcatgtcagcacacaagacattggtggccgccaagttagccgaggaggtggagcagcacaagcccaagggggaggctcgaaaggagaagcgagtggcagcagagaagggccacgtcatacctaaagaccacttggacagcaaagagaaggagctcatcaaggttgcaaccaagggggttgtcaggcttttcaatgcggtgaacaaggcacagaaacctcggaaagatttgaatccatcaaggactaaagatgccaaagtttt

SEQ ID NO: 28537 - DNA, 541 bp, Sorghum bicolor
  Clone ID: 7553670
aacgccttacttgcatttgcaacatgaaatttttgtcccaagcaagttggagcaggctatgacacccaactttcatttctcggcctgaaattagttgcattctcttaattatgtgacattagtttcatttctgatatcttggcactagtagatagggttgtttataagaagttgaacttctcacagtctgtagtacatatgttttacatatgctcaactattcagatggtagtttccatgactcagtcttgaattacaactttggtcattacttttgattgcggtgttactatgaaagtgcttaatatttccattataaatctttgaaagctatatcaatagccgaaacttaaaaaaaaaaattggtaaaggtatgcccaagttttgtagtttctatagccagaaagtgtaccgtagtccccattataatggcagtttttatttccctttttttacaagaatctagtgtaacaagtgaggacgggtggtttgcttcatttgttgatgtcatcatctaatatactgcaactacaaattgtgc

SEQ ID NO: 28538 - DNA, 571 bp, Sorghum bicolor
  Clone ID: 7553716
cgcgctctccaaggtggcgcacatggaggcggacaacgcggcggcggcgcgcgccagcatcgagagagccggtcgcggcggcggcgacatggcgctgacggtctgggccgagcaccgtgcccccagcaggccgcagctgggccacctgctgaggctcggcgaggctgacagggaggcgatggtggtgtctggcggtggccgggaagtggcggcgccggcgaggaggaaggtgcagaagcagaagccgatcgtgccgctggttgttccgctaattaatggcgtcatcttctccaagaagaggaggatgaaggacaaggagagcgtgtacatgaaggagctttacagcttgcttaggttgagttgatgatcacggctgtcatgctaaatctgtggaagtgtacttgtgcacaatcatctgcactgaagttatctatctacccactaatttttatttgtttttatagtttgtgtgagtggatcgtggagtgtgaggatgtaatttgtaaaaattaatatgtaaatttagcattagtggttatttgtatattgaaatcaagaacttatatcgggc

SEQ ID NO: 28539 - DNA, 209 bp, Sorghum bicolor
  Clone ID: 7553724
ctgtttcatgggtgggatgtgttttttttaaagtttgaagttcattagcctattttcctgaaccaaattttttgaaattggtgatttccgatgtgtaaataggtgctaattatgtgccaaattttttcactaagtgtgacgggcttttctgctattttttcctttcaaaaatgctttggaatgaaagctttgtgtgtttaggttccccc

SEQ ID NO: 28540 - DNA, 438 bp, Sorghum bicolor
  Clone ID: 7553752
ccgcgcccgggctcgggctagcagatgctggcagtggcggcggcggcaaggagctgctgccggacccgagccacttcgagtggccgtcgggctgcgacctggggtcgtactggggcaccagcgtgttcgccgacaccgacccggcgctgttcctcaacctgccatgagccgcccgtgacaacgcccccatggttaaccaatccaccatcacgacccacgagatgagatgaacagagcacgcagagcgcgcgtctggctcttgaagctaggtactggagtttcctgagcttactgtagcgatctctactcgtctagtctgtctgacagtcttttacactagtgttttgctggtttaaaatcgccccgctttgtactccgtccaatctagtaaaggctaacatgggatagccgggctctgcatgaatctgtgcttgtttc

SEQ ID NO: 28541 - DNA, 519 bp, Sorghum bicolor
  Clone ID: 7553778
gtcgctgctgtccactggccactttgccccgcgacgacgagcaccaccagaacactaaggtattccctccccttggtcggttggtcctcccttcctgctgtgctaaatcgtgcgcccaaaccttaacgtcctttactgggtccgcccttgccggcgacgagcaccacaaggtacgcccgccgcttggtcttcccctcccttgtgcgaaacggtgcatccaaaccctaacttagtattcgtattcggatctaatctaggagtaattaagtgtatattcatgtattatgcctactaacttcgattgtttttccaaacttgtcggatgttctttactggatccgccactgctgagccccatagatttaggaaaattcttatttttagtagtagaaggcgttccttccttctatttttatggaaaaatcacggcttctttggctgtatcaaggagttactgctgcgcttttaagctagaattacatttgccagctcacttcattaaaattatccgtttttctc

SEQ ID NO: 28542 - DNA, 522 bp, Sorghum bicolor
  Clone ID: 7553781
gaaggaggaggaggtggcgcgcaagcagggcgagggcgcgccggcggcaaccacggaggtgaagatcaggatcacacggaagcagctggaggagctgctgcggcgcgtagagggcggcaagcacgccggcgccggcggcgcgcccgtccaggaggtcatctccgagctcctgtccgtagtcaacaccagctccagcttccggcacagggaggaggggcagtggcggccgtctttgcagaccatacccgagtccgagtgagatccaattcatggtgctcgtcgttgttagcatgttcggcgatgaccgtggtatttttacccagagttgagttttgtgcagttgaatagttgatggtcgtgctatttacgatacgcatggtggttgcctctgtgtagggtgtagtcttttctaggattgtgggattaagaacagaggacgcataggctatgtagggtgggagactagatgagcatctgttcttagtttaatttatactagtatatgttgtagataattgggag

SEQ ID NO: 28543 - DNA, 622 bp, Sorghum bicolor
  unsure (1)..(622): unsure at all n locations
  Clone ID: 7553790
tatctacgggagccactgggcctgtaagcccatggaacagaggcggtatcggtatcgggctgggctcgggctcgggctctaaaagaaaacccagaaatggcggctcgccgtcaacgtcatcacgtacaaagcgcaattcgtttcgttcttatcttcctcgtctcgttagttcgccgccgttcgccgtcgaaccgcagcgccgccgtcgagtcgagccggcgaggcgaagggaaggagagcgggggggaagaggagaggacgccatggcgaccgcttcaggtgagtagagcatcacgtaaccctaaccctaagtttccgtgggttcgattctcccaaaaccgcgtgaaccgatccgttgccctgggtggttatcttatctccctatccgtgttgtttatcctcgattcgatgtggattagggtttgttcgggggcggtgtacctggtgttctgcctaatttggggatcggcgcttctgtgggtgcttgtgccccgcgaatttttggggatttttactgcggtgttttgaattagcgacttatgtcttgtgtcgtttgtggcagtgactttcaagtcacgggaggatcaccggaagcagctcgaatccgagggggggncccggt

SEQ ID NO: 28544 - DNA, 220 bp, Sorghum bicolor
  Clone ID: 7553813
acagtatcaaggccacgcccggggttcaaaattgcttgcactggggccttcctggggtacccgaaacatggaatgagatccttgcagcccagctaaagcctgtagttgaatgcgcaattagctacatcaaacaagttagggggaaagtttttatatacagtaactaccccggagtacactttgttaggcttcccggcaaaggttttatgctgttgatagg

SEQ ID NO: 28545 - DNA, 594 bp, Sorghum bicolor
  Clone ID: 7553908
agccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcgctccgctcacctcagcttggttccgatggggttcctgaaaagcactttctcgttgttgatcggcaccggctgcggcatctacattgcccagaactatgaagtcccaaacataaagaagctcatgtggactgtgatgggcaaggccaaggagttcgaagaatcgtacaagaagaagggcaacggcaagaacaaggataacgaatagcattgacctgcagtccgcgctccaccatctttatgtgtagaaaaccaccggtttagtaggaagctaatagttggaacagcattcggattgtttgaggtatactgcaactgtggcgtactctttgcctcggattgaatctgtctagatggcaatacaatttttgaggtgaaagct

SEQ ID NO: 28546 - DNA, 581 bp, Sorghum bicolor
  Clone ID: 7553912
cctccactgggcatgccttaatggacatatagaggtaatcaaggctttgatatcagcgggggctagcgtgagtgctctgaacagccatgagaaaacgcctatggacgaagcggtgtcaaaagggaagatggatgtgatcgatgcaatcggtgcagcagtagctcaagccgagctcgatggcgttactgtctcctaaaaggacctgatgagtacctggagttatgaatgacttgcagccttgttcttatctcccagaggttctgtctatgtcactcgtgatcctgaatttttgatgggccagtatctggggaacatggtagattagcctttgccgttgcatgagttgaaagtttattgtctatagtgtcggcaatcacctgttagcgtcaatggcatgagaccgtggaaggctgatctgtcgttataaaccagatgtgaagttgtcaaagataaggatttctcctaaaatgttgtaggaacgttgcttgttctcgtagacaaccttcgttttcctttgtgttccttgactccaagtagcgctgaaatggtatgcgcacctctcccctctttttttcaaatcc

SEQ ID NO: 28547 - DNA, 637 bp, Sorghum bicolor
  Clone ID: 7554034
tccactacaactgaaggccctgccacccaatcagataaagcggcagatcgcatacggattattggagcacatcttggagctctccctcagccttgtgccaataaagctcctgaaattacaggtagctccaaccgaagtcggcctcccattacaacccatgtgctggacactgcccgtggatcacctgcatctggaattgaagttcacttggagatgtggaaggattcttcagctcctccatcattcagcaacaaagatttcagcggatgggcaactttaggctattcagttacaaacaatgatggacgcagtggccagctgatggacatcgtggacaacattgctccaggcttctaccgcataagcttcaacactagcaagtattcgcctgcagggttcttcccttatgtcagcatcatatttgagatcaaggagaaccagacggcagagcattttcatgttcctctcttgcattcccctttctcattcaccacttaccgtggaagctaagttgttaatttacgtgtaattacctctgttgggatgttcaaaacaactatgtaaacttgacacttcccattgtgataaataagctggttcccatgtaagcttttaataagaagtattgttgttacct

SEQ ID NO: 28548 - DNA, 571 bp, Sorghum bicolor
  Clone ID: 7554048
atgccacagttgcaaaaaatgtgaagaacaaggttttttccattgattttgtttcagatgatccttcagtgattgcgtgtgatatggctcatactccattggagccattttttatagatgttgcaatattttgtctctctttgatgggaatcaactatccaagttacttagaggaagcaaatagggttttcaagccaagtggttggcttgttattgctgaagtgcgaagtaggctagacccgaacaacggaggtgctgatcctgaaaagttttttaaagccattatcgagcttggcttttcacttgtttcaaaggatgtgaaaaataaaatgttcattttattttacttcaggaaaaaggaaaaaagtaagctggcaaaaagcatcgattggccccagctgaaaccgtgcttgtacaaacggcgatgagccgattgttttgtatccactagtaatactgtagttgtagtagcgctcgttaaaagttttgtcaaactgaagtatcgttttgattaggttcctccgtacctgtatggctgtatctgtatcccagtttattccattatttttgc

SEQ ID NO: 28549 - DNA, 393 bp, Sorghum bicolor
  Clone ID: 7554056
ttgatgtgattttgaagacattgccaggaactaaaggaaggaagccagataacccgtgccgagttttatagcaacccatatagaaaaaatgggcagccaattcatgattaaagctttgaaaaaaaaacagcttgattatttgtcagtcataaaactgatgatgctagtgctcgtttaatcaacttgattcaaagaaaaatcagctttgggttatttgaatcatggaagctttttccctctacttttttatttacattttttgtggcactacttccatttgcatcacttaggattagggacctacacctaaggacttgggaaaatcgtttgaaaaaaaaaatttgactatttttttcccttattgattattttttgttacaaaaaaaactatgt

SEQ ID NO: 28550 - DNA, 492 bp, Sorghum bicolor
  Clone ID: 7554061
aggccatactctttggcatgttcacaaaaagcagcaaatttgttatcatcacacaccgcaaatagtacccttggacagagtccttgtgaaggatcttttgtttatgtgggtgatctggcatcatcagcacgttttgttaggttgtcccactaccgaccacgatgggcacttctacttttcattgcagacatcccatatatcttggaaaatggtttaagtagcttgcttcatgcatctgcggcattggctgtaatcaattgcctaccggtgtattttctggatggtgaagcgattttggagactaccttaagctatgtagcttggtttaccccaagactgcaacgcagaattctgaaagtatgccgctttgtgtggacggttttatcagttattacgttctcaagcatttgttattccacagtgctacatggtgttgtataacaaattacccatggaattttgttttgaacaaagagagaagatcttttgcgc

SEQ ID NO: 28551 - DNA, 672 bp, Sorghum bicolor
  Clone ID: 7554068
attaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccgtagggtagaatcagcgaaaacgacggtgcacctgattagcccttgtttagtgtgtgcgtgtatatatacgaatcatattaatacatgtaattagaatcattgtgtactactttatctttgtgtgaagatgcatgatacctgtt

SEQ ID NO: 28552 - DNA, 565 bp, Sorghum bicolor
  Clone ID: 7554071
caaagaaagaaatatattaagcagtttatgggttgaagagaaccggtttaaacaaagagtctgggtacaaggagcccgtccagaggaagaagaaatatttcaattcacaatggtccagagagttggaggctcatgggatggttactggctgacagagagcttaataaatgatggagacgcattctcaggtggtatcgcttactgatgtagtgaattggtgtaaatcagatgcgttcatgtgaatattggtccaatataaacttatagcaatgtagtaattgtaaaaacggttggctcaggaataggttttatctccgtccttgaagatgtcatacactcatactagcagtggcacactagcaagtggcgtgaatgaaaagttgacacatatgttggtgtgtgaaatttggccgcctttgtgcagaaatttggcggtgccggacacgctagtatattgtacagaaagagccctttcatagtgcccacaaatggtcaaacatgcatgtctgtgaagtacctttgtgttgtgtgcttgctgcttacagtaaacccccagattttactc

SEQ ID NO: 28553 - DNA, 528 bp, Sorghum bicolor
  Clone ID: 7554088
tgacctccattagcagtttaagtcagcacctgcaacagacaaatttcaagacaccagcagcacactaccaaaaccccccaacagcaaaaccccaccccattaaacccccaaatttactttcatgaacaacaacagcaacaagaacagcaatccagccggcaacgttggcgaaacggtaggaggaggttttaacttcctcaccagtaccgttggcaacactgtcggtggcttgggtcgcacagttgggggagtcaccggagcggcgacttgtggtttaggagacacagttacctccgcgaccggcgacgctggccgccccatcggggacggaatcggcaatttgggaactggcgttcagggcggactcgacagtatttccaagggtgtagagaatgttggacagtggaagaagcagtaaagagcccaacaatatcatgataactttgggagttgaggaagaatgtaattatgtgggactatcacgacggagtgtaggatacgatttgagttaatatgaacccaactttt

SEQ ID NO: 28554 - DNA, 153 bp, Sorghum bicolor
  Clone ID: 7554109
gtttttatcagtttaatatttgatatgtgggccatgtgcccacttcgatattaaatttattttttgtgggggaggggtcactacagtggcttgccactgggccccttgcgcgtcgcccagccgttgcactgctggcagggcccggcgcacccc

SEQ ID NO: 28555 - DNA, 216 bp, Sorghum bicolor
  Clone ID: 7554112
aaagtacgagtgaaaggaggtccccgccaataaggtggacttccccaaaaaaaacgagttccctgtcgtcataaaaaacccgctacgccccccccttgtccctaggaggtttcccttgaactaaaactattttactgttctattgaagggtttcttgtattgtgaagaaactgttttactgttctattgaagggtttcttgttatgtgaggtaaat

SEQ ID NO: 28556 - DNA, 363 bp, Sorghum bicolor
  Clone ID: 7554114
tgccgcatcccttttcacgttcctttggtgcaaccgggggccctccccaaacctattccatttgcccttggtgactacagctgtaatttgttgttggataatgtaagcaatcgtttcccttgctcagatgaagccattgatcaaccccatcctgagcggagagtgagctttgttttttcattaaacagaatgaaagctagccctgctgtaccattattcagtttgtgaactttttattcattttggggcccctgatgaaataaataaactgccatgagtttttttggtactttgcactccagacattgaggaggctcgctgtgattagggtaagcaattgtatgatatacgcaataataaaaa

SEQ ID NO: 28557 - DNA, 554 bp, Sorghum bicolor
  Clone ID: 7554120
gttggcatgccgcatgcggcagcgtcttcccatggctgtgaaatgttttgccaccactaccttttcacgtaaatcttcgttgctcttgcgcagattcatctcctgtttgatgttgatgcagcaaataaaacaaagcacaagtcaggaaccactcccaactgtgcattctgatgtttttgtgtcgctgtaggacaagaagctggcaagaactgacttaccttctccttcagcttattgacctgctcctccagcagcagagtctgccatgtaaagatcaaatgtaaagctgtaagctgctcatgctcatatgctcttttcaagtttgacttccaaactgtgcagttcttcaatggagcattcttccaacctctcacccaaaagtttcctgcatctcaacgaaaattagttcgtgggttgctacatagggatatcagtatttgatagcatcggtatttgatagctaaataattaccttttgtaagcatcaagtgcttcaagtttctttgccaggccttccgcatcagcttttacttgctgcaatataagcccggacc

SEQ ID NO: 28558 - DNA, 584 bp, Sorghum bicolor
  Clone ID: 7554124
gccgcaccacacgcaccatcaggttcacccctggcagcgcctactacgccgatttcatcccctacgtcaggtccttggctgccgtctctgccaacggcaaaagggctcatgctgagcgttcggctgctgctacaaataatgggggtggtgacttccaggctgaggcttagtagactaacagctaaatctgtacaaagctggagtaggttgtttgttacagatgaaaggaataattgaaggatccagagttgtgcagcctacctaaggggggaagggaaagcaaagaagcagcattctttgaagcgtagtttagcctgataagcagcagttgttttgcagtgcctcactcactctagctgtgtgggacaagcacgcgcactgtcccaagtcgtcttcttgtacaaatgtaggtttcagtccaagctagcttaacatgggtggaacctaaacgtgtccatatatctggttttttggaagggaaccttttgctgtgaaaatgcttttcttgtgccttttgctggatgtctgctcgagctaatcatttgaaacgtaatgtaaccgtgttgtgctgtgtctgaatgggt

SEQ ID NO: 28559 - DNA, 573 bp, Sorghum bicolor
  Clone ID: 7554127
tactatcccgcatacgttgccgagaagaagaagtgcagattcaatccgagaaaacatgtggtgaagattgacggcaagagaatgatgagagacaccaccgaggcgaagctgaagtgccgcgtgtacaagcagccggtggccatcctcattgaagccaaccacgccttcagccggtacagtaagggtgtcttcacgggcccttgtgggacgcgtctaaaccacgtggtcgtggtcgtgggctatggaactacaacaaacggtatcgactactggatcgttaagaactcgtggggcaagggttggggcgaaaatggctacatccggatgaagcgtaatgtgcgtagcaaagcgggtctttgcggcatgtacatgaggcccatgtaccccatcaagaataagtaattgaccggccttgcctgatgcccgtcaccgcctcatgtggctgctagctcctgggacctacctactacccaaatgtttaactacatgcatgatgatgtgtagatgtacacgcaacctcatttacgccatatatataataaaataaaaatctactttcttttttttattttt

SEQ ID NO: 28560 - DNA, 551 bp, Sorghum bicolor
  Clone ID: 7554175
cgcgtacggtccccggggctccgtgtaccgcgaccacgacgtgaactcgtacctccggtccgtgcgcggcgtggtccgcaaggaggcccggcgcgcgcgggaggaggccgagcgggagcagcgcgggcggtggcgcctgctcctgtggtggccgttcggcgtccacggcgtgtcgtcgtcgtcgtcgtcgggctcgggctcctcggggcggcgcgggggcgggggcgggggcctcgtggacgccgttagcgaggcggccaggcgcgcgcacctgctggtggtggtgctgctgcccgcggagctgctcgctctcggcgcgctcctggccgtgattagattcaggtgagtgatagataggctcacgtcggttcggttcgacacgtccgtccgtccgttgtgttcgttcgtacgccgccgacacacacgattcttttgtaccaaaaatacacacacacacacacacgtttgcaaagcaaaggcgccaagcgcagctgcgtcgcatgtaagagtaagatgaacaaggaaaaatagaaacgcgaatctttcgttcc

SEQ ID NO: 28561 - DNA, 146 bp, Sorghum bicolor
  Clone ID: 7554176
ccctggcgagtcccgtttccctgttcaggtgagggttgcaacgcgcaagatttgtgatccgttggaggaggacgctttccgccccatcctcccccattaggagggccccaaattcaggttggagctcagtgtccctgaggcgctct

SEQ ID NO: 28562 - DNA, 341 bp, Sorghum bicolor
  Clone ID: 7554221
cgggaagatgaacaccaccgatatctatgagttcatgtctgcgagagacgctgttgggcatggcacgcacacagcctccacaggtgctggtgctctggtagccgatgcaaacttcaagggccttgccagcggtgttgcaaggggaggagcacccagagcaaggatcgcggtttacaaagtgtgctgggccaccggagattgcacttctgcacatatccttgcagcttttgacgatgccatacatgacggcgtcgatgtgctttcggtgtccctaggtcaagcaccgccactccctgcgtatgttgatgatgtactgtccattggatccttccatgctgttg

SEQ ID NO: 28563 - DNA, 546 bp, Sorghum bicolor
  Clone ID: 7554274
gcaacgagggcgtcgcgctactccctcaccgacccaccgggcaccggcaccggcaccggcaccgcgccacggccgcgttcgtctcgacaggagccgatggccaccatcgcgccacggtcgcatctcctcctcctcggcctgacaaggccgcagcagccgacagcgcttcgtgcctgcgccgccttctcccgctcgcgcggcgcgccagtcccaccgcgggccgcgcagccgcggcgcgtcttcctcggcctcggcgccaccttcatcgaccaggtcacccgcatggcctccggcggcacctcgtcccgctctttcgttgccggagcgcggccgaggcagggggtttccccagtcgagcagattctgaagaatgtggagtggcccgacgagttccctttcaagcctgaggacttcagccgtttcgacgaatcatcagatactctgttctactcagttccacgttttgtcactcacattgatgaccaagcaatccgagctctcacagagtactactctgaagttcttcctccaattaatactcctggg

SEQ ID NO: 28564 - DNA, 553 bp, Sorghum bicolor
  Clone ID: 7554302
agcacgagggctcgtcgtgatggccaccggcggcggcgccagcgagacggccgtcggcgccggggaggagaacgcgagcgcttccaggatccccacccgcaggtttttcgtggcgctgcacgtgggcgccggcttccacgcgccggcgaacgagaaggcgtaccgcagggccatgaagcgcgcctgcctcgcagctgcggccattcttcgcgagggcagtggcacaagcctggatgctgttgcagctggcattcaagttttggaggatgatcctgtcacaaatgctggtcggggttcaaatttgactgagagtggtcatgtggaatgtgatgcaagcatcatggatggaagtactggttcttttggagctgttggagctattcgagatcagatgtaaagaatccaatcaaagtcgctttgcacttggcgaaggaacaaatggcaggatcgtcattgcttggtcggataccccccatgtttctggttggtgaaggagcatatcaatgggcaaaatctaaaggaatggacctagttgaatctgcaccaggggcta

SEQ ID NO: 28565 - DNA, 486 bp, Sorghum bicolor
  Clone ID: 7554305
gcgggagcagttccgtaagggcgcgcagtggttcgagctggaccgggaactcgccgtcgacgtggtcgccgacgagcggtactaccccaagttccgggagcactgccgcccgccgtgctacgtgaacgagcactacctgccgtcggcgctctccatcgaggcgcccgcgcggatcgccaaccgcagcgtcacgtgggtcgactggtcccgcggcggcgcgcacccggccacgttcgccgggaaagacgtcgacgaggcgttcctgaaacggctcacggcggcgcccgcgaagcagaactgtacctacaatggccagccgtcggaggtgtgcttcctgttcgctaggaagttcgcgcccagcacgctgcggccgctgctcaggctcgcgcccaagctgctaggatatggctgactgtcactgtcactgtcactgctctgctctgaatctgaatctgaattttctcacagggaaccatactctgcttt

SEQ ID NO: 28566 - DNA, 613 bp, Sorghum bicolor
  Clone ID: 7554367
cactttcgatgttatcaccaatgtggttagtgtagattacctgacaaaaccaatagatgtttttaaggagatgcgacgaatactcaagccaagcggccttgctataatgagcttttcaaatcggtgcttttggacaaaagctatatctatatggacatcaactggtgatgtcgatcatgcctggatagttggcgcttacttccattatgctggaggttttgaacctcctcaggcagttgatatatctcctaatccaggacgaactgacccaatgtatgctgtatgctcaagaaagaaaatagggtaaattaaatagtgtattttgcaagtgctatcaagaaacaaataaaggggaaaacaagaagaagcaagttgcttggcccagatcgcctggacttgatgattggtgagctgaggcaggcagcgcacgtgcatgtttccgtgagcaatgcaaccataggaaaaggaagcaacactgctgcacagactatttatagaggcggtcagattcatgtttttttttttggataaacagattcatgtaggttgtagcgaccgtctttactaaagctctctagaattgatatttttttaaaaaaaataatagtatttt

SEQ ID NO: 28567 - DNA, 132 bp, Sorghum bicolor
  Clone ID: 7554368
acccgttctgtttggaaacagttccttttttgtaaggttttgggggctgaaaagcccgtgaattccctgaaacttgttacttacggggttaaagttttgggttcacccggtgttggggaagcttttactttt

SEQ ID NO: 28568 - DNA, 363 bp, Sorghum bicolor
  Clone ID: 7554373
ccagtacggtggtcatggaagtcgaaatccgctaaggagtgtgtaacaactcacctgccaaatcaactagccccgaaaatgtatggcgcttaagcgcgcgacccacacccggccatttgggcgaacgccatgccctccaatgcaaggctttcctgggcaacagcagtagttgactgcttagcgatgttcagtcagcaaaaggttcacgcttgccttgtgttgccttatgtttttcaactcaaaactttgtatgttgtcataggcttacatggttctccgggactgtactcagatgccagcttgttggattttttgtatccactttaagccaaggtttgtttaaaaatagcaagtttttcgtgt

SEQ ID NO: 28569 - DNA, 548 bp, Sorghum bicolor
  unsure (1)..(548): unsure at all n locations
  Clone ID: 7554381
gcacgaggggtttccttttctaatgactagagcctgctgtgaagcttgtggtaatttgaaagcagctttcttagttgcagtcgtatttcttttgttctgtatgtctgttacgctgtacttcgctgaagagatcccactagagccaaaagatgcacaaggactgtcagattctgctcctctactgaacggttctagagaggatgcacatgcattgaatgaaccaaataatgaaagatttcctaatggccatgtagatggaaacaacgtgtcggctaacaacaacactgaggaatttccaaatgcgaattccaacacagacaatggaggagtcttcaatgatggacctggagcagttttggttaacattttgaccagcatgaggcatctacctcctgngatgcattcagtgcttgtagttatggccctaacatggttgtcatggtttcccttttttctttttgacactgactggatggggcgtgaagtttaccatggggatccaaatggagatctgagtgagaagaaagcttatgacaatggtgtccgag

SEQ ID NO: 28570 - DNA, 509 bp, Sorghum bicolor
  Clone ID: 7554431
gcacgaggcgcggcgatcgaccctgctgcaaccaaagctgcggcgatcaggtgcagagcagccagcggcgtccacggcggatcgctgcggcgaacgaagtgaagggcgaaccaagaacactaggcaaggccaggcaggcaggcagaggcactagccgaggccggcaagtggttggcgcaagttgccaggggcgtcgccggagtcgtgcggcgggcagcggcacggaaccgaggcgatggggggctacgagctcgtccgcagcgacgacgcgcctgctgccgccatcgccgtggatctggaggccggcggcaccaccgcgccatgcggcgacgactaccccaagcgccgccgcgggtcgtccacgccctctcctccggcgccggcgtcgactcggccgcagcgcctcgtctcgctcgacgtgttccgtgggatcaccgtgctgctgatgatcatcgtggatgacgccggggcattcattccggcgatgaaccactccccctgggatggcg

SEQ ID NO: 28571 - DNA, 577 bp, Sorghum bicolor
  Clone ID: 7554437
gcacgagggctcgctgaggacaataagtacccatcacccaagagatgagcggtgtgttagtgtggagatgacgtcttattgtgtagatgctcgttgatgagacgagcgccgcttgagctgcccatctttgcaacgctctgcattgtgaagttcaatatcaggctggctaacttcaattgatttgggttggctaacttaagtggagacgcttgtcttatggagaagaacattagacagattttttgcttgagggtgataaatttcatcgagaagaacattgggaggcactgatttttgctactgggagaaacttagaattatttttatggggccctaagggatgagaatccattactctaggatatgtatgtcattgtgatgaaacaatctgagtacatagatatgccaagacagttccattcaagtactgtactgttggtctctggatacatacaactatggaggctggccatcgtgctgcagatcaaccaaattcaacatagataaggtgcaagcttctcaaactttttcagaatgagatgtatgggtttctattagatgctcttctactttgttg

SEQ ID NO: 28572 - DNA, 549 bp, Sorghum bicolor
  Clone ID: 7554458
gcacgaggcaattgtagcctttactgttcttcacaatgtcaattgttgccgtggtcttatctatgttacatctcagggttttctgaagatatgtcagttgccatctgcatataactatgacaactactggcctgttcaaaaggtccccttgcatggtactccacatcaggtcacatattatgcagagcagtcactttatccacttattgtgtccgttcctcaggttcgtcccttaaatcaagtcctttcttctatggctgatcaagaactgggtctgcacatagagaacgatgttacaagtggtgatgacctccaaaaggtctatactgttgatgaatttgaagttcgcattatggaattgggaaaacccagtgggcattgggagacaaggttcaccattccaatgcaatcatttgaaaacgctttaacagtgcgcatcgttaccttgcaaaacacatctactaaggaaaatgaaaccctgatggccattggaactgcttatgttcaaggggaggatgttgctgctagaagacgagtgcttctgtactc

SEQ ID NO: 28573 - DNA, 590 bp, Sorghum bicolor
  unsure (1)..(590): unsure at all n locations
  Clone ID: 7554462
gcacgaggcctcccttcccttccttcccctcctctctctctctctctctctgtcaccccctccctgcccaaatttagccgttgtagcttccgccctctctctctctctacagactctaggaacacgaaacgtgaagaggcagagggggaggagacggttaacctttcccgaatcgaccccgttcttgggtgcgaagcgatctttctcccacccgagcgcgaggagcttcactttgatcctcgcatcgcatcttcttccactgttgcgcttgcgtttggggggcagtcaagatgaggctcctggcctgctgctacaatgatccggagatgcagatcgatccggacaccgtctaccctatccgccccgactgccgcgacgacgcccccaagacgcgcttcaagccccggcctggcctgaccctcagtccaaggagatggaagcttctccacaatgaggaaggtgttttggacatagctggaatgatcaaaagagtgcaacatgnggggagtccacccaacaatcaaaggagaggtttgggaatttttgctgggctgctatgaccctaaaagcactactgaacagcgcagcca

SEQ ID NO: 28574 - DNA, 668 bp, Sorghum bicolor
  Clone ID: 7554495
ttgatccaaagctgcatgaacatttagaaaatcttgatggaggggaatacttatttgccttccgaatgctgatggttcttttccgtagggaattctcatttgttgatacgatgtacctttgggagctcatgtggtctatggagtacaatccaaatctcttttcaatgttggagagtggtactggcacatcaagcgcaaacacaaaggatgaaagtgttctaggacagtgtggaaagtttgagcggaagatattgcaagcagctaagaaagatgaccagatccctctatctgtctttgttgttgctagtgttatagaggctagaaacaagcagttactgggtgaggcaaaaggtctagacgatgttgtcaagattttaaatgaaatcactggtagtctggatgcaaaaaaggcatgcagaggagcattgcagattcatgagaagtaccttaacacggtaaaagcatcataaggacatgtacagcttcacttggatgggctatttattattattttttggtttagggaaggcgttgtacaaaagaacttttttcattctttgtgtattgtgtaattctttaacacttgtaaattgcatttacacaaaaaaaaaggataaggatttcattcaaaaataaaaaagaaggaagaaaagaagtgttgattttgt

SEQ ID NO: 28575 - DNA, 158 bp, Sorghum bicolor
  Clone ID: 7554506
atttttgttgccccaagggttccaaaattataggtccaaatgttaaaggtttgcttcagttgcaagggtatttgtttcaccaaaccgggaatcagctttccctagttggtgggaattttttcccagcttgttaaagtttgtttgggagttgtaaccaa

SEQ ID NO: 28576 - DNA, 143 bp, Sorghum bicolor
  Clone ID: 7554526
tatttgggtcagggccagggttttttttgaagcccctaggatttgagcttttgggttgttgcattttatcctgggtaagttgcccagctggagtaattttttttgaaagaaaaggtaatgtttccttgtatgttaacaagatt

SEQ ID NO: 28577 - DNA, 223 bp, Sorghum bicolor
  Clone ID: 7554546
gcacgaggcgagttttttttttttttttttttcgagaaattttggaaagtttttggttttttagtgtgaactaagcaaggcccaggtgcataatcaatccgtcgaacaaaatcattgctattcccggcccacagccccggcccatcacgccacgccatgattaaacccggcccagtctctcatcaagccatcattgctctccccagcaaagtttttcttcatt

SEQ ID NO: 28578 - DNA, 453 bp, Sorghum bicolor
  Clone ID: 7554549
gcacgaggcagacataaatctcccggattccgactcctcttccccagcccatcataggccctcgccgtgaattccaacctgcttcccactagaccatccatccatccatccatctgcgcgtagtagtacaagctagcacaccacaccaccaccaccaccacttccgccgccccggttcatggcttccatcgttctgctgctgtcggagctgctgggcggggagagcgcgagcgtgctggcggccgagcgctacatgggcggccaccggagcctgggggagttccggccggccgtcacggaggcgccggccaggcatggccaacggctggtggacgaccagcacgcggccgccgccgggacagagcgggcgcggcggatgccggaggacaagaagaggaaggaggagtcgttcgaggacctcgccatgcctaggatcgcagtcgacatcatgtg

SEQ ID NO: 28579 - DNA, 533 bp, Sorghum bicolor
  unsure (1)..(533): unsure at all n locations
  Clone ID: 7554552
gcacgagggatgaatctgcaagaatgatagggctaatgagggagaggggtgttaacaagactccagggtgcagctgggttgaggttcatggtaaagtccttgaattctatgcaagcactgaaccacagcatggtgcagaagatatgtatcaactcatgggcatactggtaaatgagatgagactagagggatatgttccaaacctcgatctggtgtagcacacaaataaagcatatttcctcttcttgaaacgaaaggaaggacctctgtaattcacaggaggagaaaatcgcgaaatgaaataaacagaggaacaaaaacagcagcagccaacagtatgatgggataccatgctagagctcaatagctgatactttctgcctgatttcaacttcttccttaatgcagtcaaccatttgcagaataccaagcaaatcattattgagagttatgtaccttctcacttgttcaatgaagtgtcgaatgtaatctctcatttagctcttgggacctttntatggtctacttcccac

SEQ ID NO: 28580 - DNA, 557 bp, Sorghum bicolor
  Clone ID: 7554590
gcacgagggaatggatggccgcggacataccgcgcacttgcgcgacacggccctattcaatctcggacgcggctggtggcgccgaccagccatttttaaaccggcgccgggagggagagctttccagggcgcaacgagctggggcgcggtcagaattggaattccttagccgagacccgacccgatcgccttttactttgtttgttttgggcgtcagtggccaggtgggacccgaggagctcggtggtgaccccggacgaggaggtgttctacctggtggcgttcctgcggtcggcgctgccgggcgcgccggagagcctggaggcgctggtgcggcagaaccagcggatcctcgacttctgcgcggaggccggcatcagcgccaagcagtacctgcccaaccacaaggcgcagcacgagtgggcggagcacttcggcgccgccaggtgggagcggttccaaaggctcaaggccgagttcgaccccagggccatcctggccaccgggcagggcatcttccggccgcccggctcgacgccgctcgtggccgactcgta

SEQ ID NO: 28581 - DNA, 439 bp, Sorghum bicolor
  unsure (1)..(439): unsure at all n locations
  Clone ID: 7554595
gcacgaggccagaccaccatggcgtcctgattgacacccttcctgccctgcatggtgtagagcgacgcggcggcgttggcggatgcgccgttgcccgcgatgcggcccgagggagcgtcggcgtggcggtcctcggcggacccctcgccgcgggggcggatctcgcgcacggcccacccgtactgcgcgggcgccggggtcacagtggccacgctgacgttgagagccccgaggaggcaatcgaggagctcgacgcagcatccgccggcgccggcgccggaggcctccgtggacggcggcggcccggcctcagcgaagcgcgcggcgacggcgaccgccagtagcttctgctgcaggggactgttctgctgtgctgcctgccccgcgccgccgcagcccgagcgccggcggccaccgacgccgnctgccgccccggccc

SEQ ID NO: 28582 - DNA, 532 bp, Sorghum bicolor
  Clone ID: 7554630
tttttttggatgatcatgccattctttctttacacgagattttatttcaggagacatctgctggtgtgcagcgcagacgcgctcggggcggatcagttgcacgatctcacaccaatacacaacggtcacgagctcacgagacaagaagcacgcacacgagtgacacgacacgcatcatcatcactggaccttgacctcggtgacgttccgcctgcgctccccggtgcgcggcacggtgacgtacagcacgccgtccttgacctcggcggtgatcccgtcggcgcgcgcgtcgtcgggtagcagcaggctggcgtggtacccggtggccgccgaccaccactcgccgcccacctcctccccgtgctcccgcttctcctgacatgcgtgcgagtcgacgggttctgaaacctgggatgcgcaaggaagctgacgagcgggaggccttcacgggctgcaccgctggccgaccctgatcttctgtgaagggttcgagttggagcacgcctgtcgggacccgaaagatggtgaacta

SEQ ID NO: 28583 - DNA, 425 bp, Sorghum bicolor
  Clone ID: 7554651
tattttttgataaacccctacagaaatagataaaccccaaaactcgtggaattttgtcagataaacccctaattttagatgtttgtttcatattgatcctttttcatgtttatttgattattaattttagtacttaaggcccgtcaacaaactcccccaagcttaccctttgttggtccctgagcaaacagttaaactcagacggatcaggagttgcttcgatgttttttttcctgacaggcccccatgcttttacataaaaatccttccagattaaagtgaagtgttatgaagtttagtacctgcacttaaattttaagtaatcgaaagacaaaatagttaagtcaagcactatccctcctgtttatacttcccctttgttccagagtttttcataagtttccaaaataaaattcagagttccc

SEQ ID NO: 28584 - DNA, 166 bp, Sorghum bicolor
  Clone ID: 7554667
cctgccgccccggcccgcctccccgccgcgacggtcaccatcgccaaggaactcgcagcagtggctccttgcaatctgctcctgcgaggtactcctccttggagacggatgatcaggtcatggccgcggctcggatcttgggaaagggggtggtgatgggtcagag

SEQ ID NO: 28585 - DNA, 289 bp, Sorghum bicolor
  Clone ID: 7554669
acactggagagatgtgacccctgcagctactgagaggacggctccaagatccacttcagtttttctcagatttgtcttccctctgaacaaaagcttttggtggaagcaatacatgatttgaggagcccttgagctatatcctctctctacttgggtactgaacatgcggtggcaatgcctatgtcatatgtgacaagcttttggaaagggttttaagtcatagatttatttttattttttttttgcaaaacttaaagtcatagttttttagtgttcaagtttttagtga

SEQ ID NO: 28586 - DNA, 119 bp, Sorghum bicolor
  Clone ID: 7554807
tgggaggcagcatgccctggaccccctgaccactgtgaaggcgcgcttcaacaagtacggcatggcaagcgcagtgatccaacatgagtgaaggcccaagtcattggtcaccatctccg

SEQ ID NO: 28587 - DNA, 314 bp, Sorghum bicolor
  Clone ID: 7554993
tctgctgttgtagttagcttattcatataaatattctacaagctgttgtagcaataatacttgtttctttcccgcgtataaaccgagacggtaggttgctgcaagcctgcaagattaatcgatggggcattgcattggtactgtagactgtagagctagcattcagccatcttgacagttggttgtagaatgggtttacaacctgtttttttaggcctttgcttttcaaaagctgggcttccgtgggctgcttgtaaaagccagtttttgaaagttttaaaaagttggtttttgaacaaatgaaatgcacaagt

SEQ ID NO: 28588 - DNA, 539 bp, Sorghum bicolor
  Clone ID: 7658510
gcacgaggcttgacttctagtcaatttcactcgttacagcacatctaccaactacacaactttcgagttaccttaatttaatcccaaccccaaaccaaccgacaaaatgaagttcgctactgctctcgctttcgctgctggcgtcgctgcccacgccaagaacgtcacctacaccaccgaggtcgtcactgcctacaccacctactgccccggtcccactgagatcgtccacggtgacaagacctacactgtcaccaaggccaccaccctcaccatcactgactgcccttgcaccgtcaccaagcccgtcatcaccacctccgctgtcgtctgccacgactgccctgctcctcccccacaccacggcaacaactccaccattgtccccgtttaccctaccggtaagcccggcaagcctggctctcctgctggccccggtgctacccccaccgctggtgctccttccgaggtccccaccgccggtgccggcaaggtcgccgctctctccggtgccggtctcgctgccgtcgtcggtcttg

SEQ ID NO: 28589 - DNA, 516 bp, Sorghum bicolor
  Clone ID: 7658515
gcacgaggggaatattacggttcggttctttttgtgtgttgttgtttattaacatttttctggatttttaagtgtaaacaaaaagtcattacccaaaatgcacaacatttacagtaaatttctgacaaagaatacgaaaatgaatgcgtcgccaccgaaaagtgcagaagatttactcggagaatcatggattgagctcggaaacaattcttcaggcccgagaacgccggaacgtgtcacaccgttaccatttcaatcaggcgaagagtatttaaggctattacgtgaagctcaacgggaatccaatcaatcaagtcgtgtcgtatcattggccagttcacgcagagacactccacacgacagtccgaaatcaccgccgaatagtccaaatacggaattgtgcaatgaagacgaactgaagggcgtttacatcaattactggaataaggatggtgaattagtcaatcccaaagagactggtgactggatttgggaatggagtagtcgaccggatca

SEQ ID NO: 28590 - DNA, 552 bp, Sorghum bicolor
  Clone ID: 7658516
gcacgagggatcatctgaaataccgccaaaatgggtcgtcaattctttgtcggaggcaactttaagatgaatggtactatcaagtccattaaagacatcatctcaaacctcaacgaagccaagctggaccccaacactgaggttgtcatcgccccgccctcgctctacctcctccttgctcgtgagcacctccgcaagggcctcgaagtcgctgcccagaacgtattcgacaagcccaatggcgctttcaccggcgagatttccgtggaacagctcaaggagagcggcatcacctggaccattctgggtcactcggagcgacgagtcatcctccaggaggacgacaagttcgttgctaacaagacaaaggcagctgtggacggcgggcttaatgtgattctgtgctgtggtgagagtttggagcagcgtgaagcaaacaagaccatcgaggtcgtgacaacgcagctcaaggctgttgcagacaagatcaaggactggagcaagatcgtcatcgcatatgagcccatctgggctatcggcaccggcaaagtt

SEQ ID NO: 28591 - DNA, 545 bp, Sorghum bicolor
  Clone ID: 7658523
gcacgaggatctattgcaatggttaatttcactgtcgaccaaatcagaggcatcatggagaagcccaccaacatcagaaacttgtccgttattgctcacgtcgatcacggtaagtccacccttactgattccttgatcgccaaggccggtattattgcccaagctaaagctggtgatgctagatataccgataccagagaagatgaaaaggaaagaggtatcaccattaagtctactggtgtctccctttactacgaatacgatctctacggaactggtgagtctgctccctacctcatcaacttgatcgattccccaggccacgtcgatttctcctctgaagttactgctgctcttagagttactgatggtgctctcgtcgtcgtcgattgtgtcgaaggtgtctgcgtccaaactgaaactgtcttgagacaagctatgggtgagaagattagacccgttgtcatggtcaacaagattgatagagctatcttggaactccaacaggatggtgaatccatgtaccaaaacttcgttaaggtcgt

SEQ ID NO: 28592 - DNA, 571 bp, Sorghum bicolor
  Clone ID: 7658528
ttctcagcgatccggtggtcggggcggccccgcgccatgatctccagtgcccccacggaggcatagcttcccgcgcccctgtgcgtccccggctgccgagacaacgagccagcggccacggtggtgctctgctcggccgcgtaggggcaggtccatccgtgcagtgtcgaccttatccttggtccttcgcccttcctactcaacaacaagatccggcgaagtggagccttgcttcttactcagatccggcgaagtggagcactgtcgcccacgtccgactaaggcgctctgctccgccagcgcccatccactggcgagctcaatctagaatttgtattgattttgtttcaaaatagttgatttgaagagtcatggtcttatggagctagcaatgaatttattaatttgatttgaggaggaaaggtagtctgatttagattcctattttgtctgggattcgatacgtgagcgagttgaagtggcggacagaacaaagcggatagaaaaattggcagactgaaattttcacaatttattattaggtatagatatagatatagatatagatata

SEQ ID NO: 28593 - DNA, 623 bp, Sorghum bicolor
  Clone ID: 7658529
gcacgaggcagttatcaagccatagtccacattttcctcagcaccaggtgttgtcagtaattctttgctaaagacgcaatggccgaagacgaatttgaagaatacgaagtaaagattcaaggcaagaaacgattcgtgtcgttcgacacttcgctgcacgatgccatggtcgtaaaggacggaagtggagatgttttggatacgtttccattggcgcacatgaagcgatggggtgtcaaggaaaacctcctatgcatcgactactggtatcctggtgcagaaaaagggactttgttgcctttggagagcaaagaccccaaaatgcttcaagacaagctcctccaagccgccaaggccatcgctgaacgcaaaaaagctggaggccactcacccgtaccatcatcaccgatgtcatcagaatcaccttcaccgccggtgactccgacgtacatcaccccgtcggcaccaccacaatcaccgccactttccccagcaaccaatggcagcagccctcattcgaagaaatcgaaacctcaatgcgaactcgaagtctgcatcagagaagctattggattgcggttccctgacactgacaaggtttcgccgtattgtgttttgagggt

SEQ ID NO: 28594 - DNA, 561 bp, Sorghum bicolor
  Clone ID: 7658535
gcacgaggcacttcacaacacaacacaacacaacacaattaccctacaacccaataaactctattcaagatgtttgtttaccaaggaaagatgaactggtggacatacgccataaacgagaccttcgtcgttgtcctccccaacggcccagtccgcgttggcgacagcgtctatcttttctggaaatggaccgtcgatgctaaaggcgtcaagaacggcaacgtcttccagaccatcagcgtcgactcagtcacgcagaccagtgccactgatgtgacctttgtcctcaagggctcctggtacagcttcaccgtcaccacaaagggcggctatgagaacatcagcatcgtcatgagaaacccccagggcggtgtcagcgaccccatgccgcttaagcgtgagtggaagtctgataaggagctgactggcactactcgcatttggactggaaagttcaagtggatgagctttgcgcgggatgagcatgccatcttcattgttcctgatggctttggtgagggcaagcctgttatttcgacgtggcagtggaccaaggcttcg

SEQ ID NO: 28595 - DNA, 526 bp, Sorghum bicolor
  Clone ID: 7658542
gcacgagggccgttgttacaggagggaatagaggaattggattagaaatatgcaggcaacttgcttccaaaggagtcactgtggtattgacagcgagagacgagaaaaggggtgcagaagcggtcaaaaatcttgtagcgcaggggctatccaacatcctgtttcatcaactggtggttggagatctctcaagcactgcacgtctcgctgattttatccgggagaaatttggcaaactggatatattggtcaacaatgcagcagttgttgggtccataacagaaatcagtgatccagatgcttttaagttagagcttgcaagcatgaatgctcaggaaaggctagaaaggatcaggaggtacaccacagacccttacgaccaagcagaggaggtcttgagaacaaactaccacggcaccaaaattgtcactgaagcacttcttcctctcctagagttctcatcccatggaagagttgtaaatgtaacatctattgttgggctactcaggtttttcagtggtgagga

SEQ ID NO: 28596 - DNA, 566 bp, Sorghum bicolor
  unsure (1)..(566): unsure at all n locations
  Clone ID: 7658544
gcacgaggacgataacgacgcatacattgctatccgtggtattgtttacgatcttggaaagttcatcccggtccactacccctccatcattcctgatgcttctttggagaagtacgctggaaaagatgcgaccaatttgtttcccgtagatgtttcctctctctgcaacggtatcgatggctcagtacacccgggcctaaagcttgacttcaggagtaccaactacactcaacaaaccaatcttgtctccaccaatgacctcaatgctaggtttcacgacttccgagctttttggaacgactcccggcccgattggtggtttgaacagcaggtttttctcaagtctaattacatgaagggacgtgtcggttacagcccacaatatctcaagaccttgactaagtctggcaagtccattggctacatgtacggacgagtctacgacttcacggattacattgtcggtggccgttcaatccagccacgtgccgatggcaagtcgtggcccaagaatctgaataccaacacgaatttcatggatgactctntggtcgatattttccgag

SEQ ID NO: 28597 - DNA, 537 bp, Sorghum bicolor
  Clone ID: 7658551
gcacgaggcaagaacccctcactcactctcactcactcactcgacagaggcgtgactgactcaaactgaactcatatcgcgttgagagcggagcagaggagggcgaaccatgggcgaggaggagaaggcgaaggaggcggcggccccggccgacaaggccaaggaggcggaggagaagaaggacgaggcggcaggaggggaggagaagaaggaggaggtcccgcctcttccgccgccgccgccgccggaggagatggtcatgcgggtcttcatgcactgcgagggctgtgcgcgcaaggtcaagaagattctcaagggatttgatggtgttgaagatgttattgcagatacaaaggcacacaaggtggtcgttaagggaaaaaaggcagctgctgacccaatgaaggtggtagaacgtgtgcagaagaagacaggccgcaaggtggagcttctttcgccaatgccaccaccgaaagaagagaagaaggaagaggagaaaaaggaagaacctgagccaccaaaacctgagaagaaaga

SEQ ID NO: 28598 - DNA, 548 bp, Sorghum bicolor
  Clone ID: 7658589
gcacgaggcaatttaatttcccgcagaagagatgtcaggttggtcttggtcgcctagacaggccatgctacaaatgagccagccagagatgaatggccaaccgcgtcctagtattccgccacagagcctaccaagcatgccagctctcaacctacctcatccacctgctccaaacccagccctgcctatgtataaccataagcctatctgtaacaagcctgatcctacccccgtttccaacaaccttgcgcctcctcttgtccctggtcccgtccccaataactcaacttctcctgcctactacaacccaccaccaccatttgttccgcacacaaccggggctcaaacaccaggcggtctaccttcacttatgaatacctcacccatggcaagagggttatcttctgcagcactgcaaattccggctcctgcccctgctcctgctgcgacaaccaccagctctaggaagcgcaagtctggtgttggtcccgacaacgcccaagagaatcttttcccagacaatgtgccggatatagacagcgaagacg

SEQ ID NO: 28599 - DNA, 442 bp, Sorghum bicolor
  Clone ID: 7658595
cgtgcctacgatgttttacgctcagtaatacttaattcgcgtgggggcttcatcattcctgatggagtggtgtggaacagttagcaatggtttggtttcagtttggggtgcaagcgatctttcagggaatgtatagaactttttatttgggttacgaacatacgtcacgggagaaccggtatacccttgcaacgctctatggagtcttgtctaatgatggccacgctttgcaggagttgagacattcttgtatatgagttttgtctcggcgttcggaaggagctcgcatattccctgtgtgtgagatcttctttcgaggctgggaatataatgtgtgttttttgccttgagcaaaacaggacgatcttgtctagcttcactcgcggttcgtctttgttttctgctcccatcaataacttcaagagacacttggccaacctcg

SEQ ID NO: 28600 - DNA, 367 bp, Sorghum bicolor
  Clone ID: 7658597
aagttgttacccccgagcaggcacaggaggttcacgccgccatccgtgagtggttgaagaaggaagtttttgccgaggccgcagacaagacccgcatcctgtacggaggcagtgtgtccgagaagaactgcgccgacttggcgaaacagccagatatcgacggattcctcgttggtggtgcttctttgaagcctgctttcgtggacatcatcaatgccaaccaggcatgaatacatggagagagtgctcgattgtaagggtttgctttcataccgtatgaaagcacccaatgcccaaggaatattatgtagacatgaaaatgataacgtgaataaaaccgcgtaagcggtgtttggaattattctcc

SEQ ID NO: 28601 - DNA, 560 bp, Sorghum bicolor
  Clone ID: 7658598
atatgaagaaattttgcatcgcatctttgaaaacaaaaatatcttaaatttttaagcaattgttacattaaaaacaaaataaaaattctccaaaaaaaataattaattgtcgttgaatgcgtgccgtatgagatataaataatatgaataaatatacgaacgatgtttattaataatggatgactaaagatatcgagagaaaaattttagtgcatttctgtttgaaacgttcaatgtcgcattcttgtttaacataatttttttatttggcaaaacatttcttcttttgtcattaatatattatattatatagattctagagagagagaaaaaaaagtttattatttttagtctgtcgatttccgaaagaatggcaaaatgttttgttcgaacgagtttttatttttatggattaaaataaatgactagagtaaacattgaacgagagaagaaagagaatttaaagaacgaggtgaaagtttgcaagggcatttttgttctgttcaaaaaatggattgatgatagagttgggatggaaataaatttctattgtcttattt

SEQ ID NO: 28602 - DNA, 414 bp, Sorghum bicolor
  Clone ID: 7658619
tacgcggcttatgttttcttcgaaaagaagcgtattcaggctggcaagcccaaaacgcaattccgccaaaagatggagaaggcatggggcaacaaagggtttgatattgagcatggggccaaccaccagtacacttgttttgctggtgaagagccggtagtggatgagtttggcaagatcgactttgttgtgacagggcggcggaggtgagaaagacacatgtgcttgcgaaaagaaaaagaggaaccctaggagaagggtttcaaacctgctggtgttgtctgatactatagtatttgagctgatttagtgtgttatcatacccagatttttgaataggaaggagaatagcaaaggcgtatctgacaggtttggttctgatctattcatagcaaaggaaaagtattgtcgccc

SEQ ID NO: 28603 - DNA, 553 bp, Sorghum bicolor
  Clone ID: 7658632
gagtctactatgctgctgaaatgactgctcatcccagactccaagaacccatgttcttggctgaaattaccgctcccatggacgctatgggtggtgtttaccaatgtctcaatcaaagaagaggtatcatcattgaagaagaacaagtccaaggtactcccctcaatcaagtcaagtctcacttgcctgtcgctgaatctttcggtttcactgctcacttgagagcccttaccgctggtcaagctttccctcaatgtgtcttctcccattgggctgaagttaacggtgatcctcttgatgtcacctccaagtgccacgaaatcgtcaatgctattagaaagagaaagggttttaaggaaggtatccccgctcttgataactacatggataagctttaagcgatctatgatgggaattttattttaatcataattgagttcataaaattatattaataatggtattacatagcgtgcgtttacctttataaagaacagtttaagatcgatatattagtaataaagaagtaattcctaatggttgaaataatgcc

SEQ ID NO: 28604 - DNA, 390 bp, Sorghum bicolor
  Clone ID: 7658647
gagcgcggggtggtgcacgcgtgccacgccggcggcgttgtccacttcctcgagggctacacgccccacgaggtgggcgccattgacgtcccccgcatcgacgttgtttgggaggccgcgctcaagcacggactccggcccgcatgatccgttttctgggggcccggctcgaccgccctttgttgtagtacgaaccaggccgatcgaaacgcacgggcctggctttgtccccttccttccctttgttttccttccaagttcatcattagttgggtgtgaattggtggttcctggaaattcaattttcttttctttctttttttttccatccccaatatgtatactgtgaactatacaatatatatataccccatatacaagagataaatt

SEQ ID NO: 28605 - DNA, 557 bp, Sorghum bicolor
  Clone ID: 7658650
caccccttgatttaccccgatatggcaatgggtctcgcatgagtctcgctccaagcggctacgggggttacgacaacaatatggagatgggcaacctccttggtatgccctcggacgacgcggtgttagctgaaatccgtgacatactggcgtcgtcggatctgatgccagtaaccaagaagcagatcaagtccgaactagagaagaggttcgggatggatcccactcccaagaaggcattcatttcgtcagctgtcgagtcactgctcgtaggccagacgcagtgatgctcttttcgctaaggcacatgtgccaagtatttcgtccttcacgattacgtggcctagcaaaagtcgctttgtttttgttctttcgttctctgccataccttgttcgcgagcggggatggcgaacttgtctacatatatatacaactgtctaatcacgctccgaaagcatagcattcattttggtcattgcgggaaatgggcgttggatatggttgggttcgatttgagggttgcatagtctgggtagaaatcattttgggaatggag

SEQ ID NO: 28606 - DNA, 518 bp, Sorghum bicolor
  Clone ID: 7658652
gcctattcgagaatcattgcaaagaagcacccaacactatgcataaattgtgtgcatccgggctatgtcgacacagacatgaacttccacactggagttctcacggttgaggagggcgcgagaggagcgctgattctggctctcctacccaagggaggcatgaccggagcatacttggactgcacagaggttgcttccttcgtgtaactcttatattggtgatcggccaaaggatgtgcctctcatgtttctttcaaatgcacggttttccatagaacaaagttattgcaatatatactactagtctatcaacctattcttgtaccaatagagataattgaacgaaatgaatgtgtaagacaactttgtaacagaatcaccatacaagtgttcgacatttacaatgaagacatagttttatacatcattgcacttttatgctgcaaaatgtaattgaaaacttttttttataaggttggagaaatatgacttgatctccaattaatgtgattttattt

SEQ ID NO: 28607 - DNA, 530 bp, Sorghum bicolor
  Clone ID: 7658659
ctaccatcgcccagcttcgtgctgagattacagtcaagaccaacgagaacgagaagctcgccaaggccaacatcaccctcgagggacagaagagggatctcgagggctccgtcaaggccctccaagatgagcttgctcgcgcccaggctaggatcaaggaactccaggccactgttaagagccacgcggccaaggacaaggagatccgcgatgctaaggctcgtgctgatattgaggctgccaaatcagaggaggaggctgccaaggcactggctgaggttgagaagtacaagcagtgggcttttgacaacaaggtcaagattgatctctccagctactgaagccagaggctcctgccactgcccttggtgccaatgggagtttcgtgccatagagtgttgagatattgttgggttgtaggtgccatctgcttggcggcctgggagatgaagaggagatggggagtggagaggactgtttagctcttaagtagtcctgatatctaaacttaatacatttcctttgttccc

SEQ ID NO: 28608 - DNA, 340 bp, Sorghum bicolor
  Clone ID: 7658664
caaagaagtgaaaaacgaaaacgaaccaaggtggttcgaaacattccgcatgcaaacccacgaggaagaccaagaattagtgatcgaattgaaggacaagaaaagcagtttgcctttcggcaaagtgaagatacccttgaacaccatgtccaacaccaaccctgatcacgtgtactgcaagtggctgagggtcagccactatgctcaactttcggtctccatcaaagtcaagaaactgtgatagtgatattgcagtttcatcgaaaaaccccgttgttcataccgctgtcattaatagaaatgtaagtaaacgcgagttagtcaagatatttttttggtc

SEQ ID NO: 28609 - DNA, 290 bp, Sorghum bicolor
  Clone ID: 7658665
gaacaaagcggatagaaaaattggcagactgaaattttcacaatttattattaggtatagatatagatatagatatagatatagatatagatatagatatagatatagatatagatatagatatagatatagatatagatatagatatagatatagatatagatatagcatatgttatttattctttcacatggaaatcgtgattcagatcgtgccgtgccgatgcatgtggcgtagtagcgtgttttggccacgccacggtttttggtacggcaaaaagtgttcgattt

SEQ ID NO: 28610 - DNA, 623 bp, Sorghum bicolor
  Clone ID: 7658687
gcacgaggatttccatccatccaccaacctcagccggccgagctcctgttttcgcccatcgtcaattccctcccctcgaaagtcgctcttttctgctgctcgacctgagctcgacttcaatctgagtatcgtcgccgcttccctcgattcatctatcgacaccgccccttggccctcggtgatcgttcaatctcacctcccgtcgcgcgtaaaaccatccaacaacaaaatttgactggtcgatcacgatgaactcccaaggcaacaacgatgtctcccccgaggctatgcagtcgcgaattcagcaggctcgtcgcgaagccgaaactctgaaggaccgaattaagaggaagaaggatgatctcgccgacacaactcttcgcgctgtcgcacaacaggctcatgaacctattcctaagaaccagcttatgaaggcgaagcgaacactgaagggtcacttggctaagatttacgccatgcactggtcgaccgacaggaggcacctggtttctgcttctcaagacggcaagctcatcatttgggacgcctataccaccaacaaggtccacgccattcccctgcgctcctcctgggttatgacttgcgcctatgctcccagtggt

SEQ ID NO: 28611 - DNA, 579 bp, Sorghum bicolor
  Clone ID: 7658688
gcacgaggcaaattcaggctgcagggctaataaagttttattcggagggtttgcatgcagttttggctgtatttcccttctgctcttcctgaatcagtgaatctgaataaatatcatttctgtcattggattctttcactggtatccagttccaaattgtaggctgtagccaaaatgagattgggcaacagcttcgtggtgaaaagaaaatgatcctaagaaggcgttagttagcacttctacatcaattctgaagtagcacacatttgtattatcatatatgcctcacaaataaagaggcaaagggcaaacctatgtaggaaaactttcatggaatattgaggcactctagtgctaacttctcctaaactacaaaaaaaacttaaatcaatatttcagggagataccacaaagttatattggtagcttttggtgacattatatggtcatgttacaggacttgagaagttaagcatttgaatattcgtacacaaatacttttttagcagccaattattagtcgttcttataagtatccttttacatgctcttttcactcttttcttatctgctgtgcat

SEQ ID NO: 28612 - DNA, 486 bp, Sorghum bicolor
  Clone ID: 7658710
acctgatcacaccgccgatatatctcaacattaatactgctaatgttggccacagcggctttgataccctgcataagctcttgcttgaacgactttcgtcaatcatagagcgcttaaatagccctgactaccattcacgtcatatcagctctcacgtcaatgcgaatgtagtggttctcaatgaggtttcttgagattcctctgctgtaacaaatttacctggaatggacctttttacaaaacagcagacttgtccctgcgggctataccctttcaaatcgaattcagaaggccgcggagacattgttcaacttcagcatactcctggccaactcgccctgcatcttgccttgagatctgacgaagagattcctagttcatcatcgaaaagacccgacaggtcaatcttcgtgatcaaggcaactaacagagcatccattggcctaagttgcttggaaatctatcgaaagatcttgctccagtact

SEQ ID NO: 28613 - DNA, 330 bp, Sorghum bicolor
  Clone ID: 7658738
tctcggcgagtaaggagcatccaaataacccgtttatcgaatttgtatggtaaagggtttccagtggggttgtggcaagttttgccaccggtatattgatgacccctgtcggtatcgctattgctatttcgtcactgttgcttccgccagttataaccaatgggcaggctttggcaaggagagcttagtggaacccgacccccccaaaggtagccaagcgtcccagtggtatagtgtatttgctgtcaaacgtgtgttaagtaatgcggctactatagatgatacgtaggtgctatagaagcgacgaaatagccattataatagagttgc

SEQ ID NO: 28614 - DNA, 454 bp, Sorghum bicolor
  Clone ID: 7658772
gtcgcgccgttaccattgggctacagggccgaaatgaggaggccacaagactattcagatcagccctgggcaaggcacgttattgtctgggttttcaacaccacgaggtatgtcacattcaggaactcctggttctttgtatagcagctggcggtcattacaagttggccatgaccgagctgcttgagcttgagaagaacctcaatgcaatctcgggaggctccattcagcttcagatcccaagagtcagccattataggaagagccttgagatctcaaggataggtcgtggtatctaatgccacaaagacgagtggttgaaagcactagaactggttgaagacgaagtgagcgggaacaggcagatgatatttatagaacgccaaaatgagctgctgtccagttttcatttccatttcttctaagaaaccaagtcattgattgttcgtggata

SEQ ID NO: 28615 - DNA, 668 bp, Sorghum bicolor
  Clone ID: 7658778
atttctgttaattttttttatataaaaactgcatcttttgttaaattaatttcgtttgattttttttataattttttagataaggttaaaattaacacaatttttattaaactaattaaattattaattttacatcgtctgactttattaaaaaatttatttgtgttttgtgtaaaaaaacctataaatattgtaaaataaatttatattagaaatgttaccaacaattatgcagttagtaaaaaaaatcgtacacgacgtagtgcgcgtctttatcatttattagcattagaaggttgtccgcaaaaaaagggtatttgtttaaaaatacgtacaacaaaacctaaaaaacctaactcagcgattcgaaaaattgttcgtgtgcgtttaagtaataataagcaaataactgcttatatccctggtcaaggttatagtattcaaaaattttctgttgtattagttcgcggtggtcgcgttaaagatattcccggtattaaatataaacttattagaggaaaatttgattttggtatttcagaatcttttttacgtgtaaaacgtagatctaagtatggtattactaaagaagaaggtaataaacgtatattatcattaaaatcaaaatcatagtttcattattctatataaacaatgagtatatttgt

SEQ ID NO: 28616 - DNA, 534 bp, Sorghum bicolor
  Clone ID: 7658783
gcacgaggagatcaggcccatcctataataagccggctagcacggttaatatacaaggctcaggattctcactatgatatcagcacaacaatagtgacattgaagaaccatgccctggcactagaggagcgtgcaaaggcagcaattgttcaaagtgctgagtttggccagttagcagcagaatcctttcccaaaaatctgcactgtctaactgtgaaactgacagaggagtggcttcggaacccgaagcataggagtcgctcagaggagaaccggaattccacacgattggtggataataatctgtatcatttctgtatattctctgataatgtgctggccacttcagttgttgtcaattctacagtctccaatgcaaatcatcctcaacagcttgtgtttcatgtggtcactgacagaatccattttggcgcaatgtcaacttggttcctcttaaatgacttcaaaggttgtactgttgaagtccgctgcatagatgagttctcgtggttgaattcttcttcatctcctctt

SEQ ID NO: 28617 - DNA, 554 bp, Sorghum bicolor
  Clone ID: 7658788
gcacgagggacggactggcatatggcccatctgggcggaatcgcatcgcgtggccccggctttgtcatggtcgaggcgacggccgtccagcccgagggccgcattacccctcaagatcacggtctctggaaggactcgcagatcgagcctctccgccgggtcgtggagtttgtgcacagccagagccagatcatcggtatccagctggcccacgctggccgcaaggccagcacggtcgccccctggctcagcatggcagcaaccgccacggaaaaggtgggcggttggcccaacaatgtcaagggtccctccaacactcccttccaggacagcttccccacgccccaggccatgaccaccgccgatattgagcaattcaagaaggactgggttgcggctgtcaagcgcgctgtccaggctggtgtggactttgtcgagattcacaatgcccacggctatctgctcatgagcttcctgtcccccgccaccaacgaccgcaccgatgagtacggcggcagcttcgagaaccgcattcgtctgtctctggagattgc

SEQ ID NO: 28618 - DNA, 579 bp, Sorghum bicolor
  Clone ID: 7658791
gcacgaggtaacaatccatctggagagcatctggcataaagcgaaattggtttctttcaaagcctttgttttttcatcaccaataatttatccactcatcatttaaacaactacaagatgtttcaagttcaaggctctgaaattctcttcatcattttgtggtgtctccaatttctattgtgcattgcgtgtaccattgtactagttttattcacaaatacacagtccattcgtgcaagagctcccgtactttcatccctgtcatcattgggtgcttcggtttatcttggtgcctacactctatcctatagtatacctgaaactccatgcagtttaattgtcctggtggccaatgttagtttctacattctgtgggctccattgttgttgagagcgtggagaatttactttatctaccattggaattcaaaaatgattttagaacaaaagaaacaagaagaaatagccaaggaacgaagaaatgcaagaaacttgaacaaaaagttgcaaaacagagccaagcaaattgaaatctctgatgatgaaggtccacctccagcacaaccacaaaaaccatca

SEQ ID NO: 28619 - DNA, 529 bp, Sorghum bicolor
  Clone ID: 7658800
gaagattcctaaactgcggaccctgaagctggaaggctgcaaattcatggttgatggactaaaagctattggaacctcatgtgtttctttaaaggagttaaacttgagcaagtgctctggaatgacggatacagaattctcttttgctatgtcaagactaaagaacctgctgaagctggacattacttgttgtcgaaatatcactgatgtttcactagcggccatgactagttcatgcacttccctcatctctctgaggatggagtcttgtagccgtgtttccagtggagcactccaactgatcgggaaacactgttctcacttggaacagctggaccttactgacagtgatttggatgacgaaggattgaaagctctttccagatgcggcaaactttcaagtctaaaaattggcatttgcttgaagataagtgatgaaggtcttacccacattggaaggtcctgcccaaatctccgcgacattgatttgtacaggtgtggaggcctcagtgatgatggaattattcca

SEQ ID NO: 28620 - DNA, 535 bp, Sorghum bicolor
  Clone ID: 7658808
cgagtacagcgggaaaaacagcggtccacaccccgacatgcacttggacgcttcctccacctgtgacacgcccagactcgcgacgtacccttcagaaccgctgcacaccacacagatgcacagttttgtacatggttggaatgcacgtagtcctcaactgctctcgatggcatcacaccaccaccaccaccctctccgcaacggaaatatagtagccgttgcatgctccctgcatccacggccagttatccatccacagcatccctgtctctcttcgcgtcatctctccgcctcttgacacccactccatcccacacaacacccattggttcaaaccaccactcgggtcctaccccccgtcgaaacctacggtgcgtcccttggcaccgcaatgtcacagcttcgtttttgacattctccatcccggaaaattttggacgacgtgcaaaaccagacagacacctgtctgtcttgctgacggcgccatcactgattgcttctaacattgaccctaaggcgagtcagcaagctagca

SEQ ID NO: 28621 - DNA, 571 bp, Sorghum bicolor
  Clone ID: 7658813
gcacgagggagagccattgtcttcgaaatggctgacctctcccttgatgctgttgcccagctgggtacaagtctcgcgagtaaactcaatttgcactctgaaggatgtcgcaagtctcgccagcggctcccaaagctggtgtctctggtcaactcgactgcttcgaccatccgtcagattcatgaactgatgcagcagaacgacaagatcttcacagaagcttgcgtgaaggacatcaacttatttgctgcgaaatgcagggctatctacgtcggagttctaacccttatcgcgaagaagacacaaagtgtcaatggagacaaagatgcaaagactttatcggccgagcagattaaggagctcttggcctgtcttgccaacatgagtgtttggcgaactgaagcttggaactggctggagccgcgattcaagatttgccagcaggagttgaagcaagtcaagtttgagcttgtcctgcgctatctacttggcagtatcgcacgacttcagatggaaactatgatacgttccccaggcgcttgagaaaatgaaaactccctgcgatgtttcg

SEQ ID NO: 28622 - DNA, 561 bp, Sorghum bicolor
  Clone ID: 7658824
gcacgaggctctgctgccgcgtctcgtgtcaggctgtcagctagcttgggggcgcgggggcagtggggcactacggccggccatggccgccgcggcgagtacacctcactgccaccgaccgtggcagctgctcgtcccagcgaaagcgtgcgcgagccgccgcacgggctggcctgccgtagccgcaggagtcggagctggcggtgcgccgaacgcatggacgggcaggctgctaccgccacctgcagctcggcgcgccgtgaggaccaaggccggggcggccgaggcgcggccgtcgtcgccgccggacgccgtgacctacagcgcgagcatctccaccgacacgcccctccacgaaccccctggggtctccttcgacgagtacctccaggacagcgctcgcgtgttccgcgccatgttccccgacgagagcaggagccagcgggtcggcgacggggaatggcgggtccaaatgctgccgctgcagttcctcctcctcaccgtgcgccccgtcgtcgtcatgcagctgcggcaccgccaccgcgccggcgggctcgacct

SEQ ID NO: 28623 - DNA, 582 bp, Sorghum bicolor
  Clone ID: 7658827
cgatcgcaatggctgaagctgctaagaaggaacacctgtcgcttgtcgtctgcggccacgtcgatgccggcaagtcgaccaccaccggccacttgatcttcaagttgggcggcatcggtgagcgtgagatggccaagctccaggctgaggccgactcgaagggcaagtcgtcgttcgcgttcgcgtactacatggacacgtgcaaggaagagcgtgaacgtggtgtgaccatccagtgcaacaccaaggagttctacacgccaaactaccactacacgatcgtggacgcgccaggccacaaggactacatcaagaacatgatcacgggttcgggctctgccgacgctgcgctcatcttggtgccagccgagaagggtggtttcgaagccgctatcgccaaggccgacccaaagctcggtgtggacgaaggccagacccgccagcacgcgcgtctccttttcttgctcggcattgagcagatcatcgtcggcgtgaacaagatggactcgtgcgactggtcggagacccgtttcaacgaaatcaaggacgagttcgtcaagatgattaccatgatcggtttca

SEQ ID NO: 28624 - DNA, 286 bp, Sorghum bicolor
  Clone ID: 7658828
gcacgaggcagacctttgctggccatgagtccgatattaacgccatccaattcttccctgacggacactctttcgtgaccggatctgatgatgctacctgccgtctcttcgatatccgcgctgatcgcgaacttaacctctacggatccgagtctattctctgcggtatcaccttggtggctacatctgtatcgggtcgccttcttttcgctggttacgatgactttgagtgcaaggttagggacattactcgaggcgagaaggttggctctctcgttggccacga

SEQ ID NO: 28625 - DNA, 189 bp, Sorghum bicolor
  Clone ID: 7658830
gccgcggccactcctgcgccggatgctctagctccgggagccactcctggtcatcccgtacctgctcaccttcctgggcgccgcggctgtcagcgctggcccgcagccactggtcgctgctggactcgctcgccagggcgctgttgccgaccggcaacgccaagcacgccgtcgtgccgcacgcgccgg

SEQ ID NO: 28626 - DNA, 544 bp, Sorghum bicolor
  unsure (1)..(544): unsure at all n locations
  Clone ID: 7658837
gcacgagggctgtttagcaggtctgcacactcgttgcctatcgagagcggcggcggccttcgtcacccaccctgtgctcatgctaagtgttgaggctcatacatattactggattgcaaggccgagatggaaattatgtgcctgcagaaacgtcttgcaagaaacagccttacatgacgcagaagtaaattcctaccgccatagtgagaggaagaacaggaaaagggacggcgcttacattgacaaagatggcgtagcaagaaccttcgaccgaaagaaaatatctagaaagagggggggtgctatcaaaggccgtggttggaagtacggctctgggtttgttgatggagtgttcccagtgttgagtccaatggcgcatgatatcctagaatttgtgcagaaggggaccgacgtcaccaatatctgggaatcactggacaaaattcctcaagcacacgatctttgggatgacattgtcaatgttgcagtccagctccgactgaaccgacnatgggagccgatcatcacagtctgtgagtggatc

SEQ ID NO: 28627 - DNA, 468 bp, Sorghum bicolor
  Clone ID: 7658841
gcacgaggactcactccagtcactctagctctagctacttgacatttgccacgtcgtctccaccatcgatccatcgaggtcgtagctcagcaagtcattcatggcaggaggcaacaggtcgcaggacgaggacgtgcgcgtgggcgtggaccgtttcccggagcggcagccgatcggcactacggcggcggacgacctgggcggccgcgactacagcgagccccctgcggcgccgctgttcgagtcgtcggagctgtcgtcgtggtccttctaccgcgccggcatcgccgagttcgtggccacgttcctcttcctctacgtgacggtgctgacggtgatgggcgtgagcaagtccccctccaagtgcggcaccgtgggcatccagggcatcgcgtgggcgttcggcggcatgatcttcgcgctcgtctactgcaccgcgggggtgtcgggggggcacatcaacccggc

SEQ ID NO: 28628 - DNA, 553 bp, Sorghum bicolor
  Clone ID: 7658847
gcacgaggcgagagcgggtgcgcggctgaactcccacccgcgacccaccaccaccaccgatggctctgcttcccgccgcaggggcggcggcgccggcgacgccgtccgccgccaagccgtgcggcctcaggcggccgtctgctcctcctgccgcggccctgcggctcgggccgctcttctggccgtgggaaaaggtgaaaattggtcccctttctgtttcccccatgggttttggaacatgggcatggggaaaccagttactttggggctatgaagaaagcatggacaacgaacttcaggactgcttcaatctggctctaaggaatggcataaacctttttgacactgctgactcttatggaactggaaggctgaatggacaaagcgaacggctactcggtaaattcatccttgagtgtgaagggacgattaaatctccagatgatgtgatcattgcaactaagtttgctgcatatccttggcgacttacatcggggcagcttgtcagcgcctgcaagtcttctttggaaagattacaacttgatcggctcgg

SEQ ID NO: 28629 - DNA, 410 bp, Sorghum bicolor
  Clone ID: 7658849
gcacgaggcactagcggtctctggtatatatccttgattgcctacacgtacgacacgtagaagctagtaagctaagagtactgccgtcggagacgacgacgacgatggcaacaagcaccacggtggccgccgtccgtgagatccggcgtgcgcagcgtgccgacggccccgccgccgtgctcggcatcggcactgcgacgccgacattctgcgtgcttcaggacgacttcccggactactatttccgcgtcacaaacaaggagcacctcacccacctcaaagacacgttcaggcgactatgtcggataaccgggctggagagacgtttctttcaccacactgagcaaatgctcaacgcccacccgagcttactccacggcaacggggacctcgacgcacggctggacatg

SEQ ID NO: 28630 - DNA, 437 bp, Sorghum bicolor
  Clone ID: 7658852
gcacgagggtcgggaagcgcctccccgccggccgccggccaccggctcgctgcccgccccctgccgccgcctgcccgcctcgccgtagcggcagccacgcgcgcggctctgcgtggccgcgctccgccagtccgctggccgcccgccatccacgaacaccacctacaagggtcgccccaaatccttacgccagaaccggcgctgaccggagtgccccgccccggtaaaaaaaaaccctactccaagacagcgtcgtgaagtcaccgacgtcaactccgatggcgtcctttccgccgccgccgcacacgctacctcctaccccgacagcaccctacccgggaacacctccgcctctgcaccaccaccaccaccagcagcagcaggggcccgctccaccgggggcggcgacgcttctggtgaggcatctcccagacgcg

SEQ ID NO: 28631 - DNA, 555 bp, Sorghum bicolor
  Clone ID: 7658853
gcacgaggccacaatcatttgtgccgcctctgccaccgaacaaggtcatgtccacggttcttgccactccagcccctaccgggtggcgttcctaggcagccatggtgaacaaattatcagctacgtttactcatcggttactggcacatggggcgatgccatctcaatgacgtctcttaaaccgtttgacccagatgaattcatttcttgcaataatatcctagttgggaatttcatttactggctcctaaatgaaagaactatttccatacttgagtttgatttggacaggcagagcctagctacaatagaggtaccgccagaaatgattgacattaaccctgttgtccgtgaagagtccgaatttttgattgtgccagcagaaggttgtgggcttggcttactcatgatagcaggtttcagtgctcgaatatggaagaggaagtacagttgtgatggaaatgctggatgggtgctcatagatactatcagactagatcatcatcttcgactcaagccgtgggcacatacattcccccctgtgctactagggtt

SEQ ID NO: 28632 - DNA, 600 bp, Sorghum bicolor
  Clone ID: 7658859
ttcggcacgaggcgctgatgaaccatttgcaggaaacagcacttaatcatgtgaagaccgctgggctgctaggtgatggattcggctccacaccagagatgagtaaaagaaacttgttctgggtggttagccaaatgcaggccatcgtcgagcgttatccatgctggggtgatactgttgaagtagatacatgggttagtgctaatggtaaaaatggaatgcgaagggattggcatatacgtgattctataacaggccacacgatactgaaggcaacaagtaaatgggttatgatgaacaaacttactaggaagcttgcaagaattccagatgaagtgcggactgaaatagagccatacttttttgagcgttctgctattgttgatgaagacaaccgcaagcttccaaaactgccagatggtcaaagcacttctgcagctaaatatgtgaggacagggctgactcctcggtgggctgatcttgatataaatcagcatgtcaataatgttaaatacattgcgtggattcttgagagtgcaccgatatctattcttgagaatcatgaactggcgagtattgtgctggattacaaaagggagt

SEQ ID NO: 28633 - DNA, 459 bp, Sorghum bicolor
  Clone ID: 7658873
ttctatgaagaagttttaaattataagagggccacacctgatgaaagatctcaactcgctccaaacctcattgataattacattaaggatgatgcattgaatgaaattaatattgctggtaaggtcaagaagagaattattcacagatacaaccaaataacctacgatgacgaggtaccaattgatttgtttgatcttgccgttgaaaaactcaaactagtcctcaacgagaatggtacctatcaaaactttttggagagctcagaattcaagcagtacattaaaaagattaagaataataagaaaattaaggaattggaggttgctggaggtgttatttaagcaattatctgttccttaatgagtttccaccaaattttgccaattttaacccttgtatcatattctgtttttacagaactttttcgacctttataaagttccacaatttttactggg

SEQ ID NO: 28634 - DNA, 518 bp, Sorghum bicolor
  Clone ID: 7658874
tgccacgcagcaggtttgaccgtgaagcttgcagtgcttgtgtggataacatcaagatggtgtacggtgatgactctactgagctcagtaatttcaagcgtgtgataagggaggaaagtaacaagttggaaagcaagaaccaagataaattgttggatgcatagatcctgcatggaccacattgcatgtgaaggtaaaactgtgaagtgaacaatgctcttaggttaaggtggaaaatggaacatcttgagtgcaagcttcagttctgagcacatcctcgattcttttagtcaagcttggtgtgttcagaagtttatggtgttcttttttatatacatagaaaattgtttagcaggcaagagcatttcagttggtttggttggtcccagacttatcattcgattgcagtcctaatctaactcaattttttgctgcgtgccaaaagtcatatccctgtttcatcagtactatcagagaaatgctagttattttaatactaatatttatcatctttctcc

SEQ ID NO: 28635 - DNA, 161 bp, Sorghum bicolor
  Clone ID: 7658875
ggtcgggggttccaaaaaaacccgggtttggtttggacgtgggccaaggaactcaatgtggagatttccatggggaaccaaatccgttggggctttggttcccgggggggtggtccatacttgaaaaagcgccaggaaaagatttaaatggacggagttgt

SEQ ID NO: 28636 - DNA, 611 bp, Sorghum bicolor
  Clone ID: 7658889
tctagcggtcatgcttggaacctgggactcagtccgtcgtcccggcatgacactgaccctcaagatctggccacctgcagttccacctggtccacctcggcccagaatgtatccacccccacccatgggctacgttccgccggttaagaaatatcgcgaagagatgaaggagacctatcgtgagatggtcgagttgctcggcctctctgacgcgtgtgtcccagaccaggagactgtcaagtctggactgggagatcttttgcgactgtggactaatgccattgatccccatacagaggattgttcggactgtgcatcgttcatgatgagttacagctcttcaagctttgaatacagcgactgagatattggtgatattgggtgggaaggtcttctttgttgagtgcttattttaccctgatgaccaaattgatgatctgatttgcgagaaccttggtgtctcaaacgccgcggtattagtgaacagtcgccaaatgcacaagacatgggcgcaatccatgttcaagctgaatgtcttgttcgggtctaccagatactacacatttcaatgacatagctatcttgttcactaattttatcgtcatccttct

SEQ ID NO: 28637 - DNA, 391 bp, Sorghum bicolor
  Clone ID: 7658893
cggcgcacagtagtcacagcaacttgtcagtttgaccggcgcggtgcttttcggtagtgagattgacgccaggagtggttttcaagtcggcgtgaagagtagatgcagttgcaagtcgcagattcgtgggtgttcgtcatgccgaggatctttgaaggtttgatttgctttagatggtgtggaagaatggttcgagaggcatgttgtgattattgattattgactattacgtggatatgaagacggtatgtcagagacagaaattgtcccagaagaagaaaagaatagattagactgaaagaagaacgattttgatgcttgggtttcaaggcgatccgatgatgcttgaatcccatgatattaggtagcataagaattccccatccctttc

SEQ ID NO: 28638 - DNA, 236 bp, Sorghum bicolor
  Clone ID: 7658895
gttgggcctttagccccgatcgggaagggactgttgccccggtttccgaaccggtgttgcccttccaggattaaaggccccccctttagtcccggtttgggaaaggttcccaaccggtgttaaagggttttgccagggttgccccgttgcaggatttttttccaaccggtgttaaagggtttttttttttttttttagttcccttctccggttgcgtttatggtttaaataaaata

SEQ ID NO: 28639 - DNA, 161 bp, Sorghum bicolor
  Clone ID: 7658908
ttagtgtcccgtcccttgatgttggccggggtacagggatttatttgttcccacatcggccgttcatggactgtcactccgaatgtataatgtgtgtaaccaaacttgcttaaatgtgtggtaagttttcgtttttactacgtgttagcatccatgggagg

SEQ ID NO: 28640 - DNA, 227 bp, Sorghum bicolor
  Clone ID: 7658911
ttccccagccggactcgattattcgtggtggacttggggaagaaaatacagtggctgatgcgatacctccttttcattattccctatttattgttttccccgtttcgtgctttttttcgcacctgcaaaattctctgcaccatagttccccttttttgacacaacgcgggctgttagtactgggtggttgtattattggatgggtttcctgtgttcagttgcccttt

SEQ ID NO: 28641 - DNA, 110 bp, Sorghum bicolor
  Clone ID: 7658912
aaggattaaggggtcccgtttgcccagaagttccccccagccaagccccatttgggatcgaacgccaagggtgtgttggaagctcaatgcattaagagattttccatttt

SEQ ID NO: 28642 - DNA, 397 bp, Sorghum bicolor
  Clone ID: 7658914
gccccctggagatcgccatcacctgggtcctgccgccgcccctgcgcctggtgccaaagactgtcctgcgcggcgtcgccgaatcggttctgtcgaggctggcggaaaaaatgaggcgggacgtggacgtcggactcgtcgccgacttcaggaggtttccccgggaaaaggcggcagcgtccagggccaccccgacgctggacgggacggcatcgagcaaagaccaagcctttgaaagacaaagtcgctgatgatcctagccttagcttgtattgtacatggaaaggtgtacgtgtgcagcgtgatcatttacatctggtttttgctataaacaggaactaatccgagactagaacacacggaaacccggcggatcggagtccagtcccctgtttac

SEQ ID NO: 28643 - DNA, 660 bp, Sorghum bicolor
  Clone ID: 7658923
cagacttgaatctatcgcgacaatactcgagtctttcactgatcatcacttgggcgacgaattcaatctctcatcaccaaagactacatcctccggtatcgccgaactgattcaacaatatgtcaggtcctggccagaatactgtcgatatcgacgctctcctcgatcttaccgagtacgataatttccaatctcctgctactacagtatcaccatcaggaacatcaaaggctacattcgccagccctatcacagctgctgtcgctgctcccgccaccacaactgcccaaagcctgagcggtcccagtcacaactatgacatgtaccgacaacagactggctttgtgcccggtgccatcgccaacacaatggccgttaaccagacaaacaacactggctaccaagacttccgcaacatcgactacctaaccaccttcagtcccgaggctgatctgtttgatttcaacacatctccttcgcaggctactttgggtgcttcggatatggatatggatttcgagtcgcagaccgagacacaacagtttttcactgtcgaccctagtagcattgagcaagagaacgctggtcttccctcaccacccgttttgcctacacagaacaatggccgtctctggcctggtgctcactcccaagccgctc

SEQ ID NO: 28644 - DNA, 658 bp, Sorghum bicolor
  Clone ID: 7658926
ttcggcacgaggcgatgagaccacctctctcaccgactacatcacccgcatgcctgagcaccagaagcagatgtactacatcactggcgagtccctcaaggccgttcagaagtctcccttcctcgactctctcaaggagaagggctttgaggttctcttccttgttgaccccattgatgagtacgccatgactcagctcaaggagttcgatggcaagaagctcgtcgacatcaccaaggactttgagctcgaggagaccgacgaggagaaggctcagcgtgaggctgaggagaaggagtacgagggcttggccaagagcctcaagaacgtccttggcgataaggtcgagaaggttgttgtctcccacaagctcatcggctctccttgcgccatccgtaccggccagttcggttggtccgccaacatggagcgtatcatgaaggcccaggctctccgtgacacctccatgtcctcttacatgtcttccaagaagacctttgagatctctcccaagtctcccatcatcaaggagctcaagcgcaaggttgaggccgatggtgaggaggaccgcaccgtcaagtccatcactctcttgctcttcgagacttcgctcctcgtctccggtttcaccattgacgagcccgtccagtacgctgag

SEQ ID NO: 28645 - DNA, 580 bp, Sorghum bicolor
  Clone ID: 7658935
gcacgaggaagaaagtcaccaaagcagcggaacttaccctgcgagaatccatctggcctattgcgctggtcactgttctcttcttcctctggggtttcagttatggactccttgatacgctgaacaagcactttcaaaaggtgctgcatatcgatcgtgcgcgatcggcaggtcttcaggctgcgtactttggtgcttatcctctggcgtcgctgggacacgcttcgtggatccttcgtcattattcgtacaaggctgtgtttatctggggtctttgcttgtatgctgttggcgcgttgattgctattccgtgtatcaaggcaaagtcgtttgctgggttttgcatgtccatctttatcatcggaaacggacttggttctcttgagactgctgctaacccattcatcactgtttgtggtcctcctcgatactcggaaattcgcatcaacatctcccaagccttcaacggtatcggcaccgtcattgctcccgttctcggctcatatgtcttcttcaacaatctcgacgataatgcggcgctcgccaacgtgcaatgggtatacctcgccatcgccgtctt

SEQ ID NO: 28646 - DNA, 599 bp, Sorghum bicolor
  Clone ID: 7658936
cgtcctccagtccccctgttttccagctctagcaacaccactccccaactgcacaacgttacaaacatggcagatctgaacagcaacaactccttcgactcgggcgcaagcctgatgtccaacttcaacaatggaggcttttctatggaccaggtgtccgcattcacggccatcaacgatccttccgttgctgccgggtctacgcgcaccgtgtcccccaaggacatcttcaatgatgcctttgggtctgcgcccccatcgacggcgtttacaaacttgacctcgcccgacgtcggcgactctcccttcttcaacgacagcttcgagtgctcccccatgttcaacggcgagcccaacatgaccgacacaagcgactggttctccctgttccccgagcaggagaccaaggttcctgacaacgcctatgcgcccgccatctctatgcctttggagcgcaccgtcagcagccagtctatggagcgatctggttcttccagcaccggctcccccattgttctcgatagctacacgcgaaggaagtcgtcagtcacaaactctcctgctatcaatggtgtcagcaagtctcgtcgtcgaaaggg

SEQ ID NO: 28647 - DNA, 491 bp, Sorghum bicolor
  Clone ID: 7658943
gcacgaggccgccgtcgacgtgctcgacagctccgtccacaacctgcagggcgtggcgaggccgcccgccgtcaacgtcgccggctcctccaccctctccaattccgcagggaggaggaagaagactcggccggtcagggcgttccccacggacgaggggacgctctggaagacccggcccgccagtggccgcgctgacgcctggggtcgattgatttcccagtcttctgagtatccctcaattccaatttatcctgctcatttcactattggccatggcggaaagtgtgacttgaaactcaccgagacatctcctgggtcacttatttgcaaactgaagcatgttaagaggggtgctgcccttgagatctacatgaacaaagttgtccatgtcaatgggaaggccttggacaaagctgctaaagtcaccatcaccggtggtgatgaagtcatttttgtttctgttgggaggcatgcttatatatttgagc

SEQ ID NO: 28648 - DNA, 646 bp, Sorghum bicolor
  Clone ID: 7658947
gcacgaggccgaattggtagagcgagaggttaattcacagacttccccgaggacatctgcaccgaatccacgcattgcacgttaaggttcgtgtgttttgaaggaaaccccgagaggaagttctactatcatgatcaagccaagcgcaaaagatggacgatgttcgcccatgagcagtctagaagttgaccgcacttcctctgcagccttacatctattcgaaatcacagactgcagtcaggctatgtagcaaaccgttcggaacagacttcgaattcagggcgcccggatagacgcagcggtcaggctcgatgaaacaatgctcagtctacgctctagacgtcggcgtgatcattgatataaagtctgcttgcttcatccctgctagtcttaggtctgctggtgaattccagtgccaaccatccaagatgccctcttcgctcctgcaggatgccccctctgccgctagcatgcaaagcaaaactacggaagcaacaagcgtcgatatccacgtcatcgcattaacttggctatctcgcctttcccttgctttgtcacctctctgtaactcaaacatagcctcagccgagatgaatccctctacgccgctctctgtactatttgcgccggatgccattctgagaga

SEQ ID NO: 28649 - DNA, 583 bp, Sorghum bicolor
  Clone ID: 7658953
gcacgaggttttcttccacttttactttctcccccccaacaacaagcacaatattatctgccagtaaaatacactcttttggggcagagaacttgttcttgattttgtaaagagccttctctttattttattagagcccttttgtgtgtctttgtttctatctgtcttctattgcattgatagatcgcctcgacttgtgggctacgtttcccctcgagcttgctttgagagtagccctggggttctcttcaacccgtcaagatgagttccgactattcttatgacgagcagggccaattcttccccttctttatcctaaccctcactggcatcgtcactgttccccttacctacacactccttcgcccgaaccgcgaccaagatgcgcttgcgccacggatcaagaccaactacaagtcagagcatgcggctacggtcgagtcgctcaagtcagcgcagaagcgtagccaatggagggtcaagcgggtcatcttcgtgataatcggctgggccctcatggctggcatggcctacctgatcatggtcacccagcgaactgtccccaagctttggaacccttacg

SEQ ID NO: 28650 - DNA, 621 bp, Sorghum bicolor
  unsure (1)..(621): unsure at all n locations
  Clone ID: 7658955
gcacgagggtcaaacaacccatatcaatctactcaatcattgtttgctttacaagatgcagtcacttgatgctattgttgttggagctggattctccggaatcagcgctctgtatcaacttcgacaacaagggctaaatgtgaagttgtttgaaaaggctcctgaagttggcggcgtttggtattggaaccaataccagaatgcagccaccgattctcccagcgaactctacagatttagctgggataaagacaacctgcagacttacccatggccaaaccatgttcttccccaagaagaaattcaaggctatctaaagcacgtcgtggaccactatgacttgaggcagcatattcacttttctcgcgagctcaagtctgcgtcatttgatcaaggtgtatggactgtcaaattttctactggcgacagcttcaagacaacatacttgatccttgctgtgggtacatgtcacaaacccgtttggcctacccttcctggccaggacaagttcaagggcgaacagtatcacacaggactttggcctgagcatcgtgacatgcgaggcaagcgagtcggaatcattggcaccggctcttcaggcgctcaactcctcgtnaggct

SEQ ID NO: 28651 - DNA, 575 bp, Sorghum bicolor
  Clone ID: 7658960
gcacgaggatcaaatccatgtctcacagaaagttcgaagctcccagacacggttctttgggattcctccccagaaagagaactaagcatcatagaggtagagttagatcattccccaaggatgatgcctccaagcccgtccacctcaccgctttccccgtcttcaaggctggtatgactcatatcctcagagatgtccataaggtcggctccaagctccacaagaaggaaaccgttgaagctgccaccgtcctcgaagctccccccatcattgttgccggtgtcgttggttacatcgaaacccccagaggtctcagagctttgaccaccgtctgggctcaacatttgtccactcaattcaagagaagactctataaaaactggatgaactccaagaagaaggccttctccaagtatgctgccaagtgggctgatgaaaagaacatcaccagagaactcgacagaatcaagaaatactgccaagttgtcagagttatcgttcacacccaattgaacaagctcaaccttagacaaaagagagctcatgtcctcgaaatccaagtcaacggtggtact

SEQ ID NO: 28652 - DNA, 492 bp, Sorghum bicolor
  Clone ID: 7658966
tgcagctccatcttcttcctggaagatagagatccagatcagcggagagagggagatggcttcgcacaataacaataaggatgccaacatctaccacgcaccagtcggtggcaatggctatggtggcactgtcaacatgggccctacggcaccagcaccggccaagccggaatcaccagtggtgacgcagcatgccgaacaatacacctcgtcatacaccgcttaccctgcacctcaccgccgtcctccggcgccatacatgcgccctcaaaagccgccgccgccgccgccggcgtactatggtggtggttggtactggggcgaagctgttggggaatacggcggcggtggatactacgggtaccgacctccacaaccgctgccgtacggtggtggtgggtatgggtattgccctccgtctgagttcggttggggagccggcggtggtggctacagctactacgatggcggttatggaggcggcggcggcta

SEQ ID NO: 28653 - DNA, 604 bp, Sorghum bicolor
  Clone ID: 7658973
caagcacgaaggactcggtggtcagagaccccctgctcctaatgctttgccttcgattggacagcatcacccaatgatgcctggcttgccaaccggaggctacgttcctcaatcccttgcaaatggtcctcagtctctcgcaagcactccccagtctctcacaaatggctcccagccccccatgccaaatggaggtggcatgcttaaacgaggacgagaagaagaagaagatctgcaccgaccagtctctaatggacatgatcctatgagtaacatgcacgcaatgtctaatggttaccctcaacagcctccccttgcgaatgtacatcagcctcctctgcagaatggaggagatatgctcaagcggggcagagaggaagacgatgaggttcataggtcagcgcataatgcacacgacaccatgaacaacatgcctggtggcatgcctggtatgtcgaatgcatatgctcagcctttaccaaacgttcatcaccagtctcttgctaatggagacggaggtatgctcaagcgaggtcgagatgaggatgatgacgttcaccgatcaagtcccaatgggcatgattctgcaggcaacttcgaagta

SEQ ID NO: 28654 - DNA, 443 bp, Sorghum bicolor
  Clone ID: 7658980
gcacgaggatttggtcaagcatttgattcaaaacaacttggtctccaagattgcagttgcggacaaagtcttgccggatactgctggcctctccgctgaagagttgaagctctacaaggacgaaaacggcattgttgtttacaagcaagccaacttggcccgtgaagccactatcagcaaagttttcgagctcgacggtggtaacttccaatatgttttcaacttggctgctatcaccaagtacagccaacctgaagaggtctacaaagagaacatcatcgacgttgctaaaatttgcgccgctgctgcattgaaatacaaagtacaacgattcattcacgtctccactggtcaagtctactcttctggcaagaaagcctcagccgaagacgacaaaattaagccctggactgatatcgccaaggccagtcttgaggccgaga

SEQ ID NO: 28655 - DNA, 467 bp, Sorghum bicolor
  Clone ID: 7658981
gcacgagggtgtcacgccgccacggcagacaccctcttgcctagccaaggcctcaccggcggcgacacgctcctgtccagcaacggcaggttcgcgctcggcttcttccaagccgggagccagagcaacttctctgctgacggtgacagcactcccaaatggtacctcgggatttggttccacacggtgcccaagctcactcccgtgtgggtcgccaatgccgacaaccccgtcgtcgccgccaacctcacgtcctgcaagctcgtgatttcccatgacggcaaccttcttgtcatcctagacgacgaccaccaccacctgcagccggccaatggatcatcatcgtccacggtttggtccagcaaaaccaacgccaccacaaccaacggcaccaccaccaccaccaccaccaccaccatggcggctgctgctgcttctctcctcgacaacggaaacctcgtcctgca

SEQ ID NO: 28656 - DNA, 567 bp, Sorghum bicolor
  Clone ID: 7658982
gcacgagggtccttcgcttgaaacctctgtcactctttgatcaatcactacactctttgcctaatttcgtaatataatacccaacttcaaaatgcgcttcaccagcttcggactcgtcgccatctcggctttcttcaccaccacttatgccgcacccactgcgctcgacgtttccgtccctgccctcaccggtgccgtcaagccagtcaccgatatcgtcaagccggtcaccgacatcaccaagcctgtcaccgaccttgaactcgtctcccgcactgataccgtcgatgatgtctgcaacaagctcatcgcgaccttggccgacgtcaagaagcacactgccgtgatcaactccaccatttctggagtcgaccacctccacatcactggggagctcaccgccaccatcaagggcgaggtcactgccattgtccagatcttggttggccttgccggcgagctggttgtcattgtcggtcataccaccgatgttgttggcgatgtcaaggtcaaggtcgtgggcctcgttgtcgaaatcatcatggagatccttttcactcttaacgg

SEQ ID NO: 28657 - DNA, 535 bp, Sorghum bicolor
  Clone ID: 7659001
gggccctctacccagcatcacggtagaccccaacgataaggtggctctcaagcgagcacgcaacacgcttgctgctcgtgagtctcgtcagcgcaagtttgatcatgtcaccaccctcgagcagcgcaactttgagctgctggccgaggttgaaaagtggaagagcattgctctagctcatggatacagtggacaatgaatgtcctcgtccctctcaaatggtcccatagtggtctcaaggagctggtgaagaaccagccccgccttttggcaaaagttttccttccttatcgctttgatcggcttttctcctctgcttcttctgtcagtgcttactcgatggttcgtgtttacgcgctttgatcttagattgtttttcgccagtgtgcagtctccccgatgtggttttagattgactccgcttggcgtgagtgggtggtaatgtgttgacgacgtttgtcttcgatggttttgcaagcaagcatatttgtgctcaggtctttgagatagtctccttatataaaaaccgcttttc

SEQ ID NO: 28658 - DNA, 550 bp, Sorghum bicolor
  Clone ID: 7659002
gccgcttcttcggaacgtttttgatgaagttctgcaaaccgcgaaaggttttcttcgtgttcttgacaatgtgcattgtctttatcggaccgcctatcgttcatcacggaaccgctggtgtatcattcctctacatcgttctctttttcgagtctatctgcttccccaccattgttgctttgggtatgaggggtcttggtcgccatactaagcgaggaagtggtttcatcattgctggtgtcattggcggtgcctgtgtgcctcccctgacaggagctgttgcagatatgcatgacgttggtatctcgatggtcgtacccatgatgttcttcgttgcagcctggtcatacccaattgctgtcaactttgtgccttcttacaagaaggttgttgacgttttctacgaggcagacattggtcttggagagcgaactctggatgaggagaagaatcagggcacacagcacgaggagaaggatatgactgcacgcgcgtaatacatgtatctctttcaaagtgttgtagttagtagtcagaataacaagttccc

SEQ ID NO: 28659 - DNA, 242 bp, Sorghum bicolor
  Clone ID: 7659005
gtctcggtgccatcgtccagggtgttttccacgctgccttcggccccattggcggtgttttgggactcgttggcggtgtcctcagctgcatcttgtaagcaattacgctacaaccccgttaatagtttcgggtgggagtaggggggaagactggtagtgggatatgctgttcacatttttcccctacgcagctcagactatgatattctggtccgtgtggatccagaaaggcctggtgcatc

SEQ ID NO: 28660 - DNA, 483 bp, Sorghum bicolor
  Clone ID: 7659006
ggtcaaatcttcaacttggctgacgagaacgccactgatcaaggcaaggtgaacgacatgttggaacaaatctacggcatcaagaccggcttcgttggtcaaatcatgtccagcattgccgccaagatgtcgctcaagaacatcgctgaagttgccaacgacaagcacttgaagccttggagtgacatgaccaaggaggctggcattcaagacaccccgttgactccttacttggacgaagagttgttgaaggaccactccactgctattgacggctctgccatcaccaagttgggcttcaaatacgacttccccaagcccaccattgatttgttgaaggaagttatcagagacttcgaagccaagggctacttccccaagaacatcgtttaaacgagtctgctcgcgtctaaaacgatagcgacagttgtgataatattgtcattgttatattaatcgaattaaatattagtattgtaaccc

SEQ ID NO: 28661 - DNA, 692 bp, Sorghum bicolor
  Clone ID: 7659011
atggagaggcttgcatccagatctggaagaagaggatgaacatcgaatgcaaaagatgaaagacaagggattcctggttcacgatggctctcatagtgaaagcttggctttctctattttcaccaggttcggtggccaccttgtcgatgtcggcttctcagatcttctgatccagggcgacgtggaaatgattaccaacacgcagattgcccacttcgaagaacgtgcagttgtgatgacagatggccgacgcgtcgagtgtgagagcgttgtatttgctacaggatatcaaccgatcacgactctctggcggtcgatattcggtaatgagatcattgaccgggctggtcctgtttggggcctggaccatgaatgtgaactgcgtggtgtctttcgccgcacgggacatcctgggctctactacgctggaggcaacttcggcacttcacgatgggctactcgacagctcggactgctcttgttggctcgaaagttgggatatgataaagagcaagatgcaagtcgttcggcatgattctactcgcggtctcgtagagggctattctaacgagagataatcttccaaacttattttattggtcaggtttgtttgtaaaaatagatatttagacaacagtagatatccttgtagaataagatacgtggtattcatgaccacgggtagccgcttt

SEQ ID NO: 28662 - DNA, 582 bp, Sorghum bicolor
  Clone ID: 7659017
tttcttttttgttgggaacagtagtgtccctcatcggaaagcccttgattgcaaagatgatgccgacgagttcacgacacgacttccgattttttgttgatctagcatgctctgtcacggatatacaatgactaatgagtcacggtttgcatggaggcttaatttttggaaagagtttttgcagcaaggtttttccttcgatgatttaccccgaaatgcgatatgatcgcatactatgggacaggactgcctgtaactagcccaggcgggaatgatgagtttggactggacccttgtttactgagctgttttggctagcccaaacgttggaaagtcaagacgccgaagggaacctatgggaaaggctttgaattatgaattacgatcttacatttcttattttttttcttcttttcatatgtgctcgcgtttcactgtggtacagaaaacgcgggcacaggcgaatgtgtgtgtgtttttttttttttttggaagtgttgctttattaggtaacgaattatgagggaacaataaaagctgttttttttttttcaagaatagatacaattagagagttggttc

SEQ ID NO: 28663 - DNA, 479 bp, Sorghum bicolor
  Clone ID: 7659020
ggttggcccgcagacgccgctcgccagcatcccgtcgattgccgtgtggcaaggcgagttcctcgggcagctcatcctgaaggccgagaagatgaagaaggaaacgggcaagccgattgttgtcgacaccattcaggaaaacgaagacgagtgggtgaagcagaccaacgcaattgccgcggcaaccgttttccacaagggaaactcgtactttttcagcgaccacaacacctctcgagcgcccaaggatggcataaccaaggagggcacgaggcatgcgatttgggggcttgggggctttcacaactatgtcaatgcttgtcaagaggcgattgacgcaaactaccgtggattcacgtttgcagcctagaggtgcggttggttgaagacgctcttattttgagatttgatggatgttttttgaggctaaaaggaagagaaaccggggtttctattcattagcgacaacgtgttatttt

SEQ ID NO: 28664 - DNA, 478 bp, Sorghum bicolor
  Clone ID: 7659021
aagtaaccttggtagttgaggaagcaagcaaggcagccgagatgcaagccgaggacgagatcagtgagcctgaagaggattccctcgcgggacagatgcacgttctcaagactggtcaaactcccaagacccgcagaagggattctgacgactctgaggatgagagtggaacagatgaagaggaggatgacaccagtgcaacaaataccgatactgaggacgagtcataacggcccaccagtctctctttgtggatataaaaaaaagtactgtaatcactaaatcatgagcgaaaccctgcccttctcaggagcatgatgtgtgtatacggaaacgatataatccttgtgtatgtatgtattaggacgggagggagggagtcggaggaagatgacaaccactttaaagcttgggcatttatttctctatcgagaaacaaagtggggagtttcggggtttctttagaggcacacccaca

SEQ ID NO: 28665 - DNA, 625 bp, Sorghum bicolor
  Clone ID: 7659070
gcacgaggccgggatgcagcctagctgcacaggcgccagccaagggcgcggggccatggcgggcggaggccgtcgctggcctcgtgctcagggccccgctagcacggaaggaggaaggaggcagcagccggttaggctagcggcgcccgcgccccttcctctcggcgtgtaagccggtgaccgggcaggcagcggcggccgccggccagacagtgcccgcgcccggctctctcgcgagctcgtgcggcggcccaccccctctcccctccacacatgctaggcgctagacctacgctgggcgcgcctgctccgcctcgtgcacgaccagctgctcgcctgctcgtcctgcggcggcaagatctggtgtcgggtagctggcgacgtacaacctctccaagggccacccccatttcgaggaggcaccgataagatctctctcatgttctcggaatctctattagatgatctggctgatatgcttttgcagggtacccctatctacacatccaccgcagcaaagaattcccttatctaatttgtggcgcccgtggtccagtactgatggatttgtgctggccttgctgattatcttttggggccatactaaacagggggtacttggggg

SEQ ID NO: 28666 - DNA, 542 bp, Sorghum bicolor
  Clone ID: 7659074
gcacgagggtggcctgcagggaagccaaccttgcaagctctggcagcggcatggcgtcggaccgaggagaggtcgacacatcccgcgccttccggtctgtcaaggaggcggtcgccgtgttcggggagcgcatccttgtcagggaagctcagttcagaccaaatggtggcgcgcatggcggccgtcgtgttggcaaggaggtgaactccagggtgaatgctgtcgccatcgccgcctctgatgtgaagccgcctgaccggagcgatggcgtgatggaaagccactccaagccaagtgttgtcacctacaatgccaagaaagagttgactagtggcaacaccaagcctgctgtgccaaggccgccggttgcagaagacgtgccaatgtacctggtccccacctcgccgacgttctttgcgtcgtcgccttcgctggccaacgacgacgacgaggagcaagagcgcaaggcggcggacctcatggtcatgagctccatcaagaatctggaggacgaggcggccaggacgaggcaagaggtgtcg

SEQ ID NO: 28667 - DNA, 545 bp, Sorghum bicolor
  unsure (1)..(545): unsure at all n locations
  Clone ID: 7659076
gcacgaggggctgctgctgctaatgctgcatcaaaaggtgtacctgttgtcattgcaagtggatttgcaacggatagcatcattaaagttctcaaaggagaaaagattggtacacttttccacaatgaagcaaatttgtgggaatgttccaaggaagctacagcccgagagatggcagttgcggcaagagactgttcgagacgtctacagaagttgtcatcagatgaacgcaaaaagattttgctagatattgctgatgctctggaagcaaatgagggtgcaattaggtctgaaaatgaagccgatgttgaggcagcacaaggtgctggttatgaaaagtcgttggttgctaggatgaccctaaagccaggaaagataacaaaccttgcaagatccattcgtgccattgctgacatggaggaccctatttcccatacattgaaaagaacagaggttgctaaagatctggtttttgagaaagcatattgcccattgngtgttctgctcattatttttgagtctcgtcctgatgcattggtccagat

SEQ ID NO: 28668 - DNA, 550 bp, Sorghum bicolor
  Clone ID: 7659099
gcacgaggatttgaaactgaccggccctacacgttctgttgtggtgttggaccctgcgacctttgaggttgatctgaaagttaagggtactactgagtctgaggatcaatggttgagttttctagctgtaacttaccgccacttctctcggtttgactcgcaccttctggaaagggattatgctagcaagcttagcgaactacagtttcaacttggctctattatttattcagtggaggcaacaatcgaggtgcgaattactagtggatcatggccacatggtttacgagcccagtttactgccggtacagccagcatacctggtgcagaactcatcttactagattctggtgaccatggagtgccagttgctgaaattggaagacgtattgagctttcgcgttgtgttgcatctgttgaagttgatggcgagctgagggttcgtgtgaaggcatttctaggtgataagattgtggtaaacagagtgaaggcttttaagtctcgcacaactggtgtaagcaacgagagtcttagggttcacttcgacaga

SEQ ID NO: 28669 - DNA, 137 bp, Sorghum bicolor
  Clone ID: 7659100
gcacgaggcatccatttgttgcgcctgcttctagtgctaaagttgctcctttaggaggactggaattccaagctttggctgcttctggtcagatccctcctcaagctctggctgctttgcaggatgaactccttggt

SEQ ID NO: 28670 - DNA, 364 bp, Sorghum bicolor
  Clone ID: 7659105
gcacgaggctgtcgccgagctcgtgacgtctgtccaagctaagcaagaacactctcccctgccatctggagcagcttcttcccaatctgctcgcttcttcttcttcttcttcttcttcttcttcttcttcttcttcttcttccttcccccgtagtttcttgtaggcagcaactcttggattgagacagataagataatcgaggtatatatcccccgttgttgaattcgaattcctctcttggatttggatggttcctgcctgctgccttccgaatcctgccttgatctgtgtgagaggagctgtgccgcccgcaagctgccgatcgatcgatcgcaaagcaagttcctcggttgggttgtcagt

SEQ ID NO: 28671 - DNA, 589 bp, Sorghum bicolor
  unsure (1)..(589): unsure at all n locations
  Clone ID: 7659125
gcacgaggccggccctccccatccctacccatggcgctctcttcccacgccaccaccaccgccacggcggctgcggcggccgtcggcacctttccccaatccacccgctcctcctcgcggcgactccccgcgtcgtctgtctccccccggcccccgccgcccccgcgctccctgcgcctcgaccatgccgcggcgccgtccctctccgccgccgccaccgtgcccgcgcccgagggcctcctcgccgccgccatcgagcacctggagcgcgagccggcctccgtcgcggccgacgaggccccgctcgcggcgctgtccccgcgggagctgcagctggtgctcgtctacttcgcgcaggaggggcgcgacgcctactgcgcgctcgaggtcttcgactggctccgccgcgccaaccgcgtcgacggggagaccatggagctcatggccgccatcgcctgcggctggatcgagcgcctcgtgggggcaggcggggacgtcgctgacgttgccgcgctgctcggggagatggactgcgtcnggctgcgccccgggttcagcctcgtggagaaggccgtcgcgctctactggg

SEQ ID NO: 28672 - DNA, 557 bp, Sorghum bicolor
  Clone ID: 7659134
gcacgaggcaacgcaccggccggcaagcatcagcagatcatcatcacgcagatcgatcgaactcgaaccccaaaggccactagctagctagcgcaactcgatcgatcgaaacaatggcgcaccatttcctgggcagcaagcaccatggcggtgaggcgtccaaggtgaccgactggcgcaaggaggagaagcaccacaagcacatggagcagctcggccagctcggcgccgtcgccgcaggagcctacgccgtgcacgagaagcacaaggcgaagaaggacccggagcacgcgcacccgcacaagatcaaggaaggggtcgccgccgccgtcgccgtgggcagcgccggctttgccttccacgaacaccaccagaagaaagacgccaagaagcaccgccgccacggacaccaccactagttattattgactagtttcatttaccaggcgcgggtgccaaactcgttcatatatatgttaccgccgatttatatagtatagtattttttagtatagaaataaatggggtctccaatatatatgtatatatatcattgt

SEQ ID NO: 28673 - DNA, 583 bp, Sorghum bicolor
  Clone ID: 7659136
gcacgaggacaaaacaaaacagcctttgtcacttgtcactcccccgctcggttccaagagtgagtgagagagagagagagagagtccaaccaacgccacacgagatcctcgcccagccggcgacggcggcgaccaccatgggagaagcagccgcggatccagcgccggcggcggcgaaggggagggtggcgccaccgatgtcgtggcggacgcggctctccgtgctggccgcggggtacctcaccgacgccacgcgccgcgccgacggcaccgtcaaccgccgcctgctcgccgtgctcgacaagcccgtcgcggcgtccgctaccccgcgcaacggcgtcgcctcgcgggacgtcaccatcgaccctgccctgcccctccgcgcccgcctcttctacccctgcgctcctgctcccgccgacgccgcggaggcggcggcggtgcccgtcgtcgtgttcttccacggcggcgggttcgcgtacctctccgcggcgtccctggcctacgacgccgcgtgccgccgtatcgccaggtacgccggcgcggccgtgctgtccgtcgactaccgccgctcgcccgagca

SEQ ID NO: 28674 - DNA, 137 bp, Sorghum bicolor
  Clone ID: 7659141
gcacgaggcaccaacgttcgaagcaaagcaatcagcctgagcaaagcaggagcagagcaaacgatccagcggcgttttctcattcggcgcggcaggcgcaatggcggcggggaaggcggcgatgaagaagccgtcgt

SEQ ID NO: 28675 - DNA, 598 bp, Sorghum bicolor
  Clone ID: 7659146
gcacgaggattgatagcaacatcatcagatgataaccataaaaaatgtacaaactgtaagctcgttagatgacaaacatggagcatcagaaacagtctcacattgtatattggagttattgctggttcagtagctcttagcttctgtagtattctgtagaagaaagcaaaacataggaactgcaaaggcttccagtctgcattgcccataatagctatccaaacaacctgtatgtaaagtgtagataaatatattttcgaggaatacaacatatcgacagtgataaggatatgcgcaaagccttattcgagatagaacaaaaaggttaaaaactactacatccagtccatcatacatattattcaaggtacgagcgtatgagtatattgcatacacagttccaaaagataaatgcctttcgtattttaacatgtttgccctcttaaaatgaactatggaaaatatacgatgtggtgaaaacagtgctgcagtcacttggcccaaatccattacgcaaaattgatatttgttttggactcgagttagtagtttttttaacaactttacagattaaatatgagtaataaagcatgaaatc

SEQ ID NO: 28676 - DNA, 516 bp, Sorghum bicolor
  Clone ID: 7659163
gctcgccttcatcaccggccagacgcgcagcctctcctgcgacccgattccagattcaccgcttcgttcagagcttgcacgtggcactgatgatgagaagttcatcgaaggaaatcagtcgcagaagtcataacctagcgatctggtacctgaatttcaacgttctggtactcgccaaggagtcaaggctagaaccttaagctatgatgatctggtacctgaatttcaacgagctgatggtcgccgagaaatcaaggctagtaccttgagctatgaagatgaacttttccgcaaatttaagacaggcagtgcagtccctgaaattcagccagtaaatcagacgccattgcatactcataatcaggaaactgtgagtaagaatacaagccacgctggagtgaatacaagtcatgatggagttagtaagaatactagtcatgatggagtggcaagtgtccaatctagcagagaagtggaaataagacctaggtctgcacctccaagccagtcaaccga

SEQ ID NO: 28677 - DNA, 502 bp, Sorghum bicolor
  Clone ID: 7659203
gcacgaggcctccttgcgcttgcccacaccacctcgctcagccggaagacccgcacacgcacgccacttgtacaccatggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgg

SEQ ID NO: 28678 - DNA, 592 bp, Sorghum bicolor
  Clone ID: 7659225
ttctcgccgacgaggagccccaggtcctcgccaccgccgtgttcgccttcctacgactcctctccaggaaccgcctcgctccggccgcaggcagcgtcgagtgcaaggactgcgaggagtgcaatggtgccaagaatctgcaagaatgcaggggaaggcttgtgtctttctgcgtctccgtgctgcgggatcacttccaagtgtgcgcactgctcggaagggaccttgtgaggtcgctccacgagctggcgctcgtgcccgagttccagctgctgtggagagacttgattcttgaccgtgctgccgacgtctgtcggattggcacaccccggtggtgcacggcggtggccatcacgtcggagatggagacacagctcttgttcatgatgaacaatgtgaagtggggcgatcagaagaggtaccagctgtggttcgcaaggaagcacctgatggtgcctggaggggaggagaggatccctgacattgtgcggttcatatgctgcgggtaccacccgaccaatgaggtcatgcaatctggtgtcattgctcgctgggcggtcgtaggttggttgcttacgagttgcagcaaggg

SEQ ID NO: 28679 - DNA, 535 bp, Sorghum bicolor
  Clone ID: 7659234
caaatatctgctgaagagtggcttgcaaaagtatttagatcatctacgtttcaacttaattggatatggctgtacaacatgcattggtaactctggggagcttgatgaagatgttgctaaggcagttactgacaacgatatcattgctgctgcagtactctctggtaacaggaacttcgaagggcgaattcatgcattggttcgggccaattaccttgcctcccctcctctggttgtggcctatgcccttgctggcactgttgatattgattttgagacggaaccaattgggaaaggaaaaaatggaaaagatgtgtacttcaaggacatatggccatcaaatgaagaaattgcagaggttgagcaatcaagtgtgctgcctgacatgttcaggagcacctatgaagcaatcacacaaggcaacccaatgtggaaccagctgtcagttcccaaggcaaagcgcttcccatgggaccccagttccacctacattcatgatcctccgttcttcaaggatattacaccgactccgcca

SEQ ID NO: 28680 - DNA, 564 bp, Sorghum bicolor
  Clone ID: 7659273
gatggagaaactagcggcaggtacatcagaccaagcacaagaagcgtccgcaggccaccagacgacggccaccgcgccaccaccgtcggctcgcgtcgtcaagaacttcctctcgatgatggacgtcgaaggcccatcgagaggtggcggcagccggcgcacggagcacggtgcgcccaggctccgccagctcctgagctcaggaggccctctggcggctgacgccgtggccgcgagctgatccgcgtccgtccttccctttgtgctgagcgcgtgcacgcgtgtggcctggcgattttttttgaagagcgcccaagctgccccgcgagactaaacgcacgcacgacctgtaaattacagtagctatatgtgttccatgttccagacggggcatcgttccggccactctgctgtgagaaccgagatatggatgccgtctggctgtgttggtgttttgttcactgagcttttgactccgtgttgtttccagttgctgcgccgatgcaaactgaatcaactgacacgatgtagcattactaataataaccaacgcgatgtttactc

SEQ ID NO: 28681 - DNA, 663 bp, Sorghum bicolor
  Clone ID: 7659289
aaggacaagagagaggtgaagaaaattttggaagcaggcataaggaatgtgaaatatgggttaatctttggcttgccctgttacctgcgagccagtttcttgattgacatttacaggcgcataaggaatgtgaaatatgggttaatctttgacttgccctgttacctgcatgccagtttctaattgatatttacagaggcacatccaacaaagattgcactactcgttcagataccaacctctttggtctatagtacctggcatggatttactgcctggttaacctatgaagcagttgaatttgtgtgtgaagggattatttcactggtggtatgttcatctaaagggatggttacatttatctcaaggatgaaatttgtgcttctcatgactcgatttcccatcagttcaaaatattgataattggaatacagcagaaaaataggtctttgtgcaaatttttcaccatccataattgaaaactgtgatgactgataagcttttcgatgcttcaagttgaagttacacaacataataagattctgtcagcgaggcgttcagatccaatgtttggctgtgttaaaaaatggtatgcatagcatcttggtgaaactgatttttttttgtattatactattatttctttatatattgaaaagttct

SEQ ID NO: 28682 - DNA, 154 bp, Sorghum bicolor
  Clone ID: 7659316
ggtccctttaggatgggatccaaattgggtagtgtgtccagtttaactgccaccccttgttagtcaccagttaattactagttttaggtagtgttgaaagcattcatggaacaagtggggggtaaagtgctttggaaatttttgttaactttgg

SEQ ID NO: 28683 - DNA, 366 bp, Sorghum bicolor
  Clone ID: 7659343
ggagatttacgctcgcctgtgccgatccaccctctttgatgccggcacaaaggaattctggattctgaaggacaagggaggtctttgcatcagtctatcatcaaaggcaatgactattactgggatagatgatcggaggtactggagccaccttgccacagaggaatcaagattccatagtgttgcctatcttcagcacatttggtggcttgaggtatatggggagcttgagttctgctttcctgctggtgcctacagccttttttttcatcttcacctgggccggccctataggcgcatgggtcgtaggctttgtggaactgagcatgtgcatgggtgggatgtcacgcccacgcggttccaact

SEQ ID NO: 28684 - DNA, 418 bp, Sorghum bicolor
  Clone ID: 7659390
aaagatgttcaagggtggggcatgaatgatagaggagtctcatatacctttggcgctgacaaggtttcacaattcttgcaaaagcatgatcttgatcttatttgtcgtgctcaccaagttgttgaagatgggtatgaattctttgctgacagacagcttgtcaccatattctcggcccccaattattgtggtgaatttgataatgctggtgcaatgatgagtgttgatgaaactttgatgtgttcgctccaaattctgaagcctgctgagagaaaaaacaaatttatggggtcaaacaaaatgtgatagtgaaagcaattttgcttccagcagatctgaggctctcctgtggatgcataacgacaacagcatgctggcgccaagcttgagggcagcattgggctactaccagagaaac

SEQ ID NO: 28685 - DNA, 107 bp, Sorghum bicolor
  Clone ID: 7659405
cgcagctgaggaccaatatgcatagcagaggctaaagatcagagatagaaattgaagacttctgagcaattatactttggggaaataagtgtgtagtaaagtgttgg

SEQ ID NO: 28686 - DNA, 474 bp, Sorghum bicolor
  Clone ID: 7659407
tttgtcgtatcagactttgatgagcccatcaaactcaagttttcaatgatgcagatcgattgcacacataccaaaggtggcttgtgcgttgattctgtgtttatatatcctaaagggtacaagcctgagaaggcgagcatagtcgacacatagttcgcaaagttggccttgtagctttcctgcaagatgaaacaagaggcaattcaaatgtggatggctagccttttttctggccatccttacctgaaagcccattgtatattctttttgtttttttttccttttattctgatagttttgcatgaatgtaaagccttttttttttggtagtgttagttaaacaggtggagaataggggagttaagtgagactcgagtcattgagtgcagtgttagctcaaaagaggcggtagattgccatctgcatctgtaattttcatccctataataatgatgtacggcgagctggattgtt

SEQ ID NO: 28687 - DNA, 164 bp, Sorghum bicolor
  Clone ID: 7659416
tggaattggggttttttgaaacaagtttcaaaggtttttgtcccccagcccatgtttaaaaactttgcaaaacaaatgttacagggtttatgcgatgtttcagttagtaaattattttgcgccccaggcacccttgtttttatttgcctaagatcaactaaaaa

SEQ ID NO: 28688 - DNA, 523 bp, Sorghum bicolor
  Clone ID: 7659430
gagaagccaaataatatcatacctaactgttggtctggaagttactcttcatggcaagtgcctgaatttttttcccctttcctgttactgtgtgtcacaacaattatgtagctgtagatatattgattatggaaggatgaagttgccaaattgacctgaggcgatttccttctccagccaggaaaaattctgaacatcaaggagtttctgtttgcaagtttcactatttaaaagcagtcgtgtcactagtgaggaggtaaggactgggccgaggcagtattatcagtttcttggatatggattgttgtgctagtttcgatagaggtgtcaaacatcaattaggatgaagaggtgagcaacattcaaggaggtgttgatgcttgctgacaaccttagaaaaggcgttcctgtagctgaccacttggtttgtcggtcagacaattctagacgtgaattttgatctgttggccagatgccaaataggtatttcgtatctcttgatttatgggattagcatttactc

SEQ ID NO: 28689 - DNA, 527 bp, Sorghum bicolor
  Clone ID: 7659497
gcacgaggcacccctctccacctccgacgaccaccaccaccatggcggccgcctccctcgcgcgtctctcccgccgcgccaccgcctccgcctccgcggcggcgccgtccctccggcgcctcctctcggccacctccaccgcccccgccgcggcatccgccccgccgccgcccccgagcgcggccgccgccgcggccgtgggcgcggatcgggtgcggtgggactaccgcgggcagcggcagctcgtgccgctgggacagtggatgcccaaggtggccgtggacgcgtacgtcgcccctgaggccgtgctcgccggccaggtcaccgtccacgacggcgcctccgtctggagcggcgccgtcctgcggggggatctcaacaagatcacgctcggcttctgcgccaacgtccaggagcgatgcgtgctccatgccgcatgggcggcgcccacagggcttccagctgagacacttggtgaccggtacgtgacagtgggtgcctactgtctgctgcgctcttgcaccatc

SEQ ID NO: 28690 - DNA, 504 bp, Sorghum bicolor
  Clone ID: 7659500
gcacagggcaaagagcaaaccagacaagcagcccaacccccgcacctcaggcccaggcagactcgtcgatcgcggcgagagcacgagatggcgatgcggaccgcgctgacctccctccccgcgcgcctgcgcgcccccgcggccccctcctcggcggcggcgaccggcggcggcctgcgcctcctcagcgacgggaagggccgcgtgctcagcgaggaggagcgcgccaaggagaccgtctacatccagaagatggagaaggagcggcaggagaagctcaagaagcagctcgagcaggagaagcccggcgccgacaaggccaagcccgccgacgccgacaagaaggccgagggatctacctaggattgaaatggcgctgatggaaggcaatcctgtttcgcatgcatccgatggacagctttgtttgtacatgtccagcgatggaagaataaattctgtaaaacgttaatggcactggatatgctgtgttttcggttggttgca

SEQ ID NO: 28691 - DNA, 479 bp, Sorghum bicolor
  Clone ID: 7659597
tacacagcttcgtacgttgccgctgccgccgcggccagcagtggtggcggccaccaccatcaccatcatcaccatggacatcatggaggcggcggatccggtggtggcggacacagcggcggccatcatggaggcggatgtggcggcggcggcggccatggtgaaggcggatgtggcggtggcggcggccatggtggaggcggatgtggcggtggcggtggcggcggcggcggatgtggtggtggtggcggctgttagattggatttatgcatgcggctagttactcctagttgccataatagtcgcgttatcttgttatgcaccgtcagtcatattaggaatatcgtttgttattagattgttgagtcgttgtgtggatgctctgctaatttagtgtcagaagcatttgtttttgtccatcacaaattcatgtcatggccgaaaacgtttagcaaatcataatgttttttttcgtatt

SEQ ID NO: 28692 - DNA, 518 bp, Sorghum bicolor
  Clone ID: 7659598
cgacaactgcgagttcagggtcatgcagctgggccccggcggcgagtactccctcctcgtgcaccacaccaaggaggagctccagcagtgggggatgtcgccggagatgatcgccgaccagcagtggcgcgcgtcggccaaccgacgcagctgggccgaggagtgctcctctttcatcgacaccttcttcgaggagcccaacgactcgtccgagacctcatcctcggacgacgaagaaccagtggacaaggagaatggcaagaccaagctgctcgagtaactataacaactgttcatccacccattcactcgcatccttcttcctctcttgcttctttgaaattctttccattggattggatgacgatttctgctactagtagatgatttgaggagcagagcagagcagtgatggtgtattcagccattgctgatctctttctttctcaacagtcaacaaacagtctgtaacatgttcataattatagctattagctagaatgattgaatttgggggc

SEQ ID NO: 28693 - DNA, 252 bp, Sorghum bicolor
  Clone ID: 7659606
aaaagtagactccccattcccccttccatggggtatgggagcaaaagagtgggccaaatacctcaaaactcaactctcatcttcgatgtggagctggtgaacgtaaaatgaagtgaggaccagatcacttgaagacccatgagtaactgcggcagtttcacaaattttgcagcacagttatttgtttgggcaatgctgtttaatagatagggacttgttaagtggattcatctctaccgttatcgtacattg

SEQ ID NO: 28694 - DNA, 416 bp, Sorghum bicolor
  Clone ID: 7659693
aggccttcctcggtaagcagcagcagcagcagcagcacaagaaggccagggtctcccctccctctgacgcaatggaagaggactgatcgatcgtccggctgctctagtcctgctctgtgaactttgtgtgcatgcttgctcgctcgctcgctctgtgttaactactgttcatgctagtagttgttgactttgatgttagtagcaatttaatcttattgtgtatggatggtaaattgaactgaacaagggggtttggggcaaaggatgtaggtgtagggatatggcaagggggaaggacgaggttttaattagaaattagaaaagtctcagttgtaatcagtgaattactcgtgttatgaattatgaacttatgatgagctgctgctgctgttatactgaaacactgcagcttgttc

SEQ ID NO: 28695 - DNA, 627 bp, Sorghum bicolor
  Clone ID: 7659694
cgtctccaccgccccgcagggcaccccggggtacgtggatccagagtaccaccagtgctaccagctgacggacaggagcgacgtgtacagcttcggcgtcgtgctcgtggagctcatctcgtcgaagcccgccgtggacgtgacccgcgaccgcagcgagatcaacctggccggcatggccatccacaagatccagcagtgccagctggagcagctggtggacctcgacctcgggtacggctccgacgaggcgacgaggaaggcgatgacgatggtcgccgagctggcgttccggtgcctgcagcagaacggcgagatgcggccgccgatcaaggaggtgctcgacgcccttaggagcatccaggaggacgggttcgggaagaagggagatgcgctcatcgcgccgcgctcgcctgacaccgtgcacgctccgtgggatagcatgagtacaacccccagtattagccaatgacaataataagcaccttgacgagtagtcacggtagtacgacaagatccgtggcccaaagatgtcatgacttgatgggtgtcattttgttgagatctaaagtgctcccgatcgatatatgtagaaatagaatagagattttggccttttggtggtgt

SEQ ID NO: 28696 - DNA, 158 bp, Sorghum bicolor
  Clone ID: 7659698
atgccgcccttccactttatcaaaaacggcgaaacggtggagactattgtcggtgccaggaaggacgagctcctggccctgatccaaaagcaaaccgggtccgggtccgggtaaaaaaaaagtcagttgttgtcaataaagggccagcgcattgcatg

SEQ ID NO: 28697 - DNA, 314 bp, Sorghum bicolor
  Clone ID: 7659771
gcacgaggagcaactccgtcccgcacccgcgccgctccggtaggacccccgacccgaccacccgcgaaaaccacagcgccgcacatgcagcgcctcgcctcctcccggaggctcctccaggcggcgctcgtccccgcccgggccaactccagcctctccgcggccgccgtcgccgcgcccgcgccagagaatggcgccgacgccgtccccaagatgccggccttcgactacacgccgccgccgtacgacgggccgcgcgccgacgagatcttccggaagcgggctcagttcctcagcccgtccctcttccactt

SEQ ID NO: 28698 - DNA, 420 bp, Sorghum bicolor
  Clone ID: 7659778
gcacgagggagatttccatcccttccgatttcccattccctccctccatatcccgcatccgtctatggcggctgcactgggcgccgtggtccggcggctgcacacggcggcggcgcagcccccgcgcctgacgaagttcgcgctgcacccgcccaaatccgttgaaatcgaattcgctgatggtagttcatttcatctgtcagcagaatttctcagagtatacagcccagcagctgatagcaaaatccgttcagtgggtggtgaaaaggttatctttgggcgacaacatgttgggataatgtcagctgaatcagtaggaaactacggagtccggatactctttgatgacttgcacaagacagggatcttcacatgggattacttgcaccacctgggttctaacaaatttggtctgatgag

SEQ ID NO: 28699 - DNA, 491 bp, Sorghum bicolor
  Clone ID: 7659790
gcacgaggcagagccggatcagtggtggaacttgtggtgatggactgcaagggaatcaaacagtatgacctcctaaagttcggtcaaggatggatgaagcttgaaaaatttgagtttcagatcagcaattgctggtcatcagggactccttctaactcttcttattatgctcaccacccgtataaatatgatctcagttgtgaaaatctgaaggatttgaggttggcgcatatagatatagctatgcggatgttggggcatattgtagctgtgccacatattggactccattttcttttgaggaagtgcaaagcattggagaaactttgcctgcactatgttactggcttagagaagagcgatatgattgcactgttccagaactgcagcacccttagaagcttcacactccacgaattgcctacgctgaggatgccactgactgatgaaagccttgtggttctaggtcgcagctgccctatgcttgaggt

SEQ ID NO: 28700 - DNA, 528 bp, Sorghum bicolor
  Clone ID: 7659792
tttcagtatcaaggcccttgagtgccccacaagtccctgcggcgaaacaaagtgcaccagtcacttcaacagctccgaatgcacctcttctttctcgttcaatgagtgctgttgggcggttgggaaatgaaccctctgccagtgctcctagtttcattccccggtcacgaacatatcgcaatgccatgatggagaaaagttctggtggtggaagcagtttcacacatcagcaaggttcgtccgagcaagcagttacaccattgcaatcgatttttacatcgcaaccttccattccgtcatcagagaccttgtctaggaaagaggaaacatcattgagacctgggtttacatttggaactgtaaagcccgagtcactgaacccatatcagggcagagaagatacctcacaacaagcgagcagcagcagcagcagcagtagtgattgtatgccatcgaattcgaacatcagaagcgagattgcgaagctcaatttgaatggaagatcacgaagcaagcaactgttgtcag

SEQ ID NO: 28701 - DNA, 458 bp, Sorghum bicolor
  Clone ID: 7659797
gcacgagggctgcccgaggggatcagggtggcgctcgtcactttcgctgcgtccgtgtgggtgcacgatcttggatttgagggttgcgctcgggtggttgtgctcaatggcgagcgtgagctcgagtctgacaagatacaagaactacttggtgttcaccgttcaccgtacaagaagttggctatgccaaggtccactgaagcgcagcggtttttgctgcctgtttctgaatgtgaatttaacatcacatctgcaatagaggacctgggctccatgtctgcatgtccacgtgggcatcgccctttaagagcaactggcgcagcgatttccaccgctattgctcttctagagggttgctgctcacctagtaccggtggtcggattatggtctttacatctggtcctgcaacagttggtccagggtgtgtggtggaaactgatcttgggaaagcaattcg

SEQ ID NO: 28702 - DNA, 482 bp, Sorghum bicolor
  Clone ID: 7659800
gcacgagggataatcttccttccccccaatccccccccccgcgcgcgatctcgggaaccatgcatggcgaggccttccgcttctgcagcggcggccgcgctccgtgcctgcctcggcgtcgccttcgccttcgcgctgctgctcctgctcccctcctccggcctcccgcgccgcgccctgtccgccgacgagagctgccacgacgtcgcgcccgggtctgacggtgaccgcggcggcggcggcgggtacgtcgactacctgtacctcttctactgcgtcctcggcggcggccgccggcccttcctcgggtacgccgcgctagcggcgtggctcgccgtgctcttctacctgctcgccgacaccgccgcggtctacttctgcgccagcctcgagggcctcgcgcgcctgctcggcctcccgccggccatcgccggggccacgctcctctcgctcggcaacggcgcgcccgacgcgctctccga

SEQ ID NO: 28703 - DNA, 438 bp, Sorghum bicolor
  Clone ID: 7659840
gcacgaggggagcttcggcgtggtgctgtacgagatcctgacggggcggcggtcgctggaccggaacaagccggcggcggagcagaagctgctggagtgggtggtccagttcccgccggacagccgcaacttccggaagatcatggaccccaggctccgcggggagtactcggtgaaggccgcccgggagatcgccaagctggccgacagctgcctgctcaagaacgccaaggagcggcccaccatgagcgaggtggtcgaggtcctcatgcgggccgtgcaggcgcacgccgagcctgacagccggactcccggcggccccggcgccaaggggaagaaatcatccgacgctgccacaccgtccaggcggtgattggtacgtgtcgtcaccggtgaaggcgctagtgccttgctccgtatttctgaaattgggtagtc

SEQ ID NO: 28704 - DNA, 535 bp, Sorghum bicolor
  Clone ID: 7659855
cacggacccctccgccccaccaacccggttcctcggcgcgtggctcgccggcgggttcgccatgagcgtggcgtgggcgtacgtgatcgccaacgaggtcctgtcgctgctggtctccgccgggaccatcctttccgtggattcggcggcgctgggggtcaccgtgctcgcctggggaaactccgtcagcgacctggtagcgaacgtggcggtggcatcccgcggcggcggcgcgcaggtggctgtgtccggctgctacggcgggccggtgttcaacgtcctcgtgggcctgggcctgtccatgttgctgtcgtgctggagcgggtacccgcggcccgtggagataccaagggagcccgggctctaccggacgctggcctttgtggcttctgggcttttgtgggccgtggtgatgctacctaggagaggaatgagggtggacaggacgctgggctttgggctcctcgtcatatacttttgcttcctctgtattaatatttcacagcttaagaatgcacgataacatattgggttt

SEQ ID NO: 28705 - DNA, 508 bp, Sorghum bicolor
  Clone ID: 7659864
gggccagaggtgtagtaatgctactcgcctaggagagagacatccttatttagacttgttcagatctgcggtttcttgtatcacttatgctgtattgtgttgaacatgtggtgctttgcttccaatgacctgcatgtattatgagtgagacagattagaaacgtagaggttttactgcgttactcagtggattttgttgaagtcgaattgttaggttcagaggcgtgtttttatctcagtagcatatgtatgggtatactcaaagtgtgttgcatctgcaagtgctaagctatcagagctttgtgcagaacaaaattattttgggtcattggtaatgggaatttactctgaaatgaatttaattggcttatgtttgaaggaaagaaaagtataataatgtactcctccgtcccatcgaaagtgccgtttttgtgagacccacagatttgtcggaaagaggttattgataagaaatgtatgtaatgtacctgaatttctgtttgttgtc

SEQ ID NO: 28706 - DNA, 564 bp, Sorghum bicolor
  Clone ID: 7659911
aacatgttgggataatgtcagctgaatcagtaggaaactacggagtccggatactctttgatgacttgcacaagacagggatcttcacatgggattacttgcaccacctgggttctaacaaatttggtctgatgagaaattacatcagaactctgagaaagcacggtcttagtcgcgatccccagagaaggaaatgacatagcaacagtctctagacgaccttgcctcttgacgcatgagctgctccatcaggcctgcctgccatgtaacgaagctgttcagttgagcatttgagatgttaagacacaacgcaaggataccattaactagtgaccaacagtaaccatgatacaaaggagtgatgaaagtacaaaaacgttcatatactggagttgattgactagttggaaactggaactggacaagtatcctgtcaggcgccttcaatcctcatgatgtatgatgtttttctttcctctttgtgaaggaacaatgggtgcttactatgttttggtcgggtgtacaataaatatgcatcgtttacttgtttattagtagaggctt

SEQ ID NO: 28707 - DNA, 262 bp, Sorghum bicolor
  Clone ID: 7659922
agcccggcaatgggagtcccactcctacccaaaagtgggcgctcatgctgtgtttttgagcatgcagcatgtccatgtgcgtgagggcagtactgcaccggcagtggattgcaggactaaaggagccagcgtgttttgtgtgtcacaagtcgcaagttgttgggttgtttttttcagcagacagcacgaagccagcaaccagtagatagttcccccccagtccaataatgcatgcttgcttgctagtgtaatgctactagct

SEQ ID NO: 28708 - DNA, 532 bp, Sorghum bicolor
  Clone ID: 7659936
gcacgagggtttgccaaaggttagaacatagcttggagattctaggtgtcagtgcaatagaagatcgcctccaggatggggtaccagaaactatcgaaatactgaggcagtcaggaatcaacttctggatgttaactggtgataaacaaagtactgccattcaaattgctctattgtgcaacttgatttcttcagaacctaaagggcagctcttgcatatcgatgggaaaactcaagatgaagttgctagaagcttggaaagagttcttcttaccatgaggattacgtcatcagagcctaaggagctggcttttgtagtggatggctgggcactagagattattctgtcacactatactgaagcttttactgaactagcagttctttcaaaaactgcattatgctgtcgtgttacaccttcacaaaaagctcagctagtgaagcttctaaagtcatgtgactatcgaactttggcaatcggtgatggtgggaatgatgtaaggatgatacaacaggctgacattggtgtagg

SEQ ID NO: 28709 - DNA, 551 bp, Sorghum bicolor
  Clone ID: 7659983
gcacgaggcggacactcatcacctgccatctctgatctctccctctcactctcagcgcttctgcgtcagcagcgcgcgtaccatcaatttgcccaatctgccatctccagtccacgttccccaatccgtctccgatggacctgtctcccagctcgccgtcgccgtcctccgtgccggtgccgtgccagtggtccggcgccgcggcgtgcggcctggccggcagggtgttgtgcgccgtcgccacctgcgtcttcgccgccgtggggtcgctggtcggggcggtgacggggtccatggtggggctggcgacggagagcgggatgctgcgcggcgccggcatcggcgccatctccggcgccgtcttctccatcgaggtcgccgagtcgtcacgcgacctctggcactcggccgactccggcgtctggtccctcctctacatggtggacatcatctcgggtctcctgagcggcaggctggtccgggagaaggtggggccggcggttcagagcgccgtgcagagtcagatcagcgccatcagctcgccgttcgag

SEQ ID NO: 28710 - DNA, 219 bp, Sorghum bicolor
  Clone ID: 7659986
ccgtcgtgtggctgctgccgccgctctgttcctcgcaaccattctacggctccgcccgcgctccacgcgcaacaagtacaggctaccaccgggcccccgggcgtggccggtgatcggcaacctgaacctgatcggccggctccctcaccgctccatccacgagctctccaagaggtatggcccgctcatgtccctgcggttcggactccttccccgtcg

SEQ ID NO: 28711 - DNA, 509 bp, Sorghum bicolor
  Clone ID: 7660001
gcacgagggccgaacgacacaggtggagcgtggtccactccccgcgcgcgcgcgcgcttcgcctccgttgaaaccgcgcctctgctggggcgagtgttctggaagcttccaaaccctagggcgggacatcgactgagacagggagagggaggccgcggagcctaggactcgccgcccgcggggatcgagggagtgatgcgcggatcggggcggcgggcgcggcgcggaagctcggccgcatgaggtgcctcgtcggcggcggcggcgtccaggacagcccgcgtggagcggccaagagggtatcgccggcgtcgtggcggctggacaccgccgcggcggaggcggacgccgggggagcggcggcagcggccaaggggcccaggctctgcttcaggccgcgggacgtcatggagacggtgcacgaggtggccatttacatccaccgcttccacaacctcgatctgttccagcaaggatggtatcagatgaagattagtgcaatgtgggag

SEQ ID NO: 28712 - DNA, 601 bp, Sorghum bicolor
  Clone ID: 7660017
cgccgtgcagagtcagatcagcgccatcagctcgccgttcgaggagacgagcgacctgttcgagaccggcagcgtcaggggcctccccgaggacgcggtgcgccggctgccggagacggtgatcgcggcggacaccgccgtggacgcggcgggccaggcgctgtgctgctcggtgtgcctgcaggacttccgggtgggcgagcccgcgcggaggctgccggggtgccgccacctcttccacgtgccctgcatcgactgctggctcgtcaggcacggatcctgcccgctgtgccggcgagacatctgaactgatcgccggccgatggtcaggcacggctccaggcctcctgccttccggctgtgccggcaagatatctgaattgaccgccggcggtcgtctcgctcgatctgccagccgccgtcgaagatcgggtgtgttagtgttgctttggacgagacggtggcctcggttagtggactagggtttgtaggtcggcacctgatgcccgtaagggaaatggtgtgctctgttaatgaaaattgaaaagaaagcagcccccctaaaagaatttaagaatggaaaaaaagattatatgtatgt

SEQ ID NO: 28713 - DNA, 577 bp, Sorghum bicolor
  Clone ID: 7660027
tggcgacgacgacgacgacgacggtaacgctgagtataacggagtttctgccgtacagctagagagaaggctccacgagcttctccatgaaagaaaccgggacaggattgaggagctggaagctgcgctgcggtgtgcggagcagaagctcgttgagaaagaaatggaggtgtccttgtggaaagacacggctaagtttgcactgagagaggacaaggagctgcagtgacagtgagcatcaaagttcgcccgctctgtttcagtcatacaactcttttgcgcacgattcatcggctgtacatgatcacggccgaaggaggattttgggcaaacaaggtttgccatggcgaactggagaatggatctctgtggaagatatagtgaacctgttcataccaaagtttagtgttagcatattagatctccagagaacgttttgggttccggtaaaatcagtagaatactgtgtaacagtgtaagttagcctcactggtgtacggatccatatacgagattggatactgcatgtttctgcttgcgcagcccatgacatggatggatcatgtattcatgtggt

SEQ ID NO: 28714 - DNA, 442 bp, Sorghum bicolor
  Clone ID: 7660041
tcgagcgcgccgccgccgccgacggccagcgccagcggtccatggcgctcaacagcgagggcctcgagggtcttgttcctcgggcaaagttactactatcacttggcggtaccttctttctggcatttgggcccctgattcttgtgaccgtttctctttttgctggtttatatgtgtactttggaccgagttttgtacatgatgcaagcaagacaccggtgtcggtgccaccatacattgatccatacgagctgcttgaggacgagaggctcagccgaccctccccagatgtgttctgaacctgaatagtgcaagaaccagtgcagaaatgtttacaagaaatagtcatacatagcccaacattctctttttttactagacgtgtagttgtaaatgcaactatagctgtagactgatataatcaaaaaaagcttcaatacgc

SEQ ID NO: 28715 - DNA, 378 bp, Sorghum bicolor
  Clone ID: 7660063
acctagggggatcaacatttttcagaaggccgagcgctcacgggggccaatgtaccccctgatgaatttggagtttcaactgagcccagataaagataatatgatgatagccagttccccagcgccagccaaaaataagagctttgtttacgagcctttgctttttgactccccgatggcatccaggagatcccttgccccattttcatttgacattttccatccagcacatttgagaacatttccccctagaaatatcaaagccaattgattttttttttggaccccagttaactcctaacagtatgatgtataccagaatgacaaagactagctgtcaactgaattagatatgttgcccagttttgttaattattt

SEQ ID NO: 28716 - DNA, 116 bp, Sorghum bicolor
  Clone ID: 7660081
ttttgccatttcagattttactcaaggttcaaaaaagtagtcagttccatgggtactcgttaaaagttccccattggtttttgttttcagcccattttatttccagttaatgattt

SEQ ID NO: 28717 - DNA, 528 bp, Sorghum bicolor
  Clone ID: 7660099
agctggataattataccaaccgcgatcgtatccaatgtgttacttccaaccatgctggcactgagaacagggttatctcaaggatattgtgcatcaattccagttatgatgtggttgatcctcatctctcgactccctttgatgatggaaggagtgtggagggaaggatttggctatacgaggatggaaccttcggttttggatttgttggcagtaattcaattatagatttgaggcacgtttcatcagctggttgtattcttgatacttaacattagatctggatcttgctggcacataattttttgccagcgagccccttgtacagtacttttaggaaaattcaatagttggtgtgaggcatgttgcctccgattgttgtactattgatgataaggtcagtaaatacgggtcccttttggcacataactgttgctagaatacccttgtaaaccaaactttggttcctttgggcatgtacttgttgatagaataccgatgtatactactatttgttcattgaattcc

SEQ ID NO: 28718 - DNA, 617 bp, Sorghum bicolor
  Clone ID: 7660104
tggttccccatgttgcgtgtaacatccaaataaagaagcctatttgcataattggtgggggtgatcttcctgatgacactgtactaacctgctcacgtggcttcgacaatgcattggagttcctatcaacatgcaagattgcaaacttgactattagagcagaacttggatgctgcttgctgcaccgaagcggtaaattgaccattcaggagtgtttgctgcagtgtgagcaaaaccctttggactatctgtcatttccaataatcagcacagcgatagagtacaattcatttccatccctcaaggagcaagggcatggtgtaactgttgttcgcacccggattgaagggggtgcgaaggctgtcaggacgaacggaacactcgcgctgcagcgcgtgcgggccatctattcccgtagctctgttttcttctggtttgaggtaggagaaaagtagaaccgtctgtacactagcaataaactctcgtgttcttgtatctcagtatctgtatcaccctagccgcctagcgtttggtaaattcagatggctgtctcctgtttgttgtaaccttataataactcactgttgtttgaatcaacaatgaaatttttttttttg

SEQ ID NO: 28719 - DNA, 587 bp, Sorghum bicolor
  Clone ID: 7660107
ggcacgaggcccgaacctgccgacggcgtgcaaggacaactcggcgccgctgctggacatggtcaccgcctgccacgacaagtccgggaaccggtggcccaacttcatcgccgtcgacttctacaagaggagcgaccgaggcggcgcggcggaggccacggacaaggccaacggcggcctcgtctgcggctgcgggagcatatcggcttgcaacgcgaacgggacgtgcactccgcggcacggcaggacgccgaaaggcatcttcaacgcctcgtccgacgcggcggcgtggaggtcgccgccgccgccggtgctgcagtggcagcggctcatcctgctaccgtgtctccttgctctccttctgggcctgtaaattctacgtattttgccgtgtacatacatagacggattggtttggttgcagccagcgagcgagcgtattttgttgtacatacagacagattggttgcagcctgtcagcagcttagtccacactagtctgtgtatgagacagggtgcacatatacagtagcataaacacaaacatcaaatgcggacagatgcgtttaaccatgttttgatcggcc

SEQ ID NO: 28720 - DNA, 476 bp, Sorghum bicolor
  Clone ID: 7660109
gggctccggcgacgacggcgcccccgtcgtcttcctcaagcacaacgtgatcgacgagtacgacgagcagtcggaggtggcggatcggctgcgcatcaagatcgtgccgctcttccacttctacaaggacggcgtgctggtggagtcgttcgcgacgagggacaaggagaggatcctcgccgccattcagaagtacacctcggccgagccagaaccagaaccagaaccagaagaagaagagcagtaggagtgattcaactccagtggcggagatcagtttcctcgagagggtgcagatagcctaggtatgtagaattggagataccatgcacagcagcacaggattatcgcatttggtaattgggatgtgtgagctaccaccagcagtatatatatcatgagtctggatcaatgtaccattatctgtaacacgagatgtatattattatctgaaccaaacgtgcgtccttatttgt

SEQ ID NO: 28721 - DNA, 148 bp, Sorghum bicolor
  Clone ID: 7660119
gggaccaaaacgggtacttgcgactttcagttgctttttaccctcgcttagtatggtaatcgtaatggtaggtgaaaaaaaaatatggtaatcgtaagggtgggtgaataagcttcccaggtgtgttcgtttgtgctactcccggctg

SEQ ID NO: 28722 - DNA, 127 bp, Sorghum bicolor
  Clone ID: 7660127
attgagttgaattgtcagtatccgtttcacccatcgacaatgttgttttggtgtttagaaaggaaagcccccctaggttttgtagcaaattgtcctttttgtaatcggggggtaacaaaaaattcac

SEQ ID NO: 28723 - DNA, 611 bp, Sorghum bicolor
  Clone ID: 7660128
ctcaaaagcctgcaatgcagttgtaaggaactcggaatgggagaattctcccaacctagctcagaaatcaggccttatctcaacactcatcagcacacatttctcctcagcagctcagaagcccccaccgcggccagccgatgtgaacataaactcggcagtgtaccctggtggcccacctgttccagtgcagaccccaaagctgctcaagtttgttgatccaacagagatgatgcgtgggccgcaggattcaccgggctactgggtggtttcaggtgcaaagctgaaccttgagagaggtaagatatcattgcgggtgaaatactcactgttgacagctatgatgtcagatgatgagtcacttgatgatgatgaattttagaacctggaacaaaagaaacctgtgtagctaacgttgaggatacagatgaagaatctaagatttccatagaatttgtgcatttgtctgatgttgtatgctttgtgtttttttaaaatgtaatagcatgaatgagttctctgttctgaatggagcgagaaaatttgttgtaacatttctttgtagcgtggcgcctagccatcagcattagatgatagatcaaaatatttgt

SEQ ID NO: 28724 - DNA, 498 bp, Sorghum bicolor
  Clone ID: 7660181
gcacgaggccgatccctctctcctttctctcctctctcccccctaccctcggcgccgccgccgccaccatccacctccgcccctccctgtcctctcctccctatgcagcctccacacggccatcgctcgagcaaggaagtggcgtggcctcgctacgcaggggagcgcgttgaggcacgcgagatcaaaaaacacgacagatcgggcgaaccttatcgggccccatggtggtcatggtctgcggaggagtaggcggcgctggctccttcctgccctctcctctccgcatagcctccatgctggcatgagcaccgtcgtcgcttgagcacgggaagccgaacaaactctagggcgcgagagagcagtgggatctatggcctgaatccatggtggcgctagggtcctcagcgtggtgatggagcttgacgtctcagcaacgaagcggtccagctgaggtacgctgcatttctttatctatcttcacttctctttcttacg

SEQ ID NO: 28725 - DNA, 179 bp, Sorghum bicolor
  Clone ID: 7660234
gaggagctcaaaaaggagggcctccagttccccagcaagatttgaaacgctccacgttccatgtacatttccgtgtcatcatttaggttgtttttttggagttttggtcatggttgcaatgttttgctacaaatgttcccgtgcaaacgtgactacatgaaaaatcggtttttttgaat

SEQ ID NO: 28726 - DNA, 415 bp, Sorghum bicolor
  Clone ID: 7660252
tattgagtcaaagatgcaagtcgacaagactagccaactgaagtttcttcttctttatgcttctacaggaaagaaaaatccatgaatcggctattcattttgaacctggatttctcggagccataatagccctagctggtcaacatattgtggaatgagacggtataatgactcatagactatgccaatgggcggttgactttagatatggagttgtggatgttattagtgtaaatattcttcatgtcttttgttgtggaacggggttaactcctatgagattttctatgcctcttctaattcgtgattttaggatggcgcaagatgtgtctatatcaggttctatatttgtctatcttgtgtttgattagttattgctacattctaagaagatattatatccattaaatgttcc

SEQ ID NO: 28727 - DNA, 434 bp, Sorghum bicolor
  Clone ID: 7660253
agggaggggcaggcaatgcgactgccggggggccatgaagcttggggcccaagataatataggtagcaggtgcatggacgatgacgtgcagcttgagaactcgtacgtaactatatatacgtgtgtggtgtaaatcgattccttgcggcagtagtggtggtcgatcatggcgctccgctgatgtcaacctccaatatcctgtgtaccgccgctagctgtactacgttactactattgcgtttctccaacgcgctatgtgtctcagtagtttcattatccatcaacagatacggatgggagatgtgtccaattcttgcttcgtggtcatgtttagtttgtcaaaacttttaggtttagctactataatattttcgtttaaatttgtaattattattcaaccatagaataactagtgttaaaagattcgtttcgtt

SEQ ID NO: 28728 - DNA, 317 bp, Sorghum bicolor
  unsure (1)..(317): unsure at all n locations
  Clone ID: 7660316
gcacgaggctcatcatcagcgtcattagtagaatccaaagagacatgtaaatcatattaggttgctagcttagctgcagctgtggttgcttctgtaattacgctagccagtagtttttgtgttggattagcagttccattttcgttcggatgccagaaaactgattcatacatattcgatgattctttggttcagacgatgtgtgtccggttattgcnnaaaaaaaaaaaaaaaaaaaaaaaaaaaaaaaaaaaaaaaaaaaaaaaaaaaaaaaaaaaaaaaaaaaaaaaaaaaaaaaaaaaaaaaccctcgaaact

SEQ ID NO: 28729 - DNA, 553 bp, Sorghum bicolor
  Clone ID: 7660376
gcacgagggcctctcggtctcccgcgctgccatggacgggggaagagagcagcaggcgccgccggaggggcagcccggtaagaacctcatcaagatcccgtcctatcaggaggtcttcggcaccggcgcctcctcctcttcctcgaagccggcctcctacaaccctcctctcgccagctccggcggcaccgccgccgccgccgcttcatcctcctcgtcgtcctcgggatcgttctcgcaggctttctccttcctcaagtcctccgagttctactcccctccgccgccgccgcctccccagcccaccaccaccaccccgaggccgcctcaggctagcccctcagcgccgacgcgccagagcaagaacgccattctcgtcagtcataggcagagagggaaccctctgctgaagcacatcaggaatgccaggtggacgttcgccgatgtcgtgccggactatgtgcttgggcagtcgtcatgtgccttgtacttaagtatcaggtaccatcttctacatccagactacttgtactatcggataagagagctgcag

SEQ ID NO: 28730 - DNA, 298 bp, Sorghum bicolor
  Clone ID: 7660383
gaaaggttttgatgtaaggtcagcccttaccgctgcttttgttaagtattcggagaagatccgcagccagggccccgatgcagcaaacgaggccggtgaaagtactagcagctcacccatggaagctgacagggcgagagactagattaccagtaggggtgttaacggtactggagaaatgctaagtttgtcccttcctgttaggtgcttgttgttgctgtacttgcagaaattttccaatgtatgttttccccttgtaactattgcccctcagaagcatggaaaatgtttagcccgt

SEQ ID NO: 28731 - DNA, 147 bp, Sorghum bicolor
  Clone ID: 7660396
gtcaggttgttttcccaagaccaaagcaaaatgccctcagctagttagttcatcaaagcaagatcgatccatccatacatgtgggggaatgaactagctagctagcgggtacttgatgtggtactagtgtagtgtaccccccccaca

SEQ ID NO: 28732 - DNA, 240 bp, Sorghum bicolor
  Clone ID: 7660404
aagggagaaaattgtcaactgtaaaaaaactgaaatttattgctaaagactctcgattttcagttgcttccccaagttatgtttgtaaaaatgatcatcttcccggggtaaaaaaactcggctactgatgctaaacatttttttgttcaagcagactgaacattttttcagctagcatcgcattattgtttttcaattggccccatcgttttcggaaaaaatcttcattagtagtttttg

SEQ ID NO: 28733 - DNA, 147 bp, Sorghum bicolor
  Clone ID: 7660421
cctgttgcaagtttatccccaaggaattttgcaaaggaaccggccttttcggagcaggcaatttaagccttaaaaaggccgatcctgcatgggggcaagtgcaaaataacgaagtgcagtataaaggatgtaataacgccaataatc

SEQ ID NO: 28734 - DNA, 547 bp, Sorghum bicolor
  Clone ID: 7660458
gcacgagggtccccccgacaccaccaggggcgacgacaacggcgccaggcgccagcgacatgccatcgccgccctcctcctcctgtctctccccttcccttcctctctctctcccctgcccttccgatgcggtggcgggcgctgcttccagctcgtgtggtcaggccaaggctgcgcgatggcacctccattactccctcctccaccctcgttgctattatttatctagcgctttgcactgtattggtcaatgcctaggtcagtgcccagtgctttcttaggatctaatttgtcattgtcggctaacttcttgaataatggtctattttttagtttctatatacaaatgtattgttgtgccatgtccaaatgtttaccaatggtttaataaatacaatgcttgagctgacgtcttctctcctatttcaagtatgaaatgaaatggtttaatttaatatatttttgcacatgtcatacgaattctgatttaatacaacccttcaatatcgccatttggtgtttcaggacacgtgaaaatagctttggg

SEQ ID NO: 28735 - DNA, 504 bp, Sorghum bicolor
  Clone ID: 7660460
ctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccctaacatagcattcctacagcagtgcggtctaactgcctctaacagtttagagttcccaatactgatatccatgaagcccgagaatgtcagggaaagggtggcatgtgctgagaagcttggtgtgccgcgcaatacagggatgttcaagagtgccttgtgggccgtttgttgcgttggtcccaactccattggtgcaaaaatggatgtcatgaaggcgactcttggatgctcagaggcagagctggcttctgtggtgcgcaagtttccccaaattctgaggatatcagaaggcaagctgagtagcacaatg

SEQ ID NO: 28736 - DNA, 526 bp, Sorghum bicolor
  Clone ID: 7660499
gcacgaggtatgcttccacctttcgccattaaacttatgtttggaggattgacagaaccctttggacttatggagtagcaaaattcaaagggcagagaagagtcaagttgggttggcttatcttgtacttgtgaattgaagctgctagtgatttcagagtacatcggatcagacaaagctgtgaaagaggtgccagagtcaacaatagcattaaaattggtgttaaaggatttacttcccaccatggcaccagttatgcttatgttgtaatatggattttgtttataaatgtttaacggggtttcctgctgatctgagcttccagtgtccccaaaattgattctaccacgaccatcatctccaaagcacatggagaaggaattggcagcaactccttcacttgctagtaaactagggactgatatactgtccataccaagcccaagtagaccattgggtgcagcactgcctagaaatgaacccgtctgaatccgcccacaaccaaacgttatgggggccgtaacaa

SEQ ID NO: 28737 - DNA, 463 bp, Sorghum bicolor
  Clone ID: 7660581
tggtcgtcgtggcgcacgggcggccggtgccggatcccgtgggactggcaggtggaccagctcgtgtacgtcgtgtccggggaggtcaaggtcatccccgccggccccgtccacggcgacgactacatgcacttcgtggccggggatttggtcaggtacccgcgctggttcgaggccgacctttacttcgacggcccgtacgaggagcgctaccggttcctcgcctacggagacgacaactagtttagagcaggatagggagctgctttttggatttcagctctgtcagcgcttatttgttgcctagattatctatctatctatcggcaaatgtatgccgttttaaataatcctctgtaacgtattggtgtgacgatgaagaactggtaatcaggcacggaaataagccaatcattccaatgtttgcgattttataatttagttcctccaaacttttgaattg

SEQ ID NO: 28738 - DNA, 513 bp, Sorghum bicolor
  Clone ID: 7660582
gcacgaggcagcgacgccgagcggatctgcagccacctcagtcaccggcggcgatggcgagttccaactccggcatccctatcaaggcagaacaagattcggatggctcggcacaaagcacagctgatatgactgcttttgtgcaaaaccttctagtgcagatgcaaaccaggttccaaactatgtcggagaacatcatttcaaagatagatgaaatgggtgctagaattgatgaattggaacagagtatcaatgacctcaaggctgagatgggcaatgaaggcatggcgacgccatctaagataaaggaagagtcaaaaccttcagacagctctgcatgagtgcagcaaaaacagcatgattcatttgagacatcattgctgtatcttgggcgttcatcactaacaaatataccctgttatgaggtttcatttgagcaaagattgtaactcatgctactagtgttttgctgaatggtttgctataaattgtatccgtcttcgttctctgtag

SEQ ID NO: 28739 - DNA, 406 bp, Sorghum bicolor
  Clone ID: 7660600
tttgtgactaacattaagcgctacatcaagaacctcactggcaagctggagccaaaaaaggcagatgaattcaaaaagggcattgagggtgcccccaagttcctttttagcaagctcaaaaattttcagttttttgttggtgagagtatgcatgatgatggaagcctagtgtttgcttactacaaggaaggtgcccctgacccgacattcctttattttgctcatggtttgaaggaaattaagtgttaggcgggcatgccctttttacctcatgttgcttgttatcatttttacctcatgtcgatggttatcatttatataaaactatcctatttttgtttctagtatggattatgtcatggatggttatggaaaaactgttttggaaaaaaactgttggaaaaag

SEQ ID NO: 28740 - DNA, 548 bp, Sorghum bicolor
  Clone ID: 7660650
gcacgagggttcgtcacaacaaatctacttttggagatgttttcaaggtattttttgcactgatgttggcaacaattggaatatctcaaacaagtgcattggcttctgattctacaaaggccaaggattcagctgtctccatattcgcattattggacagaaagtccaaaatcgactcaagcaatgatgaaggttcgacgctacatgaggtcaagggcgacatcgatttccgacatgtcagcttcaagtatccaagccgcccagatattcaaatatttagcgattttaccttgcacattcccgctggcaagactgttgcacttgtgggagagagtggcagtggcaagtcaacggtaatctctttgttggaaagattctacaaccccgactctggtactatctcattggatggagtagagatcaaaagcctaaaagtcacttggttaagggaccaaatgggtctggtgagccaagagcctattctcttcaatgacacaatccgtgccaacatagcttatgggaaacatggggaagtcactgaggaggag

SEQ ID NO: 28741 - DNA, 459 bp, Sorghum bicolor
  Clone ID: 7660656
gcacgaggcctggaccagcttcttaagcttgcaagaatagaagatgatgacctgctgatcatgtcggatgttgatgaaatcccaagcggtcacacaattgatctcttaaggtggtgcgatgacattccagacatacttcatcttcagctcaggaattacctttactcatttgagtttttcttggatgacaagagctggagggcatcaatacacaagtacaaatctggaaagacaaggtatgcacacttccggcagacagatgagcttcttgctgattcggggtggcactgcagcttttgcttccgttacataagcgattttgccttcaagatgcaagcgtacagccatgttgacaggatcagattcaagtacttcctgaaccctgaaaggattcaagatgtcatctgcagaggggcggatctttttgatatgcttccagaagagtacacattccaagaa

SEQ ID NO: 28742 - DNA, 537 bp, Sorghum bicolor
  Clone ID: 7660683
gcacgaggctacagatgacatggaacttgctatagaaagccaactatctttgttattgcgggtgcccttagcatcactgaacttcctctcgatgttgaacctgtcctacaacgagctggtggggagaataccagattcacctaacttcttggcatttaccaacctctcgttcctgggcaacattggcctatgtgggtttcaggtgtccagagcatgcaacagcacaacactgccatttatgaagccacatcattcagagaagaaatcactagaccttgtattgttcctttttacaggatactcggatttggcgtcggattcgcaattgcgattgtcctgacatgtggaatccaagttaggaggagatcccagaaccgcagcatatttctgcgctgcaagaaagttctcttcttcatgtagatggcctgcgaatgcaaatagaaatgcgtctgcatcagtgagtatatttctatgcttgtatcatcaataatgctatgaatgtttgaagtggaaaaggcgaagagcacaggatgacta

SEQ ID NO: 28743 - DNA, 542 bp, Sorghum bicolor
  Clone ID: 7660752
ggctagctagtctaaacaagccagaggtgccgattcttttgttaggatcgctagctgctggagtccatggagtgcttttcccaatgtttggtctaatgatctccaatgccatcaaaacattctacgagccgccacaccaactaaaaaaggatgcaagcttttggggtttgatgtgtgttgtgttgggtattgtatcaatactatcaataccagtggagtatttcttatttgggatagccggggggaagcttatcgagcgtgtccgtgccatgtcgtttcggagcattgtgcaccaagaagttgcttggtttgatgatcccaaaaattccagtggagcacttggcgcaaggttgtcagttgatgctttgaatgtccgacgtttagtgggtgataacttggccttggcagttcaggtcatctcgacactaattgcaggatttgtcattgcttttgtggcagattggaagctcacattgatcatcctttgtgtgatgccactatcgggtgttcaaggttatgcacaagtgaagttcttgaagggt

SEQ ID NO: 28744 - DNA, 269 bp, Sorghum bicolor
  Clone ID: 7660759
aagtgcattaattgtggcttcaaccttacagattatacctgggctcagtggcctttggcgtaatgttgccacgtatctgaatgcactttcagctgctcctttggtggcactagttggatttggactgtatgagctacgatttccctcggttgccaaatgtgttgagattgggctacctgaactaatccttctggtgatctttgcaatgtacctgccaaatactgatcacatgctgaagtctatctttgaccgatttgctgtattgttca

SEQ ID NO: 28745 - DNA, 270 bp, Sorghum bicolor
  Clone ID: 7660783
gcacgaggagctgcagcgtcagcgcgactggtacctgatgagcaccgcggcggcggcggcgggtccggacccgtcctacttccatttggcggcggcggcggccgagcacgaggacccggcggcgctgtggtccccgcggcttcgcccgtccccgtgccccgagtgcgaggcggcggcggcggcgggcatgcggcatccggcgttccactggtgcgtgcgcgacgcggtggtctccgtggggttccgctcccacgtgggccccatcgagcg

SEQ ID NO: 28746 - DNA, 476 bp, Sorghum bicolor
  Clone ID: 7660784
tgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacaaggatccattggagagccgggagaaggtgatgtccctggtggacccggcgatcgtggaagggtgggcaagggaggaggccgtccgtgtgctccgcgtcgccgtgctgtgcaccagccgcacgccgtcgatgcgcccgtccatgcgctccgtcgtgcagatgctggaggacgccgccgccgcaagggaggacgacgacgtcaaggtcctggaggtcaaggtggtctgaaattgcactgtatgacgctgtaggctctggtaacggccgtgtccggcggtgaccggcgtcgaaccggagtagttactgtgcgtagataggaggacgcgttgggtca

SEQ ID NO: 28747 - DNA, 566 bp, Sorghum bicolor
  Clone ID: 7660794
gcacgagggttattgttcactgttgtctcacaggatgaaaaatacaaagcaaaggtctgtattgatgtgattgtccagaggcttggtgatgcaacagccgctggaatttacaggtggttgttcagtagccttgagaagaagacatccaaggtcaccctgtttgcactgccgctctgctttgtgtggcttgtcattgcatttcatttgggccgcctccagactaatcttgccaggcttcaggctgcttctgccgcgtcctattcctaagcagggctgctgcgagtgtccttggagatgcgcttccagaatgtttgaacagacatggccagaagttaggttgtcaccaatagttagtttacacattctgaaggaatttcaggtttaattgatggacaaaccttcagtatatagtatcaaccattacagaagagtttatttagcatacgagaggggagaaatagtatagattagaacagtatacaaattcagtattcgatctcgatgtgcgctgtagggaactctagcatgtaatctgtgagttattataatgatataatgatgtagta

SEQ ID NO: 28748 - DNA, 635 bp, Sorghum bicolor
  Clone ID: 7660853
accatccagtcaggaaggtattccaagcctttgaagaggcagaagtccgcgtaggcgagtcaaaggtgacgggcaacaacaacgggacagtggtgcattctttcatcatcaagtgtcctggcgctgagcagcaaacgagggagaaggtgatagcggcaatgtctcgcgcgatgagcagttgagcagagcagcgtaggatcagactggcacagtagagaggcggcggtttatccttcctgttggttgcgaacaagaagcagcagcagcagcagcccttgacatggtggattgtcgataggagagttgtaggtggagagaaacaagatgagattcttctgactttagcaacgcaacaacaaaatgggggctccagttaagcagcagccattgtatggtaggtttcttttggttggtccgaccgtgtagttttgatgtttttgtttgggaaggaaggatggatggataccgtgttcctagtgtaagcgtgatgacgcagcagaacaataaacagcagtacatgtttttttcttcttcttcttcccttttttgttcatgcgtgatttggaaattaaatttattgcaaattttgttttactttctttttatatgatgccggttgttcagtaatttatatg

SEQ ID NO: 28749 - DNA, 142 bp, Sorghum bicolor
  Clone ID: 7660855
aaaggaggacgcgttgggtcaaaggaggcaggggaaaatgaaaagctgtcactgtcagttgaggtcagtccagtcagcattaagcagcagagcatgagcatgtgtagtgtaccagtacgattagtattattttgcctgactg

SEQ ID NO: 28750 - DNA, 649 bp, Sorghum bicolor
  Clone ID: 7660905
cacggggtggaggcgggcaacaatcccgcggagctggcggcggccgtgggtggcgcctccagcagctcctcccgggcggcggcgaggagcagggtcgcggcggctgctggcgcctccggctcctccccggtggcggcggcgaggagcaggggcgccggcgccgtggccgcggcggcgggcggcggcggtggcgtcgggccgagctgccaggtggagcggtgcaacgccgacatgggcgtggagaagcggtacaaccggaggcacaaggtgtgcgacgcgcaccgcaaggcgtccgtcgtcctcctcgccggcctccgccagcgcttctgccagcaatgcagccggttccacgagctgtcgcacttcgacgacaccaagcggagctgccgcctgcgcctggcggggcacaacgagcggcgccggaggaacccggcggaggcgcacgaccagaacggcggccggggcgacccggggaaccaccacctccacatcagatcagataaacctatctaagcatgctctctctcttctgtcatgcaggatgcacctagcatcaccgatcgataatccgatttgtgtctcagtgcctaccctgtcctgtgtctgtgtgttgcgtatggtacgtgctgctgctactacgtgctaactt

SEQ ID NO: 28751 - DNA, 305 bp, Sorghum bicolor
  Clone ID: 7660906
cacctaccacactggaaccacaaccaccgttgtcaattgagtagcctgagtttgcgtgaagctccatggaacagtactacccgaaggggttgcaaaatttattgacggctcctttgatcaaccatttcccctgaatcccctccaatcccatggaaaatggttgaatccaaactagccctgagtggtcaggaaagacacaagttgttttttataataccagggttatgtttttttggcacaactgcatagtaataataaaaggcggaagactgaacaatattgggataaaaaaaaaaaaaaaaaaa

SEQ ID NO: 28752 - DNA, 515 bp, Sorghum bicolor
  Clone ID: 7660909
gcacgaggcgcagcggagcagagggacgggagaagaggcagcgagttcctgaatcttcctcctccgcagctgagcctgctcgtcgacccgccggcaggcatggatgggaagaacttcagcaataaacagcaagctgaacaaaagaacccggatgcagtgacagacagtgttccaagccaatctcaagaggccttgaatccgtcagatgatggaaacaccagtccaatcaatggccatgaagctgatgtgaacatggaagcttccatctccaccgaggacgtcattcgggccggcgggtttggagcgaaggatgacattggtagcctcctcccaacagcaattgattccaccgatttcgaggcctcgctgcgggacgcccgcgacttcgaaggcgagaaagaggcaccgtcacatcctggactaggatggaagggggacaaggctgatgatggaagcaaactgtcagatgtgccgcagcagtgatcgtgctttcttcttctgtcatatatgtgtct

SEQ ID NO: 28753 - DNA, 510 bp, Sorghum bicolor
  Clone ID: 7661010
gcacgaggcgttttgctactaattttattgcattaaaagcatatataagcacaagactgatctacaagcaatggttgtctccaatgagtggacaacttgtgcatactataaggaagcaaaagccaaaaagttcactaaagctgtgctagatcaaaaattttggaaagattgtgctattatttgtcaaatatcaaaaccaatagttcgggtgctgcgaatagtggacagtgatgagcgacctgcaatgggctacctatttggagcattccatgcttcaagagaggaaattgtgaagagatttcagagaaagaaggaactagtgaagcctttcttgaaatacatagatgcacggtgggataggcactttgataaaaatcttcatgctgctggcttttggttcaatcctaataaccaatatgacaatgacctgagagagaagtacaacttcactacttctagagttcttgatgtcatagagaaatatgctggcaaagatattgcccttagaag

SEQ ID NO: 28754 - DNA, 375 bp, Sorghum bicolor
  Clone ID: 7661044
gcacgaggctccttggtgggcgcgtcgcagcgcagaacgaacacaacgcactcagggtccccgccgctgatggcggcgtcgatttcctccctcgtcagcctacccgcctcggggagcggcggcgcgtccagcagctccaccacgtcgccctcccccgccgctcccacgctgtcgccgtcggccccggccaccacggccttgaccctccggcggcgcctgggcccgtcggtgccgccgccgggcggcgacgcctcggcgcgcagcagcagcgggccgtcctcggccgccagcgcccggcacgccgtgttgacaagggagctcttgccgtgggcacggaaccccgtgatcagcacggacggcggcggcggggacgcg

SEQ ID NO: 28755 - DNA, 496 bp, Sorghum bicolor
  Clone ID: 7661046
gcacgaggaccaatttggccgaaggtcatctatccagcacagagattgcccactgcagctttgttgtgcacgcttgaaagtacagtttggtgtcagtacaaagtttcttgataatgcagggcgtccaaagatgagcatagtggttgagatccctgagagtctcagtaaagttttagaattctgcgatgatcttgctaggaagttatctcaggaatctggtagcagttctgaatggagacccctgattaagaagtatggatatgttaatcgtccgactgtccgcctgaacatccctactattgcaaacagcaatgctacagcctactcaactgatatatgccagaaagagcctactggcagcatccagaaacttgatttcagcaagtgtagccaccacagaattggactccctgtgtgttaaagggagcaaggtggacgcatgcttctcaccggagctatacgattaccagcaaaatgctggcattcggctggttgc

SEQ ID NO: 28756 - DNA, 384 bp, Sorghum bicolor
  Clone ID: 7661049
gcacgaggctcaatccctcattgctgcgcgttgcgcacctccaacgcgcactgcgactggaataagggcacgagggacgccggctccgccaccggagccgacagcgccgggtgccgccaccccgcgccgaccgcgggcgacggcggcctgggggacatgtcgtgcgcctggcgctccccgctgccgccgtgccgggcggcgccacgctgctgctgctcggcaccgctcctgccctcggccagctggtcccctcccccctccttcctggcggcggcccccgcctggtccgcctcccagaccggcaccgtgggcgacacgacgagcggcgacaggagcgggatcggcgccctcccgtcgccccacactgcgggcgccgaccccgtc

SEQ ID NO: 28757 - DNA, 669 bp, Sorghum bicolor
  Clone ID: 7661116
catcgactgatgctgagcaggtggattattgattcgctttccgcgcgatcccctttctcgcggcgactcgctgatctctcgtacgtctgcccggctggcttccgcagggaactgccgtagggtagtctctcctacatgcgtgcatgcggcgctcgtgggatggctctcctatatgcctataaagggcggagcggtggcgagtgggtggccgggtttggaggagacgggggcggcgtggacggtggggagggatcggtgcgggcgtgcggcagttcccttgtaacgctcgcttgcttcctgcaaccgtctcccagcgagatgcctgcggtcagtttctgacttcaggctctgatcggattgggatcggcgaccgtcttgggatatgtggtcgtagactcgatttgatcccctcgttttctttaaaaaatccttcacctgtcacgtcacttggggttggggttgggttcggtgcttcgccgacggcgtttattgaagttttggcacgtcaaaactcggccgcattacaaatagttgggatcgtacgactgatgagtgataaacgttattagttcattgaacggacagtacagcagaagaggtcacagtaaaaaattctgggattggacggcaaggttgattatgttaataacaagtgcttatgtttatttt

SEQ ID NO: 28758 - DNA, 502 bp, Sorghum bicolor
  Clone ID: 7661120
acgagtgccgtgagcgcatcgcggatctcccggcggagcgaggccacggcgtcctccctgcggaggcgcgccgcgacaatgatcgccagcgccccggcagccgccgccgcggctatcttgaggaggaggggcagccgcggcatgcgcatcaggacggggctggcgctgccggggacgcggaagggtctttcggcgatagggtgatttcgcgaagggctacgaagattactgccattgctgttggcatgaagcaagacggcaactgtttttgggggagagatttgccttgcaagaggcccggcgagaataaagtttgcctcctggatgaagcgccatgccgagcaaggatggaatatgatctcacagggacacaggacacaggacacaggggtccgcgtgtagcgttttcggttttcgcctcacgcaatggattgtttagatgtgattttttttttgattttgctaccgtagtattttcgtttgtttatgacaaatattgttt

SEQ ID NO: 28759 - DNA, 649 bp, Sorghum bicolor
  Clone ID: 7661126
cgcgggcgcatctggctgtgcttgcgggggaggcgacggtgcgggcaccatggccagcaagcacggaggcggcggcacgggtcctctttgattctttatctatttttctcgtttgatctcctcttcggcgctgttatttatttatcaacttgatgtattcagaaagacggattcgggtttggatttggaagctgattttgattcagttttggtttggttccttgccttatacttgagaagttttgccttattgagttattctgatttggatttgtatcctattggagatagaagatgtgaatcgtctgattcggatttgtatctatactatatcctgaacatgagaagacgtcagtgatttgatttgagaagttttacctgattgagttattctaatttggatttgtatcgtattggagatagaagacatgaatcgtctgatttcggacagaaatcctagcagactaaaactttgacttccaatgaggacgggcggacgcggacgggcaggcagaagaatagggtggcagactgaaattttggctctttatagataggtatagaagagttatagattagtttttattttcgactatatttaatgttttatgtgccgtaaaatttaatatgacgagaaatctcgaaaatt

SEQ ID NO: 28760 - DNA, 218 bp, Sorghum bicolor
  Clone ID: 7661140
agagaaatgaccactaactactggaccatggttgacaactgaataggaacagagcatgtgtacataactgtgtgtgcgcgtggacatcaactaacactggagactggagccactgacagcggagagaagaattaagttcgatgcaagcacaaaaaccacgcatggtattgatgcaccttgttgttggtagctgctgacgttctgaggcatgtgggcag

SEQ ID NO: 28761 - DNA, 438 bp, Sorghum bicolor
  Clone ID: 7661180
ccccgcagcgtcacagggctaaaaacctgcatcgccgccgtgcgcgccagcgccgcgcagcccgcgcagatggaacgcaagggggaggttaaggtcgtgaagctgcgggcggtggaggccacgcccgagtccttcgctccgttcgggcaggtcatcaccggctcccccgacggcgacgagttcggcccccacgacgcccagctcgacctcagcagcggcatcccaaggttctacatcatgcggttgcaggaccggccgctggagttctcgaccatcacccaccacgccagcgtgacccagtgcctgggcgccatcggcggccaggactggtacctcggggtggccaagccgtcgatcgtggatggagcgtccgagcagagtggcccggaggggaggaagctcttacagtctgccgcggggcactgttacctgcctcct

SEQ ID NO: 28762 - DNA, 647 bp, Sorghum bicolor
  Clone ID: 7661196
cagagtcacgagagctaccactgccatactcagcaccagcgataatgaccctacaagacgtacgacgtcgaggggaaggtccgggagtcggtgcgccgcagcgtcaactggatcaagggcaagtgctccggcatggtgtacggctggtggtgatcgcgtcgcgctacctccaccgtcggccggccgtcctcgccgcgcgccatgcccgccgccactggtctgtccatcagagtggtactactactacgtatatgagtatgagttgagcgtttcttggtgtatgctgtcatcagacatcacccgtagactctcctccgatctttttttttccatctcccttgatcttttttgttcttggatggagttaggaatttttttaggtttactacttttaggagatggatggatttggtggcatgtagcatgagcagtgaagcttctcttggtgatttgtgagaggggggtgggtggtggtgacatggttgttgggttggggatgagaaaatcccaagagaatgcttcaggctgtgtggtgtcttactcctttgtacagatatatcatgcatctttccagtctactagtatctggtctatgtaaatttagatgctgtatgtatatatgtatatatagagaataagatttttgt

SEQ ID NO: 28763 - DNA, 218 bp, Sorghum bicolor
  Clone ID: 7661231
gtgttccgggtttcaggctccaagtttctcaagttgaacaaggggacctggcatgccgggcctttgttcaaggcggatgctgttgatttctataatcgggagttgagcaacaccaacgttgtcgatcatattacacgctatttcaagaaacatgatgggataacatttgtggtggaggactaaaaaacatttcgcaatccgaacatcattgccaagac

SEQ ID NO: 28764 - DNA, 542 bp, Sorghum bicolor
  Clone ID: 7661241
agaccaatccagcatcaggtccagtgattcagcagccaatgtacgacccgttttatgcctccaatcccatggctgcagcccgcagcgttcagatggttgccatggagcagcagcaacatgccttcatgctccagcagcaacagcatcagcagcagcagatgatgatgatggcacagcagcagcaacaagcttcttcaaatcctttcgccaacctatatatgcacgctggcgcccacccttacgctgcaggggtgcagctccatgcaggcaacgcatactttggaactgggatgatgtagagagagttgcacataatctgctatctggttttgacagacagcttccgttcttttattgttttttttttcatttcttttccattgtaaggactgtgttaggactagaactagaacatacctgatatagcgtcaagatggccacagccgttcagttttttctttttttctggttgttcacgagtcataccaaggagggttgatgctttgatggctcaatactgccacgtccaagccctagattga

SEQ ID NO: 28765 - DNA, 647 bp, Sorghum bicolor
  Clone ID: 7661248
tttttttcttttgttttccgtctcgactcgatcgatcgcgccgcgcagctctcgttctcgatcggcttctcagcttccgatcgagcggctggggggcaccggcggcagggatgcagcggaacaactcgttcgggacgtcgtgggcggaccagtgggactacggcggcggcgacgcgagcccgagggcggcgcgcgaccacgcacgcggcggcaagaccggcggcggcggcggcggcgtgggggagaagaccaaggcggccgcggccaccgggatcaggaaggtgaaggaaggcacggcgcaggggttccagtggatcaaggacaagtgccagcggaagaacggcggcaagaagcagcagggctccgacctcccggtcccggggtactgaccaccacctcatcagatcagcgttgctcggcttcggacacgaccacatgctagctgccgctcccggtagacagcaatttcttttttttccccttctttttctatatatatactgcatatataggttattatggctggtgatcatgatttgatctcgctgctgttgcggttgtagagtagtttcatcatatgtccctgcaggtgtctgctgattactgaattcgctactactttgatgtacataaaaggatatttattt

SEQ ID NO: 28766 - DNA, 542 bp, Sorghum bicolor
  Clone ID: 7661256
ggtttgatatttgaaggaggcatgcgaatgctagaatggcttaggctcggattcgacgcagatagagcacaatcaacatatggcagtttggaggttggcatccagcacctttcatttttcaaacatatcgtgctcattgtccggatgatttctgaaggtgctaatgatccagcggagcaagccgtcaagtttgccatcagtggccaagtaaagatgctccccaactgccccactgttgacatccgattttgtagacggtgtttgctggcgggcacagaataagaaccacacaaaagatgactttggatgtggcatgtagcagcttgcgtcttgtaatacgtgtactggagtattatgttttttttgcagtttatgcttggcaaaatggcaagcttgacacttcgcaccgcatgctccattcaggttagcttgtagaacgttgtcccagaagggaagacatacaatacaaccccaaaatgtgtttggatgtgttgtaaccattaatttttcattttaatgcagtgacatgcaacttttttggg

SEQ ID NO: 28767 - DNA, 285 bp, Sorghum bicolor
  Clone ID: 7661258
tggataagagttttactgcacgtgttgaagacattcaagatgtcatcagtaccttacagaacaagagttttgtggggccgccattactcctacagggagcgcaggatcagggccgcagacacatagatggcgccagcagcagcaacattccagggaacagcaagaaggcaagagttaagaggattaaagacggcaagaaataagggatttaaggagtttgtttccttttgtttagtaggcgtgtaccagtcctcatttgggatcgagcaataacaaccaatttct

SEQ ID NO: 28768 - DNA, 149 bp, Sorghum bicolor
  Clone ID: 7661275
tgcctgtgttgtgggtggttacaggatgcccaaaaaacaaaaggctcccttttagatttgaatcggggcctgtccccaccaaaaaatgctatatgttgtattggggtgccaaaaaactttgaagtattagggttttaaaaagcatttac

SEQ ID NO: 28769 - DNA, 231 bp, Sorghum bicolor
  Clone ID: 7661281
aaagaagattgccaaggaaaatgcatcataaacagtttccccaggcaatgcaaatttaactttggaggtcaacatgttgggccttttattttgggttatcaagaacatgtatttacgtgagcaggaggccctgccctgccaagggatgggttttccctccgtttccccccataaaaaggattccctatgacattttcatttggcttactgcccttgaggaaaaattatcct

SEQ ID NO: 28770 - DNA, 147 bp, Sorghum bicolor
  unsure (1)..(147): unsure at all n locations
  Clone ID: 7661309
tacgaaagtacgtgctgtagcatatatactgtaataatgcaactgggttttttgtgtttatttacatgtaaaacaagtcaatcaagtactacaggcanaatgtattagttttgggatggattaagtatcagtttgggtaagcccctc

SEQ ID NO: 28771 - DNA, 614 bp, Sorghum bicolor
  unsure (1)..(614): unsure at all n locations
  Clone ID: 7661313
ccaggtttttgaggatgaggatgatatgctttggagatctcccggtactcctgttttcactgctccagagtgttgtcaagtgcaggttcagcatatcatggtaggacatctgatacttgggcagtcggtgtaactttatattgtatgatttctgggcactatccatttcttggagatacattgccggaaacttatgataagataaccaatgatcctgtgcaaatacctgatgacatgaacccccagcttgctgatttgctccaaaggcttctctgcaaagatcctggggaacgtatcaccctgcagactgcggcagagcatccttgggttgctggagacaagggcccagtccctgaacacatctgcaggtgtggctttggccgctggaagagaagtgatactgggaaccaagtgcaataacagcacgtaaacgggatgatctagtgtagataactgatgagaagtatggctaagcaaagccagtgagatgactaacgaagcatttctctattgtcttacatttcccttttataatgagctgtttggtgatcgattgaacatatttctttaattttttatacataatagactaantaaagtttttttaaaaagtc

SEQ ID NO: 28772 - DNA, 639 bp, Sorghum bicolor
  Clone ID: 7661325
gcctgtggcaaggatacttgagctctgcattctacatattgctatggcagagatgacatcaaaaggaacacctcacaaagttgtcatcaatgaggcagtagatctggcaaagcgattttgtgatggtggtgcccctcgggtaattaatggatgccttcgaacatttgtaaaggatcatgttgacattgcaggcacgagccagggagctgaatcaaaatcgtgattttttgcaaataccctgaatcgtacgacagaatggtggccgaagtaaagaagtatagagaaacccttgctgtcttggagttcaggcaaacaccttccatcatgaagatttagtgtttaacctaagggaacctaaaaggtaaacatgctgggcctcatcaaggagccacaaatagttcattctctcagaatgttcagttattaggtgaagtatacagagctgtaaactggtgatgcacattcgtgtccatctgaaacaaccgaaggttattgcttctgatagcctactagtcccgcagatcgttaaatgatgatcagatataaagatgatcacaagctctgtaaaagattgacctatatgtaataggttatgagtggcattggctcgtgctttgggagacagataattcgagtttc

SEQ ID NO: 28773 - DNA, 560 bp, Sorghum bicolor
  Clone ID: 7661328
atggacacggtgctgtcgcacgccgagtccgggctggtgcacccggacgagctggacgaggagttcgacaccttccccaccagcaagcccggcgacgtggtgcggatgcgctacgacaggctgcgcagcgtcgccggccgggtgcagacggtggtcggcgacctggccacgcaggggtagcgcgcgcaggcgctgctcagctggagggaccccagggccacggccatcttcatcatgctctcgctcctcgtcgccgtcgtgctctacgtcacgccgttccaggtggtggccgtcgtgctgggcctctacctgctgcgccacccgcgcttccggagcaagcagccgtccgtgccattcaacttctacaagaggctgcccgccaagtccgacatgctgctctagctctaggcctctctacctctagctagctacgatccatccatccatccatccatccatccatccatcgagcgagcgtcccctttctggatcccaacttccccagcaggacacaggacagcaagcacctttttttttaaaaaaaaaattagtttcttatt

SEQ ID NO: 28774 - DNA, 565 bp, Sorghum bicolor
  Clone ID: 7661376
tcaccttcgcggcgcagccgaagcaggaggaagcgcccaccaccacctcggagctgcagttggtggccgggctgtctgctgcggcgccgtcctcctcctcggtggtctccgaggacatggcgccgttcgcgtccctggacgcggcggggatattcgagctcggcgacgccgcgtcagccgccgcgtactggaacgccgggagctgctggacggacgtcgtccaggaccccagcatgtacctaccctagctcgtttggtttagttacctatcgcgatcgctagattaagccgtggttaaatgcttcttaacgacgaccacgagctactacactacgtctccctaatactagctactcccatgtccacgctctctgctgcctgccctgcctctctctgtaacttttttttttcccttactcttgtttatttattggtaatttggcttcacacaggctgcgtctagaaagctaacacctgtgtgccctgtctgcactctgcgagtgcatgtggcggatcattgccgcggtgcgatggaaatattaattaatcgcattattatggtttt

SEQ ID NO: 28775 - DNA, 570 bp, Sorghum bicolor
  Clone ID: 7661378
tctgccagcacgaggtggccgggctggagatgcagagcagggacggcgactggatcgtcgtcgagccgtcgcccacgtcgctggttttcatggtcggcaacgccctccgggcatggacaaacgaccgtctatacgctccattccaccggattactgtcgccggtgatgtcgccagatactcagcgatgctgttctcggtccccagctacaaggttcaggtggcagatgagcttgtggacgacgaacaccctccccgtttcaagccccatgacaacaacgacttcgtctgcttctgtgtttccgaagaaggcgctcgccaccaagacaaactcaaggccttctgtggagtgtaacaagcagcagaacacatcgccgtcccctgtccgtccggcatctgttttacctcactcagcagggttgcatgcagtagagaccatccctgtagactagaaattttagaacacacaataaaagatacctctgctgcatttcttgtagtctggacatgaacaagaataacatagcattctggtatccatgaaagaaatgaataaagttttttttctcgct

SEQ ID NO: 28776 - DNA, 517 bp, Sorghum bicolor
  Clone ID: 7661383
tctggcagaccagatattccgcaatcctgattatcacaaacatgtgaggaaggcggtagtgaagcagctgaaggaattcaagaaacactatgaaggttatgtgccaatggaatataaggtttacttgaagaaaatgaaaagatccggggaatggggagatcatgtgaccttacaggcagctgcagacaggtttgctgctaaaatatgtctgttgacgtcgtttagagacacatgcctagttgagatagtccccagagatgccactccaacaagagagctttggctaagtttctggtgtgaagtacactacaattcattgtatgcagttgaagatcttccgacacggaaaactaaaaagaagcattggctgttctagcttgccaggcttcggtgatttcttgatatatgctattggtcttctccttgtagtccagcagcatctgtaaccctgcctagttacgcctttcgttaatgttgtaagctgtaacttgacctggaatcaaattcatttattaag

SEQ ID NO: 28777 - DNA, 192 bp, Sorghum bicolor
  Clone ID: 7661385
cggtcgtcaatgttaattcctttctggaccagtttgtgtaatgtgtgttgttaatcgatctggagggtataaattcggcccgggtttgttgtaacttgtaatgcatggtataaaaaaaaaaagggttgaggagtgcccctgttggtatgtccattaatccaaggggagggctaagggtaagtttgtttgttc

SEQ ID NO: 28778 - DNA, 347 bp, Sorghum bicolor
  Clone ID: 7661413
gaccccatcaaaaccaggatgcaagtcatggatggggccggtgacccgattcccgtggggaggacagtgcgtaggttgatcaaggaaggtgggttggctgcttgttacaggggcctaggcccgaggtgggggtccatgtcattgtttgcaccccccatgatccccccctatgagttcctcaagcggttttcagacaagggccaggagagtgtttttgcatgatgtttgatacccagtatagccaccaagtaatcaggggcatttgctttgtttctttattgtttcatttccaacccatgatatgttatgtgttgaaaaaaatggcgggcgaatgtttgtaaataatc

SEQ ID NO: 28779 - DNA, 508 bp, Sorghum bicolor
  Clone ID: 7661469
cctcatggcctacgtcgactacttcgggtcgccgccggagcacatcttgcgcgccgtcaaggccgggctgaaggacaagggcctcgatgccatgctcgcgctgatcgaggacgagacgctgtcgtcgttctcctccgcgtcctcgtcctccgacgaggaggcggcgggccgggcgcagctgaggcgcccgtcgtcggggagctacgggcggcggtcggctgaggagccggtggtgtgcagccccgcgagctcactggtggccgtcatggtgcaggccctcgcgcaccgggtgagctacgtgtgggtcctcgacgaggacaacgactgccgcctcgctggcatcgtcacgttcgcggacgtgctgagggtgttccgggagcagctgctgtgagatctgaagagtgtttgctgtttcctcgctcgcattttgtggtgtaatgaaatatgtagaaagagcatgagctgttgtcatggaccaagtgcttggttttctgaaacttttgatttc

SEQ ID NO: 28780 - DNA, 557 bp, Sorghum bicolor
  Clone ID: 7661483
gacaaggaacccttgtttgatagtgtgaaagccgtattaggaatgcttgaagtatgcacggagtttgctcaaaatatctcatttaattcgaaaagaatacaaagttcccttccagctggttatctggatgcaacgacgctggcggattatcttgtgaagaagggaattcctttcagaacttctcacgagatagttggaaggtctgttgctctatgcgtctacaagcagtgtcagctagccgagcttgaattggatgacctaaaatctgtccatcctgtatttgagggcgacgtctatgaatacctgggggttgaaaacgccgtaaacaagttcatatcctatggctctactggttcagaacaagtaaagaagcagcttgaggattggcgcatccagctcgggatcagctcataagggttggtacggtcctagaaataagctcgcaaattagtgattgcgatttttgaaggtgtatgtggacgtcgtgaacttattttactgtctatcggttcgttgtcatacttttgaaaactggaatgggtgatgcaaacatgagg

SEQ ID NO: 28781 - DNA, 582 bp, Sorghum bicolor
  Clone ID: 7661510
ccgcgcaggtgttcaccgagggcatcgccgccgcgtggcccggcacgttctcgctccccgtcagggccgccgtgcccgtgatgtacagcgcgcgcaggatgttcgcggcgtccgagtggctgcgcgaggagctgcaggagcgcgacgacctcgggcgtggcccgcccgtgccgcagcggcgggtggtggccggcagggcgctcgcggccgccaacctggcgttctgggggttcaacctcttcgcgttcctgctgcccttctacctgcccagggcgctcaggagatactacctcggcagcgaccatgaggatgacggcggcgcacacgcacacttgaagcagcagcagcaaccgcaggatgaagggaagaaggattcgtagatcaggttagactacatgtgtgattagtagcggaacaagctgtactacctgtctctgtctctgtctctctgccatcattatgtatgccagtagttatcttgtttgatgcatgccaaacttttttttgctccatgttattaccagacgagcaacgcttacaaactgctaatactatcttctactactatcaacaattttattc

SEQ ID NO: 28782 - DNA, 119 bp, Sorghum bicolor
  Clone ID: 8087897
gagaaagagctgaagggcttacaggagagagagtctggtgctaaggctgaagagaaacacattttgactcagatggaagaactgaagactgaggctgatgactggaaagccaagtcgga

SEQ ID NO: 28783 - DNA, 407 bp, Sorghum bicolor
  Clone ID: 8087898
gcacgaggctcaaggtgactggccagcgcaaccaagacttaccatccgtcgaagaggttgtcaagagagagagcgagaagcggatcgagaacgagaagcttgcgcaagtgggctatgcctatgacctggctcacagcaaggcctgggagcacatggaaaaggttaccgagattcgcaacaagagagaccaagagaaggccacctcgcaccgtcagaaggagcgacgacggcagtgggagagacgtcacatcagccgcgacgtgaccaagaagcataagaagaagaatggcgagaagaaggagcgaaagaaggagcagcgggaggagctcacgaagaaggccattgaggcagcagccaaggcagagagcaagtctgagaatgtctcgggcgtctcaacacctctggac

SEQ ID NO: 28784 - DNA, 137 bp, Sorghum bicolor
  Clone ID: 8087901
gcacgaggcggccagagcgccgccgtctgatacccaacagcatcgatggcggcgagggtcccggcggccgatctcaaccagcacctctcgtggccgttcacctcattgcgctgccgcagtccaagtgacgccggcct

SEQ ID NO: 28785 - DNA, 157 bp, Sorghum bicolor
  Clone ID: 8087902
aacatcaagcacgccgccgatcaaactgaaaccgcttggcacggatgcggccaacaaaacggcattgagatctggcgcatcaaccaattcaaggtcgagaaggttcccaaggagcactatggccaattcttcgaaggagacagctacatagtcttga

SEQ ID NO: 28786 - DNA, 158 bp, Sorghum bicolor
  Clone ID: 8087907
cagagcctttccccccattattagtgggaatcaccacacactctcgtgctgaccacccccgaatctgcgtgtcacagaccacgccaccgaagcctgctgcttatgtgaaggcacagaagctgcttcagccttactctgtcttacttgaaccctgggtt

SEQ ID NO: 28787 - DNA, 160 bp, Sorghum bicolor
  Clone ID: 8087908
cgcccaccgggatggcctcgtccgccaccgccgtcgctccgttccagggtctcaagtccaccgacaccctccccgtcgcccggcgttgcaccaccaaactcgccaaagtcagcaacggtggcaggatccggagcatgcatgtgtggccggcgtacgggaa

SEQ ID NO: 28788 - DNA, 362 bp, Sorghum bicolor
  Clone ID: 8087917
gcacgaggcacagacccttcctcgacccagcgacgagtccaacgacatgaataattcagttaagggggcaggcgatggttctcctcatggcctgatgttaacccctgacattcgtgtcttggccgccgacgtggagaaggaatctcaaaagtgttccaaatcacctttttccggcctggcaaatgcccgcatctggaagttcttcttccgtgcggtctaaaggcggaggactcgaagattgggatgaccttgaaggtgctgatgttgaccgatacggttttatcacactaccgccaccgcctggttcaagaacgggcacaccaacagagacgcggtcagcctcgggctccccaagaaaacgt

SEQ ID NO: 28789 - DNA, 189 bp, Sorghum bicolor
  Clone ID: 8087936
tcttaccatctgttttctctaccaaatgaagaaatcattctttgcacctgctccattgctgcccccgactctgaaagtgggcttcaaggagtacgttgagtacgtccaggcgtacaacttatatgtcgatttccttgctggctctatggcctcatggaaaaagactgtcaaagagagagcctccaaggt

SEQ ID NO: 28790 - DNA, 257 bp, Sorghum bicolor
  Clone ID: 8087938
atcgccattgccgtttacctcacctgccagaacgagaagaccactcttcttggcaagaccaagcaggattacgcttgtatcctgcgatggatgtcttatgccaacactgagatcctcactcctctcggtggctggttccgtccgctcgtcggccgcgacccctacaacaagaagaacatcgaggactccaaggctgccgccacgaaggctgtccacgttctcgaggaatacctactcacccacacttacctcgtcgg

SEQ ID NO: 28791 - DNA, 192 bp, Sorghum bicolor
  Clone ID: 8087940
gcacgaggcacatgcgaaactgttggaacgacggggtgccaatggtcacccaacgccccatccctaccaacggcaacttcacctaccggttcgacgtcgcctggcaagaaggcaccctttggtggcacgcccacgacgccttcctccggggaaccatctatggcgctctcatcatccggccccggcaacgcg

SEQ ID NO: 28792 - DNA, 160 bp, Sorghum bicolor
  Clone ID: 8087945
gatctcgcgtcctccgacacccagacccgcccttccctcgctccaaccgccgctgcgctgcccgtgcccgagaccaccggggaccgcgttgaccggcgcagcagctacagggaccgggactgcgacgtgtgggagagaaggttccccccccagccatggg

SEQ ID NO: 28793 - DNA, 197 bp, Sorghum bicolor
  Clone ID: 8087946
gcacgaggacgacgtcggagcccaagggcgtggtgcactgccaccgggggctcttcctgatcacgctcgactcgctcatcgaatgggcggtcccgccgcacgcgacatacctgtggacgctgcccatgttccacgccaacggctggagcttcccgtgggggatggccgtggtgggcggcaccaacgtctgcctgcgc

SEQ ID NO: 28794 - DNA, 523 bp, Sorghum bicolor
  Clone ID: 8087948
gcacgaggcagaactcatgctaggactcactggcctcagatgcttaagctaaaagactggccttcttctagttcctttgacaagcgattgccgcgacatggtgcgcgaatttattagcgcattgccatttcgtgagtatacagatccacgatgtggcccactaaatcttgcagccaagcttcctgctggtgtcttgaagccagatcttggacccaaaagttacattgcttatgggctctacaaagagctacgcaggggtgattctgtgaccaagcttcactgtgacatatctgatgcggtaaatatcttaacacacacagctgaagtcacttgtcagactgatcaccgccaaattgaaaaaatccaaaaagacatgagagagcaagatctgcaggaactatatgggggtctaaaatcctgctctgagctgaagttgtcaccacctccaactgaatgcagggatgaatctgccgatgaaggattgaagacctcatatattagagaagacaattgtgtcaacaga

SEQ ID NO: 28795 - DNA, 101 bp, Sorghum bicolor
  Clone ID: 8087950
gcacgaggcttcgtcaagctcgccaagcaggccggcctcttcgtgcacctgcgcatagggccctacgtctgcgccgagtggaacttcggcggcttccccgt

SEQ ID NO: 28796 - DNA, 132 bp, Sorghum bicolor
  Clone ID: 8087954
ccgtactcacagtgcccattgcccagtgcccattgcccgtgccattgccttgccagtgcctatgccacccacggctcctatacccagcgatctgcgcaactaatctggctgcgtattccattcgcccgttgt

SEQ ID NO: 28797 - DNA, 170 bp, Sorghum bicolor
  Clone ID: 8087959
ccaacacggatctgccaacccggcatccctccggcgagcctcgtccggtctgcgctcaagaactccggcgccgcggcgggacgcggctccagcgagctctattccgccgcgaccggacggtggggtgtccatgtgcgacgacaagccactcttcctcttcctgccgccgc

SEQ ID NO: 28798 - DNA, 136 bp, Sorghum bicolor
  Clone ID: 8087961
gatgagcagcgggcaggacgccgtgctgctctactcggccatggcgctggagaacctgtcactgcactccgcgaggctcacggacgtgccggagccgacgccgccgcctgggagcctcctcatgtgcgggtgcttc

SEQ ID NO: 28799 - DNA, 175 bp, Sorghum bicolor
  Clone ID: 8087965
aagaagacactatgggcgatcgtcccacgggtctcaaggcaagcaaggggattgagcttctcacttggggcacgcccaatggcgtaaaagcgtccattatcttggaggagctcaaagaagcatatggcaaggactacacatggcaagggatcaacattggtcagaatatccaaaa

SEQ ID NO: 28800 - DNA, 197 bp, Sorghum bicolor
  Clone ID: 8087979
gcacgaggccggcctcgggatctcgtgctggtgattgatcgacacaatggcgccggtccacgccgcgctgcgggcgccctcctccgctgccgccgccgctgctcaccaccacgcggcagccccgcctgtcttactcgctcgctcgccgtaccacccccgcagggcggcggcctgctgctcgctcgccaccgtcggcg

SEQ ID NO: 28801 - DNA, 436 bp, Sorghum bicolor
  Clone ID: 8087982
cggaagaggcacggtggagacgcggccccgcggcggagccctcgcctcttcttctcctacccgccgagggagacgctggtgacctgacgaactgagcccacggtcgagaggggagaagacggggacagccggaggagcgcgcgcgcgcaggcgactaagcggatccacctagatgttggttggcagatcaccaacactgcctttggtgactgctgaaactcctgcatttggcttatttataacagctcgcaatgtctcgagtgcaatggtggtgaagctttcagataacaaatgtggaggaaaattgagtgtcgggcgaaacatcgagcctgggaaaagccgtcgggaatggcgggcgctatcggccgaccaagcgcaagcttctgtcatggatgtcgatgaggagtgcaaacaagtcctcacttcattggatgtc

SEQ ID NO: 28802 - DNA, 366 bp, Sorghum bicolor
  Clone ID: 8088001
gcacgaggggcgcgcggggagacccgtgggagcgcgtcgtaggcctcgggttcggcggcgccgagggtcctccatccgctacgtcgtcggcgtcgtctccgctgctgctgagcttccactccggcagcgtcggtcttgacgtgtcaccatcgtcgtcgtctgctgccgccagctccgacctgtccaagaaacggcggtgggagcaagaaatgcagcagcagcagcagcaataccagcagcagatggccgggtacacgcagagccaaatgccaggcaccgtgtggatggtgccgagcagcaacgcccaggccgccgcagttgctggcggaggcggcagcaacgagtcgatctggacgttcccgcaga

SEQ ID NO: 28803 - DNA, 383 bp, Sorghum bicolor
  Clone ID: 8088003
gcacgagggtttgatgcctggttttcacttatacatcagctacaacaaagggtagttatcttctcagatgctggaccagacactagatgggtgggagatgaggcaggagtcgcaggctatacttgctggtcccccttcaacaagagttccgtgacaattgggcataccattgctgaatactcacgcagtggggatccttttgggcaagactgggttcctgcagaatgtgatgtttccatcagaccaggttggttctggcatgcctcagagaaaccaaaaaatgcgacaactctgcttgacatatactacaaatcagttggtagaaattgtctcctcattttgaatgtccctcccaattcatctggcctcattgccaatgaaga

SEQ ID NO: 28804 - DNA, 373 bp, Sorghum bicolor
  Clone ID: 8088004
gcacgaggctcgcctgctggaactggaatccgcggaaccgcagctgctgcaagtgcgagtttccccggcccaggccaccagcgcggcagcgcccagcgacgagctgattctactgcacgcggccacgcgtcatcatgccgtcgatggcggcgccggcggtgtctgctccaagctccctccgcatttcgcgccacgggatgatcggaggaggagtaggacaaggatggggagaacggtgccgctacgggtcacggtctcagagggctatccgcggcgccactgtttctgccagagcttccatgaacataacatgctgtgcaaaccagacacaaacggcgcagcgcaaatcgtattcggggccaacctctccacc

SEQ ID NO: 28805 - DNA, 239 bp, Sorghum bicolor
  Clone ID: 8088012
gctgtaaaaaccaatactatgtcggatttgtacaaatcatcaatgcaagctcggatcgcaaaactgcctgacctctcctcactgcatcttgatgaagaagacgaggacgaggaagatgaacttgacggcattggtgaattaccaagtggacttggtcctccagccatgccctcaacgacccgtcaccctcgctccagtgctcgagacagtaccccgaatcccgcgtatgcgccgatctc

SEQ ID NO: 28806 - DNA, 461 bp, Sorghum bicolor
  Clone ID: 8088013
gcacgaggccatcacctctgacctcttcccgtccccgtcccccgccgccacctccgacccagagccagagccccccgggggggagcaggaaccctcctccaactcctcctgcacctcctcctcgctcgcggatttcgacgccgccgagcagctcatccacctctgggacaccaccccggaggcgctcgtcttcgaggctcccgaggacgacgccgcgcactacctcggcggcgtcgacgtcgccgtcgaccacctctccacccccggcgtctccggccgcgctggggtcgccgtgcagctcgccatgtcgcgcctcgaggacgagctccgccacctcatgctccgccactcggtgccgctcgacgccagcggcctctactgctcgctccgccgcctctccctcggctccatggacgacctcgacacctcctccgagttcgatcccaccaccccacacagcc

SEQ ID NO: 28807 - DNA, 149 bp, Sorghum bicolor
  Clone ID: 8088021
gcacgaggccgaccaggcctctgctctgaaagcaccgcgcgtcgtcgcccccacctcggagcctcccgctcccaccgtcctcgcgaccggggaacgagtcgcctgcgtgcacgacgtctcctaccccgagggctacgacgcgtctgcct

SEQ ID NO: 28808 - DNA, 172 bp, Sorghum bicolor
  Clone ID: 8088053
ctccacggcgtcctcgtctccacccatttccgttgcagagtagctcgacagtttctctcagcctcgagcggagcggggagaggatcggatcggatcggatcggagagcctacgacgcggcaggagctggctatccctcgaggtcagggagcggcggcgtcgccgcgcccgca

SEQ ID NO: 28809 - DNA, 506 bp, Sorghum bicolor
  Clone ID: 8088078
gcacgagggtcgtggtcggtgtgctcgacacgggcgcctggcccgagagcaagagctacgacgacgccgggctccccgaggtgccctcgtggtggaagggcgcgtgcgagtccggcgcctccggcttcgacgccgcctccgcctgcaaccgcaagctcgtcggcgcccggttcttcagcaagggctacgaggccgcgatggggcccatggacacggaccgggagtcccgctccccgcgcgacgacgacgggcacggcacgcacaccagctccacggccgcgggcgccgccgtgcccggcgccagcctcttcggcttcgcggccggcacggcgcgcggcatggcgccccgggcgcgcgtcgcggtgtacaaggtgtgctggctcggcgggtgcttcagctccgacatcctcgcgggcatggacgccgccgtcgccgacgggtgcggcgtgctctcgctgtcgctgggtgggggagccgcagactactcccgcgacagcgtcgccatc

SEQ ID NO: 28810 - DNA, 444 bp, Sorghum bicolor
  unsure (1)..(444): unsure at all n locations
  Clone ID: 8088080
caaatgttggtctcctcctccacctcctcgtcgtccccttcggcgtcccagcagcagcggcagccgccgccggcgcatccgccgccacctcctccctcctcctcctgcctcaccgaccagcagccgtcccccgccaagcgcaagaggcgccctcccggcacgccggaccccgatgcagaggtggtggcgctgtcgccgcggacgctgctggagtcggaccggtacgtgtgcgagatctgcgggcaggggttccagcgcgagcagaacctgcagatgcaccggcggcggcacaaggtgccgtggcggcgctaatagcagcagcacggcgggaggcggcggcgccccccggaagcgcgtgttcgtgtgcccggagccgagctgcctccaccacnaccccgcccacgcgctgggcgacctggtgggcatcaagaagcacttccggcg

SEQ ID NO: 28811 - DNA, 334 bp, Sorghum bicolor
  Clone ID: 8088085
cctgcaccagaagtttgatctaccagcaccttttgttctgcacactgactgccctcactactggagatatcatcttcctggtgagacagaagaagaatttgcgactagacttgccaccaatttagagaatcttattctcaaagaaggaccagaaacaatcgctgctttcattgctgaacctgtgatgggtgctggtggtgtcatccctcctccaaaaacctattttgaaaaggttcaagcagtggtcaagaagtatgacattcttttcatagcagatgaggttatcactgcatttggaaggttgggggactatgtttggatgtgattattataa

SEQ ID NO: 28812 - DNA, 519 bp, Sorghum bicolor
  Clone ID: 8088098
gcacgaggcagaaaagggcaggtagcagtgaaccccacgccacagcaacccacacaacacggatggccggcggcaaccgtgacgcatccgacgcggcggcggccgaggcggagctccgggcggggttcgagacactggccgtgacgcgtccggacccttccgcgggggtctacgaggtccgcctcaaccgcccggcgcagcgcaacgcgctgagcccggccgccttcgcggagatcccgcgcgccatgtcgctcctggaccggacccccaccgcgcgcgccgtggtgctgtccgccgcgggcccgcacttctgcgcgggcatcgagctgggcgggcccgggaacccgctggccgccgcctccgcctccgccgaccccgtggccgccgcggaggcgctccgccgcgcggtcctggacatgcaggcggcgctcacggccatcgagcggtgccggaagcccgtcgtcgcggcggtgcacggcgcctgcgtcggcggcggcgtcgacgtcgtcgcggcctgcg

SEQ ID NO: 28813 - DNA, 488 bp, Sorghum bicolor
  Clone ID: 8088124
caaacagggctgcctggaaatcggctgcgcgcgtgaaccaagcccagcggggcgtgcaaggcgctgctgctggtgtagggggcaagaagacgtcgcttgcccaacggtcaaagtaccaaatggagcctgattccgaggacgacgaaatggagaacgagattgagaacaacttggatcaactacacattgctgcaaagagcctgaaccagctcggtcgtgctatgggcaccgaagccgacaagcagaacgagcacattacccgcattacgggcaaaacagatgctgtcgatgacaagattgccaggaacaggctcaagttggatcgtatccactaaatttttgatgacatctgtgggagcttctgtttgttcttgtgtaaaagaaggcgaaaaaaagaagaaaacctctgctgtacatgtcacgtatagatattgatcctttgagggaaagacattattttgacaccttggatatatggaaaacaacca

SEQ ID NO: 28814 - DNA, 527 bp, Sorghum bicolor
  Clone ID: 8088125
tatccgtgaggtctctgtcatcgttacccgtggtgtcatccgcgctgcccagaagaacggcgtcgaccgtgctgttgagctgcgcgacatgtccgacgagcagcttgacgaatacatcaagaagaacatgtacgatccttacactgagcgccaatactttgaccgcaaggtatcccaccttgtcgccagcgaaaagctcaatggcaccaccgtcggtgtgactgaggtcaccaacggtcttgctcacttgtaattgttttgtacatttcttggatatatttcgttgtcaacacttcatcgctggatatttgatctttttccgtttcggccgccgcatctttttggactctagggtattgggactcaaaaatatttttctctttcttcggcgacgggctggacacggtttagatatcctactaatcacggtttctcacaacacgacggacgcatgacatgtagatagttttccttattcggtgcaactgggcgcaccgtacaaaagagggcaagaatgcaatatgtta

SEQ ID NO: 28815 - DNA, 353 bp, Sorghum bicolor
  Clone ID: 8088128
aaggcgtttcgcgctgcgggaccaccgccgcgctcctgctcgcgcaggtcacctgccacgcgtgccgccagcgctcgctcgctgtggcggccgtcgtcaggggcggcggcggcggcggcgagggacacgccggccccgcgatggcctgcgactctatcagaggaggcgggggctttggagcagcaggcatctagctccaccactcgtgcatgccatgcacagcgcggctggagattgtgtatgtagagctagctaagctaattcgtatgtaggccggccggccggccttgtgtcgatcgtgtcttgtagccattactgcatgcatgcaatgcaaccacgcacccgcttggttt

SEQ ID NO: 28816 - DNA, 609 bp, Sorghum bicolor
  Clone ID: 8088145
ctggccagatgcaagctttgaagactggacaagctcccaagcccaagaagtttcggaaggcttccgattcctctagcgaggaaagtgacactgacggcgatgcggacgacaccagcgataccgacaccgaaacggaagatgaggattgatttgattgtctcttgcattgattgattggttgtatgctggaccggtgcaaccgtggttgatctccatggatcatctcttttttttttctccctctggttttctgcatttttcattcatacctttgctgctctcggacgcttttcttcgtccacccttttctcttcctcccgtcatgattgttatctcggtgatggtgagtcagtgagtgtatgcttcgggcttcgggtgttagttgatcttcaattttctggattttgtttattaccgcgttgcttggccatctagcatcgacggacacgaaaatccccctccgccctttcttgttcttcatccatcgtgactccatctccctgtatctatgtcagcttgcatgtctacctacctcatttctataccacggcctcggagcggaatcagcccaccgcaaagctatattctgagaaacattaaatcgtcaaa

SEQ ID NO: 28817 - DNA, 544 bp, Sorghum bicolor
  Clone ID: 8088155
cacgccgcggagccttgctaaatcggacatgtcagcaaggccgctatcatggttaagctgaagtcaaagaggctaccgcgggtcgaggagctgtgcacccttaagactgcctggcgagactgaggcgaaatgattttgtagctcatctctctacaccaccacttccgcttcgagctgttctccccgctagactggatctagccgggtacacactggtagcggctgtggcgcgatgccaagtgagcgaggccagaggctgccaaacaaggctgtgctttgttcggcatgacctacttcgctccagggctctcccgctgggaacgggagggcgcttggtatatgcatttcaagagatgctggatataaaacaaaaacaaaaactcaaagtgtgcgagagaaaatgttatgaaaagagagggaaaaccgccgaaaaaaaaagatataacagacgggaaaaaaatcggctcttcaccctggcggtggggatgctttgcacgcaagtatgaagcgcactgctggaaaagggtccctgttcgttctcttt

SEQ ID NO: 28818 - DNA, 522 bp, Sorghum bicolor
  Clone ID: 8088172
gcgccgccatcgagttccgcggcgcgcgcgccaagctcaatttcccgggccacgaggcgttgctgccgttccagggccatggccatggcggcgacgcttgcgccaccgcggcggcgaacgccgagacgcagacgacaccgatgctgatgacgccgtcgccgtgcagtgcagacgccgcggcggcggcgccgggagactggcagctgggcggcggcgtggacggcggagagggagacgaggtgtgggaaggtctgctacaggacctgatgaagcaggacgaggcggacctctggttcttgccattttccggcgctgcatctagtttttgagctcttgtactgtacacacaagcgtgcagtggttactgacaggatctcagctagactgactagcattctttttgtagcattgaactaattaagcatagctagttggttcgttgtaggtggattaatttggaagaggggtggcattcttttgttgtgtattgattcgtggaaagagatataatccctctcaatg

SEQ ID NO: 28819 - DNA, 556 bp, Sorghum bicolor
  Clone ID: 8088189
ggcgcccagaagtacctcgagtgctcagccaagacaaacgagggtgtccgagaagtgtttgagcacgccacccgcgctgctctgctgaccaggaaagagaagaagaccaagaagtgcttgatcttgtaagcgcggccaggcctcaatacaggcggttctccgccaacccccgcgcctcgttgagcttcgacaagaaacaaacactgtggcgactgttgggtgtgtaatagtcgtttatccgagaaagagggcaagacgtgaaaatggccacccagggtagcagacgactcgcatctctttccgggctgctcccggcccatctctctctttctcacaatctctctctctctctctctcatggcacctacacgaggcgttttactgtgctggatcttttgtgtgtttggaccgtacatcatcttggggtagttcatgatgggggtttatcttctccgagcgtgtggaatcgagattgagcaaatggtaggattttttttctaataatcggtgcttgttttgctctttacaacgtgtcacaggcagcattcccatgaac

SEQ ID NO: 28820 - DNA, 451 bp, Sorghum bicolor
  Clone ID: 8088212
cgagtgtatgcttacaagagaaagagtggcaatgatggtggcagtggtgatctcgtgtgatacatatgcagtttgagccgtactgatcactttgaggggtgcctgtagctgtagttgtttgtagagagccagccctctacggagtacggagttgctacgggattctggtgttaacacactacttttccccttatctcttgatttatgattccaaaatgggctagggaagaggacacttggtttaagtttccaaatgggctagttgaggctatatattctcaaatgggccatccccatattattttgggagttggcaaataacaaaatttgcaaaactattagagttgctataaggggatcttcaattgccaactttaaactagtattagatgccatgtggagtagagagaaaacacagatttttaagctagcgggaagagaagagctagtt

SEQ ID NO: 28821 - DNA, 693 bp, Sorghum bicolor
  Clone ID: 8088235
tgtttccgcagttgccaagagtagccgatcttgtttcagactcgggcattccagttatcgcagctgggggaattgtagatggacgtggctatgttgccgcattggcacttggggcccaaggagtttgtttaggaactaggttccttgctaccgaggaaagctttgcgcatcctatttataaacaaaagttaattgagatgagtcgcacaggctacacaaatatttttggacgtgctagatggcctggtgctccacaacgtgtcctggaaacacccttctatgttgagtggaaggataatttcccagatcaggaaacagaggaaaatcatcccatcataggccactctatcatccatggtgtgcacaaggatattcgtcggtttgccggcactgttccaaacgccacggcaacaggagatatcaacatcatggccatgtacgcgggtcagggtgttgggctaatcaaggagatcgtaccagctgctgaagttgtcaaaagtctggtcgctgaagcaaaggaagtcattagagaaaagctttctggttaccagtaaaattctactacctgaactgagctagaacgtgaagtatttgtgagtagtcaccaatcaaaataattgtgagtaccaaggtttgtttcttgtgttatttgtaagtaaaaaaccgatgaaaataaatgagacaaccaaaggt

SEQ ID NO: 28822 - DNA, 673 bp, Sorghum bicolor
  Clone ID: 8088262
attgcacacgggatatcaatcagcaatacatcctggatcctgcttgcccggatgatgatctgtggagccccaagactgtagcagagacagatggaatgagtagggtgatgctagagtctgcactgcttgcctccaaatgtacagaatctttatacagtctatcctacacttgggggaatgatgaaacagttcaggagagccttggtgtccgcaagggaacaattggagagtggaaacgatttaaccatgaattgctttacaatcatgatatccagagtgcagtggggtaccattcaaggctagccacaaaaggatacagggcgctgatatacagcggcgatcacgatgctgtcgtaccccatgttggcacacaggcatggattaggtacctcaacttgaccatcgtagatgattggagaccatggtacgttggtgggcaagttgctggattcacaaggagttatgcgagtggactaacatatgccactgtgaagggtgctgggcatatcgcaccaatgtataagcccttggagtgccaaaaaatgttaataagatggatttcaggggattctctttgatatatgtctaaaagaatggtccatcacttatttgagtgggtagcatgctgtacctcaaagtcaaaataaagaaatttttcatgtcatgcaatgaa

SEQ ID NO: 28823 - DNA, 607 bp, Sorghum bicolor
  Clone ID: 8088265
accccagcaagcgcgtcaacatctactacgacactctggacgcggagctccggtaccgcggcgccgtcctgagccccgccgcgaccgcgaccgcggctgcgtcccccgtcgagttctaccagcgccggaagtccgcgcaggcggtgaggatcgagttcgacgggaagggcgtcgccttccccggcgacgacgacgtcgggaaacagctggagggcgaggtgaaggccggcgtgaagctgggcctggagctcaacgtcgacgcgcgggtgaggtacgtgttcgggagcatcaagatccggcagaagccgacggtctggtgcgctttcagcatcccggtgccgtcgacgcccggcggcatgggcgtttctttctccgacgaccggtgctgggtcaagtaccggtgatgaattgggttgagttcgcttgttgattatggtgtctgatttattgttcagaagagtttgattaatacgagtacagtgttgttttttgggttaattgttggtgtgtattgtgagtagagtagttgatttggtgagtgtgaaagctgattgtgctattgcattattcatttgtgagtggttataaataagaatcacatcaacaa

SEQ ID NO: 28824 - DNA, 547 bp, Sorghum bicolor
  Clone ID: 8088270
tttgggtgcgcgacacccggccatgatgcaggcgggtccttctctagaatttcaaaacagcttcatgaagagcattcgcgatgttgccgtctttgcttgggcgctgactggaatcaacggcagcctcgtcgattacgctcgaggcaagccagtaggcgagagtcagcctccagatggttttcctgtttggaaccccttaccagacccaaactttctaggcgtcaaacagccatctgccgccccttcgggctacggctccgggtccaacagctctgccagcaatgacccgtttggattcggcgatccagggctccgttaaaagccttgtatcgccgccaacgcaattgagacgatcaaatgtataagcacagccgtatgcagcgctttgtcgccatgggacgttaccaacctcagccccttcatcggctgaggagggcgaccaggctatcgtttttacaggagtcctggttatggcgcttatgtcactggtatcttatgatttatgtcaacaattgcacgggatataccaagccacatagcgctatgt

SEQ ID NO: 28825 - DNA, 611 bp, Sorghum bicolor
  Clone ID: 8088271
gcgacactcctcagttcaagtaccttaggatggtcatcaaggagacgctacggctacacccaccagcaccgttcctgatcccaagggagacgacgcagcatgtacaagtcctcggctacgatttgccgcccaagacacgggtcttcgtcaacgtgtgggctataggaagggaccctgcctgctggaagaatcctgaggagttttaccctgagaggtttgaagatgctgacattgattttcaagggacagattttgaactgcttccgtttggtgctggacgcaggatctgccctgccattcctatgggtcttatgaatgtggggtttacacttgcaagcctgctgcattctttcgattggagattgcctgagggtatggcacctgaagatgtgagcatggaaggtacgggtaggcaaattgtctccaggagcactcctctgtatcttatcccgtctccgtacataagtggacaaaccaagttgtattagccggattgtaggtctggttgcatactttgaataagttcagtcatgcaatgttgaaaatggttgttgtatggacatcctaaaaatcaactccatggatcatcatgatatcacattacagcttgg

SEQ ID NO: 28826 - DNA, 451 bp, Sorghum bicolor
  Clone ID: 8088276
ccggtgcgaccgatacggactgggtgtcaggatcatcagggaagggaaggactactacctgatctcccagggcgagatccagaggtacttgggctcccgccaggacacggacacggatggcgattgcggcaaggacgcgccgcggcaggacgctggagacgagcaccggcagatatccaaccggatcctcttcttccttggggacctggagaaagcatgcgcggacgccaaacgtgtcaaggcctgaacctgaacatgtgctacccttgtgaccctgatcatcggcacattgttcagcgcttgtatgactcttgctaatctgcataactcgtgcatagtgttgctatactgcatgtatagtgcctcacattcaattcatgtaagttgaatatcatgtttacatccacctgaaattataattcaagtacagtcgattagggtgcaaatcgac

SEQ ID NO: 28827 - DNA, 592 bp, Sorghum bicolor
  Clone ID: 8088286
gcaaggtgttaagtcctacccaaccattaagtggttccctgctggcagcaagaaggctgtagcctacgaaagtggacgcagtgaacaggcctttgttgattggatcaatgagcatgccggaacccaccgagtcaccggcggtggccttgataccgttgctggtaccgttgagtctcttgacacgctcgtggccaagatcacaggcggtgctgccatcgctgacgtcgccgaggaggtcaagaaggaggtcgagaacctcaccgattctgctcagaaaacctacgccgagtactacgtgcgcgtctttgacaagctgagctcgaacaatgactgggtgtcgaaggagctcgcccgtttggacggcatccttactaagggaggactggcccccgccaagcgtgaccagattcagcagaagaccaacgttcttcgcaagtttacccagaaggtcgaggagaaggtcgaagagatcaaggatgaactgtaaagaaccatgcatatgataaatgagatcagaaaggaagtcacgaatcaaagggttttatgtatttggaacttagtcgactagactcgacaggataaaattgaacga

SEQ ID NO: 28828 - DNA, 659 bp, Sorghum bicolor
  Clone ID: 8088293
ggggataccgtccccggcgtcgctctcaagtactccgtgcaggtgacagatatcaaacgattcaacaacatgatgagtgatcatggcatctactcgagggagaggcttctgattccgatcagcaacccagaaatccttatgggcagcacctgctacatcgagatggaccataacgccaagagagaggttgcaatcttttaccctgagggacgcccaggtggcaaaactgaatccgtggcaagcattgttgctgcagagaggcgaagcaaaaggattctcgagtcggtgaggcggagcctgcacgtcgacgatgggactgctgcgtactacttatctgttactgaaggtgatccgagggctgccatgatggagtactccgaggaccttaggtgggagcagcaacgcgcaggggggtagattcagatttcagatcagtggcatatgttaagacattggtgctcgatgatggttattgtttgatgtgtatattgtacaatcccggattgttgtaagtataagcacaaactttggtttaaatgtatgtatgtatgtattgtcaaatggcattgccgttgagaacaaaagtcgtaccggatgataattgtctggtgaaagtattacatgtcatttgtgaacctgctttgtttgtaagtaagata

SEQ ID NO: 28829 - DNA, 480 bp, Sorghum bicolor
  Clone ID: 8088298
gcacgctgtcggtgtgcgccgccggctcgtcgtaggagcgacgacgaggtgcgcagaagaagccatttccatttccacgcgtcgtcttttcagctttgttgcgcccaggccgaggtttttttttgtctttgttttgtccaacgaatcaagggggtgttctcagtgtgtgtgtgagtcagaaatagatcggcgaaaaatgaatagaagcaccaaaaaaaaaagtgtgttgcctgcctcgtgaggcctggtgatgctgctggttagattcgtttgccgccagcaccgacgcctcacgcttgcggaatcgcagatgggcatagataatctacagtttttccgtcgtgtaactgtacggtagatgcccttgaccattgatatgtagagtcatcgtcgagtggcatccgatggtaatagtcgtccatatataatgtatttctggaatctggacattgggtttttttttatatagagctgtaagca

SEQ ID NO: 28830 - DNA, 115 bp, Sorghum bicolor
  Clone ID: 8088305
ctcgcgaccgcccatggatgtgatgatggagttgctcttagggttggccttgtgcatgtgggctggtcttgctgttccagcaaaatttctgtcggtgctcccacattttgaggag

SEQ ID NO: 28831 - DNA, 541 bp, Sorghum bicolor
  Clone ID: 8088306
tgctcaacgagatcaggcgagccgacaacatcaagcgcctgaagaagatcaacaggcaggacatccgcgatcgatcggcgcccaggctcgacctcctcaagggcctcaaggcgctgcaccagcaacacgacgttctgctcaaggaggtggcggccccacccaagctgaagcacgtcgagaccaaggacaagaccaagcccaacctcttcttcgacaagaacgtccatgtccacaagttcgagaaggcgccgctgctggacgaggtgaggaagggctttaaggccaacgccaagcacgtcgagaccaaggacaagtccaagcccctcatcgataaggacttccacctcaagaggttggacaggcagggcttcctcgccgaggtccgccagggcacccagctcaagcacgtgtagccctcatctacgagccagagcacgacaacgcggaagtagcgacgggtagggtggggtatccgacaggatgtaagcttttaagatcttctttcttctttcttagacctatgatgtgtacataaaggaca

SEQ ID NO: 28832 - DNA, 559 bp, Sorghum bicolor
  Clone ID: 8088313
gagtggcaccaccaaaggataatccccttgcccaaaccaaacagttactgggacatctttgctgcagctgcagggtacttgctcctaaaagcgaaaccacgggattcttcgcaaatagcaaagtgggagtcacagtatttcacactcaacctcaagacattcctagttgagaggctgtgtgtttcaaattttcagtacactagaggtgctctcctgtatgctagtttcctatcaccattctcactgccaagcatatgatacggtcagcatctcaaccaggacttgtcaaggtgatgttgcaatgccagtcggtaacatctgtatggtgccttggaacattatgcatgagacatgctaatgctgttagagatgacatctatctagtctcatcagctgtttagtttatgtagtcatgttttccctgttgacattgtgttgtactgttgtgttttggagctatttggcatgcaatcgaggcagtaaggaggccttctaactgatttgtgctcgcacatttgtagccatagctcatggagatttgtccaatcagaatctgggt

SEQ ID NO: 28833 - DNA, 498 bp, Sorghum bicolor
  Clone ID: 8088317
ctcctccgacggcttccaccactacgccatcgcctgggacgcggccaccatcgagtggcgcgtcgacggcgagctcatcccccgcgaggagcggcgcgagggggagccgtggccggagaagcccatgtacctgtacgcctccgtgtgggacgccagctacatcgccgacgggaagtggaccggcacgtaccacggccgcgacgcgccctacgtctgcagctacaaggacgtcatggtgcccactgccaagcatttagtggaagaagacgaagagaatcaggatgcagatgccgctgatgcgcctgctgtcgatcctgcagccgacgctgatgctgcggcggcagcggcagcggcagcggcgggaaaagagaaggacgccggagccggtgaagtttagatcttggtggtgcgatgcaatttcgttttgttcaagtgtcgctgcaaccaaaacggatgtatgaataatggatgcggtctgatcagtgaaacaaacatttc

SEQ ID NO: 28834 - DNA, 241 bp, Sorghum bicolor
  Clone ID: 8088320
agttcagaatgcatatcatcaagatcaaagaaagctcagccaggtaggaagcatggatattgagtcacagcagtcacaagaggagacttcaaacagtgctgatgcctgaacctccgattatgaacaatcacagcaaataggaccctgaagtcatctgataacaacattgatttgatcattgctcagtacttaatagagtgagtggatcaggtttacagtttgcgtatactggaggcaggtg

SEQ ID NO: 28835 - DNA, 575 bp, Sorghum bicolor
  Clone ID: 8088340
gtggatcaaactgtgtgaataagggttcgcctcgcctacgatctgctattgatggccctggcaaatggagtggcgagcctcttgtggagtgcacttcccacatgtgccccgtaaaaatcaactggcacgtgaagcagaacagcaaggactactggagagtgaagatcaccatcacaaacctcaacttccgaatgaactacagcgagtggaacctggttgttcagcatccaaacttcgataacatcactcagttgttcggcctcaactacaaaccactcactccatatgggggtgacataaatgacacggcaatgttctggggtgtgaagtcctacaatgatgtgctgatgcaagacggtaagcttgggatggtgcagtcagagctccttctccgtaaagactcccggactttcacattcgaaaagggatgggccttcccacgccgggtgtacttcaatggtgataactgtgtcatgccagctcctgaaaattacccatcgttgccaatgcaagcctagtaataaggctgtaacgaaagaaccgtcgttcggtttgattacggctgattgccatta

SEQ ID NO: 28836 - DNA, 109 bp, Sorghum bicolor
  Clone ID: 8088361
aacagaagaaggctcctcctgtaattcagccttccattcttccctaatgtaattacgacttaggtattactggatatctctggcagcggggctgagctgtttttcatgc

SEQ ID NO: 28837 - DNA, 376 bp, Sorghum bicolor
  Clone ID: 8088413
gcacgaggctctactgcaagggagccggaaggctcgtggcgctcgaggaggaccgtgcgcgggacctccgtctccccgacggcggcgtcctcccgagcgtgccccccgacgtcgaggtcgagcagtgccgcagagacccccagcgcatccgcccgttcccctccggcccaggctccgccgtagcggacgcgcccttcgtctgcagcttcgataagatggctgagtatttcaacttgaagtcatgcttgtccgagacagtaccgctgggttccttcaactctctgttcagcttcaccggttcatggaagaatgatgcggcggccacgaaggcccttgcgatcgatggctattctctgcctctgtttcgagtgaaaat

SEQ ID NO: 28838 - DNA, 247 bp, Sorghum bicolor
  Clone ID: 8088431
gcacgagggcccgatcccacagcatccacagcaggcggcggcggcggcggcggcggcccagcagcagcagcagcagatggccggggattcacccggcgcggagtcgctccggcaggagctcaagacgcagcagctcaaggtgaagcgtctcaaggaggagtccctgtggaaccagagctacaagaaggccgtggggctcatggcgcgcgccgcctgcgcggtgttcgtccgcatctgctccatcttc

SEQ ID NO: 28839 - DNA, 148 bp, Sorghum bicolor
  unsure (1)..(148): unsure at all n locations
  Clone ID: 8088433
gctcctgagccgggccaggtgctcgcggtcgatcggcgccacgagtggtggtctggtttctttcagctcggnagaggtagccatggggaggtcgccgtgctgcgagaaggcgcacacgaacaagggcgcgtgnaccaaggaggaggac

SEQ ID NO: 28840 - DNA, 501 bp, Sorghum bicolor
  Clone ID: 8088445
gcacgagggtagctatgaaaaataaggcatcgacaacaaaattcacattgaaaacagaagctacaaaaatttctcagaattgtacatggtggtctccctgacaaaatttccatcccaggctgccaagtgtgtgtgcatttcgttcctcaccaagtgcgcgcgcatttcattcttcgatgtgtgaagcatggtgcacgcacatcagccatgtgccatcaaccttctcgaaaatgttggtggcgatttgctttccccaagttcttcctttggtctttaccacttccaagcacgtgacataaccaaggttgccacggatgtgaacctctatattcttgagatcaatattcagtggaaactcataatctgcattgcaaaccatctcccagctttgcatgaccacatcataacccgatatccgacctgcagcaggatgtataacatatacatggtcacccttagcccagatagaatacattgcagcgatatctccattcttgaagg

SEQ ID NO: 28841 - DNA, 374 bp, Sorghum bicolor
  Clone ID: 8088469
gcggcggtgcggtccaagctccgggagtggtggcgcgacccgggcccgctggacgaggccctggcgcgcgggtggaaagacggcgtggaccgcatcatggcgtggctgggccccatggcgcgcgacacggtgcagtggcaggcggagcggaacatggaccggacgcgccggttcgacggcgcgccgcgcgtgtacgcgctgcagacgctgcggtgggcggacaaggagaaagccgaggcggccatcgtggaggtgctcgtcgcgctcagctgcatctgctggtacgaggagcgccggcgaggctccgtccgtctcggttaatgaattgaaccgttcaacgccttcttgctctcgctcgatcggatcggacgtgg

SEQ ID NO: 28842 - DNA, 602 bp, Sorghum bicolor
  Clone ID: 8088472
cggcatcgacccgcagacgcaccgcgcgctcggagtcagagccgacgccgccacggctcccggcgccgtcgcggcgcaccaccgggcggcggcgctgctgcaccaccacgcgggcgccgtcgtcgtcccggtggccccggtcaagctcctcgccgtgaagccggcgcccgcggagtcgtcatccgacgacggcggcagcagcagcaccggcagcagcggcggaggcagcgccggggagccacggtgccccgacctcaacctcaacctcgacctgtccgtgggctcgccgccgccggcggcggctgccgacacgcccacctcgctgtgcctgtgctaccgcctcggcctccgcgccggggaggcgtgcggctgcgaggctgacatcacggggcaacaggggtttagatttttcaggccgttggaacaaggctagtagtgccgtaaactacgagcttctgctatcagacttgagaatgagaacccgagaggagagtcgttaaaatagcgggcttgattcactgcaatttgcaggaaggacaggcagttttttctcctaatggacagcactgtttgaggaaaagaggaaaacggattaaagaaat

SEQ ID NO: 28843 - DNA, 635 bp, Sorghum bicolor
  Clone ID: 8088507
gtcgaccagttgttggcctcaaactgctcttggaaggagccaaacagaatcgtctggctattcatttgcagcaccttggatcattaccaaagatattcctacctcattgggactcccatattaccattggacctccaaaatggcaaggtcctgaagaacaggacagcagatggttcgagccaatcaaatggaagaactttgctcatgttagcacagcacccatagagtacactgaaacaaatattacggacctatctggtgtttatattgttacaggagcacagttgggagtgtgggattttggtgcaaagagtgttctccatcttaaacttttgttctccagggttcctgggtgcacaattagaagatcagtgtgggaccacagcccatcaagttcttcgattcataaaacagacgaatcttcatcatcctcaagtgataatgccaaacttctgaagatcgttgacatgacagaaacattgaagggcccacaagatgcgcctggccactggctgatcacaggtgctaagttgggtgttgagaaaggcaggattgttgtgcgtgcaaagtactccttattgaattattaaccaaatgtttaaagcattcattcactcactctaatattgagcact

SEQ ID NO: 28844 - DNA, 476 bp, Sorghum bicolor
  Clone ID: 8088524
agaacggcttccagcgactacttgggcccgtcgaaggcatcatgcgacggaatgaccccaccaagttggcttctgaaggcgacaatgtagatcccctctcgcacacttcgtaaaccatttccgtcaccaaacctacgactcctacatgtttaccccccatggacagggttactttttcagggctatgaccggagcaaagaatctgagtatccacgtgtaccttgatgcagtgctctcactcttcggcgttttcacatgtattcctacgcttcctactgtcactaaacatggcttgccgtgatggagaagaaagaacgagagagagggagagagagggagagagagagagagggaaagaaaggagaaggacaaaggcttttgattccacaagcataataagctttagttgtgcactgctctgttagctatatttcattcaggtatgatggtcatggtttagacattatgcatcagat

SEQ ID NO: 28845 - DNA, 477 bp, Sorghum bicolor
  Clone ID: 8088535
gcacgagggtggcaacaaggtcatagatttgatgacagcgttattcttctggacccttatgcaaaattagtttctggccgtaagcactttgcggttgaagaagagaaaccaagccagcttttcggaacatatgattttgatagctcaccttttgactggggtgacaattataggcttcctaatttgcctgagacagatcttgttatatatgaaatgaatgtccgtgccttcactgcggatgagtcaagcaggcttggtccagcttttcgtggaagttaccttggtgtcattgataaaattcctcatttgctggaacttggcgttaatgcagtggaactacttcctgtttttgagtttgatgagctggagttgaagaggttccctaacccaagggaccacatggtaaatacatggggatattctacaatcaacttttttgcgcccatgagtcgttatgctagtgcgggtggtggacct

SEQ ID NO: 28846 - DNA, 122 bp, Sorghum bicolor
  unsure (1)..(122): unsure at all n locations
  Clone ID: 8088556
gcacgaggatttgttcagaaaatatctgctttgttacttggttctcatgtnnnagaggatgcaacaattttaaattgctagtgatttcttacttctagataactgctcctgttttatgtctn

SEQ ID NO: 28847 - DNA, 471 bp, Sorghum bicolor
  unsure (1)..(471): unsure at all n locations
  Clone ID: 8088563
ccacttcccaaaagcaaagcacgttgctaatctaaccaatcccctccgcttgctttccttcctccttcgccttcctccccaccaccaccaacagcaccaccaccaccaccagcagcgctccatccatcctcgcctcggctctccccctgcgcccccttcccctccgtcaccgattccctcttgctccgtcttgatcgggcgggcggcgggagggtcaggctggcaagtcncgcggcgatgatcacctctccgtctccctcgccgtcgccgtcgtcgtcgcggacgcccaacaagggcgggggcggctccgctacgccgccgccgccgcggagtctgcaggccagcaagtggcgcagcggcgcggtgcgcggggtgtacgggcggcgcctgctggacgcgctccgcgccacgggcgggggccagccgcgcgccgtgaaggcagcggcggactcggcgctggcgctgacggcg

SEQ ID NO: 28848 - DNA, 555 bp, Sorghum bicolor
  Clone ID: 8088564
ccgccggcttcgacgcggacacgggcgtggtctccaaagaggtcgtcatcgacgccgccaccggcgccaccgtgcggctctacctaccgcctgctgtccagggaggagccaccacgacgaagctcccgatcgtcgtcttcttccacggcggctacttcatcgtcggctcaactagcgaaccgatgtaccatcgctacgtcaactcgctggtcgccagagcacgcgtcgtcgctgtctccgtcgactaccgcctcgcgccggagcacccgctcccggcagcctacgacgactcctgggccgcgctcaggtggtcggtctccgccggcgcggacccgtggctgtccgaccacggcgacctcggccgtgtcttcctggtcggagtcagcgccggcggtaacatcgtccacaacatggccgtctccgtgggcgtgaacggcttgttgccagccgccgaaccgccgcgcatagaaggcgtgatcctactccacccttccttttccagcgagcacaagatggaggcagaagaaggggggttctggcgagctaacaataaca

SEQ ID NO: 28849 - DNA, 439 bp, Sorghum bicolor
  Clone ID: 8088582
cggtcgtgaatcgggatggcggcgacggcgacggcgacggcgaggaagctgatcgtggaggtggtggaggcacgggacctggtgcccaaggacggcacgggcacgtcgagcccctacgcgcgcgccgacttcgacgggcagcgccgcaagacgcgcaccgtggctagggacctcaacccggcgtggaacgaggcgctcgagttcgacttcccgcccgccggcgtcgaccccgtcgagggggagccgctcgaggtcgccgtgctgcacgacctccgcgtcgggcccacccgccggaacaacttcctcggccgcgtccgcctcgacgcgcgccagttcgtgcgcaagggcgaggaggcgctcatctacttgccgctcgagaagaacaagggcttcctcaacagcttcaactgggtccgcggcgacattggcctcaaggtct

SEQ ID NO: 28850 - DNA, 428 bp, Sorghum bicolor
  unsure (1)..(428): unsure at all n locations
  Clone ID: 8088587
cgcccatgggcggcgacgccatgcgcgtggacgatcttctcgacctctccaccggcgccggcgccggtgcccacgacttcttccccaccgcggccgcggccactgacaaggggcaccagcaccactcgggcgccatgggtgagccgtcgcccaccgccaactcctcggatcaccagacgtcgctcctctccttcgccgatgagttctacatacccagcgaggaagctgccgagctggagtggctatccaagttcgtggacgactcctactccgacatgccgaattactcgtcggccgcgcatgccgcaatggcggcggccgcggctgctaacgcggcagcaggcaatggaggaggaggcacctcggccggcggtcaagacagctgcgtcaccggcgcggcgcctggccgcggcgcgcgtancaagcgg

SEQ ID NO: 28851 - DNA, 316 bp, Sorghum bicolor
  Clone ID: 8088594
gaagtgtgcagcatgactttgtcgaacgcgcagatggctttgcggaagtgttccctgagcataaatacactgtggtcgagatgctgcagcagagaggccatctgacggccatgactggtgatggtgtaaacgatgctccgtctctgaagaaggcagattgtggtattgctgtcgaaggcgcttcggaagctgcgcaagcggcagctgatattgtcttcctcgcgccgggcctgagcacaatcgtgctggctatcaagacagcccgtcagatctttgcgagaatgaagtcgtatatccgataccgtatcgcgctttg

SEQ ID NO: 28852 - DNA, 441 bp, Sorghum bicolor
  Clone ID: 8088615
caggccagagacaacgcggcgttgctcaagggcaagggcaagggcaaggagaagggcaaggtgcaggagcggctccgcgtgctggcccgcctcgtcccggggtgccggaagctccccgcgcctactctgctggaggaggccgccgactacgttgccgcgctgcagatgcaggtcagcgccatgcgcgcgctcgccgacgcgctggcggccgcgcagctgtcgtcgccgtcggacgcggacgcggaggcggggaggtgaggcgtggtcacgtgggtgggtgggattgattgcttgattgattggcctagccgcctggccccatgacatgattgatcaccagctccagccggagcagctcgctcccccccacctgccggattccgacgggggatcggggaggggaagaaaacaaataatcatttgcggtgcgtgcgttgctct

SEQ ID NO: 28853 - DNA, 444 bp, Sorghum bicolor
  Clone ID: 8088616
cccttccttttccagcgagcacaagatggaggcagaagaaggggggttctggcgagctaacaataacaggtgggcggtcatcttccccggcgcgatcggcggcgcggacgatccgaggattaacccgatggcggccggcgcgccgagcctagcgaagctggtgggtgagaggctgctcgtctgcacggcgtctttggacccgagggcgccgagggggccggcatactgccagcccgtgcgggccagcgggtggcgcgggaaggtggagtggttcgagacagaaggtgaggaccatggtttcttcgtccacaaccccggcaaccacaaggcggttgaggttatggatcgagtggttgctttcctcgaggaccagtgaccccaacctcaggcacagcaagatcgttgtagctgatcatggtgtactgcaagtgtgacctcaagtaa

SEQ ID NO: 28854 - DNA, 524 bp, Sorghum bicolor
  Clone ID: 8088622
tttcgtcgggatgggcctgtcgggcgtggtgcccgccgtgcacgcggccgccgtgaactggcacgagcccgcccggaacgtcacgctggcctacgagggcgccatggccgtgtcctacctcgtcggcaccgcgttctacctcacccgggtgcccgagcggtggaggcccggcgcgttcgacctggcggggcatagccaccagatcttccacgcgctcgtcatcgccggcgcgctcgcgcactacggcgccgccatcgtgttcctcaaggcccgcgacgagatggggtgcccggccagctaagcgaggattggggagacgaaatcaaaccattttgtttacagctttacttacagcagcagcagcagcaagcaagcaagtgtgcaagcatgattgatcgttaattaccgttggccgttggaatgacagttgattggcgttacagattatattccttctcaatttgtacatagaagaactgaagaagctcatcgagtcatgattgattaatgcattctttcgatcg

SEQ ID NO: 28855 - DNA, 642 bp, Sorghum bicolor
  Clone ID: 8088627
gtcacccttcaaatcgcacatcatgtctgcccctcgcgctacctcaccaaacgctgcctcttcaggctccacaacggcgcgtcctgcgtcgccaaagcccccgggtggccctgccacggttatgcgcaggaaggctgccgctgaccgcgccgagaagaatgccaaccagcgaccaagcagcacaagggcggccggagccggtggcagctcaagcaccatgctgaggctgtacactgatgagtctcctggactcaaggtcgaccctgttgtcgtcatgacgctgtctgttgtcttcatcttcagcgttgtcgctcttcacgtcattgccaagatcatgcgccgtttctccgcataaacggaacacacgccattgctgtttttctttcgccttccacaaatctcctgttttcaggcagctactctcctgtagtagccttttactatatcccccccttcgatctgcgattagccgtgtctgattcttcattgactgtgttgggaccaaagggcagagctaaaagagagcatgaatccactgaggaaaaaaaaagccaccattacccatgatatcattgccattattcagagcgagcacgacattggggagctcagtatgatcagggaactgctcgttttgcttgc

SEQ ID NO: 28856 - DNA, 553 bp, Sorghum bicolor
  Clone ID: 8088637
ggtggaggtggtcgatgctgtcgtccacgaggtgggcgcgcgtcgcgtgggcgttaggctgtctccgttcgtcgacttcctggactgtgtcgactctgatccactggcgcttggtgaatatatggtgcagcagctgaataggcacgaggggctactctactgccatatggtcgagccgcggatggccaatgttgatggccgcagacaaatccctcataggctcctaccgttcagaaaagccttcaatggaacgttcattgctgcaggcgggtatgatcgggaggaaggcaacaaggtggtgggtgaccattatactgacctcgttgcgtacgggagactctttttggctaatccagacttgcccagaaggtttgagttgggtgcacccttgaataagtacaaccggtcaactttcatcacgcaggatcctgtcgttggatatactgactacccattctatgaggataacaaccatgtatgattatgtagctcattcattcgtgctgtggttgataagttgattcatagtgtctagcctcctagattatctaaa

SEQ ID NO: 28857 - DNA, 562 bp, Sorghum bicolor
  Clone ID: 8088643
gcaacggcagccgcggcaagaagagcccggcgagccccggcggcggtcccgctggggtcgaggtgggcttggagggcggcgtgcgtcggtgcacgcactgcgcgtcggagaagacgccgcagtggcggacggggccgctgggccccaagaccctgtgcaacgcgtgcggcgtgcggttcaagtccgggcggctgatgcccgagtaccggccggcggccagccccacgttcgtgctcacgcagcactccaactcgcaccgcaaggtcatggagcttcgccgccagaaggagctcatcctcatccgcggaagccacagccaccgtgacgccgccgcagccgcagctgccgcggcggcggctgctgcaggatccgccgccgggccgaggccggagctcatcttccgtgactacggcgtgtgttaattagctgcatggccggcaagcttggcaaccgtctccggcacggagaggaagctcgatcgcgtcgtgcattgcattgcatgcatggagctgccttagatccttttgcgaaattctgccgtttctttctttctttctttctt

SEQ ID NO: 28858 - DNA, 520 bp, Sorghum bicolor
  Clone ID: 8088649
ccgctggacccgacgctgtcaggcggcgcgcacttggtgcagtgggtgcgcgagcacgtgcaggcgaagcgcgacgcggcggagctcctggacgcgcggctgcggggcagggcgagcgaggcggacgtgcacgagatgcggcaggtgctgtccgtggccgcgctctgcgtgtcgcgccgcgccgacgaccgccccgcgatgaaggacgtggtggcgctgctcaaggagatccggcgccccgcggcggtggacgacgcgaagcagccgtcacccacggccacgggcgccgcggcaacgcccgcgccggtgtcgccggtggtgagcgcgcactcgaggggccaatcgtccagctgctccttcgccgtctcggagtactctgcctgacgggatgcaaatttttgcaagtgtagtgaacctagtaaattgctagcatcttagcaagtccgtaaacagttgttgattagccaaggatgtactattggtgatgttgtacttaggtgtaatctgcccttgtacatta

SEQ ID NO: 28859 - DNA, 305 bp, Sorghum bicolor
  Clone ID: 8088670
gaatctccatctcctggatttgatcctggttcacagggttcaggcctagattttgcatctcgagaatcaaagtgccataactgtggtattagtgaaaaaatgaccccagcaatgcgtcgtggtccagctggtccaaggactttgtgcaatgcttgtggattgatgtgggcaaacaagggtaccctgagaagttgccccaaggcaaaagtcgaatctcctgtggttgcaattgaacagggaatcagtgacaacaaagcgctggtgacgccgagcaatgacaatgttgctgcaagcaatggcgaagc

SEQ ID NO: 28860 - DNA, 170 bp, Sorghum bicolor
  Clone ID: 8088681
actgctgctactcgcatccccatgttccttgctggtcgtttcttcgctggttatggcgttggtctgatctctgccaccattcctatttaccaatccgagactgcccctaaatggatccgtggtaccattgtcggatgctaccaacttgccatcaccatcggtctcctgct

SEQ ID NO: 28861 - DNA, 448 bp, Sorghum bicolor
  Clone ID: 8088683
gcagaaagtgatgcaggtcgcacaccgacttgcaaaggagaaggatgaacttcagtcactcaggaaagagaaggaagaggcagaccgcctgcaagaagagagacaccatttggaagagagtactcggaaaaagcttctagagatggagtctgcaatttctagagcaaatgctcagctggagaaggcagaagcttctgctcgcagacgtgaggttgagaatgcacaactcacgttacagatggaagctgcaaagcgacatgcagcagagtcagcaacaaatatttcagagcttttaaagaaggatgaaaacagtcgtaaaaggtctcagcgttgggaatctgacagagccctgttacaagaggaccttgcagcacaaaagagcaagttatctcgggttcaagaacaacttcagcatgctaaagagctaaaggatcaagtgcaggcaagg

SEQ ID NO: 28862 - DNA, 302 bp, Sorghum bicolor
  Clone ID: 8088702
gcacgaggcctatcagccgccgccgccgccatgggaggctcgcacagccgcgaggacctcgacctatccgactccgactcggaggacgccgagtcccgggcctccgacaactcctccgactacggaacgcctaccccggcctccgcctcctccaagttggccagcggcggaggggcggcggccaccccgggctctatcgacgccatcgaccgccaccttcgccagctccacctgaagtacaacgagcccatctccccgaaccctagccccgggcccacacccagcgccaaccccgccgcgct

SEQ ID NO: 28863 - DNA, 114 bp, Sorghum bicolor
  Clone ID: 8088703
tcacaggtgtgctatgcgtggggataaaagacatttcatttgtgctaggagttgtgacagtcctaaattgctttgtgatgctatttgttatcatagccggtagttacatcggct

SEQ ID NO: 28864 - DNA, 548 bp, Sorghum bicolor
  Clone ID: 8088705
gttcagagctagtcgagacactacactacacgagagtgaagtgggagtggccagtgccagtcggctctgctacagcagccactaatggctcgcgtcgccggcctttgtgagctgcttctcctcctgctcctcgccacggccacggcatcggccgccacacctcttggccggaagggcggccacgaagccgacgacgacggcgagctcgagttggcagcgaagaatgagaacgacggcgtcgtcgcagctgctggcagcaggacgtcggccgggaggtacgcggtgatcttcgacgctggaagcacggggagccgggtgcacgtcttcaagttcgacaagaagctccacctcgtccagatcggcgatgacatcgagttcttcgccaaggtaaagcctgggctaagctcatatgctggtcgacctcaagaggctgcaagctccctactccctcttcttgagcaagctgataagattgtccctcgccggcttcagaaaaataccccgcttaaacttggggcaactgctggtttgagattaattggagatga

SEQ ID NO: 28865 - DNA, 302 bp, Sorghum bicolor
  Clone ID: 8088710
ccgtttgtcctttgcgtcgtcggtgcataccatttttttgacaatggctccgatttctatcgcggacctcgtcgccgctttgccggctgaggatgcttggggccccgccacctcgggcgacaacatgctcgagggcgttccctatgctcctttctccaagggcgacaaattgggccgtatggccgactggactgctgagtctaaggatcgtgctggtcaaggtcgccagcagtacaaccgcaacttcagagatcagcaggtctacggtgccggtactaccaggctgttcactatccaggctg

SEQ ID NO: 28866 - DNA, 151 bp, Sorghum bicolor
  unsure (1)..(151): unsure at all n locations
  Clone ID: 8088714
gcacgagggccgcctcccgcacgcgctcgtgggtcgtggctcgcgcaggcaaggcgccgtcgctcagcggccgccggcgacgagcctccgcggaatcctgcggccctaccgncgaggtggcgagttcttcttccttctccaccgacgggac

SEQ ID NO: 28867 - DNA, 483 bp, Sorghum bicolor
  Clone ID: 8088716
gcacgaggattgctttgcaccttcctccactctattacacgcaccttccgatcgtttctcttttccgcagctccagttctttcgtttcatcatgtgtggcatcttcgggtacatcaactacctggtggagaaggacaggaagtacattctcgacactcttgtcaatggtcttgcacgtctcgagtaccgcggctacgactcggccggtctggctatcgacggcgacaagaagaatgaggtcttcgctgtcaaagaggtcggcaaggtcgcctcgctgaagaagctcgtcgatgagcagaacttcgacctcaccaaggtgttcgattcacacgccggcattgctcacacccgatgggccacccacggtcctacttcgcgcgtcaactgccaccctcataggtccgaccccaactgggagttctcggacgtccacaacggcatcatcacaaactacaaggagttgaagactctgcttgaggctaa

SEQ ID NO: 28868 - DNA, 310 bp, Sorghum bicolor
  Clone ID: 8088733
caaggagtggctggccgaggtcatcttcctcggtcagctccgccaccggaacctcgtcaagctcgtcgggtactgcagcgaggaggagcaccggttgctggtgtatgagtacatgcccaaagggagcctcgagaaccacctcttcaagaagttcccgcccgtgctgtcgtgggcaacgcgtctcaacatcgcggtgggcgccgccaggggcctcgcgttccttcacaaccacgagaaacccgtcatctaccgcgacttcaagacttccaacatcttgctcgacccggactacgaggcgaagctctcggac

SEQ ID NO: 28869 - DNA, 371 bp, Sorghum bicolor
  Clone ID: 8088749
cggcggcgaccggagagagagagacaaggcgcggcggcacgagaaagcggcggcggcggcgcccaggtcgccgaacccgaagaggcccgttaggaggcgggcgccgggacagagcgaggagttctgggagtggcacatgcctactgcggccggagctggacagggaaaagcgtagcagcagggtagtgtggcgcgacctaactatagggtttttgtttttttaacagtgcttgttactgctgctttttttgtgtgtataaaagagagagaaaaaacaagacaggtgtagtcgtataatggtagatgatacaactattgtctgcactgcctttgttcagggttgcacttgcaccgtacccctgctgtaaggc

SEQ ID NO: 28870 - DNA, 569 bp, Sorghum bicolor
  Clone ID: 8088775
ccttcagtgcgaagctgtcatgtctggcgagctaaagcacggtgttcttgcccttgtcgatgagaacctgcccatcgtcatgatcctcactcgtgacgacatgttcgccaagtcgctgaacgcctaccagcaggtcattgcccgcagcggacgacctatcatcatctgcaaccaggacgaccccgagttccccatggacaagaccgatagaatcgaggtccccaggaacgtcgactgcttgcagggtctgatcaacgtcattcctctgcagcttatgtcctactggatggcggttgccgagggcgtcaacgtcgatatgccccgtaacctcgccaagtcggtcactgtcgagtaagcaagtatgatgtgcatgggttaatggaaacggcgctctggatatccgaacagggatatcaccggtgttacggaagctccttgaagagagcagcatgttcgatacatctcgtacgaacgatatgaatggcttctactttagcacctaggctggtaatagcacccaagaaggtcactattacccaagatggttctattacccaagacggtataga

SEQ ID NO: 28871 - DNA, 499 bp, Sorghum bicolor
  unsure (1)..(499): unsure at all n locations
  Clone ID: 8088784
ccgtggccacgctggtcgagctgctcctcgacgagggtggccgccgcgtccccgagctagccgtcgtggccatcgaccacctctgcggctgcgcggaggnccggtcggagctggtcgcgcacccggcggggctggccgtcgtgtccaagaaggtcatgcgggtgtccgtagtcgccaccgagagcgccgtgcgcgcgctccacgccgtggccaggcattcgccgacgccctccgtgctgcaggatatgctcgccgtcggtgtggtggcaaaactgctgctagtgctgcaggtcaatgccggcgatagggccggtatcagggcaaaggacatgctaaagacacacgctagggtttggaaggactcgccatgcctccaaagggattcttacccttgctgatacatacatatactactacatgtacattacattgatatttgtagccaaaaggagcacacattttgattctccttttcaagtttgttactaattaaattatt

SEQ ID NO: 28872 - DNA, 659 bp, Sorghum bicolor
  Clone ID: 8088799
atcttcattgacaaagatggaaaggagaagaacgggtttagtgggagaatggggaaccgaattgctgctccaaggctgctgaagctcaacccactggactctcatctagcaggagcaaacaacaggttcagggagggaagattctcttgggtgacagagaatgggaagcaggagcggcatctcgtggccactgtgggaaagtacagtgtggtctggaacttcttgcaggtcaagaacagccaccacgagtgttaccagtaccaggaggggcttaagagctgctattgctacaaggtgatccccaaggacgagtcaattgtggccagccgcttcatgcatgacaggtattcggtcagcgactccccggaggctccactggtggtggctacgcccctgaaggtcacctccttcagcatatcaagcaggcactagctccgtgctgctgtcgctcctctccagcattgcgagggtcggttgattgcctcccatgtcccatgtggggtgtaactcttagatgattctgttttcgttttcttttcttggtagacttttaacggtcaagcttggtgactacctcgtcatggtttgttggaggaccgaaatctatgttcgttgaccaaaactttgtgcttgttttttaatatatatattgtggctct

SEQ ID NO: 28873 - DNA, 680 bp, Sorghum bicolor
  Clone ID: 8088801
ttgtattttgcgtggattcagtggtaaatacacctacaacgggaaggaatatgatgcaacagcctcacctgaaggcgcggtgtatgacaagtgcagggaagagataatcaaggcacttaagttgaatgcaccatgtgaaagcaagaattgtacctttaacggcgcgtggaatggaggtggtggagctggccaagacaacctctatgttgcatctttttttctttgacaaagctacccagtttggcttcattgatagcaaggcacccagtgcaaagtccacccctgaggcgttcaaaggtgctgcagacaaggtttgctcactgagcgcccaagaagccaaagttatgtaccctaatgtccttgatgtgccatacatatgcatggatctcatctaccaatacacattgcttgtagatggctttggtttggctcctacgaaggagattacattggtggctagggtgaagtatggagagtactacattgaggcagcatggcctttgggtactgctattgaagctattgcacccaaaaagatgagacaagatgcatgattggggtcttttagggtccttagtcctccctagctagggattttgttttccccagacattgtggcatctttgttgattcatggattttgcattgatcctatgtaataaccgatctcttatgagaag

SEQ ID NO: 28874 - DNA, 137 bp, Sorghum bicolor
  Clone ID: 8088813
acatgactgctaaagtatagacatgaccatcttcaacgatgatgatgggaaggcctacctgatatactcttctgaggacaacagcgagctgcacattggcccgctaactgatgactaccttgatgtcactgatgtga

SEQ ID NO: 28875 - DNA, 452 bp, Sorghum bicolor
  Clone ID: 8088826
gcacgaggggcactcttcctcaggtcttcccgaacctcaagtggtactacatcctggtcgcgtacatctttgcgcccgtgctcgccttctgcaacgcctacgggactggcctcaccgactggtccctcgcgtccacctacggcaagctcgccatcttcatcttcggcgcgtgggctggcgcgtccaacggcggcgtcctcgtggggctcgccgcctgcggcgtgatgatgagcatcgtgtcgacggccgccgacctgatgcaagacttcaagaccgggtacctgacgctggcgtcgcccaggtcgatgttcatcagccaggtgatcggcacggccatgggctgcgtcatcgcgccctgcgtcttctggctcttctacaaggccttcaccgacatcggcatgagcggcagcgagtacccggcgccctacgccatcgtgtaccggaacatggcc

SEQ ID NO: 28876 - DNA, 466 bp, Sorghum bicolor
  unsure (1)..(466): unsure at all n locations
  Clone ID: 8088833
caaatatgtgcggtattatcgctatcctaggttgcaaagatcccaaagctagccgcgctagagctgtcgagttggctaccagaattcgtcaccgtggccctgattggtcaggttatcacgttcaaggcaacaacgtcttcgctcacgagcgtttggcaatcgtagatgtccaaaacggtgctcaacccctcttcaacgaggacaaatccatcgtcttggttgtcaatggagaaatttataaccacaaggatattgaagccaccgtattgaagggtgatcacaagtttgcaactcaatccgattgcgagtgcatcgttcacttgtacgaagagaagggcaatgattttgttaacgaactttcaggtgatttcgcttttgttgtgtccaagggtgacacttacttggctgctcgtgaccctattggtgtctgcccgatgtacattggttacgctgctgacggtgctgn

SEQ ID NO: 28877 - DNA, 214 bp, Sorghum bicolor
  Clone ID: 8088849
catcggaagattttggctggcacacggatcccaatgtgccctttatgttccagtgcatatcatcagacctgggaacgacatcattgtaaggtaatcgttaactgcatgctcctaatcctgggctcattatcgatttggttgcggatccagatttaacgtgttgtccaaaacagtaaaaagggttgcacgtggtgtacatcctacatagtactct

SEQ ID NO: 28878 - DNA, 562 bp, Sorghum bicolor
  Clone ID: 8088868
ttcgtcgtgtgaagaacttgcacttgtctgactgcttgcgtgccaacaaggcctgcatggcttggggtgttgagatccgtgtaccgttcttggacaaagagttcctcgacgtcgctatggacattgcccctgaagacaaattgtgctccaaggaacgcatcgaaaagtacgttctgcgcaaggccttcgatactcctgaaaacccgtacttgcccgagtctattttgtggaggcaaaaggaacaattcagcgacggtgtcggctactcttggatcgacaccttgagagagtggactgaaagtgaggtcaatgaagaggaatacgctcgtcgtgctgagctcttccctcacaacactccctcgaccaaagaagccttctactaccgcaagatcttcagtcaattgttccccaaccccaccgctgacaagactgtcgctccttgggttcccacttggtcaaactctactgatccctctggtcgtgctcaaaagatccacgaggctgcttacgaaaacaaagcttaagattttgacatctttttgacttcgagaaacgaaacgta

SEQ ID NO: 28879 - DNA, 441 bp, Sorghum bicolor
  Clone ID: 8088871
ctatgaggaccgacgacatcggtggcagcgcctttgtgaagctcgtgaagcaaggaagcgctgctctcctcaacgcctacgcgaggagagggtttcctttcaattcctgggaggtgaaggcccttctgctcgaggcgctggtctccgaggaggctgccgtggtccaggcggagcggttcgagcaggcgaacgaatcctgtgtttgatggatgaaaatgaaatgaaatgatggtgcgctgaagcttgtccctgcttgggagctgtatcatcaggaaggggggcgtggagtagctgtgtattgtgttcgtacttcgtagttggtcaccacttctgtgacctttttttttggtgttgaggtttctgaagcagcttctcttggtcggcatgtttctctaactgccggggtaagtgtaatgttgttgtgtgcactgatgactgaag

SEQ ID NO: 28880 - DNA, 403 bp, Sorghum bicolor
  Clone ID: 8088878
cggcgctctcggcgcgcgcgcgctgtccgtcgagaacgagaccgaaggcagcggcggcggcggcggcgccgtgccggacttctcgtggcagggcttgtccgcgaccgacaacagcgcggtggtcgagctcggcggcgccaagaagcgcgcccggacggagccagagccccaagaagtggcgcaggcgccgccgtctgatgattcagccgacatgctgttcgacgctttcatgttcggcgaccagttcagcttgttcaacggcggcggcgtgtacgacgagcctgccgcgactgcgatggacggcttgttgggcggcgacgccgtgctgtgcaacgacagcgtggggctctggagcttcgacgacagcgtgtgttattactaggccggccggctttccttcttc

SEQ ID NO: 28881 - DNA, 668 bp, Sorghum bicolor
  Clone ID: 8088891
gcacgagggctctttcttgattctatgggtggtggtgcatggccgttcttagttggtggagcgatttgtctggttaattccgttaacgaacgagacctcagcctgctaactagctatgcggagccatccctccgcagctagcttcttagaggaacccgcgcgaccggtgcacggcggcgcagctcttggagcacccgttcctggccggctgcggcggcgtcaaggcagcggcggcggcggcggcggcggaatgggtgtctcccaagagcacgctggacgccgcgctcttctgggaatccgacgactccgacgatgactccgatgacgaaggcgacgtgtcagagagccccgcccagagaatcaaggcattggcctgccccggctcggccttgccggactgggattccgaagaaggcgactggattgaagtgctcgacgagcaatgtgaagccaaagccaccaatttggtgccaaccgaagatgtggccagcgaagacgagtgccagctcctccagagcgaggtgttggaaacagaggtggttgatttcatcgacgccgacgccgagggcgatgatcctgagtgttctgtagctgtaggattacctagtgctgctccgtcagttgagctgcaggaagaacagcgtactgtattacttactgatgcttgt

SEQ ID NO: 28882 - DNA, 399 bp, Sorghum bicolor
  Clone ID: 8088898
gcacgaggcatacatcctagctctgttcaactgcctcctatacacctggtacgggctcccagtagtgagctccggatgggagaaccttcccgtcgctaccatcaacggactgggcatcctgctagagatcacattcatcggcatatacatatggtttgctccagcagagaagaagaggtttgccttgcagcttgtgcttcctgtcctggcgttgttcgccttgacagcggctttgtcgagctttatggcgcatacgcaccacatgcgcaaggtttttgtggggagtgttggtctggtggcttccatatccatgtacagctctccaatggtggctgctaagcgagtcatagagacgaaaagcgtggagttcatgccgttctacttgtcgctgttctcctt

SEQ ID NO: 28883 - DNA, 397 bp, Sorghum bicolor
  Clone ID: 8088901
gcacgagggccaccccggcccaggatgtccgccctccagtcgccctgttcggtgttgacggcacctacgctactgctctgtacactgcctccgccaagtccgctgccctcgaccagactgccaaggccatcgctaccctcggccagaccctgaaggccgaccccaagctgtccaccatgctcggcgctcctactctctccatggccgacaagcaggagatcatcaaggagctgcagaaggttgccggtgccgacaaggccgacatcctcaagaacttcctgcagactctggccgagaacaaccgcctggctaccctcgagggtgtctgcgagaagttcggtactctgatgagcgcccaccgtggtgaggttgagctgaacatcacctctgcccagga

SEQ ID NO: 28884 - DNA, 167 bp, Sorghum bicolor
  Clone ID: 8088902
tcccggcatactgctacttcttcgccagcgcaccgacgagcccgtccagggcgagctacgccggggacgcctccgccacgccgggcggcggcgacgaggcgacgttcgacttcacgctcgggttcagcgggcagctgcaggaggccacgccgatcctcgcggacgac

SEQ ID NO: 28885 - DNA, 188 bp, Sorghum bicolor
  Clone ID: 8088913
gcacgaggcgcttctctaatccctcacttccttccccgtcggggttgaagcctggttccggtcacaaaagacttgatctggtgtccgacggaggcggcggcggcggctcctctgcagatggattgaggggccatggaaaacccggcgccgccgaccgatcctgccgccgtcacgggcgccacgccaac

SEQ ID NO: 28886 - DNA, 421 bp, Sorghum bicolor
  Clone ID: 8088928
cttcgcggcgttcggcgaccgggtgaggttctggacgacgttcaacgagcccaacctgtccaccaagttccagtacatgctgggcgtgtaccctcccagacactgctcgccgccgttcggcagctgcaacagcggcaactcgcaccgggagccgtacgtcgccgcgcacaacatcatcatgtcccacgccgctgccgtccgcaactacaaggagagctaccaggcgaagcagggcggctccatcgggatcgtgaccgccatgaaatggtacgagccgctgacgaataccacggaggacattctggcggcgcgacgcgcgcagcctttcgaaaccgagtggtttttggacccaatatttttcggtgattacccgagagcgatgcgagagatcttgcaatcaaacttgccaaccttcaccgcg

SEQ ID NO: 28887 - DNA, 406 bp, Sorghum bicolor
  Clone ID: 8088949
ggtcgagaagggtgcacggggagctctcatgatggcgatggcacccaaggaaggcatcactggtgcgttcttgaacctcaccgaggtcgcgccattcgtgtaatatgctctccccattgtagtacagacagaaaattctacgcaaccaaacaaaggatactggtactttgttggtgccgtgctccgtgcaagtttaagtttccttcggaattgatcttacactagaagtactagaataagagtactagaagttataaaaattttagcaatttaaggtatgtaagttttttttagtaaaaaaaaaaaagagtactagaagttcgtggatgaatgtggggcatatagctagttataaaaattacttagatttgccttcactcttatctgtctattttgtaaaccaata

SEQ ID NO: 28888 - DNA, 363 bp, Sorghum bicolor
  Clone ID: 8088959
agtcttcgatgtgccgctgcaagtggacccggcgcacggtccttcccgggctcccgtcggcgagaccgagaccggcacaacatgcagtcaaaagggacgacggaggtggcgtgccaagattagaattgaataccgtggtgtcctgcagtcctgcctgcctgcccagatcgagaaattaacgaataactaattgtagctttgctgaagttgtgaggtagttgtactcctagtagatcacttgatgctcgatcggcgctgctcacctcagtcactggtatatcaatcgccatgtacagtacaaaatttcaccattccattcatcatcaaatcggcctgggtttttaggctgcagctgttcatata

SEQ ID NO: 28889 - DNA, 401 bp, Sorghum bicolor
  Clone ID: 8088976
tactgcatgtacaggagagaccacggggcagcagccgaagcagaggtgcgtgtgcatggcgccgccgctgatgaggagaagggcctgaaagcagcggtgccgatggccgtgctggtgcagccgcaggagacaactgatgcaagcaagtagggtcaatcaaaatgtctgaaatcaaaatcacctgtgactttctttacctcagtttgcggcccagcccaacggcccaagccaacacctcactggacttcccgtctccaaggcgaattaatagaaagtagggctcatgggctgtacggccacgcagcagggaccctccatgctgtaatgtcacaaatgcccagggaatagctaataggaaaaattccggccaggtttggtaatttatacaaagcttttattta

SEQ ID NO: 28890 - DNA, 470 bp, Sorghum bicolor
  Clone ID: 8088978
actctctccatggccgacaagcaggagatcatcaaggagctgcagaaggttgccggtgccgacaaggccgacatcctcaagaacttcctgcagactctggccgagaacaaccgcctggctaccctcgagggtgtctgcgagaagttcggtactctgatgagcgcccaccgtggtgaggttgagctgaacatcacctctgcccaggagctcgacgccaagaccatctcccgcctcgagaaggccgttgccaagtccgagttcagccagggcaagaagctcaaggtcgtcaccaaggttaaccccgacattgtcggtggcctcgttgtcgagatcggtgaccgcactatcgacctgagcgtttcttccaagatcgccaagatgaacaaggctctgactgatgccctgtaaatgtaaaatagcccaattgcccccctgaatcaagtcttccgcccagagggagtggatgtgcg

SEQ ID NO: 28891 - DNA, 125 bp, Sorghum bicolor
  unsure (1)..(125): unsure at all n locations
  Clone ID: 8088992
gcacgaggcaagagcagcggcatttgagatcgatatccaagcgagcacgcgcacgacccgagcaatctagctgctaagtacgacgtgtacaaacatctccgagttcgagcaaaatggnaggtgtn

SEQ ID NO: 28892 - DNA, 478 bp, Sorghum bicolor
  Clone ID: 8088994
gcacgaggctggttaattccgttaacgaacgagacctcagcctgctaactagctatgcggagccatccctccgcagctagcttcttagagggactatggccgtttaggccacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagattatcatgtaccttccaattatatacggcagccttcacatttagggcatacctatagtaatggctccacgatgagtaatggattttcggaaagcatttatgaagatgctttgagtgaagactgcgaggatgatgacataaaaggccaagatggcattgacttgttcaaagagaatgaagatgagcctcttggcaatttggatataacaatcaaagggagaaaga

SEQ ID NO: 28893 - DNA, 391 bp, Sorghum bicolor
  Clone ID: 8089003
tttcaactctgggctcctaagtcttgacaccgatggcccaactgaagttgccgctggagtgattgggcttcctgtcgtgatcagtgccggcccgcgtcgctctcccgcctccttatccgcacaggcagcccgcctttcatcctcagcgtcaccgccatctcgtacggcggaggcgcctccatgctcgccgcccgcaccggctccacggcgaacctccggaccacggcagccacaacggttttcatctgcacgtacgccatctccttcccgaggcacgccctcgggccggcgtggaagaccgggtacctcgccgcgtccaccgccacgaactcgccgccgccgtcgagccaccgctcggggcggaactcgcggcagtcgtcgccccacagcc

SEQ ID NO: 28894 - DNA, 385 bp, Sorghum bicolor
  Clone ID: 8089004
caaagcggagaaagctgccgctgcctgctagcagttgcagcccccgccgccgcggcccccggaggaggcgaaccaaccgcggctgtccccggcgggaatttcccagccgcggccggcgatcgagtcagttccgtcccgtcccgcgccgatgcggatcccgcggcggaagggcggggccggcccgctcgctgttggggtgcccagcatgcgggtgcaggtggccgcggtattcgcgctcgccgcgctgctcggggtctccgtgctctacgacagcgcccacatcgccgccacgctgcggaggcacggcggcggcccgacgacgtacgccaagctctcgtcctccgacgacggcggcggccgtagaggcgctcgcgccgacggcgcg

SEQ ID NO: 28895 - DNA, 436 bp, Sorghum bicolor
  Clone ID: 8089005
gcacgagggaggacgtcattctggaatcgtgaccttcaacagactcgaactctctatatcatggccatgtcccttacgcggacagccctcggggcgccgcaatcgcgtctcattacagccgccgccgccatcacagctagatctatcgccgcgcaccggtccttcagcaccaccaaccatgctctactcccctccggcttcggatctcccgtcctgccttcttacttctcgaagccccggctgccggccaatactgtggtccgatttgtgcctcagcagacagcttggattgttgagcgcatgggaaagtttaaccgtattcttgaccccggtctggctatcctcgtgcctttcatcgatcgaatcgcatacgtcaagagcctcaaggaagttgccattgagatacccagccaaagcgctatcactgcggacaacg

SEQ ID NO: 28896 - DNA, 543 bp, Sorghum bicolor
  Clone ID: 8089015
gcacgaggggagtcaacaactcgggtaaacgcggtcgcgacgacgaagatcaggacccataccgccccgacagtgtccaaggcgacgacatgggcggtctcaagaggcgcaagaccatggagggtggcgcggttggcggcaactacgctgatcccaaccctggcatccagcgtgcgcataccatgtcagctcagcgtgccagacggtaatgggataaccttcgcgcaagcatttgggtggtcagctgccggttcccatattagaaggcggtttggcctctatctctagcgaattcgcggcattgagcgagcggtcttttcagaagcaacatacaacatgccacctcgacatctctcaggcactctccaatcggaacgcaacggttcgaggcgacctagatgccaccttttcgctcccacatatttctttgtgttcacatttccttctgattttatctcttgtctacatttcaacacgtttcggcattcacgacttttacgaccatgtgcttcgtggaaccactgttcctatacaccatgtcct

SEQ ID NO: 28897 - DNA, 386 bp, Sorghum bicolor
  Clone ID: 8089037
cgctcctcatcctcctctcttgctccctggcagcagcaacgtcgcctctggggacaatcgagcgcgtaactaagcagcaaatcctggcaagcatccccccggtcgggggcgcgcccgtgctcttcctcacgtcgccgtccggcaagtacgcggcctacttcgtgcgcacgcacaccgtgccgggcgccggcggcctcggcgccgacttctgctacgtcgagatcatcgacaccaccacgacggccgcctccggcgcacatggcggcaccgtcgagggcgaggaggagggcgctgctgggacgagcgtgtgggagtcggagtgccatcccatcagcaccgtcaacacgtgcgcgctgctcttctcgtggcatgggctggaggtgttc

SEQ ID NO: 28898 - DNA, 335 bp, Sorghum bicolor
  Clone ID: 8089039
gcacgaggggcacccttattggtgtcttcgtcggggacaggcacgtcatctctgccgcaaactcaactggttggaacaacaagcaacaacaagactgcacagaatgatgcgccacagacaaccctcgatttgaccaagccctttgacggactgcccaagggaggcattgccgccatgctacttggcaacaagaggcgtcttaatctgggcgaagttgaagaggacgaggagccggtctcaaagcgcgcagctacaggacctacccctatcgttaccaacgggcacgatggtgttgagccagcagcgctcgtacctgtgcagcacgggggttgttc

SEQ ID NO: 28899 - DNA, 483 bp, Sorghum bicolor
  Clone ID: 8089050
ccacgacctagacgtctattccatgacctacacttctatcgctcttcagtcaaaacggctctattttagcagtgggtggtcagcttcattcgtcatcacgttgaagcgctgtgttttatcccgacgagtgttgtgattttatgttcgggaggccagtcacctcgacaattttgcatggttgcgcaagaactcagggcatcctccatggtgacccgattgagatagcctgctgagcgggactatggaaatatcaaagaaggatagcaagccgttcctctccagattattccatccttttggcccacggcttgagaacgatgggtttccaggaacaggttacctatcgacaggtggaggagtaagggaaatgacagtcaagggaaacagaaaatcattttcagagggaatcgacaaatccccttcccaacatcacctgcccgcggcgaaacggttatcactccacataccggcacggcagcctgt

SEQ ID NO: 28900 - DNA, 445 bp, Sorghum bicolor
  Clone ID: 8089059
caagtcctagcttgtgaaacatgaagacacccccatcatcaaatttaaggctactgcgcttgttgcaaaaaaaatcctgtttggaaatgggtacctatgcacagatcggtgcgacgccacttaagcgaagctaggcacagccacctccatttgcatatagcccactatggttgaccaggtctcatgcaggaaaaccatggcgctggcaatgagttagtgagctgtagcatcatggattagtgccggtacatggtttttggcttgtccatcagccctatcgcggttgtgtggttgtttgcttgcggacatggcaatagtgactgggaagtccaagcagttttacaaccgataaactgcctcgttccgggctctcccaaagttcaacttgtgagcttggtgaagcttagataggtaggacaagagtgtattagaataatagaaggaa

SEQ ID NO: 28901 - DNA, 590 bp, Sorghum bicolor
  Clone ID: 8089061
acggaggagcgcgtcgcgcacgacagcccggcagcggaggcaccgctggagtccgtccaggttcgcctctcgaatgtgcagtccaagttcgcgggcgccatcagcgacggcggggacatcgtcctggagggccgggtcaagtacggcgtgccgcacctcaccctcgtcggaccctacgaggtggacgtcagcctggagggcaacctgatcctgtgccggcagatcgaccagcccgggatgatcggcaaggtcggcaacatcctcggccagaggaacgtgaacatcagcttcatgagtgtcggccggacgttccggggcaagcaggcgatcatggccatcggcgtcgacgaggagcccgacaaggagacgctggagaacatcggggccattccggcgatcgaggagttcgttttcctcgagctatgatggacagcgagttttctgtaggattaatatttgatagtgcgtactgaacttggggtttgacgtccgatggacacagggacgaacgcagatccgtggtggtctgtctctttctgtttgggaatctctacattttttacgccaggagaaggaagtagtatatgtaa

SEQ ID NO: 28902 - DNA, 550 bp, Sorghum bicolor
  Clone ID: 8089064
acagggacgacccgcggaacatcagcctcgagttcgccagcttccgaccgggggcggcccacggtgacggacggcggcaacgggctggcgtacacgaacctcctcgacgccatggtggacgccatctacgcggcgctggagaaggccggcgcgcccggcgtccaggtcgtcgtgtcggagagcgggtggccgtccgccggcgggttcgcggcgagcgtggacaacgcgcgccagtacaaccagggtgtgatcgaccatgtccggcagggcacgccccggaggcccgggttgctggagacgtacgtgttcgccatgttcaacgagaaccagaagactggggacgagatcgagaggcactttggcttgttcaacccggacaagacgcctgtttacccaatcaacttcccaaactgacacggcgatgctttcactcgatcgctttgtgtttgccacataccgtatttatttagtatatatatatacgtcaataaataatatgcattgtatgaacgagaagtacaaaataatccatggtattggcttgtcgctg

SEQ ID NO: 28903 - DNA, 614 bp, Sorghum bicolor
  Clone ID: 8089098
gctgagaagtacgtcgatgcctttggcaagttggctcgtgagagcacagctgtcgttgttcccggaaatgttggagatatcagcggcatgatcgccactggactgagtgttttcggcaaagttggccaggcccaggcacaaactatggccaagtctcttgtcgaacccaagaaggaaggctcagagaccgagactgatacaccctcagagcttgatggccaggcaaaccccggcgtcaaggagacggtgatcgagagcttcaaccaggctgccaagcgatagggatgaaataccaacatagcctatggcatattacggaacgagatgaaaccacccttatatcgactcatcactcaaccacaacatgaacattccacactaccatgattatcggcgttcagcggatgtattatagggatctttggaggatccgagacggccttgctcacagagctgggggataacggagagaaacgtcatcatgtaacataaaattttctttattcaaaattcaagcgcatggcaaaaggagggaaaatcacggctcaccagtctacccacttcttcaagcatataaatagcctgctgttgaagtaggggagcacagaatcgaa

SEQ ID NO: 28904 - DNA, 384 bp, Sorghum bicolor
  Clone ID: 8089106
cctacttgtcgtgatcttcacaagacaacaaggtaatcagcagggctacagaaccttctaaagggatgttatttgcagcataggatagggaatggtgtgattgccatcgttctgagccaaaagaaaatggtgcattaaaccatgtgaattcctttcggtgagcagcatctgcatgctgcatgagatcaagcaagcggccgattggccatgctctacatgccattcagttcgttgacgaggaattaatcaccagccatgttggccggcacagacacaggccagaggccatactacaattcatccatgataggcaaaggaagatccaagacaagatcaacaaatatacaaatagttgtacaagcaaaaacttttggatcttgttgt

SEQ ID NO: 28905 - DNA, 107 bp, Sorghum bicolor
  Clone ID: 8089107
ttctcggtcataatgtagtcacagtatctaaggtaagtagaccaaatcaggcattgatcccacactacacccatgagcctgagcataaaacacatactttgtgcaaa

SEQ ID NO: 28906 - DNA, 658 bp, Sorghum bicolor
  Clone ID: 8089109
ggttgcaacgtatcattaagatggttgtgcagcgtaaagaagccgagaacctcgagagcagcgttagcatagcccatctggaaacgcgaatcgctggtgctttgcaagtgggagcacgggaagagttccgtctctatctttttacctacgccaagcgattaggcgccgagggagcaaggctcaaggttgaagagctcctcaatagtcttctcggaggtatccttgaggagaatgaagaagaggatgaagaggacgatggacatggttggttcagcaaagagggcgatctatgtgggtgggatcgcagagagctcctgaaggacgtagtgatgattcttggtaaataccgagagcttcagcgacttactctgcaatatgcaaaggtactcgacataagcttagaggatggctcagtagatgtcgagcagatggatgtggaggcttgagttgattttagggctgtatcattatagtactacctccccctcgacgaagggagggagaaggtgggaattgtttcttgtttaacaaacaaacttggcgttgagggcttatctattggggacgttaagcggtgcttgggggacgggcgatagatcactgtaggtgctggttgatacgaaacaacgcctggttaatgagggaacgcaatcacaac

SEQ ID NO: 28907 - DNA, 490 bp, Sorghum bicolor
  unsure (1)..(490): unsure at all n locations
  Clone ID: 8089111
ttaactctttgccctatggagattcctcacacctttttatttgngatgtgaaaaatgccagaaatataatgtgtggcttgatattaagttccatggacccaatatgtagcttgctttacacttatagtaggctaaatatggaatgaatattaaaactttaaggtacattgcagggacctctggtacacttaatccatgcaggcctggtcaatctaattaaatgcagcacactgttgctttatatgaaccccctattagttttatctgtttgacgttgtgtttgctttctggacaaatgggcaactacctgtaagtttaatgttgtcaaagtaaatgtccaaaggataaagcatcatcattcatatgtagacttttatgtaatggcagacttttttggtactgctaaccgcaccgactctacttctaattgtcttggattcaagtgtagtattggtgaacaataggaacagcagaaatctcttactcctaa

SEQ ID NO: 28908 - DNA, 514 bp, Sorghum bicolor
  Clone ID: 8089113
gctcccgcccttcgccgagccgctcggcgcgcacagcagcaacctgcccttcggccaggaaccggatggcaacggacactcggccgagctgccccaggcggccgatgtcggcagcggagcagcggcctttggtggcgccgcaggggtgactgggccggagctcgggcagggagagcacgacccggcaggcgtgggtggcgccgcggccgggttcggtacccagcccttagtggacaacagtccctatgacagcggggcctggaaggagggccgtggggcccacatcaccgccataggtgtcgctctttgcgtatgcgctgtgcttggcgccatgggcacgggtctctgatgccactgctgctgcaattggttggccgtgtcctttgggtggggtgggtcatgtttggtgtttgcaaattgcaatgggtgatggttaagtatgttttcttttcttctttttatagttattcgcttgtatcaaatatcgtgtaagagggaatgtttatctaattga

SEQ ID NO: 28909 - DNA, 381 bp, Sorghum bicolor
  Clone ID: 8089163
gcacgaggccgcggttcagctcgcgggccacagagacggacctggacaccaacacaccaacaccgagtgagctgtgagcctcaaagcccctcgagccctcgagagtgtgaggcacgactagcatagcagcactctagcagacgcatcggtcgatccaagaaagcttagcatcgagcagcggcagccatgacgctggacaccccggccgccgtggtgctggagctgatgaccatggggcagcagtccgcggcgcacctcagggacctgctccgggcctcgtcccccgcggcgtcgtcgccgcaccaggagctcgccgccgagatcctccgctgctgcggccgcgtcatcgacgcgctcagggccaccaccaacgggcgcaag

SEQ ID NO: 28910 - DNA, 503 bp, Sorghum bicolor
  unsure (1)..(503): unsure at all n locations
  Clone ID: 8089202
ttttgtcaagctatttgagttccctagcgcagtagacgactgcaacttggccattaagaaagacccagcatttatccgagcctacatccgaaaggcccaggcttacttcggcatgcgcaagtactctgaatgcgtggatgcctgcgacgaggctatgcgggttgatgtcgagcaccacaagggtgccaacgcccgtgagattgagcagcagcagcagaaggctctctcagccatgtactcagcccgagagaacgagacagaggagcagacaagacagagactgatgcaagacccagagatcatgggcataatgcaagatccagtcatgcaatccattttgcaacaatcacaatctgacccaatggctctgaacgagcatatgaagaacccaagtgtgcgatccaagattcagaaactgatggccgcgggcgtcatccgagtgggaggtcgataaaaggcgtgagattcncaagtcgttatgtaaatttgcaataatgagcaca

SEQ ID NO: 28911 - DNA, 159 bp, Sorghum bicolor
  Clone ID: 8089215
aaggttaatggagtgattaggtggtggtagtactatgtggggattggtattggattagctaactgatgatgggtggggttgaagagtgtggatgcattggttggtggtaatgtgtgtgttacctgctgaataactcttcagactcctcaattcagggag

SEQ ID NO: 28912 - DNA, 321 bp, Sorghum bicolor
  unsure (1)..(321): unsure at all n locations
  Clone ID: 8089232
ntactcctcctatcctatcctatcctatatacagtcctacatagtatttctcatttgcagccacgaccacgactcggagaagagaaaaaaagaaagaaagaaaatccaagcaacaacaataacaagccaatcctgctctagtatctaattcctgcctgcctcattctgtaatgtactacaactgctgctgtattagagttgagatgagatgggattcccaattggatcccttcctgaataagtctatatacatatatgtaaagggcgaaaacgaagatttgtccctgttccattcatttgactacttattagtacgactac

SEQ ID NO: 28913 - DNA, 459 bp, Sorghum bicolor
  Clone ID: 8089251
caacggaggctcgccggcggcctccatgtcgcagggagggtggtcgccgtcggcgtcgtccgaggtcgggttcgacttcgaggcgctgcacgagtggcacgacacggctgctcctgatccggtgatggagttcctggacggctgcttcggatgggaatccgtcctccaagacagctccgacttcggcgggctcctcctccatgacatcgctacgtttcagtagtagattatttttagaatagcagcagcagaccagcggtagatctggactggacatgtgttgtcgccgtcgctgtagtacgtgtactccgtacgtgagaacagtcagtccgaccgagcagtaatgagtgacaacctacgagggtcacaggctcgctcatcagatggttgccgtagagcacactagtaacagtatctgtttcaggcagagggttcagatttttttaaaaaaaaaagaat

SEQ ID NO: 28914 - DNA, 375 bp, Sorghum bicolor
  unsure (1)..(375): unsure at all n locations
  Clone ID: 8089265
ccaagcccagcaagcaaagcaaccagttcagctagctagctagcttattggtgcataatttcatcaagcaagtctcctgtgaccttgctcatataaccagtacgtccgagatcgatcgattaagctactagctgtgctaagtatatatagctagctagttacctgtcgtcgtcgtcgatcgtgcttgcattcgtgcttattagctctgtcaacaatggcgtcgccgtcccgaacaaacaagccgcagcttgtgttgtggccgtcactcctcacgctgctgatcttcttgcccggcgccctagaggcttctgctgcgggtgccggaacaggcaccagcaccttctccccgagctccatcagctcctctgccgatgn

SEQ ID NO: 28915 - DNA, 361 bp, Sorghum bicolor
  Clone ID: 8089274
gcacgaggctcttactcgcggtcgcggcgccctcgcctccctgtcactccctcgtcccccgccccagcccccatccacgccgcgtcgccctccgcctccaaataaagtaaacgccgcgggtgacaggaggccaccaccgaatccccccctgcgccccctttaacccgtcgtcgccgcgcccgctcgatcccctccgccttcttcgccgccggccaccggaccgcgccagctcctcggcagccgagaaggacccggcgccatggggttctgggaggcttttctcaactggctccgcaggattggttgagattgttacggacgcagcgaagctgcagcttgcttgtggaaagcctctggtttg

SEQ ID NO: 28916 - DNA, 506 bp, Sorghum bicolor
  Clone ID: 8089276
gcacgaggcccagaccatctccggcactggtgccctgcgcatcggtggtgcgttcctgcagcgcttctacccccacgcaaagaagatctacctccccaaccctagctgggccaaccacaacgccgtcttcaaggactctggcctcgaggtcgagaagtaccgctactacaacaaggacactatcggtctagactttgagggcctgatcgccgatatcaaggccgctcctaacaacagcatcatcctgctgcacgcttgcgctcacaaccccaccggtgtcgaccccacccaggaccagtggcgccagatcagcgatgtcgtgaaggagaagggtcactttgccttcttcgacatggcctaccagggcttcgccagtggtaacgccgaccaggatgcttttgctcctcgccactttgtcaaggagggccacaacattgctctgtgccagagtttcgccaagaacatgggtctctacggtgagcgtgttggtgctttctcgctcgtct

SEQ ID NO: 28917 - DNA, 400 bp, Sorghum bicolor
  unsure (1)..(400): unsure at all n locations
  Clone ID: 8089294
tganaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagaaggctctggaaggcaaaggcatcaagttctacctgagcgctggcgtcgacagggctgagccatcagcctcggatccgtccaaggtcggtgctgtctacctcaaagatggcaccaaactcgacgcagaccttgtcatcttgggagtaggagtatctcctgagacaacgtatctgaggggcaacacggctgttcagctggaaaggatgg

SEQ ID NO: 28918 - DNA, 332 bp, Sorghum bicolor
  Clone ID: 8089297
gcacgagggcctgggcctggggctgggactgggaggccaaattgagcaaagctccgtcctccgtcggagccgagcaacgacgatggacgagccagccggcgacggcggcgtgcacgggcagcgacgggacggagggcggcagcacgcgccggcggtggtgtcgctgcgggagctgagcctggcggacgcggacgtggacgccttcatgtcgtgggcgtcggacgaccgcgtgatgcggtacctggtgaagcggccgcggtgcgacactcgagagcaggccgtggcgcagatccgggacaccgtgctgggccacccgtggttccgcgccgtct

SEQ ID NO: 28919 - DNA, 278 bp, Sorghum bicolor
  Clone ID: 8089304
cgcctctgccgactccgccgctcgcgcccgtccccttgcccgctcacgccttccctccctctccctctctacctctctctttggccgtgctggcacagaggtctggcctggcgcggccatctccacgtacggcggcgccgccgccgctgtgcgcagcagccgcgccaacagccacggtggtgccgtggtggccgccaacgggcacggtggtgccgtggtggccgtctcccaccacagcgcgggacgcagctgcctccgccggggactgctccctgcgg

SEQ ID NO: 28920 - DNA, 149 bp, Sorghum bicolor
  unsure (1)..(149): unsure at all n locations
  Clone ID: 8089306
gcacgaggatcaatcacaatggcctcttctcgtgtcttcgcctctcgcctgncctcccagatggccgtcaaggccgctcgccctgctgtccgagcccccgtcnctnctgccagcaagcgaaccatctctggcgccagccctctccaggc

SEQ ID NO: 28921 - DNA, 568 bp, Sorghum bicolor
  Clone ID: 8089320
cgctcaagacatccagtcaatcactctacaaccatggctccttctcttgtggaaaccactgcctccgcgattccccttgtggaaggcaagatctctgtcaaaggtctggcgcgtgagccactcaaactgagcggcgcgcttgatgcctttgataaatttgatgtcacaccagttattgggcgcgaattccccaatgcgagcttgaaggagttcctgcgtgctccgaattcggatgagctgctccgggatctcgcggttaccatatctcaaagaggtgtggtattcttccgcaagcaggatgatctggacgacgatctacaaaaggaacttgtacagcgactaggcgagctttccggaaaaccaaagacttctggactgcacatccatccggtggccaactcgggtcgcgagcattccgtcgaagacgacgagattagtatcatcagctcgcagcagcgcaaggcgttgtacacccaacgcaatggtctcaagcaaagcgctcgcacagagtggcatagcgatatcacctttgaacctatcccaagtgactacacaattctccgtttga

SEQ ID NO: 28922 - DNA, 169 bp, Sorghum bicolor
  Clone ID: 8089325
aggaaaaaagatatcaatgccccctatcatggccttgaggctcggattataagctgcatgatgaccttgaaggggaagaagaatcaagtgggggttgtgaacagctaggtgcttgcttgtacagctacatttctattattcaaatctgtaagaaggaaaaattttttat

SEQ ID NO: 28923 - DNA, 192 bp, Sorghum bicolor
  Clone ID: 8089326
gccgtgagagaagagacagaggttcctcgtagcgggcaagtgaactgttaatgaggtcaaactggttcatggtcaatttgggcgggtgttaggacgtgattagcaatgtttctatgcctgggtcgcgacatcatgtacagcaggctgtttcttaagaggattcatgaaggtcataggtacaagtatgagttc

SEQ ID NO: 28924 - DNA, 577 bp, Sorghum bicolor
  unsure (1)..(577): unsure at all n locations
  Clone ID: 8089330
tttgacggagcttccaaagaccggaggagatacactctgggcttcgggctacgaagtatacgaccgcctgtcagagccttaccagaaattcctggaaggtctgaccgcaacatacgctcagcctcgcttcaatgaagttgccaagaataacaacttcaagattcacccaggcccacgcggtgctcccgagaatgtcggcgaggagcttcgcgctgagcaccccgttatccgtaccaacccagtcacgggttggaagagtgtattcgctgtcggcacacacgtccagaaggtaaacggagtcacggaggaggagagcgctcacttgctcaagtggtttgtggatctgattgtcgagaaccatgatctgcaagtgcgcctccggtggcagaacccgaatgatcttgcgatctgggataatcggtcggtgtaccatgctgcaacttgggactacgaagagattggtcctcgaacgggtcatcgcgtagttgggcttggagagcggccgtacctggaccctaagagcgtcagcagaagacaggcttggaaggaagcgagtagagtagnccaagagctaata

SEQ ID NO: 28925 - DNA, 203 bp, Sorghum bicolor
  Clone ID: 8089341
aaccatcaccgtgatctagggagacagtggaaaaacaggcagtggcgcacatggacttggacttggaggaaggccgtgctgtaccatacacaagcctcaagaggagacgatgactgagtccttgtttagtcggcaaaattttggtttttttttttttgctactgtagcactttcgtttttatttgacaaacattgttcaatct

SEQ ID NO: 28926 - DNA, 499 bp, Sorghum bicolor
  Clone ID: 8089350
tctggagagtcttgatatcggcatttgccccaacataacatctttaccagttctgccatcctccctccagcgcataactatatatggttgtgacgacttgaagaagaactgccgagagcctgatggagaaagctggccacagatttcacacatccgctggaagcacttcgtttaatatcgccgcttgaaagaaatgagagaagacacctcgtggtgaccccaatgccgcagcgcccccgtctctgcagactcaccacccagctgaagtcgatcagaagccgatctgttggtgatgccgtacccttggttctctgtttggcgaccctccacagtccacggttggtacttgcgaggaacgaaggtggttccatttatatcatttcacttgtactgttattccttgattatgaataatgggtcttgctatggtacacctaaataactgtgaatcgtcgatctgagtagcaattgtcaaatattaccttgcaagaggtaataa

SEQ ID NO: 28927 - DNA, 442 bp, Sorghum bicolor
  Clone ID: 8089351
ggcgctgcgtgagtgtgacctgcgctcagccccagcgactggcacctggccccggcggcggcggcgacgcagccagcccggcgccccggcagcgcaaggccgcgatggccacggtttgagagcccggtcgcctgcgtggctgaggaggcggcgcgtgcttgtgccctgtgtggctgctcatgcatgctgctcgtccgtagcccgtgcggctgctcgtgcttgctgcgaggtggctgatcgtgcatgctgctcgcccgtgctcctgtggggcgatggcagcggctcgcttgcggcctgtgtgcagcgccggcggcagtgatgaggaacaagacgagtgttttcaaaatagttcctaatgaagtttgtaaatattatgtaatttatgtgtctgagcgattttgttattaacccccgctaatcttctaatttaaacaattaaatc

SEQ ID NO: 28928 - DNA, 164 bp, Sorghum bicolor
  Clone ID: 8089355
acttgagcagctcattagtttgtagcaagcatgtacagagagtgtgtatagcacatatactatactacttaaacatatagattcattattgggcggctctggtaatggtagcaaaagacctgccagtaattcgttgtaaaattgatcataatatattgccgaga

SEQ ID NO: 28929 - DNA, 463 bp, Sorghum bicolor
  Clone ID: 8089362
gacgcccgccccgtgcccgtggggcaggtgtccgtgtggccgtacgccgacgagggaggacgcagggccaacatcggctacgccctcgcgcacgaccagtggggccggggcatcgccgtcgccgccatcaggatggtggtgggcagggtgttcgacgacctgccggggctggagcggctggaggcggtgacggacgtggagaacgtgcggtcgcagagggtgctggagaaggccggcttccacagggagggggtgctgcgccgctacatcgccggacgcggcggcgaggccagagacgcggtgatgtatagcttcttgtcgtccgaccgtgcgtgatcgactcggtgtcgtaccgggcgctgatagctatgccacctgaacatggttgtctgttcggtgatgtgcgttccagaatttgtgtattgcaacttggtagtgacggttttattacactacaaagaaa

SEQ ID NO: 28930 - DNA, 436 bp, Sorghum bicolor
  Clone ID: 8089365
cttatccgtaccatggcccaggaggcaatggaggcttggtccgaattgagcactggaacgttgctcagaatgccggccgtgccgtcgccacgcacattgtgaatccatctgcaagcaccacgcactttatccccgtcttctggtctgctctgggggctcaactgcggtacagcggaaataccattgcctcaggatgggacgacgtggtcgtggatggagacgtggccgcaggaaagtttcttgcatactataccaagggcgaaaccgttgtggcagttgcctcccaaggccgcgatcctagcgtgatgcaagtgtctgagcttttgaggctaggaagggcacccaccaagagtcagctgaagagtggtgtagatatcttcagcatcgacgtatcggcatagttttgtaatgtgccgcatacatagcattgataaag

SEQ ID NO: 28931 - DNA, 572 bp, Sorghum bicolor
  unsure (1)..(572): unsure at all n locations
  Clone ID: 8089386
cgtcgagtcccagatcaagatcntgatccgccccttatactctaaccctcccatccacggtgcccgcgttgcctccaccatcatgaacgaccccaagctgaaccagcagtggctcggcgaggtcaagggcatggctgaccgtatcattgagatgcgctccctgctccgcaagaacctggaggagctcggcagcaagcacgactggtcccacatcactagccagatcggcatgttcgcctacactggtctgaagcccgagcagatggaggttctcgccaaggagcactccgtctacgccaccaaggacggccgtatctccgtcgctggtatcaccaccggcaacgtcaagcgcctggccgagtccatcttcaaggtcaccggttaaacggggtaaaatagacacaaaagaaggggaaatttaaccggggataagaggcgaggcaaattttgtgcgaacgtaacgagaacgggcttgtgcgaaggggcttctcctttgcatgcgcccttgtactgatatctaatgtctctgtgttttatattagcatgattcggcttgagtccaatccaactga

SEQ ID NO: 28932 - DNA, 504 bp, Sorghum bicolor
  Clone ID: 8089496
ctgctgatggagccatgcaggttgagtggaatgaagatgaagtattcaatttcttggttaactactatgggaagatgcttgtatcatcctacagggagacctccatggaatctcttcttcaagtaaccaagcaagtaggctcaatttctgacgattcttccgcatccagtgccgcaacagtaccaattggagctgccctgggtatcgcccttgctagctgtacatttggggcactagcatgcttctggaggacccagcagaagaacagaaagcaaagaaagaactggaactgaaaatagtgcatcacttgcaaactctaaactgcatgtctgcttcggagggagccttcgtgagtgtatattttctggactggttatcttggcaatggcaagtacccaaaaagttgatccgtgattacatgaaaaacatacagaagtagatttagtagtgccaagtgacgtgattgttttgtgcaatggcgtcaacattgttgcaggtacatac

SEQ ID NO: 28933 - DNA, 124 bp, Sorghum bicolor
  Clone ID: 8089521
gcaactgtgcaagcccaccaaacattacccgtttggccatttgagttgggttttaagtgctaaaaaaatcaaacttccatggaatactgaaatctcttttgccagctataactaagccccagcg

SEQ ID NO: 28934 - DNA, 297 bp, Sorghum bicolor
  unsure (1)..(297): unsure at all n locations
  Clone ID: 8089568
ggtggtgggcgccgcaccacngacgtcgggtgcgcgcaggcaagctgcgccacgggcgccacgctcacgctctgcctgtacaacccgcacggcaacgtgcagggccagagcccctactagctagctaccttagcggcggccgatcgatcagatcatcaggtcggagccctcactgccggcgacggcagcggagtactacgtaggtgcagtcttctctggttcggtgacttcggtcatggatgctttgctttgtgttgtggtgtactaatccggtgttgtactggtgttacttggtgt

SEQ ID NO: 28935 - DNA, 192 bp, Sorghum bicolor
  unsure (1)..(192): unsure at all n locations
  Clone ID: 8089575
cagaaaaagaaaagttattcgttatcagttatcagccatgagcacnccgtttgttgttgcaagactgtaacttaaagagatgcattatttccctaacatgtaacacctgctagtaagtacgtttgcaatgctcgtcatatctagcaaagtagcatcacactgtttgtcaaagattggcgtttaatgaatgag

SEQ ID NO: 28936 - DNA, 357 bp, Sorghum bicolor
  Clone ID: 8089591
gatacagtaaaaaaaagcatttacgaacataagggatatgtttttaccacatttatattgagtcgtacaggcaccagccacgttgtagtgctgcgtttttcagcttcagatgggtgcaagtgagaagaagcgagagagttgcattcggcaaggaattgggtgtttgcaggatccttattgttcccgttgttcaaatttttcgtgttcccttttctcttttttttcccgcgtttccgctttggatatcatttgtagttaaggttggtgctgggtggcctggcgcgacagtacaataatggaaggtgattagtttgaaaaaaaaaaacaacagctggcttctccactcagcctttgtac

SEQ ID NO: 28937 - DNA, 341 bp, Sorghum bicolor
  Clone ID: 8089613
tgcaaggcaggcgtgctcgccaacctgaagaacgactggaagaagatcgccaccgtcaatatcatcttcctgatcttcctcatcgtcgtctactccgttgggtgctgcgcgttcaggaacaatcggcaggacaactcgtacccggcctggaaatgaggtgcgcgtggcaatgtataggttgtttagtgtttcggtgagctcggttcgcgcctgtgtctagcaagctaccgtatgtattaatgtgctcgggtcatgtcacttgttgatgctgttttgcccgcgaacgcatgatgatagcgtctgaaggctattatattatcgagaatatgtgtcgaaaaaat

SEQ ID NO: 28938 - DNA, 342 bp, Sorghum bicolor
  unsure (1)..(342): unsure at all n locations
  Clone ID: 8089614
aagtacgacgccatctccagcttcgtcgacgacgacaagaagaagcacctcgagttngagtggaaattcgaaatcgtcaaggattggccagagaccaactaaacaagcgttggaagcggactcccttttttgttcattcgtttaatcatgcccctcctaccttccccatctcacgagatatgaagatgtctgattatccccaaagaaaaaatatcacatgtgcaggatgccgaagccgcgttttgctgttggaaacaagcatagtatacattttgcatgacatacattttgcatagtaacattttgcatagtaacattttgagcaagcgcaaaaaacaaaac

SEQ ID NO: 28939 - DNA, 359 bp, Sorghum bicolor
  Clone ID: 8089616
gcaaccagcaacatgtcgtggatcagcgaacttttacccggctggtcgtccttcttgtcctgtttggaggcgctgtccaggcctcgtggattggtcaaatgaattccggagacttcaacccccgtcgacaatctgacaaacgtcgcacctatggcgacgaggagacccgacgcccacccggtagaaagctgatcccgtatctagaacttcccattgatctattttctcttttttttttttggtgacgttatgctatcacggcgttctgggtttgaggtgcttctttgatcggagaatggtcggggttctggcgcaagggactatacggagccgatgatattgcatgcctgcaaccacta

SEQ ID NO: 28940 - DNA, 158 bp, Sorghum bicolor
  Clone ID: 8089620
gcacggtcggggagtgtgcataagtttgttgtgatttctttttttagggaagtttattgtgatttctacttgtacaaatcaggaggatgaaaaaactaagagtgtaacaactacactgttcacttgttacttgcccgaggatatacgtgtttagaaaa

SEQ ID NO: 28941 - DNA, 186 bp, Sorghum bicolor
  Clone ID: 8089622
agttagtgagcacataatcaacttcataaagaaatttagttgactggagttccttaaatacaccatgtggttctataaatcacataaatggcatgcaataattaaaagtttggaatcattattcagtttgttgggttgaggatctaactgtaattcatgttcaaagcttgtaccaaaattgttttt

SEQ ID NO: 28942 - DNA, 207 bp, Sorghum bicolor
  Clone ID: 8089649
ccttcgccgccgacgcccccgcgccgagccccacctccggcgccgcgtccgtctcctcgtcgctcgttgccgccgtgctctgcccggccgtcgcgctcctcctcggcaacctgcgccactgatgatgtctcctagacgaacgagagccgccgtagtgctgtcgacatgcgtcgcgtgatgccttcttcttgcttgcctgtgtgtgtt

SEQ ID NO: 28943 - DNA, 352 bp, Sorghum bicolor
  Clone ID: 8089712
gcacgaggcttccacgcgcgccccttcttccccgccgtcgagtggtcctccggcgcggcatcggcggccatggactgggtggagaccccggcctcccacgtgctccgcgtcaacgtgccgggcctcggcagggacgacgtcaaggtccaggtcgaggagggcaacgtgctcaccatcagaggcgccccgcccgcagccaagcagaaagggaaggaggacgaggaggaagggacggtgtggcacgtggcggagcgcggcaagccggagttcgcgcgggccgtggcgctgccggagaaggtgcgggtggacgggatcagggccggcgtggagaacggggtgctcaccgtcgtgg

SEQ ID NO: 28944 - DNA, 575 bp, Sorghum bicolor
  Clone ID: 8089728
gcacgaggctgaaagaaaagaactttgacataaggaagacggctggtggaagatcctatgttgcagtgtataagaaatacaatgcaactgtgtccaaaaacttccttgaaatccatctcttctgggcaggcaagggcacttgttgcattccaacccaagggtactatggacccatgatctcagcattaagtgtgacaccaaattttactcctactgtgcgaaatggtgttcccaaaaagaaaagcaaagcaggggcaattgctggaatagtaattggtgctgctgttgtaggactagccgccttagctggaatctttatgctggtacagaagagaagaagagtagcacagcggcaagaagagctttacaacatggtcggaagaccaaacgtcttcgtgccgcaccggccgagcccacaccccaaccacacgaaccaacgttccccccgggcccccgcgaggaaaaccatgtgccgagcccggccgcccgccatgttcccacgcgccaggcgccactaaatcagcagcgcctggccgcccggagctccccccagtagcggcagcaacaaagcaggc

SEQ ID NO: 28945 - DNA, 456 bp, Sorghum bicolor
  Clone ID: 8089797
gcacgaggccaagctatgcatttccctttttttctctaaaaaaataaaagactttcagtacgtgtactctacatcaagttgagtgctgctgtcttaggttcattcatgcatcctttgccgagcgatgatgccagtgtagtgtctttgggatgcttagcgttagtaggatatggatataatagtagaagtatgtgcgtcagtgcgtcgcaagagtgggtgcgtgggggccgcggggagccccaccctgagctaacgtgctgatctccgtgatgcttttgatatggttggtatgtcgccgctgttaagcatttgtcgccactaaccagcgactgtggccaaaaaaaaaaatgatcccccgaccgttagcattggctccggcgaacaagttgcatattcttatccacacagaggagtgctggagttagactggtctaatctaatctaatctctcccagc

SEQ ID NO: 28946 - DNA, 432 bp, Sorghum bicolor
  Clone ID: 8089822
ttcattcccaggtgcctgctgtgctcctccacctcacgtcctcacctttctacctcccctccgaccccctgcggccatggacaccgccgccgctgccgcctcggcgcagcgacgatggctgctgtgggccaggcgccaggccgccgcgtacctggccgcggcaggcgggggcgacgacgggtgggcggcgtccgcggtgtccgcggtccgcgtcgtcgtgtgcttcctggccatggcgatcaccacggcggcgtgggcggtgatcatgctgctgctcctgccgtggccctcccaacgcatccgccagagcaacgtctacggccacgtcaccggacgcatgctgctgtggattctggggaacccaatcaaagtggaaggcgccgagcacctcaagacgatggggatcttcatctgcaaccacgcgtggccgct

SEQ ID NO: 28947 - DNA, 432 bp, Sorghum bicolor
  unsure (1)..(432): unsure at all n locations
  Clone ID: 8089847
gcacgaggaattacgcgacaggggccacagcggatcctaacggggaccaagtccaacctaatctgcctgtgaaacggtcacatcaacaagggtctattacctccgcctatcattttccactggcatgtattcgcgatacatgggaatagcttcggttttgccatttctatgaaatgaaatatcaaaaccctgatctgccatttcgaaacagttcattatggataattcactaaaagacactggacgcatacttacatcatacaacaactgctgccaatgtctttcacacaggaccctggcctggtctgatgaggagtcactcgaattaatcactggaaaattacagtcctcgaggatccgcgcagtaatattactccgtctccagagtcactcctcaaatctgaaatgcaagattaccttcttcttaaanag

SEQ ID NO: 28948 - DNA, 342 bp, Sorghum bicolor
  Clone ID: 8089861
ggcaagggaagtcggcaaaacggatccgtaacttcctctcgcgccgacgataccagccagcactactagctagtgattgggtcagccaaccaaaccaaggatccaccaattcattcgacggacaagaaatgttgctttttaatcagtcagtcatcagtcatcacaggaatgcgcaagaaacgttgcatctgcgtgcatcctgcatctgcgtgctcctagttgctccgaatttcgtgaccaaattcgtagaaacggagaaggggctcctgttgtatgtatgctggggatgtatgtaagtacagtgtattctttcttctttacaaacctactctctatcttgcg

SEQ ID NO: 28949 - DNA, 387 bp, Sorghum bicolor
  unsure (1)..(387): unsure at all n locations
  Clone ID: 8089876
gcacgaggctcgtatcttatctctactaccgcggccgtagtgccatcgtgcgagcgcagcgcggagagagtagaaggaagcaagtgtgtgtccgtctcatacctactggggttggctggtgtggtgtttgagacgtgcggtcgggagagcggatggagaggaagggagggtgctgcctcgcgccgaggtacggcgccgccgggcctgcggccgcgcagcagcaggcaggcgcggcgtggcagatgggcaggatcatgctcaagttccgcccgattgcacctaagccggcggccatggcgcccgtgccggcaccgacgccggtggtggctgggccgtccgttggtgcggccgggagagggaagcgaaaagccgtgtgcggtgcangcg

SEQ ID NO: 28950 - DNA, 553 bp, Sorghum bicolor
  Clone ID: 8089905
gcacgaggctgagcaattcaaccaggagctatctttgtctgggaaaatcccatctggcttcttcaatactatgtttgagttttctggcagctggcagaaagatgctgctaataccaaaacacttgctttcgatggttggtatgtcacactatacagtgttgcactctcaaaagggcaaattgtactccgggatcatgttaaacaggctgttccatcaacctgggaacctgccaccttggctaggttcattagaaaatttggcactcatatagttgttggtctaaagatgggcgggaaagatgtaatttatttgaagcaacagcattcatcgaccttgcaagctgctgatgttcaagcagagcctgatgttatctcaatgtcctttataccaatcacttcactattgaatggagttcctggaagtggatttttgaaccatgcaattaatctgtatctccggcataaacccccaatcgaggaattacatcagtttctggagttccagcttccaaggcagtgggcacctgtttacagtgatcttgctctgggtcct

SEQ ID NO: 28951 - DNA, 142 bp, Sorghum bicolor
  Clone ID: 8089921
gcacgaggcccactcccaaacattcccaaggcaaggcacgcacgcatcgagatctcgcgaggccacagctgctcgccttcgacgcgcacaatccccctagccttagatcacagcaccactatggggagcataccggcggcgg

SEQ ID NO: 28952 - DNA, 489 bp, Sorghum bicolor
  Clone ID: 8089923
gcacgaggggcgtcgctcgaccctgtgccccggatcattacgcccacgcagatgatcagcaatgcaactggagttccgttggagaacattctgtatcttggaggcccaaacattgcttctgagatttataacaaagaatatgcgaatgctcgcatatgtggagctgacaagtggaggaaacctcttgcaaatttcttgaggcaaccccatttcattgtatgggacaatagtgatctcattactcatgaagtcatgggcggcttaaaaaacgtatatgccattggggctggtatggtggcagcccttaccaatgagagtgcaaccagcaaatcagtatacttttcactttgcacatctgaaatgatatacatcacccatcttctagcacgagagcccgagaaacttgcagggcccttattagctgacacatacgtcaccctgctgaaaggtcgcaatgcatggtacgggcagaagttagctaagggagaa

SEQ ID NO: 28953 - DNA, 301 bp, Sorghum bicolor
  Clone ID: 8089931
gcacgaggctttggttggacttcctggagtgaatggtctgtcaactgagcagaggaaaaggcttaccattgctgtagaacttgttgcaaatccgtcaatcatctttatggatgagccaacctcagggcttgatgcccgagcagctgcaattgtgatgcggacggtgaggaacactgttgatactggtagaactgtggtctgcacgatacatcagcctagcattgacatatttgaagcatttgatgagcttttccttatgaagcgtggtggagaagagatctatgctggtccacttgaacat

SEQ ID NO: 28954 - DNA, 480 bp, Sorghum bicolor
  Clone ID: 8089936
gcacgaggccgcttctccgagaccgactccgacgaagccgaggccgtccacaacaccctcgccgtcctcgagaacctcctcgacctccgccccaacctcgccgacaaagtctgcgacggaaccaagctcctacgatggcttctctcgcgcctcaaggcacgcgagttcgacgccaacaagcagtacgcctccgagatcctcgccatcctcctgcagaacagccccgccaatcagaagcgcctcggccagatcaatggagttgacgccctgcttcaggcggttgctatgtacaaatccagggacccaaagacctccgacgaggaggagatgctcgagaacctcttcgactgtctctgctgcgtactcatgcccctggagaacaaggagaggtttgtcaaggctgagggcgttgagctcatgatcatcattatgaaacagaagaagctggcatacagctccgcgatccgcacactcgatttt

SEQ ID NO: 28955 - DNA, 542 bp, Sorghum bicolor
  Clone ID: 8089941
gcacgagggataaatgtgacacatcatgttctgggaaatcgatcaggtaagatatcaaattagattcttgacatgaccttgtgactatttgtgggggctgaaatgagtttatgcatacaggtttaggtgtaggtctgcgagtggcagccaaaggcccttttcattgagtatcctatggctgcatcgatgtccatttcagatgggcaagctgtaggtcctgctgctgtgccagccaagaaaagaaagaaaattgctgcgacagccaggaaagagaagaaggatgggcgaagaagcctaaagggaaaagaaagaaggcgaagatattgcaaccacttgaaagcccagcaatggctaccagaactgaagcaagaagctgctgtttaccagtccttcgaagtctaccagaagcatgcattcgaaggcttagtctgtgatgtgaaagtgtactgtgagctgtaagcatgtcatccttttgcttggcttggtttctatgaaccaatgtatgttaaaccattatgtggaccttctgtcccttaggaact

SEQ ID NO: 28956 - DNA, 521 bp, Sorghum bicolor
  Clone ID: 8089953
taaaatgcgcgagctgcagaacccaaccaaagagtaaacaaccgtgtcacgctcatgcacgcgttttctcggtgagcacacaccacacagacacaggagccgccgccgaggcgggctaaactgtctgaccacacggcacaggcgtacgtagctagcagtgggcgcgaagcaaggcattaggcgacttatggcgtggtcggagacggacgccgcgctgttcgcggcggtgctggggcgggacgcggcgcaccacctggccaccacgccgccgcacctgggcgggcccgcggcgtcggcgtcggcgtcggcgcccgagctccaggcgcgcctgcaggacctcgtcgagcggggcagcggggcgtggacgtacggcatcttctggcaggagtcccgcgccggcggccgcgccgtgctcggctggggcgacggccactgccgcgacgccagcggcggcggcagcgcctcggcctcgcacgacgacgacgacgatgcggcggagcggagcgtggcgcggaagcgcg

SEQ ID NO: 28957 - DNA, 420 bp, Sorghum bicolor
  Clone ID: 8089959
gcacgaggcccaggacacggcctccggtattttgaatgaagtcaagcccgactatattgcttggagtgctggtgctggaggtaaaggtggcgcagaaagaactttcaaggtggaccgagatgccgccgttcactttatcaatgccgcagcatctgtacctaccatcaccaagttccttcttatctcatacctagcttctcgtcgatctggtgcttcatggtggcctgctggcgagtgggatgagtataatgaaaaggtcaacaacggcgtattggcaaactattacaaggccaagatcgaagccgatgagaccctctacaaggtctccaaaaagagtcctactcttgttggcatcgatctgagacccggaactctgactgatgacccagccaccaaagttgagtttggcaaaaccaagag

SEQ ID NO: 28958 - DNA, 277 bp, Sorghum bicolor
  unsure (1)..(277): unsure at all n locations
  Clone ID: 8089960
gctacgtgcatcattagctattcatcagctgcctgcaactaatcaattgtccaccggcgagaaggagaagatgcaggcggtgaaggagaaggtgaaggacgcgatgagcacggcgaaggcgaaggcgagggagcaggaggcgaaggcggaggagaaggccggcaaggcgacggcgagctcgagcgccgagaaagagctggtgcaccagcgcgccaaggccaaggtcgccgccgccaagatgnacctccaccagnagaaggccatccacaagggagga

SEQ ID NO: 28959 - DNA, 395 bp, Sorghum bicolor
  Clone ID: 8089972
gcacgaggccgagtcggtcacggactgccaatccgactgctccgactcatgggcctcggccctcatcaccgagctcgaccagttcaggaacgacaagagcggcgcgagcacacggaccgcgagcctcgcggccgcggacatcggcgtcatggacgacttcctcgagatggagaagcttgcctccgccaacggctcgtcgaaaggcgacgccgtcgaggacgcgagcggtcagctgtcgaagctcgaggagaaggccaggaagctggcagccgagaaggccgagcgggagaaggcgctgcacgaggctcagcgcgagctgaggacttgccgccaccgggtaatggttgctgaggagaaatcagctgagctacagcggcagctgaaccttgccaatg

SEQ ID NO: 28960 - DNA, 148 bp, Sorghum bicolor
  Clone ID: 8089997
ttgcacgcttgactacctcctccatacccgcagactccggccgatcaccatgtctggaggagcaacaggagttggaggaggcagcggctacgggggcttctaccacggggacgagcctggcacctccgaccagctcatcacagccttc

SEQ ID NO: 28961 - DNA, 640 bp, Sorghum bicolor
  unsure (1)..(640): unsure at all n locations
  Clone ID: 8090002
gcgcagtcgtgacggcagcagcagcggggcggcggcggcggcgcggcgtgcgtccctgctgtgagcttccccgtgtcaggctagctcaggctgacagtgtaccacaacgtcagtcgcacgaccccggaactcggacaaccctcgcggctcgcgcagccctctcccgctcccatggatccaccgcaagagtcggccgctgccggccggaagaggcgccggcgaggaggcgtccggaatcgcaaaaagctttcctcgcagaaggggcttcctccagcggctgcgcccccaacgccggcgtccccaccggtgaagcggcggcgcaaggacgtcgctggccaggccgccgccatgccgaagagaggcaacacctcgagcctactcgacaagatgcgtgcaaggttatctggtggccatttcagaatgttaaatgagaagctatacacttgcagtggagaggatgcgtttgactacttcaaaaatgaccctaatctttntgatgtgtatcatacaggatatcaagagcagatgtcacactggcctgaacagccagtgaatgtaataatcaattggttgaagagtcacaatgcatcatggactgttgctgattttggctgcggcaatgccacagttgcaaaaaatg

SEQ ID NO: 28962 - DNA, 350 bp, Sorghum bicolor
  Clone ID: 8090015
ctcgcagaggcgggcagccgagcttctagaagctgaacctagtctaccttttttaacagaagaaggagatccttgctcgccgcactgctgagatgatcggcgccggccgcggcaggcggcgggggcggccaccggcgtccctgcccacgagcgccgcttcccgccggagcgagcactccatctcctgctggtattgtgactgcaagatatatgccttaaacgacgccctcttcaatttggggtggaactatgctagatatatgagagcatggttttctgtaggtgtttatctctctctcattgctttagtcagtatatccttgatgctattgtgggagtcaattggtgtg

SEQ ID NO: 28963 - DNA, 476 bp, Sorghum bicolor
  Clone ID: 8090029
gcacgaggcgcgctccaaaatcgaattccttcccctcccccccgcaggctcgcatcacggcacgccggagccatcgccgccgccgcctggacccctccgcgcggtggcttgaaccctccgcacccgaaccctagcggcggtggtggccctacgctccggtcgccgccggggaaagggaataagcccgtcgccctcgccgacatcaccaacactgggaagcccaacgccgccagattcatcgccgtccccgacctcgtcaaggagaacgccaagttgatggctctgctcaatgagaagacaaagatcattgacctcagcagggttgagatatacaagctccgtcttgtgctgcaagcatcgaaacaacagaatctactccttgcacaaaacaattcccagatgcttgcggaaataaacacagggaaagatcgaattaagctattgcagcacgagctttcttgtacagcagcactgct

SEQ ID NO: 28964 - DNA, 314 bp, Sorghum bicolor
  Clone ID: 8090085
caaaactgatctatcgggagagtgtagggtgaccatggtgaaggtgcagaggatgggaggggttgtgttggcagcagcagtgctgctggtagcaatggtggccatggtggcggcagaactcgtgccggtgatggacaaggacctggagtcggaggccagcatgatgaacctataccagaggtggcgcagcgtgtacaacgggtcgttggaccacgttgagaagccaagcaggttcgacacgttcaaggagaacgctaggcacatcaacgagttcaacaagagggaggacgagccgtacaagctcggcctcaacc

SEQ ID NO: 28965 - DNA, 405 bp, Sorghum bicolor
  Clone ID: 8090104
gcacgaggggtctaccagcatatgttatccttaatgcactccttcggtctgcaaaagctgattcagtcgggctaatcttaagtgacggctctgagattacatctgacaatagacctaaaagtaccatctttgattggttctttgacccacttatggttataaaggaacaaatcaaagctgagaatctcagcgaagaagaggaagaatatctgaaaatgcgagtactgttggctggggatcccagtcgcctgaaaggttctctgcctcatgttccatccttgaccgagcgaaaaaaggcagatatagatgcattcgctcgcagattgcaaagaatcacaaagtcgatgtctatatatcctacagcgaagcgccgcttcgacatccttgtgaaggcgctcctgtcag

SEQ ID NO: 28966 - DNA, 211 bp, Sorghum bicolor
  Clone ID: 8090110
ttgggagcgacgcgccgggcaacctcctcaccggcttcggcttctatgagccctactggctcatcgacttcgccaacgcctgcatcatcctccacctgctgggcgggtaccaggtgtacagccagccgatctttcagttcgcggaccggctcttctcggagcggttcccggacagcgggttcgtgaacgacttccacaccggccgggtggg

SEQ ID NO: 28967 - DNA, 583 bp, Sorghum bicolor
  Clone ID: 8090139
gttttgatcgcctgaggcagctacagactctggatattagacacaccatggttgtgtcgctaccactatgcatcaccaagctacagaagctccagcatattcgtgccggcactagcattactacagcacaattggatgatgatgtctccagcagcggcactgctcaaagactacctgcagcagcagaagcaggatcggcatcgtcgtcgtcgatggacaggcagccacgagctgctgctgctctggtgtcccggtcccggctccggctgccggggttgtgcgcacgccgccgccgcggccagcggctttgtggctctcgcaatggaggcgttgaggcgcccccaggtattggggaaatgatggccctacacaacatcagtgtcattgacgtcagtgttgcaagcggccgggcaatcattgatgagctcaagaaccttacccaactgcgcaagcttggagtctctggcgtcagacgagaaaactgtatcgagttttgttctgccatttcgggtcacccgcatttggaatccttgtcagtgtgggtggaccataatcaagctggctgcttggttgccatttcctc

SEQ ID NO: 28968 - DNA, 566 bp, Sorghum bicolor
  Clone ID: 8090313
gcacgaggctcatcctgttgctcgagctcgtggtgcacaggctcatggcggccgctatcggcacaagggttgctgttgtcaccggcgggaacaaaggtatcgggctggaggtgtgcaggcagctggccagcaatggcatcaccgtcgtcttgacagccagggacgagaagaggggcgcagccgccgtagaggagctcaaagacgcggggctctccgatgtcattttccatcagctggaggtcaccgatgctcagagcatcgctagattggccggtttcttgaaggcgcgttttggaaagctagacatcctggtaaacaatgccgctatcggtggggttgagacacttcccatcgaaaatcctgctgagatcaagggcctggatgcgtttcagatgatgcaatggatggggaaacaatgccggccgacaagcgacgctgctaaggcaggcattcagacaaactactacggggtgaagaacgtgaccgaagcgctgctgccgctgctgcaagcctcctccgacggaagggtcgtcaacgtctcctccgacttcggcctgctaagtcat

SEQ ID NO: 28969 - DNA, 134 bp, Sorghum bicolor
  Clone ID: 8090315
gttaggtgaccaaaaacaagatcaaataacgaagcgcaagaaaaagttaacacgtactatccatgttgaatccaatgacttggattttgagattcactatgcctttcttgatgaacctcatattttactagctc

SEQ ID NO: 28970 - DNA, 512 bp, Sorghum bicolor
  Clone ID: 8090320
gaggaagaaggcagctggcccgagcagattccagaacaagcgatcccgaggcgcagctggaccctatcccttccctgctgccaaggctgctaggggctcaaactttggtccgcgtttccagaacccaatctcacgatccttaaactacgcagcccatgctggatatataaatccagcagctgcatcatcatactatgtgcctgggagcgtgtcagggcgacgaggtggtgtgccattcggtggatctggagctacatatggtggctcccctaactttgcagccggtggggggcagcagtcattccgtcgttaggtctatggctgttgttgcaactgaatgctccttgttttctggctaataggatcatgtgtacctcctgctattcaagcatgttcagttcttgattttcgatggatgctggatactgaaggccgtgtagtatacattatggtactgtgtttcctttgataaatttgagctgtgtcctccataaaaaaaaaaaaaaaaaaaa

SEQ ID NO: 28971 - DNA, 392 bp, Sorghum bicolor
  Clone ID: 8090330
gcacgaggcaaaagaatagcagtcttcgagttcatgcacatttgctatgtgcgaagcatgtcgagattttaacagcggctgctgcagcctgcagctccgaaagaccggacacttggtaactaatcgaaccgccagatcgcacttgtggtaactaatctgaatggaaatgctctcgttctactaaaaaaaaaaaaaaaaaaaaaaaaaaaaaaaaaaaaaaaaaaaacctcgaaactagttttttttctttccggcaccttatgaaaaatcaaagtctttgggttccggggggagtatggtcgcaaggctgaaacttaaaggaattgacggaagggcaccaccaggcgtggagcctgcggcttaatttgactcaacacggggaaacttaccag

SEQ ID NO: 28972 - DNA, 574 bp, Sorghum bicolor
  unsure (1)..(574): unsure at all n locations
  Clone ID: 8090340
gcacgaggcagagagtggcccaagatttccaaacccacttacaagatgcaaaaaatcatggtcccagtaaaaaacacccgttaagaaccagaccccataagcaaccactgatgatgattggggatgtcatgttggagatgaaaatcatcaacaaacagatttgcaggtactccaccagcacctctactgtcagagccccccttgatgtctgacatccatcttctgttatgcaaagcttgagccaccattcgttgcttccctgctctcttgggaatgatctgaatcatgttgggagcatcttcagctattgtcttgccatggagccaacagtctgaccagaacttgattgaagcaccattgcccaccatggtttgcacagcaacttaaataaggtctgagcactgcatggaacctgaactggcagtccagcccaaatactttcctcgtcaatcttctgttcccacagccaccttatatgaagagaccaacccagaacttcaagattatggatacctaagccaccataacaaataggctgctgaactntctcccatganatggacatatgattatn

SEQ ID NO: 28973 - DNA, 528 bp, Sorghum bicolor
  Clone ID: 8090343
gcacgaggcacacacacacacacacacacacacacccaccactctcctacttgtccacctctccagctctctccgtcgtctgcgctccctgcctcctggtcaactctgccatccacgggagatcgatccatccatccatccatccatcggcctcgccagtcgccatggcgctcgacgcggccatcgacgtgtccagcagcaagccgccggtgccgccgccgtcgccgccgaggatcgactcgtgggcgcgcggcgggaggcggtccaagcgccgcgccgggagccccgccagcgacggcggcagcggaggaggcgaccacgaccagtccgagcaggagtacctcgcgctctgcctcctgatgctctcccgcggcctccgcggcgacgacgcaaccgacgtcgggggcggcgcggcgcctacggtggcgaagacgacccagcaccatcatcagcacgggtacgagtgctccgtgtgcggcaaggtgtacccgtcgtaccaggcgctcggcgggcacaagacgagccacc

SEQ ID NO: 28974 - DNA, 102 bp, Sorghum bicolor
  Clone ID: 8090368
gagcacaaagaggctgagatgattaaggctctggagaacatggtggatgtctacatggtctctgctgaagagtgttcagaggctgcaaagggcaagtctcaa

SEQ ID NO: 28975 - DNA, 493 bp, Sorghum bicolor
  Clone ID: 8090423
cggaggagaggctggacgagctgctgagcgcgttcctccgggacttcgaggccggcgcgctggacgcccgcgggtggccgacggagttctcggcgtacaaggtggccaaggtggccctgaactcgtactcgagggtgctggcgaggaggcacccggagctgcgcatcaactgcgcgcatcccgggtacgtgaagaccgacatgaccaggcagactggcctgctgacgcccgcggagggcgcggccaacatcgtgaaggtggcgctgcttccggaaggtggccagaccggcgctttcttcgcgttaggccaggaggcgccgttcgtgtgacagtgcgccatgtccccctagactagggcacggccggtccagcgctactgcgccaccgccgtgctagtgctagtatctacctgcgcagtcgctggtttgagacggcgaataaagaattgttgcagcttcggtaataaaattgcccagatgtcggatacttgttt

SEQ ID NO: 28976 - DNA, 120 bp, Sorghum bicolor
  Clone ID: 8090424
ttgatcgagtcggtgaaaagtccctatgtttccctttttcaaaaaatcgtcctaagtcagtttggttgggtttgtgaacatttttggtggggcccaccagtttggttggaactgtgcaat

SEQ ID NO: 28977 - DNA, 369 bp, Sorghum bicolor
  Clone ID: 8090445
gctgaccaaggagcagtccgcgctcctggaggaccgcttcaaggagcacagcaccctcaacccggtacgtgctactctacttcccgtctacggtctacccctgcgtgcgcgacacgttcggttcggtgactcccgatcatcgactgactgctggttgctttgctgctactgctacatgtacaccacaccacaaatatagctgcacttgactacatcgatcgattactcgactgctgcgtacatggccgatcattacaacaccacatatatactgcatatactagttatctctttttgcacatatatgtattttaatagggtgtcaccaaagaagtatacagatattcttcttcattatttcttttcccc

SEQ ID NO: 28978 - DNA, 518 bp, Sorghum bicolor
  Clone ID: 8090502
gcacgaggccactatcttcttttatcttggtgccgtgccacagcccagaaggagagcggcagcggagagctctcgcctctgcactagccgccgcaccgcaacattatggcgagagctcacctagccctggtcagcttcgtagctgccctcgccgccgcctcaattattggtgcggcgtccaagtcgttcaccgtcaccaacaactgcgagcacacggtgtggccgggaatcctctccagcgctggctcggcggcgatggacaccacgggcttcgcgctggcgccgggggaatcgcgcgccatgagcgtgccgtcggggtggtcgggccgcctgtggggccgcacgctctgctccacctccacctccgccgacggcacgggcaggttcgcctgcgtgacgggcgactgcggctcggggaggcaggactgcgccggcggcggggcggccccgccggccacgctggccgagttcaccatggacggcagcgggggcatggacttctacgacgtgagcctggt

SEQ ID NO: 28979 - DNA, 574 bp, Sorghum bicolor
  Clone ID: 8090529
gcacgaggaaaccaaccgtccctgtctttcctctgactttcccccaccacttcttccttgtgatgtcgtcgtcctctttcggccgcctcacaatccagcgcagaacagggatgacaaggtcgacgagatcctcctccatgcagcgctgcttgtgcttctttctccagtccgtttggattttgctcctgctcaaaggcggagtcccaggcatgcgaccctaccgacctgaaggcactcctcgccttctccgatggcttggacagcaagcccgccaggctcatcgggtggggccacggcgacggcgccgcctgctgttcctcgacgggcgtcgcctgcgacctcgggcgggtggtcacgctgtatctctccaacaagagcctccacgacggcatctcctccgcgctcgcctccctcgacgccctcgccgcgctcaacctctcccggaacgcgcttcgcggtgctgcgccagaggagctggcccgcctgtggagcctgcgggtgctcgacctcagcgcgaacgcaccaagagtcgccgacgcacgcgtcgttgcccagcgatcaatcgcaaccacca

SEQ ID NO: 28980 - DNA, 267 bp, Sorghum bicolor
  unsure (1)..(267): unsure at all n locations
  Clone ID: 8090535
gcacgaggccgcagtccggcgtagtattattgctttgcttgctcgctcgaggtgcacgtggcggtggaagcttcccggtggggggtgtgggtggcggaggcggtggtggtggtggttgattggttgatgtcaatggcgcangtgtgctgcgactcggccgcagcggcgacggcggcggcggcacaggtggttggggcggaggcggaggccagggccagggcgcgcgccgagaggcggcgtcgggctggggaggccgcctggaggtgg

SEQ ID NO: 28981 - DNA, 642 bp, Sorghum bicolor
  Clone ID: 8090574
gcacgagggatcaagcaaatgaaatctcaaaccgtgcaaatatgccttctagaacaactgacttaaatgagtcaggatttgtatctcaagtgctcaagcaggcttcagaaattgaaagtttgaagcaagaaaatctgaggttggtggaagagaaggatggactggaaattaatagtcataagctggcagaggaatcatcctatgctaaagaattggcatctgctgctgcagttgaactaaagaatttggcagaagaagtcactaggctttcttatgaaaacgcaaagctgaatgcagacttagctgcggcaaaagagctaaatgcatcaatgtcaagaagtaacattcaccctgatccaaagcgacgtgatcatgagagcggaattttagttgaggagttgcagaaagagttggttgctagttgtcaaagggaggctgtgttagaggacacactatctaaaaaagaccgaagagagactgagcttctaaagattattgatgatgcaaaatgccgtgagcatgagatggaaaacgaactggcaagcatgtgggcccttgtttcgaagataaagaaagaaaactctcaacaggatgtgtttgaattcaaagcaaagcaaaacggctttcactcatccaagactg

SEQ ID NO: 28982 - DNA, 574 bp, Sorghum bicolor
  Clone ID: 8090579
ttcggcacgagggcggccccctcccaagatggcgcttcaaaccctaaacccgcaccggcacgcggcggccgtctccccgtcgccggcgccgtcgcccgtcccgcgccgcggccacccgccgccgcagcctctcctgcacctccctccccgccgccgcctcgcgggcggcgccgcccggccgcgcgccgtcgctgccgccgtctcgggggccgtcaacgaggccaggaggcgtggggcgccgcaggagggcggggaggacgggaggaaggacacggacctcgccacgctcgggaacctctgcgtcgacgtcgtgctcagcgtgccccagctcccgcccgcgccgcgggaggagcggaaggcctacatggagcgcctcgccgcctcaccgcccgatcagaaattttgggaggctggtggaaactgcaatttagcctttgctgcagctaggcttgggcttagctgttccactctgggtcatgtaggagaggaaatatatggaaattttcttcttgatgtgcttcaagcggagggcattagtgttgttgggatgcttgaaataccaatgctgctgcgt

SEQ ID NO: 28983 - DNA, 535 bp, Sorghum bicolor
  Clone ID: 8090607
gcacgaggggagatctacctcttctcccttcccatcaagaaaagtgaaatcatcgacttcttcatgggtatgtctctgaaggatgaggttctgaagatcatgcccgtccagaaacagacccgtgctggtcagcgtactcgcttcaaggcctttgttgctattggtgactccaacggccacattggtcttggagttaagtgctccaaggaagtagccactggcatccgtggtgctatcatcttagctaagctgtcggttgtccccgtcaggcgaggctactggggtaacaagattggtaaaccccacaccgtgccctgcaaggtcactggtaagtgcggttcagtccaggtgcgtctgatccctgctccccgtggtactggtattgtcggtgccccagtccctaagaagcttctgcagatggctggtattgaggattgctacacttctgcccgtggttccactggtactcttggaaactttgctaaggccacctatgctgccatcgccaagacttatgcttacctgacccctgact

SEQ ID NO: 28984 - DNA, 569 bp, Sorghum bicolor
  Clone ID: 8090630
gcacgaggctgaaatgatggagaacaatagggagcgtagaattgctcttgttgctgctggatcagctgctggaatcgcttcaggtttcaatgctgcagttgctggatgcttttttgctatcgaaacagtattaaggccacttcgagcagaaaattctccaccatttactactgctatgattatattggcatcagttatatcatcaactgtttccaatgttttgctaggggaaaaggcagcatttattgtcccgacagctgccactctaccttattctgggcatgctttgtggtgttgtgagcgtggcattcaggcagttggttgtttggttcactaagacctttgacttgataaggaagaagtttggccttcctgctgtagtatgtcctgctctaggtggtcttggagctggtttaatagctctaaggtatcctggaatattgtattggggtttcaccaatgtcgatgagattctacatacgggtaaaagtgcttcagcccctgaaatctggctcttggctcaattagctgctgcgaaagttgtagcaacggcactttgcaaaggttct

SEQ ID NO: 28985 - DNA, 524 bp, Sorghum bicolor
  Clone ID: 8090642
gcacgagggttatttagaagctgaatcccctttgtgtaaagttctggagatatatgatcacaacatcatgaaggaacttgagaaaagtgattgtgaggcagcagaggtgtatttgaatgctctagggttgctgctccgattatacatacgcggtcatatagattcagctaaagagaggttaacggcattgctagatgcactgaagaatgagtctatatggcatgcggaatggctcctggacttgcttatattgtgggcacttgcaagtatgagtgaactaaaaagtgcacataatatgttggaatcattgaagtcaagggtccgatcaatggacaggaatcggcagcaagtgatgcagaaggcaatcaagctggcggaggctgcttatgaatatgggaaaggagatcacatgaaagtctttgacacactgggtccagactttgatgcgctaggttataaagtaggaactggaacctttttattactttaagataagtaattataaaatttgtttgtgtttgcta

SEQ ID NO: 28986 - DNA, 558 bp, Sorghum bicolor
  Clone ID: 8090697
acttttgaagaagcaagagctgcatacaattatgaaagaatgcgctgcaaagaattggaaagcgtcgtgtccagattgaagggtgaggacctcaggggcctagatattaaagtccttgaagagctacaaaatttccatgtcgaagcactgtcaaggatctgccaagagaagatggcaagtcaggcgctatagcaaaagccttgcctgagacgagaagccgctttcatgcaggctagagcttctttctcagttctcccttgaagcccgtcgctctgatgtttcactcacaatttcacatcgttgctgctaccccaaccggggcaacattattgattaacccgcatttggacactgattcctgcgtttaaccggcagaaaacgaagcaaaatacggttagatagcaggcgctgatgatcactagttagcatgcagatactcgcctccttgtacagcttattaaagatagtagcagtaggactgttgtagtagtagtaccggattgtatttatactgctaatataggagctgggaaaacccgaagatggtgtttctgttgt

SEQ ID NO: 28987 - DNA, 497 bp, Sorghum bicolor
  Clone ID: 8090702
gccactggctgtggggctggcaggaatgttgctcgcctggataaagtactacagctcttgaaagaagccgatctcaatgaagaagacacatggactgagctgattgaaggaaattctctctgtattgaggtctcaattatgtctgggatggcaagaaatggttttggcgagcgcattgtgcatgttcctgttaccaaagtggtttccgacattttgcctatgttcgaagcagtgtcagagcgaagcgctgtccaggcttgattccatactgaatagtagattgttgtattcattttgtcattcacatagattcttcttttactctacgatcacacgccgttttctggtgatgagtggtagttggaggctagcctccaggtaaagctacttcctgaacagaatgtggttgctgaagctattgatagctgtacagctatggttgcgtggaatgatggtaccccctgaagttttgttctaacatgaacgtgattgatgct

SEQ ID NO: 28988 - DNA, 122 bp, Sorghum bicolor
  Clone ID: 8090718
cacctatgctgccatcgccaagacttatgtttacctgacccctgacttgtggaaggagatgccattgaccaaggctccctatgctcagtatgctgagtttttgtccaagaaccaccgccccg

SEQ ID NO: 28989 - DNA, 414 bp, Sorghum bicolor
  Clone ID: 8090756
gcacgaggcctacctggcagccagcgtggcaaagagttcaggccgtcagcggcgccgcgtgctctcgctcgccggccggcgctgactgctcgtgctctccgcggtccgctctgcctcccaacgccgcgcccgcctcctctcagactcccaccgcgacttctgttcgtcagcgcggcggcggcctgcgtccagcccaacggagagaaatctaaccctagctcccccgtcggcgctgccggcgacccttaggatctccggcgaatgccaccgaccgcggatagagtgattcgaccagtgggggagattgaaggagccccttggtttgggaatttcgggggaagcaaggggggttggtgatttggtggtgaagggagccagggaggtggaaggctatggggtcgtcgtcgaaggtgg

SEQ ID NO: 28990 - DNA, 457 bp, Sorghum bicolor
  Clone ID: 8090767
cgacgcgggggacccgcgggaggagcgcgccatggtgttcttcttcaaccgcttctacttctgcgtcagcctgggctccctgttcgcggtcaccgtgctggtgtacgtgcaggacaacgtgggcaggtgctggggctacggcgtctccgccgtcgccatgctgctcgccgtcgccgtgctcgtcgccggcacgcccaggtaccggtaccgccgcccgcagggaagcccgctcacggtcatcggccgggtgctcgccaccgcgtggaggaagaggaggttgacgctaccggcggacgccgccgagctccacgggttcgccgccgccaaggtcgcccatacggacaggctcaggtgccttgacaaggcggcgatcgtggaggccgacctgtccgcgccggcggggaagcagcagcagcaggcgagcgcgccggcgtcgacggtgacggaggtggaggag

SEQ ID NO: 28991 - DNA, 586 bp, Sorghum bicolor
  Clone ID: 8090771
gcacgagggataaactttgatgacgatgaggaggaaacagaagagcctgaagtgaacattactgaagctgcagagaaggcttcactgctagaagagaacataaaacctagagcaaatcttccgccactccttgttcatcttcgtgatcgtcgtcgtgagaagctccattatcttggtgtatcttttggactaacacaagagcttttccgcttttggcggaagcacaacttctatccgttctatgttggccagattccaagtgctgttactggtgagcatacttgtatggtgttgaggcccttaaatagtgatgacattgaagttagcgagtcaaacaaatgtggatttttggatccgttttatcaagatttcagacaaagattcaggcggcttttgggaacttctttccggcatctcaattttaagctttcaatgagcgtcttggcttcgaagattgattactcaaaccatgagccttcagaatatgataataatagtacttcaaagttattgggagacatgttgtcaccacatgacatgaaacggctagaagcatattcaaacaatttagtcgattatcatctga

SEQ ID NO: 28992 - DNA, 154 bp, Sorghum bicolor
  Clone ID: 8090786
cttccgtaacgccgaggtttctggtgcctagacgttctgaatggcagatctaaccaacataggctgctgtggctgctttagctttttaaggaagcccagtgtacctgcacgacagcctccagatgctgatgtcatgttatctcaagatttgctg

SEQ ID NO: 28993 - DNA, 507 bp, Sorghum bicolor
  Clone ID: 8090802
gcacgaggcgtcctcctccgcgggggctagaccctgccttctcctcgcgggcccggcgtcgcggcgcgcccgggcgctcgcggcgccgcccccgccccgcgccgtcgcctcctcccgcgcgccgctggtggtcaccagcccgccaccgccggaggcctcgggcacgcccgcccccgcgcacgccaaggtcgaccgctccggccgcttctgcagcccccgcgctgcccgtgagctcgcgctgatgatttcctacgccgcgtgtctggagggaaccgacgtcgtgcggctcttcgaccgcaggatcagcgcaaggcgagagcccgggtttgttttcgataaggcatgcttattgagttacaaccatatgagctttggtggggttccgctcgaggttggaacggaggaggaggctgagaagctgaccagtcagaacgagaaggattcagccaacgaagaagatgtactttcagctcctccaaaactggtgtacaacaactttgtcttacg

SEQ ID NO: 28994 - DNA, 112 bp, Sorghum bicolor
  Clone ID: 8090817
gcacgaggattcaccaatggcctacttccaggaggtggactactgctcggaggaggtgaggtcggtggccccagccggcggcttcggccgctacggcgggggcgtccagcag

SEQ ID NO: 28995 - DNA, 488 bp, Sorghum bicolor
  Clone ID: 8090857
gcacgaggagctcttgccacgccacgctcccgcctccccggcaaacaacaacacacactagctaaccttcacgcccgccgagcgccgaggccagcatatcctagcagtagcacgttgtagttgcagacgacgcgcgcgccggtagacgccatcatgcaggagttccagtcgatcccaggcctggccgggcgtctgttcggcggggcaggggccggcgacctccggcgcgcgcaggcgcatgcgcagcagggccccggggcgcggtgcggcggcgtgtcgcccgcggcgccgccagaggtggtcaagtgcccgcggtgcgagtccaccaacaccaagttctgctactacaacaactacaacctgtcgcagccgcggcacttctgcaagagctgccgccggtactggaccaagggcggcgtcctgcgcaacgtccccgtgggcgggggctgccgcaagacgaagcgcgcgtcgtcgtcgtcgtccgccac

SEQ ID NO: 28996 - DNA, 543 bp, Sorghum bicolor
  Clone ID: 8090859
gcacgaggcccaaatcgacttctcccgcgttgtcccgtccgcgccgggcggcaaggcctggtcggatgtgcgcggcgaggtgatgaaggcgctgtccactttcggctgcttcgaagcgcagtacccggctctgacccctcagctccgcgccgagctcttcgacggcgccgtgaggccgctcttcgcgctgcccgccgacgccaagcgccgcaactactacggcgccgacaggccgttccacggctacctcggtgacatcccggggttccctggctacgagagcctcgccatcgtggacgccaccaaggacgactccgtccgtgacttcgccggcctcatgtggcctgacgccggcgacaacaacgacggcttctgcggcactgtcggtgaggcggcgcggcggatctttgaggtggaggaggccgtgcggcggatggtgatggaagggctcgggatggccaagcaccacgacgcgctgagcgcgtccatgtggcacctgttccggatggcggagtacaaggcgcccaacgccgcggagaaggt

SEQ ID NO: 28997 - DNA, 415 bp, Sorghum bicolor
  Clone ID: 8090863
gcacgaggcctgcccccacgcgcgcgccagccgccaccgcctccgatccgagcggccgcttacagtcaacccatccaacctcaaatgttccttgtgaggtatcatgactgaacaccaggaatgtgttagcaagagctcttcctcaagtattagcagcagcactcaggagagtgaggaggaactgaccattggtactcttataactgaagcaacaaacacaacaaacagtgcaaagagtcttggaaggcgcctttcgcacttagattcgatcccgcacactccgcgtgttaatgggaaaattccagattttaataatgcgacaattgatcatgaatcattattagaaagattgggcacttatggcttagctgaataccaaatagaaggagatgggaattgccagttccgagctctg

SEQ ID NO: 28998 - DNA, 463 bp, Sorghum bicolor
  Clone ID: 8090883
gcacgaggcacttgtccaataagtgaagcaagcggccggccggccatcccagttgtggctgtggaaggttaggcagcagggccgagaggagctcggaggtcggaggaaatccccgaagaaggctgcagctagcggagggcgacggcggcgatgctgatcctggacctggcgatctgggtcatcccggtgacgctggtgttcgtgccgtgccggcggctggtggtgctggtggccaggctgcaggagctggaggagtgcatcatgcggccgcgaccgccgccgccgccgctcacggactcgtgggcgtggggccgcgtcggcggcattcataccatgggcatcatgatgtgaggtgtggattcaggccatgctcctgctgcggcggactgcggagccgatcaaggttcgagttcgacacccctgcaagctgcaagctgcaatggaggctcgtacggggtggagg

SEQ ID NO: 28999 - DNA, 388 bp, Sorghum bicolor
  Clone ID: 8090899
gcacgaggaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatggccgtttaggccacggaagtttgaggcaataacaggtctgtgatgcccttagatgttctgggccgcacgcgcgctacactgatgtatccactgctcggagacgcataggttgtgtgatacgagtgggagaaagcttcttcagcacgtgctgacttctccgccgcgccggcatggaggagaggccatagatcg

SEQ ID NO: 29000 - DNA, 495 bp, Sorghum bicolor
  Clone ID: 8090998
gaaaacccacaaagccaccaccaactacaccgccgcgccgccgcgtcaaacaacggcgggacgacgcctatggcattcacctcccaatccctaatcttccgggcagccgcctcgcctccttgtccccgcatagccccgtcgcccggtcgcgtcaccctccgggaccaccgggccgccttcccgcccctcgcggcggcctccacctcgatggcgtcctcggagagcgaagataagagggaagccaagctgtggggcgggcggttcgaggagggcgtcaccgacgccgtggagcgcttcacggagtccatatcctacgactggcaactctacaagtacgacatcatgggcagcaaggcccacgcctccatgctcgccggccagggtttgataacagctactgatagggatatcatcttagaggggcttgatcagatagagaggctgatccaagaaggcaaatttgaatggaggaaggaccgggaggacgtgcatatg

SEQ ID NO: 29001 - DNA, 543 bp, Sorghum bicolor
  Clone ID: 8091026
gcacgaggaatgagtatctgggactatatctggcgtggtcatgatccaacttccgttgctgttatgactgaagatggtgctgctgttacaggccttgctattgctgcagcatctttggtagctgttcaaatgacaggaaatgctatgtatgatccaattggctcaatcattgttggcaatttactggggatggttgctatttttctcattcagaggaataggcatgctttaattggccgggccattgatgatcatgacatgcagcgagtccttgaatttcttaagtctgatccggttgtagatgctctttatgattgcaaaagtgaggtgattgggccaggtttttttagattcaaggctgaaattgatttcaatggagttgttctggtacaaaattatttggaaaggactggacgtgggacttgggcaaaacagttccgggaagctgcagtgtccaaggatgatacggaattactaagggtcatggctaactacggcgaggatgtagttgaagctctgggatatgaagtggatcggctggag

SEQ ID NO: 29002 - DNA, 481 bp, Sorghum bicolor
  Clone ID: 8091031
tctcgctcaacagtcaccagtcagccacccaccgcttccatcttccagcttccagcatccagccaagcctcagcacctcagctccccaggtcatgtcaggcggcgtcggcccgacggcgggtggcggcatcacgctgccgtccatgggcgcgccgccgccgccgctgcacccgacgcccacctcgcccacggcgcggccgcaccaccactactacctcttctccatcaagcagctcaacacgctgggcgcggcggccgtgctggccttctccaccacggtcccgctgtcggatgtcgccttcgcggtgctgctcctcccctacctcctcctcctcgcccggctcgccttcccgcagcgcccgggcaagcccaacccggccgcgcccgtcttcccgggcgccggcgggcggctcaccctcgccgtgcacaccgcggtgggcttcgtcgtcggcgccgcgctcccggcgctctacatcctcga

SEQ ID NO: 29003 - DNA, 129 bp, Sorghum bicolor
  Clone ID: 8091036
gcacgagggcgcgctggcacgcacgcggggtcacatcatgggcgtctcgctcgccgagcccggccgagtcgtctgctcgctccgcgtgcgcgccccgctcaccgtgcgtcgttgccttgcctgccgacg

SEQ ID NO: 29004 - DNA, 107 bp, Sorghum bicolor
  unsure (1)..(107): unsure at all n locations
  Clone ID: 8547610
gcacgagggccaattcttcgtcggtggtaacttcaagatgaacggtgttgctgagagcatcaccaacatcgnnaacaacctcaacgccgcccagctcgactccaaca

SEQ ID NO: 29005 - DNA, 440 bp, Sorghum bicolor
  Clone ID: 8547613
gcacgagggtgccaatggacacgacactcctgcggagcaatggccgccgccgcctcctgcccttcttccttctcttgctcgctgccgccgatctcacggcggtgcagggccagcaggggcagcagcagcagcaagggggatactaccagcagcagagcttcagcccgtccatggccatcgtcatcgtggtgctcatcgccgccttcttcttcctcggcttcttctccatctacgtccgccactgctacgccggcggcgacagcagcaactccacggacccggccggccccaacggcgccgccgcgcggtcccggcgccagcagcgcgggctcgacgccgccgtgctggagtccttccccaccatggcgtacgccgacgtgaaggcgcacaaggccggcaagggcgcgctcgagtgcgccgtgtgcctcagcgagttcgac

SEQ ID NO: 29006 - DNA, 148 bp, Sorghum bicolor
  unsure (1)..(148): unsure at all n locations
  Clone ID: 8547614
gcacgagggtttcatctaccgcccgttttgctggtggtgcggctgcaggtattgctgtaggtgctgctgttggggtcggagctgctgctgcagccggcgctctcgagcgtgagcccagtccagagccagagccagagcctcatcgnnc

SEQ ID NO: 29007 - DNA, 170 bp, Sorghum bicolor
  unsure (1)..(170): unsure at all n locations
  Clone ID: 8547617
gcacgaggaacaggttctcaaaagatgtcgagtctattgatcaagaagtagcgccagtcgctatcggtgtcgtacactgccttgcttccatcattaccatcgtcattctcatctcggncattacacctgcattcttgattgcggcattcttcatctcaattctctacttc

SEQ ID NO: 29008 - DNA, 443 bp, Sorghum bicolor
  Clone ID: 8547621
gcacgaggagggaaacatggacatgctcaacatggcgttcctcaaaggcatggaggaggccaagaagttcttgcccaccaccaacagccttctcatcgaccttgacgaaccctctggcaaatccttgcctaaagacagacacagcaagacctccactgactttgctgctacccaagtccaagtgaaggaggaggaggagcaggtggtgaatgcaatatcaatatttgggggaagcagaagcgccaatggcaggggccgcaagaaccgccacgccgaggaggatgatttggaggcggagacaggcaggagcagcaagctgatgatgccggagcaggaggaaaccggtgccaacgagctgtacaatgaaatcatgaattgtacctatgagtcgttcttgaagcgcatggatgacctgcgcatcgccatgggcagtgagactgaga

SEQ ID NO: 29009 - DNA, 304 bp, Sorghum bicolor
  Clone ID: 8547622
gcacgaggggctcatgcctggggtggctgggatggcaggtggtgcggtcactgttgtgagtccggtggatacgtcggtggcacagctggattctatgggcaaggggaatggggatctgtcatcgcccatggctccagtgccatacccctttgagggagtgataaggggaaggaggagcggtgctggtgtggagaaggtcgtggagcggcggcagaggaggatgatcaagaacagggagtctgcagctagatcccgtgcccggaagcaggcttatacaatggagttggaagctgaagttcagaaa

SEQ ID NO: 29010 - DNA, 190 bp, Sorghum bicolor
  unsure (1)..(190): unsure at all n locations
  Clone ID: 8547627
gcacgaggcaaagagtcgcttgtttgttactattagttagtttctttagtttcctacgtacaagggactgcttagcttctcggctatgccggtcaggacatggctcgccgacctgcgctcgaagctcgtcgtcggcgttggcccccgggaccacggcggncttggcatcctcgccttcgaggcancagcc

SEQ ID NO: 29011 - DNA, 412 bp, Sorghum bicolor
  Clone ID: 8547632
gcacgaggcaatctttagtgaagctatacccaagcttcacacattcaccacgttatcccttcgcctactccgccaggcatccagaagcctcccagctttccgtccccttacaatattcagaatggcttctttcgcttctcagacttacactcccaccgaggaggctgagatccagcaatggctcaccacctctgagcgtctcaagtcccccgaggacaagtccactatcctcgagactctcaacaaccacctctccagccgatccaccctcctcggcagcaagccctccaaggccgacgtcgccatctacgagactcttgctcccgtcgtcgctcagtggtcacctgaggagcgcaccggcgagaagggacacccccacatcgttcgccatgtcgacttcgtccagaactct

SEQ ID NO: 29012 - DNA, 256 bp, Sorghum bicolor
  unsure (1)..(256): unsure at all n locations
  Clone ID: 8547642
cgctcgccgaccaccgccaccgaatcaccgcttcccttcccatagaccatcgaggcgccgcaccggcccgctcttccaccagcggcatctcaagagccgcccttccctgacccgcccccccacccccggcgcattctcctctccgcgccgagatctcgccggccttctcctgagaggctcaggggctgagcgatggcggnggcggcgctgccgcaggcgatggatgcgctgncgcggcnggcgaccatgctncnnn

SEQ ID NO: 29013 - DNA, 468 bp, Sorghum bicolor
  Clone ID: 8547666
gcaagatgaaggtccgcgctgctttgtttgcgttgctggcggttgctgtggggaaggacgttgttcaaggagacctacgtccagacgaggttatggcaaacaatacagacccatcattcgcactacaaggctctccccccgactgggtgtaccccgagacactgctgtccatgcctcagtgcatcgcccaacaggatcagtcagcctggttgagtgccatgacaaagtgcacaaaaaagcaatgcatgcggcactttggagtcatctgtacccgtcatcagtggcggacccaactcagctgtctcaatgcagagttctcccctcaggtggttcaagagtacatttcgtattgcagtcgttcggtgctggccaaagcacagctttaccagtggattcgcgcagtgacggaccgcacgtggcttgttgaggttggagatgccaacgggctgcacaggctctctccagcct

SEQ ID NO: 29014 - DNA, 238 bp, Sorghum bicolor
  Clone ID: 8547669
gcacgaggcactaccacgctcgccttcccattctctcgctctctcccatcatggtggcggcgatggggcgagcggcggcggaggagggtgacgtggagttcgtcgactacgaccaggacgacgaggacgccatggaggaggacggccgcgccgcgcgcgcgctccccgtgccccgcatcgtctcccccgccgtggtgcgcacccgcgggcgcttcgcgggtcgcagcccctccgttct

SEQ ID NO: 29015 - DNA, 421 bp, Sorghum bicolor
  unsure (1)..(421): unsure at all n locations
  Clone ID: 8547671
gcacgagggatcaacctgacggagcggctgtaccaggtgctccgctggtccacggggtcgctggagatcttcttctcccggaacaacccgctgttcggcagcacgttcctgcacccgctgcagcgcgtggcgtacatcaacatcaccacctacccgttcacggcgctgttcctcatcttctacaccaccgtgccggcgctgtcgttcgtgacggggcacttcatcgtgcagcggccgaccaccatgttctacgtgtacctggccatcgtgctggggacgctgctcatcctggccgtcctggaggtgaaatgggcgggcgtcaccgtcttcgagtggttcaggaacgggcagttctggatgacggccagctgctccgcgtacctggccgccgtgtgccangtgctggtgaaagtggtgttcc

SEQ ID NO: 29016 - DNA, 322 bp, Sorghum bicolor
  Clone ID: 8547695
gcacgaggctccctccttccacctactactctctccttgcttcggcatattctcttcaacccacacacatatcaagatggcctcttctgcccgtcagtttgcccgcgtggcaacccgcacaaccacccgcactttcgctgccgctcctcgacaggctttccgccagcagggccgccgcttctactcttctgagcccgagaagaagtcatcctcctctctcctgtaccttggtgctgctgccgccgccggtggtctcggtatctggtacttcacctctggtgcctctgcctcttccaagacctttgttcccacccaggccgat

SEQ ID NO: 29017 - DNA, 475 bp, Sorghum bicolor
  Clone ID: 8547699
gagaaaatcatacataactttggacatgagcatgaacaagtaatcgataagctgtgcataacctattcactagttagtcactatttccagcctctacgttgaatgtggaacattttccgatacagattcgtatagcttgctccccatcttgggctctttggcagttggcccctattgaaaatagaggtttgaccatgatctctggctggagagccttcttgcatctgcatatgcatatatataatgggcagtccctagcttcatcacgacgacgaagcaaagcagaccttcttcacaagtgcttctgctaacagtcatcgtcgcatcgctgtatattcctgaaaccagctgtccatcccactgggagcaccgcagatgccgcgaacggtgtctgatgggggagaagacgaccatggcgccgacgttgctagcaggacgtcgtcgcaccgccgcatggagcacggacatgggtata

SEQ ID NO: 29018 - DNA, 221 bp, Sorghum bicolor
  unsure (1)..(221): unsure at all n locations
  Clone ID: 8547711
gatcccaaccttcctcttccaaagttgatcgcacttgctgaaatggtgtcttctctaccccggccaacacatgacgggctctatcgtgccattgacatgtatctgaaggagcaccccggcctatcaaagagcgaaaagaagaaattatgcggactgatggactgcaagcagctgtcacaggatgcgtgcatgcacgccgngcagaatgagcgtctnccctt

SEQ ID NO: 29019 - DNA, 422 bp, Sorghum bicolor
  Clone ID: 8547728
ccacggccgggccccgcgcggggagcgcacggactgggtcatgcacgagtataccctactcgccgacgcgctcccgccggccgcgcaggggagggagtcctacgcgctgtacaagctcttccagaagagcggggccgggcccaagaacggcgaacagtacggtgctccctttagggaggaggattggttggatgacgacgatgagggagtgactgcggatgctgccgctaattctgttcctaacaccaataatccaccatgtacagtggaggagcatgcaattactgaccgtgagcttccaattgaggatcttgatgaactcctgtcaaattttggaaatgatcaggagtttagtgaagcacagcctacttcttcccatggtcaaggtcagggttggctcagtgaggggggtgacaaggctg

SEQ ID NO: 29020 - DNA, 249 bp, Sorghum bicolor
  unsure (1)..(249): unsure at all n locations
  Clone ID: 8547730
gcacgagggtcacatcgcagcaggaggggagagtccccagggtcccggaccgaatccatttccagacaccaaggccaagcaagatccatccatctccctctctctctttcgctccagccagccatccttcctctttcttcgttcttggtgctctgatctcatcgctcattcgagtccaatccgatccgatccgaccaaccaaccgctgngaatgatnncnctcaacctggcccaccagaccggcgcgnc

SEQ ID NO: 29021 - DNA, 458 bp, Sorghum bicolor
  unsure (1)..(458): unsure at all n locations
  Clone ID: 8547734
gcacgaggaccaactccaccgacggcttcatcgagttcgtcacgtcgccaaacaacccggacgccatgctccgcaagcccgtcctctgcagctcggcggcggccatcgtcgaccacgcctactactggccgcacttcacccacatccctgcggccgccgacgaggacatcatgatgttcaccatctccaagccttccggccatgctggcagcagattcggatgggcgctgatcagggatgacaaggtggccgagcgggcgttagactacctgtcgaacagcaacatgggtgcgtcccgggacacccagctgcggatgctggggatcgtcaggttcatgctggccaacctgcacggcgaggacgacatcttcggcttcgggcacggcgtgatgcgcagcaggtggctcaggctgagcgccgtcgngtcgcgggccccccgcatctcgctgcagaagatc

SEQ ID NO: 29022 - DNA, 465 bp, Sorghum bicolor
  Clone ID: 8547775
aaaactggaggccacccgaatgcattatcactccaaccatgctgacagccgaggacatatcgaccactctacaaaaattatgcatgttatcacatggaatcgctccttcaagaacttacctgagcatgaggacttgaatgataattttgatattgatgatagatttgaaactcatgctgcagttctagatagaatgcttgcttgggagaaaaaactgtatgatgaagtgaaggctggggagcttatgaaaattgattatcaaaagaaggtgtctctattgcagaagcaaaagaaacggggtgttaaacttgaaacgctggaaaagacaaaagctgctgttagccacttgcacacaaggtacatcgtagacatgcaatccatggactcaacagtttcagaaataaatcggcttcgggatagacagttattcccaaagttagtggaccttgttgatggaatggccaa

SEQ ID NO: 29023 - DNA, 441 bp, Sorghum bicolor
  Clone ID: 8547776
gcacgaggcccactcccacggttcgccgtcgcctccctccacggggtcccaccagcccccgtcctccggcgggttcggtggcggagcaggtggaggactcggtcatggcggtggtctcggaggcggaggtggcctcggtggtggaggcggcgccggaggaggcctcgggcacggcgttggtctcggcggaggcggcggtggcggcctcggcatcggcattggtgttggcgtcggagtagggatgggcgcgggggcaggcggcggcgccggtgcgggtgcgggtgcgggtgctggcggcggcgggcgttgattcatccgtcgacgtcgagtttaaagagaagctatgcatgcacgcgtgcggcatgcatgcgtaatggacgcgcgcgcgatactcgatctcctttccaaacgatgtgtgtatgttcacgttctgcgctgcct

SEQ ID NO: 29024 - DNA, 265 bp, Sorghum bicolor
  unsure (1)..(265): unsure at all n locations
  Clone ID: 8547783
gcacgagggccaattccatcatcggcgcgggtatcatcggtcagccctacgccgtgcgccaggctggtcttgtcggcggcattctgctactggtaggccttacagtagtagtcgactggactatctgtcttattgtcatcaacagcaagctcagtgggacgagtcacttccaagggaccgttgagcattgctttggacagtcgggcttgatcgctatcagtattgcgcagngggtattcgcgtttggaggaatggtcgcatatgn

SEQ ID NO: 29025 - DNA, 475 bp, Sorghum bicolor
  unsure (1)..(475): unsure at all n locations
  Clone ID: 8547786
gcacgaggattttggtagacgagacggcgctcaaaatggcaaacagtgcgccgagctgccgtgcattctcttggctgtggctgtggctgctcctgctcctacggctgtggtgcctcctcctcgtcctctactgtccgatgatgtcgtcggcgctcgtcgtcagggaactaccgggattcgatggcccccttcccttcttcctcgaaaccgggtatgtggaggtggacgagagcaatggtgtgcagcttttctactacttcgttcagtcggagagggatcctgctagtgatccgctgctgctgtggctgcaaggtgggcctggctgctcanggctctcgggtcttgtctacgagattgggccgttgcttttcgatgtgcaatatacagcaaatggttatgaaggaggcgtcccccgattgctctatagacctgaaacatggactaaggtgagcaatataatatttgttgattctcc

SEQ ID NO: 29026 - DNA, 241 bp, Sorghum bicolor
  Clone ID: 8547788
gcacgagggcatatgccgttcagcaaatctgcctccacatgcatgatcctcgggaagttcatcttgtggctgccaagcggatccttcgatatcttcagggcactctccattttggcttgatcatccctcggtctgctcccacacaacttgtggtgtacactgatgcggattgggccggctgccctgatacacgacgctccacctctggatatgctgttttccttggtggcagcctcgtttc

SEQ ID NO: 29027 - DNA, 275 bp, Sorghum bicolor
  Clone ID: 8547798
gcacgaggggcaagcacacagccaagcgggagagagagagagtacgtgatctgatgggggacgaccagcagctcgttgcggcggcccgcgtggccccgcggcggccgatgatgttccgggtaccgcggaggccggtggcgagagcggcggtcggtggaggcgaagcgtcgccgctgttgccggcggggccaacaaggaagaagaagaagaagatggccgtggcgaggctcgggggaaaaaggaggctctttggcgcgatccggcggctccggatg

SEQ ID NO: 29028 - DNA, 497 bp, Sorghum bicolor
  Clone ID: 8547803
cgacaatcaaccggccagcaacgctcaacgtgcgcaggaagagcaccgtcgtttatcctcccgcctttcagggcctgtcacagaggcatcctccctatgtctattcctttcatggtcctttgcaggtgcaattggtttgacaagacatttccaccatggacggcgatcctgccgttgagccccagcttgacggcttcagtctgacatttcctctgccatatcgtgtcggctttatcgtcactctagctgtctggggatggggcctcaacctccattggctgcatgcctttcgaatcgacgttccctccttaatccgatatcccggacggaattcgccgcaacatatatcacaccacttatcgacataccgactcgccatagttctgtcggctctattctcgctgtccatcacggtattctggctctgcacctggcgcgtgccgtccagggtcattgccttcgactggatgccaatgacatacctcgtagcgataatc

SEQ ID NO: 29029 - DNA, 421 bp, Sorghum bicolor
  Clone ID: 8547809
gcacgagggagacccccggcgaggaccccacgatgaccggcaagtacgccgccgtcttcgtccgcggcgtgcagggctacggcgtcgccggccccgtcaactccaccgacctcgaggcctccgcctgctgcaagcacttcaccgcctacgacctcgagaactggaagggcatcacccgatacgtctacgacgccaaggtgacggcacaggatctggaggacacgtacaaccctccgttcaagagctgcgtggaggacggccatgccagcggcatcatgtgctcctacaaccgcgtcaatggcgtgccgacgtgcgccgactacaacctgctctccaagacggcgaggcagagctggggtttttacgggtatatcacctcagactgcgacgctgtgtccatcatccatgatgcacaaagata

SEQ ID NO: 29030 - DNA, 422 bp, Sorghum bicolor
  Clone ID: 8547813
gcacgaggctgagggagggaggcgagggggcctttgcggcgggcgacggcggagacggcgatggcgggtgcggaggggagagggccgaggcgaagccgcgtggcgttcgtgctggtggaccggatcggggacgtgagcatcccgtcgctgggcgggcgcacgccgctggaggcggcgtgcgcgccgcggctggacgcggtggcggcggccggggtgaccgggctcatggaccccgtggagcctgggctcgcctgtggcagcgacacggcgcacctatccctcctcgggtacgacccacgggtgtactaccgcggccgcggcgcgttcgagtccatgggcgccgggttggccatggcgcctggcgacatcgccttcaagtcaaactttgctacactggatgagaacaccggagttatcgtcag

SEQ ID NO: 29031 - DNA, 227 bp, Sorghum bicolor
  Clone ID: 8547818
gcacgagggtcagatgggccaactgggagttccacgttggcttcgacatgcgcgccggcatggtcatctcgctcgcctccatccaagacgccgacgatgccgccccagggggccagcggcgccgacgggtgctctaccgcggcttcgtatcagaggtgttcgtgccctacatggacccggcggaggagtggtacttccacaccttcattgacgccggcgactacggc

SEQ ID NO: 29032 - DNA, 569 bp, Sorghum bicolor
  Clone ID: 8547830
gcacgaggcattgatgccatttgggaaatggatagatcgacatcagccaggcgtgtgccctactaatccttcaaaacgcttatctcagaaaatgaagaaacagaagttaatcgatttactaaatgacccatatgatcctgtaaatgtaaaatggacaacagaaagatgtgcggtctgtagatgggttgaagattgggattacaacaaaattgtgatttgtaatagatgtcagatagcagttcatcaggaatgttatggtgtgacgggaaagcaggactttacttcatgggtttgtcgggcttgtgaaaaacctgagcaaaaaagggagtgctgtctttgccctgtgaaaggtggtgctttgaagccaacaaatgttgataacttgtgggttcatataacatgtgcatggtttcagccacaggttgcttttgctagtgatgagctcatggaacctgctgttgggatattgaacattcaacctttgctatttatgaagatgtgtgtgatttgtaaacaaatacatggttcatgtactcaatgctacaggtgttctacttactaccatgcca

SEQ ID NO: 29033 - DNA, 511 bp, Sorghum bicolor
  Clone ID: 8547839
gcacgaggcaaggcgtcctccaactcagatgcgcgggccaagtggcggaagcggaagcgcgccgccgccagcgcgtccccgtccaagcagccgggcgaccactcagacgactccgacaccgccgcggccgcgaacggcgacgacgaggcgtcccgcgccacctccgccaacggcggccgaggaaccctagccggcggcggaggcggcggcgatgacgaccccgcgctcgaccttcgtgcggcggaggtgctctcccccaacgccgagctagtctccaccttccccgccgccgtccgccgcgccgtgggccggcctcacccctcggtgctggctgtcatcgccgccgagcgtgcggcggccagttccgacggcgctccggccaccccagccccggtaccagttctcgagaacatttcgcatgggcaactccaggtgatctcggcgatgctgcccgaccatccgtccctgtcctacgaacctgacaagccgtccacgtatgtctgcacccacc

SEQ ID NO: 29034 - DNA, 531 bp, Sorghum bicolor
  Clone ID: 8547840
agttttgggcattctgtattcaaggattctttcaaacgcatttttgagggaggtgaacagtctctaggcctttcattcaatggtacaattgaaataaactgttcaaaagatattaaagtccaaggtattattggaccatgcacatctttggagaagaaaggagctgtgtgcgctgacactgttgttggtcaaggaaatacagcagcatggaaaatgtgtggtctcgatagaaatacttctctgacagtattttttgatgtctcaccgagtgaacgatcgagccagccaggacaccaaaatccccatttgtatatacaatttgtaacaagttaccaacacccggaaggtcaaatgaggataagagttactacaatatgcaggaaatgggtagacggatccactaataccgaggaattagttgaaggttttgaccaggaaactgcagctgttgtgttggctagatacatctctttgaaaatggagatggaggaagagttcgatgcaacacggtggcttgatagatctctcata

SEQ ID NO: 29035 - DNA, 149 bp, Sorghum bicolor
  Clone ID: 8547855
gcacgagggagctctcctccagtctccactctccacactccctgatctgttcgcatcagcctcctcgtcgcacgctccaccgaaaccctagacccgcctcgcgagttgcttcgctgcctgaccccatggagccatccccagcagtcgct

SEQ ID NO: 29036 - DNA, 194 bp, Sorghum bicolor
  Clone ID: 8547878
gcacgaggagcggttcgcgtacaagggcgtggccgcgaacctgatcacgtacctgacggggccactggggcagccgatggcgcgcgccgccgcgtccatcgacgcgtggaagggcgtctcccagatgctgccgctgccgctcgcgtgcgtcgccgacgcctggctcggccggtaccgggccatcgtgctcggct

SEQ ID NO: 29037 - DNA, 399 bp, Sorghum bicolor
  Clone ID: 8547886
gcacgaggcaccggttcacgtacaaggacctgttccgcgccaccgagggattcaagagcaagatgctgctcggcgtcggaggattcgggagagtgtacagaggagtgctcccgaaatcgaagctggaggtcgccgtcaagaaggtgtctcacgaatcaaggcagggcataaaggagttcgtcgccgaggtcgtcagcatcggccgtctccggcaccggaacctcgtgcagctgctcggttactgccgacggaaaggcgagcttctcttggtgtacgactacatgcccaacggcagccttgacaagtacctatacggcaagggcgacgacgacaaggccatggccacgctggactgggttcagaggttccggatcatcaaaggcgtggcgtcagggctgc

SEQ ID NO: 29038 - DNA, 111 bp, Sorghum bicolor
  Clone ID: 8547902
gcacgagggccacgcacctctcctccgtaggccgaacctgaccacacttgctacctgctccttccttactctgccttacctccgcgcgaggagaaaagcaactcagcggcg

SEQ ID NO: 29039 - DNA, 323 bp, Sorghum bicolor
  Clone ID: 8548004
gcacgaggcagactttctcttttctctggaagatatcccctcaatgtggtgcccgactatgatacttcaggttactgcatggagtctttccttaatcctgtcttgcgttaatgatgctttacgaatatttgacgacgacacgaatgagttatgaatagatttcttgggtatgcgatacgacctttcgaatgtttagaacgcctatcaaggactcttacgacgcaaccaatttattcaactcagctttttgtttccaacatttgacaagctggatctgaactggctttcagaccagtattgtcttcatggaacacgacgtcatg

SEQ ID NO: 29040 - DNA, 121 bp, Sorghum bicolor
  Clone ID: 8548021
gcacgaggcttcgtttcgcctccggcatccgcgtcgcgattcgccaaaccaaacgcgccggcccttataaggacagcatcccctttaccgtacgcccgcccgacccctcctctgccccgaa

SEQ ID NO: 29041 - DNA, 199 bp, Sorghum bicolor
  unsure (1)..(199): unsure at all n locations
  Clone ID: 8548117
gcacgaggctccttccctcccactccttggcatcgtaccgttgaccaagaccaaccggcgacgccgaatcagccgcaggctccccggctcctcctcctcctgcgcccaccaccatgtccggcagcggcggccccagccgcgacaagacccgctgcngcagctgctgcacgctgctcgactccctgggcttgatcgggct

SEQ ID NO: 29042 - DNA, 424 bp, Sorghum bicolor
  Clone ID: 8548236
gcacgagggacgtgtccagcaactacttggatggagcttggaatgggtccgacacaggagtgcttgccacgacgaattgcttctacggtgtgccgggtcagcgcagcagtgcggattgtgaggagttttacaggaagcaaggcgtcaagcttgttgatgctccagcgccctcgcctgtgcctttgccacagtcaccgccttcaccggagaagaagaagcagaggatctccaaaaatgtactcgttggagtccttgtagccgccggagcactgttggctctgttttttattgcactgctgttctgtttgttcaagagaagaagcagaggaacaagaggaacgaggggagtggagccaaatgaggaagggacgcgctcttcacggaggagggatagcagtgtcaatccggtgatgtcattgccacc

SEQ ID NO: 29043 - DNA, 434 bp, Sorghum bicolor
  Clone ID: 8548253
gcacgaggcctcttttcctcctcctcgcccttcttctaccggccaattcctcttgtcatggccatctttgaataatttcctttcctgtcattgtatattatcccggtgcctcgagtcttgcaacggtgcgactgtgtctctcgtgcatagtgtgtttgctttgatacttccagcgtctctgattcactttcaccacaacacaatcatcttggacggtcaaccactatcaattccaaattacgagacatagagtcctgttttgaaatcacttataaacccctcctcgcccttactctttcgaatctctaccctcgttgtgcagtactcatcaacagccgtgtattacaagaacatcttcctggtcttgctgggttattagcactgccaacgccttctttcaacttttggtattcaagtaccttttggctgtacct

SEQ ID NO: 29044 - DNA, 496 bp, Sorghum bicolor
  Clone ID: 8548264
gcacgagggaggacatcacagctcagtatactaccctcctccgacctccgtgcgtcttgcagttcgcttctcagggtgcacgccgagttctcgatcgtatcctgttcgttgctcgacatgggcacgggaggtgtcgcgctggtcgccgccgccctcgccgtggtggtggtcaccaggctatggacggctctgctccacctggtgtggcgcccctacgccgtggcgagggcgttcgcgcggcagggcgtccgcgggccgccgtaccgtgtcttggtgggcaacagcaaggaggttcaggcgatgcgcgcggcgacgagcggcgacacgctggagctcacctcccacgactacatcccgcgcgtgatgccgcagtaccgcgcgtggatgtcgctctacggcaaggtgttcctgacgtggtccagctcgactcctgcgctgttcgcgggcagctacgacatggtgaagcggatcctctccgacaagtcggggctgtacg

SEQ ID NO: 29045 - DNA, 212 bp, Sorghum bicolor
  Clone ID: 8548334
gcacgaggcacctcatcagtcatcactctcacactgcagcttagctagcttagctgctgatcacaacaagcaaagcatatagtagctagctaggtgatcgatcgtcgacgatggccgccgccgcctcctcctcctcacagcagcaaatccgtccactggtgggcgccgccgcgtttcttgctgtgtggtgcctcgtcgtcggcacggccagg

SEQ ID NO: 29046 - DNA, 102 bp, Sorghum bicolor
  Clone ID: 8548345
gcacgaggccggagtccgccagcccgtgcgcgagctcctcgagctgtgccacggggacgtgcacctgcgtgccgaacgacacgtgcaccaccgacccgggcc

SEQ ID NO: 29047 - DNA, 412 bp, Sorghum bicolor
  Clone ID: 8548350
ggccatctcttatagcaattgcaccttacattgctgtgaacttctgtgtttttgacctaatgaagaaatctgtaccagagaagtacaagaatagaccacaaacatctctagcaactgctcttctttcagcaacatttgcaactttgatgtgttatcccctggacactattaggagacagatgcagatgaaaggcacaccatacaatacagtttttgatgctattccaggcattgtggagcgtgatggtctaactggtctttatagaggttttgtgccaaatgcattaaaaaatctaccaaatagcagcattaaaatgaccgtgtttgacacggtgaagacactgatagctaccgggcagaaggagatggacaaattaattcaagaaaatgaggagaaaacaagctaggaaaa

SEQ ID NO: 29048 - DNA, 194 bp, Sorghum bicolor
  unsure (1)..(194): unsure at all n locations
  Clone ID: 8548351
ccgcgctcttttcttgtcgcaatggtagcaaacaaactgcactccacttcagtacaccaacgcgacaaactatacaatgaaatatcttaggccaagtttaatttccatttttttcatcatgaaatcatgtcagtttcctgtagtccaaaatttgccgttattaacgcagccactgtcnctacaaccgcgctgtc

SEQ ID NO: 29049 - DNA, 162 bp, Sorghum bicolor
  Clone ID: 8548357
gcacgaggctcgcaccacgtgctgaacctaccctacccagtacccacactccactccagtccacccaccgggacctctaaccccaagcttgatctcgtgcgctcctctcccttgccctcctctcctagggttagcaagcttgatcccgtacgcctgcttggg

SEQ ID NO: 29050 - DNA, 418 bp, Sorghum bicolor
  Clone ID: 8548360
gcacgaggcaccaaaccaacctcctcctcccccatcatcctcttcttggcttctccttgtgccttgttcgtccccaaaagggcaagagccgacgcgagggaagggaagcagtagcagcacgagctacgcggctgccatcccgcagctactccaaacagcaacgtcctagccgacgagagcctccgccacctacccacctactcccgcccgtcgcctccgcttggcttttcgtcgagcagttggtgagcacctaacccccctggccgcggcgcgggcgagtaaggcgggcgggggaagccaacgacagcgagcggagcgggagagtgtgagccactgagccggcgtcgtcggcactcgtcagtgcttttttcgggcgccggaggggagatgaagaagctgtaccacggcggcaaggggc

SEQ ID NO: 29051 - DNA, 107 bp, Sorghum bicolor
  unsure (1)..(107): unsure at all n locations
  Clone ID: 8548373
gcacgaggcctatctaaaacagtctctcgcgncgaggaacagagctaccagttcccgtgagagcgganaaaattcattttnttccccacctgcgccgcctgatatng

SEQ ID NO: 29052 - DNA, 405 bp, Sorghum bicolor
  Clone ID: 8548380
gcacgaggaaaccatttccaaacaagcagagctcgcctgcaagcagagacagaggagagcagtagtagcaatggccaaggtgcaccccaacgccgccgccgtcgcgacagagctcgccacagccaccacacgagcggctgccgaccagcaacctgagccgccgacgacagtgctgacggtgtggcgcaagtcgctgctcttcaactgcgacggcttcaccgtctacgacgccaacggcgacctcgccttccgcgtcgactgctacgccaggcgccacgccgaggtcgtgctcatggacgccgcggggggcgccgctcctcaccgtccgccgcaagaggctcagcctggcggagcgctggctcgtctacgacggcgacgcagcagcaagcaccaccaggccacctc

SEQ ID NO: 29053 - DNA, 162 bp, Sorghum bicolor
  Clone ID: 8548382
ctactcttcgccggccggaggagtacgtgttcatcacaagtagttggggacatggaaaccaccgttgtgggagacctcatggcgaccgagctgaggcttggactgccgggcaccgtcgacgacagctgcagcctgcagagccaggtgaaggcgacgacgcct

SEQ ID NO: 29054 - DNA, 354 bp, Sorghum bicolor
  Clone ID: 8548388
ggagatcggcggcctccggctgcttcggaagctggacttctggctctacttcttcagctacatgttcagtggcaccctgggcctggtgttcttgaacaacctgggacagatagccgagtcgcgacggcttggccacacttccacgctcggctcgctgtcgtcttcgtttggattcttcggccgactgctcccttccttcttggactactactccgcgaagagtggctactccatctcacggacgggctccatggcgtcgctgatggcgcccatgtcaggcgccttcttccttctgctcaactcgagcgacctggtcctgtacctgagcacggccgtgatcgggacgtgcacggg

SEQ ID NO: 29055 - DNA, 311 bp, Sorghum bicolor
  Clone ID: 8548405
gcacgaggcagctcatcaatacctaggtagctatagctctccactcactcactcactcattcagttactgagacgcctcagtttgttcctcttgtccaattgaacactcattctcaactctcccagctcaagctccctgacctcatacacgcccatcatgggcttcctctcctgtataggccttcgtcgccggaatcaatgggagcccatgactctcctcgaccatctcatctcatcacctttaacatatctggctttcctcttgtaccacgctggactcctcctccgcgggcgggcctttcacccaccgc

SEQ ID NO: 29056 - DNA, 288 bp, Sorghum bicolor
  unsure (1)..(288): unsure at all n locations
  Clone ID: 8548461
ttcgcacgaggtctgcctgtgccgggccgagactcgctatcgacaacacatcgaacaatcccgcgcgcacacactcgcactcagcgctcactcatcactgagccattactcagctcaccaactccagatctcaatggcgcactcgcgccgccaccaccttctcctccccacggccatggccacggcgtgcttcctcctcgcgctctgcgccgcgccggcgccggcccacggcgcgcgcgtcctgacgccgggcggcgctggcgcgngcgcggtcaccaaggcgcagca

SEQ ID NO: 29057 - DNA, 195 bp, Sorghum bicolor
  Clone ID: 8548463
gcacgagggcactactccgcccgtaccgcggaggaggtcttccgcgacttccgcggccgccgcgcgggcatgatcaaggccctcaccaacgatgtggagaagttctaccagctgtgcgaccccgaaaaggaaaacttgtgcctttatggctaccccaacgaaacatgggaagtaactttgccagcagaggaagtt

SEQ ID NO: 29058 - DNA, 497 bp, Sorghum bicolor
  Clone ID: 8548471
cgtgtgtggagtatataagaaaccccgaggccagcaggatatcatccatctccggccaggactctttctccatccatcagagacgagggagtcgacggaggggcagagatcgaggcagctagcaggcatcaatggcgagcaacggcagcaacgccgcgctcacctcccacatggacgtcgacagcgtcgccttcaccggctccacagaggtcggtcgcctcatcatggagtccgccgcgcggagcaacctcaagatggtctccctggagctcggcggcaagtcgccgctcatcgtcttcgacgacgccgacgtcgacatggccgtcaacctctcgcgcctcgccatcttctacaacaagggagaggtttgcgtcgcgggatcgcgcgtgtacgtgcaggaagggatctatgacgagttcgtcaagaaggccgtggaggccgcgcagaactggaaggttggagacccgttcgatgtcaccaccaacatgggtcctcag

SEQ ID NO: 29059 - DNA, 505 bp, Sorghum bicolor
  Clone ID: 8548476
gcacgaggaacaacatcacttggcagcagaagaaaaagttctccctttgtactgaaagcacaaaaaatctctctatccctgactctttcccctcactccatcactcccaggaggtagagtgagctagcgatacacgtggctctgcctgttgagtccagtgtgtgccacttctctcacaaacactgcggcgagcttgtttctatcctgcaagaaacaccaatcttcgctagtttatgcgtcgatccaaacaccaatcttggatttctgctgcaagggctgtgcttcttgtagcaaaaggcccaaacatttgatcccaagccagctcggaatcggatccctgcgaggaccaggcggacggccatggcgtcacgctcctactccaacctcctcgacctggccaccggagcagccgaccaggcgccggcggccgccgcgattagcgcgctccggcggaggctcccgcgcgtggtcaccaaccccgggttcatcgacgactgcccggcgt

SEQ ID NO: 29060 - DNA, 351 bp, Sorghum bicolor
  Clone ID: 8548481
gcacgaggctcctcctcgtctgcgcatccggccgtccgcatccctcctctcctcttccgcggcgcggcctggtgcaagaccaagatcaagggggaggagaaggccgcgatggcgagcggcgtcaacgatggcagcgggaagagcctgacgcattggctgcgggagaacgggttcgacgacgacgccgtggcgcgcatgtccaggcggtgcaggaacctgcacagcctcgacgccggcgaggcctcgggcgtctgggactacctcctgacgggcgtcaagatggagcggcggaagctgcggcacgtggtggccaagtgccccaaggtgctcaccctgtccgtggaccggaag

SEQ ID NO: 29061 - DNA, 558 bp, Sorghum bicolor
  Clone ID: 8548485
cggaagctccaccaaccccaacggcaccccgaccaatggttccatgtcgcagcgtgatgacagcttgctcgaaagggaaatgagccgtatgcagctttcctcgggatacccgcagaacagcagcccacgctccctgcgccaaatgacttcttgggatgctcctggccccattggcggccaccgcactttcagcaccaactacgatgaccggccatcgagacagcctcgcggaccccttcccgagcgaggccaaggcttcagccgcccacgacagaatggacaccagaatcggggcagcgacgaactttcgtcgcaatccaacgtcgagattcttgtaggccagtagttatgtcacttccacgcacgaaaaatgacgtcgtcgcacgtatcatcactccttcaacgacacgtgcgatggcacccatgaacgaaatcgatgacgaacgtttaacggcctaaagccagagtttggccgcgctacttaccctggattgactttacgacgcatacgaagagaatgatgccacgatggtagagacatttacatccagaactaaa

SEQ ID NO: 29062 - DNA, 483 bp, Sorghum bicolor
  Clone ID: 8548502
gcacgaggccaatattccacacaggcaaccagatttggttcctctgaggtgcttagtgattgtcaagtaacaacaaacaatgcaacacacaattctgctggtgctggtatttctgcagttaatgaagaaacaactatgcctgctgttagtagaaagagaagaatatctgttcctgtcaaggttaatgatacgtgcggaaatatcggaagatctgagaaacacctcgagaatagctctggccctgatgtcgcagatgccatagaggttctatcatcgaagattcaggacgtgcaatctcccaggagcatatttgaacctgacaattctgttgttcaagagcagaaagatacacactcctttggcatttcaaggagctggttgaacatgcaaccgacgcaagacaacacccctggcacaaaggttaaaaacttaaactccgcaccagtcccctccccagctcccattacttactaccctttcagt

SEQ ID NO: 29063 - DNA, 353 bp, Sorghum bicolor
  Clone ID: 8548511
gcctgctgggcctcctgaacgcgggggttctggtcctcgcggtcgtcgcgctggggggcggcgcgtggctcagccaccgcgcgtccaccaccgactgcgagcggttcctggagcggcccgtcatcgcgctgggggtgctcctcctcgtgctctccctcgcgggactcgcgggcgcgctctgccgcgcctcctgcctcctctggctctacctcctcgcgctcttcctcctcatcctgctcctcttcgccttcaccgtcttcgccttcgtcgtcaccaaccgcggcgccgggtgggtcgtctccggcagggggtacaaggagtaccgccttggggactactccacctggctgcag

SEQ ID NO: 29064 - DNA, 504 bp, Sorghum bicolor
  Clone ID: 8548513
cgggaaatagaccctgctctctgtccagaatcatgcggccatgttcaagaaggccagcctctgcaatcatggtggcatacagctcctgagctcgtctatctcggctttgccacccactcgcgtgagctttcaagcgtcttgttttactcgatcgccattgagatctgatcgaggctacgcgacagcctcggattcttcggacaacctctaccagtggccgtcgagctcgtcttttactccttatgacgttctcaaccttcgtcgcaatgccccgtattctaaggctcagtactacgatcttgtaaaaatctatcatcccgatcgatcctgcgacgagcatcctctttgtcgaaatatcagtcctgaagttcgtctccagcggtaccgcatcgtggtgactgcgcatgagattctttcggatcccgcacggcgagccgcttatgaccaaaccggtgccggttggagtcatcatcctcaacgctatagcactgccgccgaagctgt

SEQ ID NO: 29065 - DNA, 304 bp, Sorghum bicolor
  Clone ID: 8548519
tcctgcgccaccacgcaaaagaaaaccccactaggcagtgcatgcggtgtccattgttcatgggcacatcctcctgcctcggcggcctgatctgctcctgctgctgcttcgacgacgacgacaagcctaaccaagagcaagagccggcagcgatggccgccgccgccgctacacccagcgccgacgacgaccagacagccatcatcacccaccgcaccgtggagctaagcaccggcgtgcgcctgcacctggcggaggccggcccatcgggcgcgcccacggtgctgctgctgcacggcttccc

SEQ ID NO: 29066 - DNA, 466 bp, Sorghum bicolor
  Clone ID: 8548521
gttttgaggacaaggaccaaaaacaatattgatttatattaattaggacatgcagctgatatattgttacctctatatttttgtatttctttcaaagaggcattgaggctataggttgcttgcacacatgaaatttcgagactacatgtgtaggtagccatatttttctgggctgccagatcaatgctacaggctatagaagattccatattattctcctgttcccatcctgcatgcagagggttggaccgtaccagagataaatatatagccatcatacacagtcatgcacacatacataggctaagcttagagcagcatgatttcatgatgatgtatggtagtagcgccggccttcgttcagagtttatttcagtcctcaaaccccgtgcaaaagcgtctatatcagtgtcacatcagtgtcgttacataagtatacatgtgtgtatttctgtttcacaagcag

SEQ ID NO: 29067 - DNA, 564 bp, Sorghum bicolor
  Clone ID: 8548546
ctcagctcctgtagcattgcctgacaaagtggcaagcaaggaaccgcaagccatggcctctgttccgaagcttcttctcctgagcctcctcgtttttctcagctatcgctctcccattgctcacgcaggtgatcatggcagctacaaggttctgtcccttggctctctgaggaccaagtccgtctgttccgagtccaaagcggttaagtcgtcgaccggtgccgccacggtgccattgcatcaccgtcacggcccatgctcaccgttgccgaccaagaagatgccaactttggaggagaggctccatcgcgaccagctccgagctgcctacatccagcggaagttctccggcggcggcgtcaatggcagccgcggcggcgctggtgacgtccagcaatcgcacgccaccgtgccgacgaccctgggcacctccctggacacgctggagtacttgatcaccgtacgcctcggctctccgggcaagtcccagaccatgctcatcgacaccggcagcgacgtgtcctgggtgcagtgcaagccgtgctcgcagtgccactcccaggc

SEQ ID NO: 29068 - DNA, 469 bp, Sorghum bicolor
  Clone ID: 8548554
gcacgaggcggcggcggcggcggcgcgaccgtgaccgtgtacgagaaggaggactacctcggtgggcacgccaggaccgtggccgtcgaggacgacgacgccgacggcggcggcaccgtgcagctcgacctcggcttcatggtcttcaaccgggttacatacccaaacatgctggaatggtttgaagggctcggagtggagatggagatatccgacatgtccttctcagtgagcacacaattggggaccagcgccagcagatgcgagtggggcagccgcaatggtatctcaggcctcttggcacagaaaagcaatgcactgagccctagtttttggcgcatgattcgtgagatactcaagttcaagaacgatgctctcaagtacttggaggaccatgaaaacaaccctgatatggaccggaatgagacccttgggcaattcattcagtctcatggatattctcagttct

SEQ ID NO: 29069 - DNA, 422 bp, Sorghum bicolor
  Clone ID: 8548568
ctcatttctcaatggctcccttctcatcacgtcttcttcatggcgtgccccttctgctaatcctcgtcggcgccgccgccgcagtgacgaccgccgtccatgcggacaccggtggctaccgccggcggcacgcccgcttgttcgcgttcggcaactcgctcactgacaccggaaacgcggccatcttcccggcgactgcaggaggaccttccacctcgccgccgtacggggagacctactttggccatcccagcggccgagcttccgacggcaggctcatcgtcgacttcctcgtggaggagctgaaggtgccagagccgacgccgtacctcgccggcggcaggacgacggccacggccgccgacttcgtcaacggggccaacttcgcgctgggtggtgcaacggcgctcgaccaggcgttc

SEQ ID NO: 29070 - DNA, 355 bp, Sorghum bicolor
  Clone ID: 8548575
catgatgacaacaaaagttgaaaggaatatgctgaggatgaaagacactaagacagatctaacactgtaaaacatacacaataggtcactggaaactaaatatgtctcaatggagaaaaggaactcctagcttagtaaatacaacacaaaagtaacgggatattgttttactttaatggcattttagtttagctgtagtgtttagggttaatcagatccatgccactataatgaaatatataccactgcaacttttgacatccaaaatatgccatcatgatttgctttatctttgtgacgtgccattatgtcattttgtatcaatgtttataaattttgaaaactgttacctgac

SEQ ID NO: 29071 - DNA, 202 bp, Sorghum bicolor
  unsure (1)..(202): unsure at all n locations
  Clone ID: 8548577
aaaaaggcaaatgtcggcatgcaggcaggctgcaagagcgagataattagttgatcgatagatcgagtctgctgctagcttagcttgttcatctatatatatatagctaattaacgtgtgctacaaattagagagaatcatctatcggcaggcagaggcagaggcagaggcanaggcagggaggtagggaggaggggatggg

SEQ ID NO: 29072 - DNA, 593 bp, Sorghum bicolor
  Clone ID: 8548585
gcacgaggaaggagctcatcctgtccccgaccccggccatgcgccgcatcctcctctcgggcctcggcatccacttcttccagcaggcgtccggcatcgacgccgtggtgctctacagcccgcgcgtgttcaaggccgccggcatcaccagcgacaaccagctcctgggcaccacctgcgcggtgggcgtcaccaagacgctcttcatcctggtggccacgttcctgctcgacagagtcggccggcggccgctgctcctgagcagcgtgggcggcatgatcatctcgctggtcggcctcgccgccgggctcaccgtcattgagcaccacccggacggcaagatcccctgggccatcggtgtggccatcgcgtccaccatggcctacgtggccttcttctccatcggcatgggccccatcacgtgggtgtacagctccgaggtgttcccgctgcacgtgcgcgcgctcggctgcgcactgggcgtggcctccaaccgcgtgaccagcggcgtgatctccatgaccttcatctcgctgaccaaggccatcaccatcggcggcgccttcttcctctacgccggcgtcgcggtgctc

SEQ ID NO: 29073 - DNA, 159 bp, Sorghum bicolor
  unsure (1)..(159): unsure at all n locations
  Clone ID: 8548586
gcacgagggagcggcatcgcggcgctgctcaagagcctgcacccagactggacaccgnccgcgatcaagtcgncgatcatgacgacgtccgacgcgnnngaccgcacggncctgcccatcaaggacgagcagtaccgncacgccaccttctacgccatn

SEQ ID NO: 29074 - DNA, 399 bp, Sorghum bicolor
  Clone ID: 8548590
ttcggcacgagggtcaaacaagcatcggatctgaaagggcattcaataaaggttttgaactgccatgattctgtcatttacattttagccccacttaagtatgcaaccgtctacggatgttctgacactaccattattcttggtgctattggtaaggttgttaaagtggagcattgtgaacgtgtacaaattattgcagcttcaaaacgaatctgtattgccaattgtcgtgaatgtatcttctacttgggagtaaatcaccaaccacttattgtgggggacaaccataaattacaagtgagttttgctcttccatctgtgcctttttccacctcatcagatgtgtatcagtatatggtaatccgtaatgtatcaatactcatcctgttataaaggata

SEQ ID NO: 29075 - DNA, 409 bp, Sorghum bicolor
  Clone ID: 8548597
gcacgaggatgagatctctcgagatggcgggggaggagaggaagcgggtgctagtggtgggcggcagtggctacctgggccagcacctccttgcggcgtcctccgccgccgaccgcctcgacgtcgctttcacccaccacagccccgccccgccgcagccgctcctcgacgcgctcccctccgtccgcgccttccgcgccgacctccgctccggcgacggcttggaggcgatctccgcgtccttcggccagccacacctagttgtcaactgtgctgccatgtcagttcctcgggcatgtgaaatggatccacctgctgccatggctaccaatgtgccttcttcacttgtgaactggttgctaagttttgggaatgaagactcacttctgattcatctctcaactgatca

SEQ ID NO: 29076 - DNA, 418 bp, Sorghum bicolor
  Clone ID: 8548606
gcacgaggatcccaacctcccagtgcaaccgagatccatggacccgtccaaggatctggccgcctacggctacggcagcgtggcctggaaggagaggatggagggctggaagcagaagcaggagcgcctgcagcatgtcaggagcgagggaggcggtgattgggacggcgacgacgcagatctgccactaatggatgaagctcgacagccattgtccagaaaagtcccaatatcatcaagccgaatcaatccctacaggatgattattgttatccggttggtggttttgggtttcttcttccactaccgtgtgatgcatccggcgaaagatgcatttgcattgcggctcatatctgttatctgtgaaatctggtttgccatgtcctggattcttgatcagttcccaaagtggcttcca

SEQ ID NO: 29077 - DNA, 445 bp, Sorghum bicolor
  Clone ID: 8548616
gcacgaggtgtctttccagagaagtcattgatatttcccagattttcaacaagttcaagagcttctgaagcaacaaaatagatgaaaccaagagcagcaactcttgatgttatgccacccaatgtgggtagaacaacaccgtagcccatcgacactactaatagaagaagccgagaaacagtcttcttcacagctgtaaatgtaactgcccacaaggtaatgcccataggtctggttccagttgaattaaagttagcatactcaaaataccagaaagccatttcacacatgccaagagcaataacaactgttatatggtaatgcagctgcaaaatgtccttccagcatcgcacgaactgaatgaaccatagaagtccaagggcaagatatgcaagtgacatgaaaccataaaatgtcatcattggagccattttaccagggagat

SEQ ID NO: 29078 - DNA, 443 bp, Sorghum bicolor
  Clone ID: 8548618
gcacgaggaataattcgaaattgcgatgcaggcccaccttgcccaactattccgttgagtagagagaggcccattgtgcgaactatggcaaaagcctattcgtttgcatttattattgattagacattgctttccagcatggattctgacttaaaggcgttcagtcataatcctacggatggtagcttcacggcactagctgttcagctaaccgtatttaccaattatccgattcaggggttcctctcgtactaacctgaattactgtcgcaatatcctttcatcagtagggtaaaactaacctgtctcacgacggtctaaacccagctcacgttccctattagcgggtgaacaatccgacacgttgtgaattctgcttcacaatgataggaagagccgacatcgaaggatcaaaaagcaacgtcgctatgaacgcttggctg

SEQ ID NO: 29079 - DNA, 549 bp, Sorghum bicolor
  Clone ID: 8548637
gcacgagggtgctaagggcatgctttggtactacgaagtattgccatgcatggctgcgaaacataacatgtgggaatccagattgtctctatttgcatgatgtaggcagtcaggaggatagttttactaaagatgagatcatctcagcatatacgaggactagagtcccccagatggcatctagtgtttcacaaagacgtacaggcactgtgttgcctcctccaggagatgatttctcttacagtgcggttgtttcagccaagcatacattcaagaatggagcacttaataccaccaaccagcccagactttcacctccaaacagtagttctgggaggtccacacttccaccagctgcctcatgggggcagcgtgatttgaatgccaggacaacagctactggggcgacatcatcacaatctcatacaaaacctaaatcagaatcacagagtaatccattttcaagttctccagtaatttccagtacaaaaacaccctcttcgtggaatgatgatacaagtacagcaacaaaaatgtcatcaggacagc

SEQ ID NO: 29080 - DNA, 419 bp, Sorghum bicolor
  Clone ID: 8548641
ctcatgtaatcattgcgttgatcctattttggccaaccaatgacctatgtacccatagatttagatccatataccgtgaaacaagtcgaataagccctgaaaaccgatccagtaccgttattggttgtttagtcgaagagaccgccgaagccctcctcgtcctcctcctcttcctcctccttcttctcctcagcgggggcagcctcggtagcggcagcagcgccggagctggcagcaggagcagcggcagcgtaagcgtcagggttggcaatgcggtccttgagctgctcaatctcgggccagctgaagtcggtctcaatggcaacagccaggaccttcttgtaggagttgacaagagagtgcatgacggaaggcagggtggggaagttgagagccagagagatggtggcaacggtggt

SEQ ID NO: 29081 - DNA, 469 bp, Sorghum bicolor
  Clone ID: 8548676
ccggcgaccccgcgccctctccgacgcggaagccggccccggctccggcgcccaaggccacggcacccgccccggagatccccgcctcgccgccggcgccgagctcgatcgggcagacgccaacggaggccccgacgtcccctccgcctcccagcgacgcgtccagcgtctcccccgccttgttcctggccgccggcgccgctgtggcgtttttcttctgaggtcggtgggtgggccggccggccggcgccgatggatccgcatccgcctgtgttgtgagtgtgacacgatggctctcgctacttgtatttgttggccgcgtcgtcgttgcattgcattcgggtttattactagcatagcatagcatactactgctttcctagctgggttcgatctgtgcgtgcgtggtgagtgagagagattgatgagtcgagagacagacagttgctatgtgggttgggatgccatt

SEQ ID NO: 29082 - DNA, 602 bp, Sorghum bicolor
  Clone ID: 8548681
ggccgaccttgttgccagcctcaatgagcttgagatcggtggtaatttcaatggtaccacgagcgatcttggtggggacaccgagagcctggaagaaagaggtcttgccaggctccataccggtgtttccagcaggaacccacacatcgacgggagcgacagcaccagcacgggcaggggcggcgacacggttggccaggatctggtcacggatctccttcaggtcgccgttggtgaaaacgaaaccgacgttgcccttgacgaaaggcaggatacgctcgtactcgggagtatcaacgaggaaagttcgcagagctcggcgaaccatggtgttcttgcccatcaggacaacacccttgccacgaagggcgtgtcggatctcgtgcatctgctgggacgagacattgtcaatctcaacaatgaagattgacttgtagtcctgcagcaagcccttgagcttgtcgaagtagccggccttgttcgctgatttgccccccatatcttcttatttcctgaaggcaggttatttaagggcaaatgggtatcctttggtgtttattatttatgtccgtgtacgtttcctctcgctcctgggtttgtac

SEQ ID NO: 29083 - DNA, 629 bp, Sorghum bicolor
  Clone ID: 8548708
ctgtggcaaaatcccttcccattcagtggatagatggtgttctttcacaaggccaacaggttgagttcttcaatgatgaattccggtgccctgtctatgtcaaagatatggtggacgtgattttgtcattgacaaaaacttggttatcaaatggagaaaaagtccaggtcctcctaaatgttggtggtccagatagggtatcaagactgcagatggctgagtctgttgctgttgttcgtggatatgaccccagaataatcaaatctgtgtctgcatcatcggttaatcgaggggtagcttctccaccagacatatccatggacatcaccaaactaacccagattcttggtatcaagccaatctcatttcgagatggagtcagaagtacacttgatgcagaagccagtacatgacacttcctcaacagtgtgcttgagttcctagggagttgcttgcattcaaatatgaaagtgtgacagaaaatcacatttaatttgcgaaatttcagtaacagtcaatttctgttggatttatgtgaaatatgtaactttgtacctactaaagaccaatgtcatcatcggtgttactgcctcattgtactgtaccattagaaataaaaatggcattca

SEQ ID NO: 29084 - DNA, 521 bp, Sorghum bicolor
  Clone ID: 8548712
agcttcacctcgctgatcgcgcccggggtggcggacgtcggtgtccacttgtccgccgggttcctgatgggcgggctcgcgccggcggccctgcttcgcgcgcctggatctgtcggtgctctgccgccaccgccactgcagcagcagcccacggtgtcccaggcgttgccccagggcatggtttggagcatggggtggccggacctgtccatttaagagctccatctccctccgccggcgcgcgcgcagtgcatcgtccaccatcggtggccggcgaatgactgctactgcatcatcgctaatctagcctcttctgttttctcttttagctgtttccattaacagtagactgtagcagtgcaccaaggtggtgatctttttgggagtttaaagtcgtttttagggatcaggaaagaaagttgtagttgagtcaggaaggaactgtgagagagtgatctgctcaggatgtcacgagactatgcatgcatgatgcttggttgcctgcatgagcatgaccaatc

SEQ ID NO: 29085 - DNA, 471 bp, Sorghum bicolor
  Clone ID: 8548715
ggaggaaggtaaggtcgtcgggaagaggcagtacgacgaccaaggagactttatcctgtgccgcctgtcgaacaagaggagggtgactctgtcggagttcaaaggcaggtcactggtgtccatccgcgagttttacgtgaaggatggcaaggagatgccctccgccaaaggtattagtatgacgatgtagcagtgggaagcattttgcaatgctgtacctgcaatagagtatgccataaaaaagtttgaagattcagacttgagaacttgttttaggagccctcttcttttgcctgtagcaaatcaaaaggcctatttgtgacccttaacgagggccatatgtgggcttgtaagagctccaagttctgtaaacaggcttcacttgtgccatgtgtaggatgtagacgactctgtaacagtttgtaatatttgatagtaacaagtaatccaccattatggtggcctgcagtt

SEQ ID NO: 29086 - DNA, 380 bp, Sorghum bicolor
  Clone ID: 8548754
gtcatgaataccagacattttggacaaagaaaacaaaacgtcatgtattcatgactggatgcagcggcggacccagaaatggaccaagaggggggctaaataacataggctaaatttttttttgctcgctcaatccagtacactaaggccttgtttagttctaattttttttgcaaaataggaatagtagcattttggtttgtatttgacaaatattgtctgatcatggactaactaggctcaaaagattcatctcgcggtaaactgtgtaattagttatttttttatttatatttagtgcttcatgcatgtgccgcaagattcaatgtgatggggaatctgagaaattttgcaaaatattttgggaactaaacaacgct

SEQ ID NO: 29087 - DNA, 504 bp, Sorghum bicolor
  Clone ID: 8548761
ctcggaatggccatgttcagtctcgggctgttcatggcgctgcagccgcggatcatcgcgtgcgggaacaaggtggcgacgttcgccatggcggtgcgcttcctgaccggtccggccgttatggcggccgcgtccttcgccgtgggcctccgcgggacgcttctgcacgtcgccatcgtccaggcagctctgccccagggcattgtccccttcgtcttcgcaaaggagtacaacgtgcaccctgacattctcagcacggcagtcatttttggcatgctcatcgccctgccaatcacgctcgtctactacatcctgctcggcctgtgatcaccgacccgtcacctgtggatgatggcaccccccgcattgctgtaaagaccaccactgctgccatatcccgttcatggggggcagaggaggagatagagctgctacgacatcgcttggcgcttgcaaaatgagtggcgggttttttttttttctctcttctttttttttttttgg

SEQ ID NO: 29088 - DNA, 443 bp, Sorghum bicolor
  Clone ID: 8548791
tccagtttgctcgtaggaacaatgtccgactcgtcacctctggcacaggtcacgatttgcttggtagatctgacggctttggctcacttgagctttggctccgatattatcgcaataagattgtgttccagaaggtgtacaagcccaccaacggctgcactaaatcgccctggaaaggcagtgctatggtcatcgacggtgtttatcaatggcgcgatgtgtccgcagtcgccaaggctaacaacgtctttgttgctacagggggtactccttcggtcggagccattggcggctggtctcagggaggtggccacggtccagcgacgacttacgttggctggggtgttgatcaggtcctcgaagccgaggtcatgctcgctaacggacagatcgtaaccgccaactcgtgtgagaatactgatctctatcgctctctcagaaga

SEQ ID NO: 29089 - DNA, 524 bp, Sorghum bicolor
  Clone ID: 8548792
gcacgaggcacggatatcaagagatgcttcgaaactattcgatcatacggctgagcctatctcaccgccaagacggctgacaaggtctgcgctagccaaattcgcctttatctcaacagaagagtccaaacccacgatcgccgatatcgaagacagtggaggtcctgctcgcaaacgaaggcgtgccgtagtgactaagaccgaatcctcgaaatccgcccaagtcgtaaagcctgaagtggtcgacgaagccctcgatgatatcccgtcacccccagcaaaagcgcgacgggttcgtaagcccgctcgcaaagccttcgatgcaacaattggcgtaacgaagatggaccctccctcagattgggaggctgtttatgatactgtgaggaagatgcgggcaccaggtggacgagcttacggtgcagctgttgacactatgggatgcgaacgcctggcggatcgaaacgcatcaccaaaagaccagagatttcacacattggtggcgctcatgctgtcgagtcaga

SEQ ID NO: 29090 - DNA, 362 bp, Sorghum bicolor
  Clone ID: 8548801
ggcaggccgccagccgagagaccctagcgcagcatggcttggatggctgcggccaccctgtgctgccgcctcctccgccttccctccgcccgccgccctccctcgtcccggactcggtgttccgctgcgcagagccccgacgccgtggacaaggagtacgccgacctcaacctccggcctctgtaccccaacaggggccatcacatgcgcatacggcagcacgtgaacccgctcagctcatccttctcggagcccacggagccgccagagtggaaggaggtgttcgacgaccccctgctccccctcatggtcgacatcggctgcgggagtgggaggttcttgatttggcacgcgaagaattc

SEQ ID NO: 29091 - DNA, 231 bp, Sorghum bicolor
  unsure (1)..(231): unsure at all n locations
  Clone ID: 8548807
cgagagcgtagcgctggttcagtgtggctacaaagacttctttgatatccttcccggccaagccgtcatcatcgagaagggcaaggagcctgtcttcaggcaagtcgccaaacaagaagcatacaccccggatatcttcgagtacgtttacttcgcccgtccggactcagttatcgatggtatcgacgtcnacgagagtcgacgcaacatgggcttcacccttgcagagac

SEQ ID NO: 29092 - DNA, 283 bp, Sorghum bicolor
  Clone ID: 8548808
aaaggactgttaaaccatcacaaggaacaacacatactgagtatacaatcaccttggctgtcaatttcttgtttaccttcctatcttcccttggcaacagcttgaatgaatcacaaaaggttaatggtcccaatgggttatatagtaatggagccacaaatggtgccatccagcactcattggagaagcatcttaagtttgacagcaatgatttgccaatacgatcgagacaagaaatgtttttgactgatgagtacaagccagttggcaagccaattaagaa

SEQ ID NO: 29093 - DNA, 363 bp, Sorghum bicolor
  Clone ID: 8548811
ccccgctgcacgcgaccatagccgttcggctccaccgcttcgtccccgctccgccgccgccgccgcggcctgctcctcccctaccccgccgctccgaccagctagcagccccacacactaccccaagccaccgcacccagccaggccctgacatccattgcggggccggtcggccagccaaccatggagaagcgacgacgaggcggcgtgtcgtccctgatggtgctggcggcggcgttgttgacggtggccgcaatgccgccgccgccccgcgtggcggccgcgctgtcgccggactactacaaggacagctgcccggacctggagtcgatcgtgcggtacgaggtgacgaggaagaagaac

SEQ ID NO: 29094 - DNA, 223 bp, Sorghum bicolor
  Clone ID: 8548817
cgctctcaacaacgtcatgggcagcgtcttcggcacgcgatacgacgtcacatccggcgccaccgccggcgccgcggaggccgagcagctcaagagcatggtgcgcgaggggttcgagctcctctgcgccttcaactggtccgaccacctcccctgggtcgcccacctgtacgaccccagcaacgtcacccgccgctgcgccgcgctcgtcccgcgcgtccag

SEQ ID NO: 29095 - DNA, 267 bp, Sorghum bicolor
  unsure (1)..(267): unsure at all n locations
  Clone ID: 8548831
cgcccacggcgcatgcaacttcatcggtgcctacgcgctgtgccgcgtgatcaagcggcacgagctgcagggcggcgagccgccggcgggcagcagggcgaaaggcgccgccgccagcagcagcagcggcagcgcgagagggcagatgagcaaggtctccagcagctcgtccctcgtcaccagcgagcagctcagcgcgtcgttcacgccctccaactccaacagtccacctcctactctggacgtgnggatgttccagttccagag

SEQ ID NO: 29096 - DNA, 191 bp, Sorghum bicolor
  Clone ID: 9280845
gtagcggcgtctaaataagatcctgtcaactgcgtgcgtgccccgccattattcaagcatggtcgccggcctagtctccgtctccgatcctggggttgttcatctccaacgtctcgcggtttaacgattgccgtcgtcgtcgatccaatgtccccctcgggcctgatctaaaaaatgtgttttttttccgc

SEQ ID NO: 29097 - DNA, 477 bp, Sorghum bicolor
  Clone ID: 9280849
cttcatcagggttgtgggtggcgagtcgggtgccatgtcctccctggcccccaagcttggtccccttggtttgtcccccaagaaggttggtgatgatatcgccaagggatcccaggcctggaaaggcatgaaggtgaccgtcaagctctccatccagaacagagcctacactgttgaggtcgtgccctctgcctccgccctcgttatcaaggctttggctgagccccccagggcccgcaagaaggagaagaacatcaagccccacggaaacctcagcttcgatgatgtcgttaagatcgcccgccaaatgcgcgctcgctccctcgccagagacttggctggaaccgtcaaggaaattttgggcacctgcgtttccgtcggatgctcggtcaacggagcgtcgccaaaggaaatccaacagaagatcaccgatggggagctcgaggttcctgccaattaaataaatctgttctaata

SEQ ID NO: 29098 - DNA, 389 bp, Sorghum bicolor
  Clone ID: 9280868
ctgtctcatacccgatcatgtcacccgtgttgtcctggaacgatctggacaattattcatggcatactcctcctaggcgaaaccttgcgttgtatatttccttcccaatcctgacggtcatccacgcagctctggcggttctacatgccccgcctgtgttggctcgtatgggtttacacacggctgcatatacaagtcttgtggctggtcttggtgctttctttgcgggcttgggtatgtgggaagtcttgtcttgaagttgcgattggttcccgccgctttgagcatagggcgtatgtactactttgttgcgtccagcaatgtgtcacccaaacctgatgtattagtatgctcgctctagctgagctgaaattaatacgagtggcccg

SEQ ID NO: 29099 - DNA, 391 bp, Sorghum bicolor
  Clone ID: 9280871
actgtgcacaagaagggcgtcaccgccgaggttgcccgcaagcgcgcccgcaagacagtcaaggttgagcgcgccgtcgccggtgccacgctggagaagatcaaggcgctgcgctcgcagaccgccgagttccgtgccgcccagcgcgaggccgccgtccgcgaggccaaggcccgcaagcaggccgaggccaagaagaaggccgaggccaagaaggacgcccccaaggtcaagccgcagaaggcgccgatcgccgctgccaagcacgcaggaaagggtcgttagaagtactgcgacattttgagtgtggccaaacttttttatgtagatttccagctccacttgcttcgcaattgaactcgcctcgttctttttctttttttgactcgat

SEQ ID NO: 29100 - DNA, 442 bp, Sorghum bicolor
  Clone ID: 9280874
cgtctgccagggctgctcgcaggtcctttgccagccgactggtggcaaggcgaggttgaccgagggctgctctttccgaaggaagtaaacgtcttccaaatgatggcagcggaggattgacggttcacgatgatgatgataatgggatagggtgtagatctcacatggttccgatcgactcgaccgcaggatagaagagggatctcgagtcatgccaaaatcaaaacgggagttccggatatctaagcgttgatctcggctaccctttctctccatgttttctatgttcggcatgcgtttcagcttttcatgtatatgcatgtgggaggcgagatagcatttcagagctccggattaatcgtccaggagcgaggactgggttgcatatcgaggatgtccccgcctgcaacgtcctttgtaaaatcgaaccaccagttcctca

SEQ ID NO: 29101 - DNA, 464 bp, Sorghum bicolor
  Clone ID: 9280882
cgggaagggactgctggcgtcggaccaggtgctgcacacggacaccaggtccagacccaccgtcgacgcgctggcacggagtcgcgtcgcgttcgaccgagccttcgtcgacgccatcaccaggctgggccgcgtcggggtcaagacggcgacggcacggggcaacgtccgccgcgactgcgccgtgctcggctgagaatagaattattcctcgtcagaatgccgtccagcacttcagctacttcgttatactcgtcgatcggattcttcagacatggggaaaaaaaaggagaatagaaggaaatggagaattgttggaatgtatagcaggcttatgtaatgtagctagcactggaatgaaaactctgttcgtggtcaggtctacaggaaatctacagagtatagaatctcacttgtggtgcactcaagcaagcaaataaaaaaaaaacgatgttataactctc

SEQ ID NO: 29102 - DNA, 431 bp, Sorghum bicolor
  Clone ID: 9280883
tcgtcggggccccggtaccggtcgctgcgcaccacgcagagcagcgtggtgaaagaggtgaaggggggagtgtcgtggggcacgcggcagaggtacaggtacgaggccaccgacgggttcgggtgctacctgaggaacgtggccagcagaggttacagcatcgcgtcggaccaggccaatgaggtgtgcgccaagggcggtggcggggcccctgccggcggcagcgtcacggcggcgtccggagcggacgaggctgggctggtccggaactgaacgttgcccgatcctcctgcatgattttcattgaaacaaataaatagtctgcctgagctctgggtccatggagacgagttgagaaaaattggaaaatatgattgaaaacctaattgtcaatcatagcaagatataatgtgagaggagaaaacgaaatc

SEQ ID NO: 29103 - DNA, 443 bp, Sorghum bicolor
  Clone ID: 9280888
gatctagggcattgcttccgtggcgttgtcccccttaatggcgacccatggcggagcagaaggagaggatgctggagttcgctcgacgctttagatggcgcatccacaaggccagcatggaagctatcaacgccttctgcttccagattggcgtccccagaactggacgagcaacaataggcacctcgcctccacgctatgcaagaagaccaagctcacggcggagcagaaggagcggatgatggagtttctgtagcgctttgggtggtgcatccacaaggccagcacggaagctgttgacgccttatgcgtccatatctacattttgacacgcttgcgttatcgtttttttgtaacaatagaaaacacaatgtataaattatcatagtattatttgttcctgctgtaacacaaaaaaaattatacaatagagttagtgagcc

SEQ ID NO: 29104 - DNA, 467 bp, Sorghum bicolor
  Clone ID: 9280906
tggaccgcatcagggaggtgctcccgatgggtttactcaccgtggccggctcgccgaggttccgcgtctacgacctggacttcggattcggccggccggcgaaggtggacatcgtgtccgtggcgaggaccggcgcagtggcggtggcggagagccggagtggcgacggcgggatagaggtgggggtctctctgcagccggcggctatggagaggtacaggaagtgcttcgcggatgctaccctgtggctccaccagaagacatgagagcgacagctcaatctaaatatgcagaaacgggttatttatggtatcgatcgtgtgatgaaaatctccgcctcccatccaaattattcaacgtttttagctttcctactagggctttgtctagtttaccaaaaaaactacaaattttgtaagattctctatcgcatcgatcttgcagtaaattttgcctgtaaatcacga

SEQ ID NO: 29105 - DNA, 499 bp, Sorghum bicolor
  Clone ID: 9280907
gcctccgatatcgaggagcgtctcgagcttgactaccagctgggtgaggacatcaaggagaagctgatcccccgtgccgtcgactggttcactggcgaggctcttgcttatgaggagtttgatgaggacgacatggacggtcccgatttcgatgatgacgaggatgatgaggatgacatgagcgaggaccacgatgacgatgaggagtccgatgaagacgacgaatcaggaaagcctaagcaagaggctgccgagtgcaaacagagctaagcagcaaaatctggcaaggtttagaggctgggagctttcaatattttagagggaaggaaaccgagagaaaagatgctcaagtggacaaggactgagaggaatggcgtatctgagttaatgacatcgctacatgttttttgtttcattggtgatcgtctccaaaagaatgttttgtttgtctttcgcgtactaggagatttatctcgataatagtaacaggtaccggggc

SEQ ID NO: 29106 - DNA, 444 bp, Sorghum bicolor
  Clone ID: 9280909
ggcactaggtatgggcagcagggcaaaggttcatcagtcctggtcatcactctctcgagaggcaaagaatccttcaacatggagagaaggcgtcaacagtttgtggtggaaacagggagagtccttccttgttcaggagcttgacctgttggattctcgttgctggccggtccaggtgtcgtcatcaaacctgtcgtcctctgcgcactgacgctggagaagcgagctaaccgttgtattttttttccttttcatgttgataagagctttgcagtcgccttggtgcataaagtgttgttgtaggtcgtggtagatagatatctcgtttttttttccttcattttctttttttttttgcttggtaatgcctggtaggtctctccccctctgaagctttgcttcaggaagcagcttgcgaacctggtctctgtgttgcagcactgt

SEQ ID NO: 29107 - DNA, 451 bp, Sorghum bicolor
  Clone ID: 9280925
ctctatgcatgctaactgctgcattgggttgcgaagcaagattcatgatctgaggattatgatggagcattggaggagttatttgtccttgcccccaaatttgaaaagattgcagatatctgcttggcgagtgccacaaaattgcagtctttcatggtcgcaccgttaaggcaataaagcatgctagggtcaagaaaaggatgtgagatcactgatacacaaaaaaggttccatgtattttgattttgaattagtcgaaaagctgccccctagaccttttttagtgtatatagtttttccttatgccaatttcggcaggctaatttcgtttgtacctcaatatgactcatgactgcttagtgcttaacataggttgcgatgttaatcgctgacttgactgataagtttcatctgtaagacagaaacaaatgagctgcactttcttgatgct

SEQ ID NO: 29108 - DNA, 162 bp, Sorghum bicolor
  Clone ID: 9280928
tgcagataactagtcaagaagctggtggaaactaagcttgtgactctctgtttaaatgcgtttttttttttggtctaggggctttcagactaaagtatgctggataatgtgaatgaagaatgtgcagttttcagcaaagtaaccctgtcgatttttctttcc

SEQ ID NO: 29109 - DNA, 200 bp, Sorghum bicolor
  Clone ID: 9280935
tggtggcttatgtttctgcacccattttcgcttagctttcaagtactattttcagttttactactactgtagctacgtagtaaattactgatatgctgcatggtttctcccggaaattaaagtttgtatatgtatatgtgccgattagtattatattatactacccgtgcgaaataaatttgacccccatgagtattttg

SEQ ID NO: 29110 - DNA, 429 bp, Sorghum bicolor
  Clone ID: 9280945
ctacatggctggggatgaattcactctcgtggatatatactacattccgctgatccagaggcttttcgcatgtgggtacggagaggttatcaccagccgcgaagctgtgagcgcctggtgggatcgctgcacgaaacggccagccatacagaggatgctggccgctgacaaggaggctatgactgctgctaggagatagaattagaaaactggggaggttctttgatgattcaattgattggtgcgggaacctcgactattggtttcgatgaagggtcactattccgactcaaaccagcccagcacatatcttccttgatgccgcgcattccagcgccattgaaattcgcagtcatcgtcaagttccaccccggaaatgtatttaaaagaggcttgaaatatatctggaattgcgctctgtaggaatgc

SEQ ID NO: 29111 - DNA, 443 bp, Sorghum bicolor
  Clone ID: 9280948
gttgaggaaactatgggttttggccaagagtagacgataacgacattactttcagcagggacattgaactggaaagggccaaactgcactcagtcgtactgctttgtagtttccgcgagacagcgacttcgattgtctgcccccatagggagcaccctcgctaacatacacgaacttttgggtatttgcttcagtcccaagagtggacagacctgggtcgtttggcgttggtgggattaatttgccttcaacatgcgatgcaacaactgcttctccctgtcagcccagtaaatagacgatttaacagaactcgagtgttgccattatcatagacgcaccttgtgatctgtttcgtaaggaaacattggcaggcattgtggaattaccggccatacacagggatagacgagtccttggatgtgatgatacttgacagacgaaga

SEQ ID NO: 29112 - DNA, 297 bp, Sorghum bicolor
  Clone ID: 9280957
cttcaccatacaaatcgccaccacctcggcggcccaccggcggccgctgggagtcgccttgttcgtcctggcccagctggtcctgaacctgctcctgctcctgctgcattgattagggatgatgtttggttggcattggataggagtaggactggtgcactgctgcacttgagctggctgcctggctgggctggctgggctacgttccattagtttgttggttttttttttccctttgggtgagaaataattggaccggtagagagagtgttgtactggagatacatgtatacttca

SEQ ID NO: 29113 - DNA, 447 bp, Sorghum bicolor
  Clone ID: 9280968
agggaaatagaagctaacaaattcaatttgaagaattccgaaaaatccctggatgcaaatgcttcaaatgcatcagataaaagtggaagtgacctggcaaatgaggaaaagacacatgccagagatgacaacccaaagcatgaggaatccgcaaacacgggtcttttgggcagtctgaaatcttttgcttatggcatcagaaacttctggaaaaatatgtaaatctgtttttgtttttggctgcaacctaacatgcgtggagcttcccacgtcctcatggcttaattaatttccccctcgtcttctgtggcttcatcgatttctaagactggaccaaattgagaaggctacagaattgataacttggccctttgttaagcatttgcgatactggatcaacttgtaaagttctttttatgtcacagaaccaatgatcaagttcttgct

SEQ ID NO: 29114 - DNA, 171 bp, Sorghum bicolor
  Clone ID: 9280969
gtgggtgtctgtgctttgtgttttgtcctgccaagctgccattgcagcccgccctaaactagttagggggtatttactgttggcaggataatgaaaatattgagttcctccttttgtgggctgtgactgagcccccatgaatttcatgataagcattttttctttcgcccc

SEQ ID NO: 29115 - DNA, 439 bp, Sorghum bicolor
  Clone ID: 9280971
ttccgcatctgcatctgtatctccatcgcgagattgagcgctgcgtgcagagcggacagaagagctacgactttgaatattatctgctcatcacctcgcagtacacagtcactaagcccctgcctgaagaggacgaggacgagggaccgaagaagaagaaacgacgagtgtcgaatgagctaaaaataggtgcagtggagtggtatcgattcgaagaggcaacttatgcccaacacgctgctggcatgttcagctgtgagcgcaagagaccagcgagcgatgaagaagataaaatgacccttgctgcgtacaccaaagacagtcgtgtgttcatggtgctgacgcgtgagcagatcaacaagaaagtaattccgcacatgaaatctattgctgtagatcctgagcaagtaaagcccaataaagagaagaagtaatattt

SEQ ID NO: 29116 - DNA, 232 bp, Sorghum bicolor
  Clone ID: 9280991
ttcttccctatggtgctgaccctgagctgccctcgccgccgttttcctcaaggccggcacggtttgaagaacatggggggaagaactaattaaagctccttaagaacgatctttcctgtttctccgttcatctttctcgtttagtattacgtagtgttgattcgagtgttatgtttccctgtaatatcaactgaagtgcctgatttctcaagctgcgtttgagcttcttccc

SEQ ID NO: 29117 - DNA, 406 bp, Sorghum bicolor
  Clone ID: 9281026
catgaggcggctgctcggcgaagcgaccgtcgccggcgagctcaggctgtgggaccggatgctgcgggaggtcaagctcaacatctcgccgggctcgtcgtgccattgctcggagcccggctggttcagggtgtgcttcgctaacatgagcttggacacgctggatgttgcactcgcgaggatgagccgcttcatggacaggtggaacaaggaaacagctgtgtcgacgcagcagcaacagcattagacgaagtcacaaagtaaaattttgagggtaaatcacattattggacaaattaaaacacagagtagttaatcgagaggattcttttttatttttcgattgatggtaacatcgattttgtaacaataactattgcctcggaaatggagagacactgcattt

SEQ ID NO: 29118 - DNA, 354 bp, Sorghum bicolor
  Clone ID: 9281031
aacaacaagaaaatgcaagaaggtcaataaacagacgatgatcatcatgcacgtgaaggctagctttcccgcgcatgcatggaacggtaagctagtgtgggccgatctcagggagatcgagtaaaactgttaaactagtttcgttttcgttaatttccgtgttcatatgctgctggtggctgcatgcaacttgttggttttcgtcatttccgtacatttttgtggtgtttttcaaagtgtttagacactattttaaatttggctggcgatggtggtctctcccctgatggcacaagctcatcatgtggaggccgggccagagaccagaatctaagcaggatgctttggacgttt

SEQ ID NO: 29119 - DNA, 345 bp, Sorghum bicolor
  Clone ID: 9281044
ccaactttgccctcataatctcccagatcgcagcaacctatgtcatcagctcggcgctgttactccgcagcaatctaccgcccgagatgaagagcaaaataggagatgcattaggggcaccgttagaaccggggtttactgagagatggtttgagggctggttcctggctgcaagtgccgccacaactttggggatctggctaggcaaacgtctaaagggggctgagtgggacgatgacggagaagggggtgatgtagatgtagaaatggggaagcggagcacatagctatcatgtcaggtagtgtgactacgaagtcttacagttactggctgatgccatgacc

SEQ ID NO: 29120 - DNA, 392 bp, Sorghum bicolor
  Clone ID: 9281046
ctcgtcaagtccaacaagatctaatgtaatgcgacaggcagaccccttgggtgaaattgtgtattgtatattcaaaattcactttccaggaagcaacagggtggtacatgtattttaccggaataaatgccaatgtgttgtgacctgctaggcttaaaaaatagtactgttggctgatttctcgtagatcatgccattagtactcttggtttgattgataagccatagcaaaaagtaccgttggctgatttcttgtgagaaaaaaacactgctgaatgaccgacatgattcgcctgataagctcaagcgaataggctgtttgtttggtccgtgagaattataatggctgagtggactaaagcggcggattgctaatccgttgtacaattttg

SEQ ID NO: 29121 - DNA, 388 bp, Sorghum bicolor
  Clone ID: 9281050
cttttgagacaggaatgcaaagtagcctccttgctcttgctttagcaaacaaattcttcccagatccactagtgggtgtgcctccagccatatcggttgtgttgatgtccttaatgggatttgctcttgtcatggtgtggtccaagaaaacagaagcctaataacccagttcaaatcgaagcaactctctttgtttctgacatcgccataacccgtgttgaaatttagtcagcctaactgatccccatggatagcaatttaggaaggttgatcattggtcaggattgctgcaaaatgatcatcgtggcatacaatctgtctctcactatttatatctggtcttggttctgtcgaactaagatttctagtggcctgaaatttcttttga

SEQ ID NO: 29122 - DNA, 390 bp, Sorghum bicolor
  Clone ID: 9281053
ccatggcgctccctctgacgagactcgtcacgttggagacctcggaaacctggagactgatggccagggaaatgctaagggctctgtcaccgactcccttgtcaagctgattggtccccacagcatcatcggccgaaccgtcgttatccacgccggcaccgacgacctcggcaagggcgataacgaggagtccctcaagactggtaacgctggtccccgacctgcttgtggtgtcatcggaatctccaactaaggaaaccaataacataaaacttttattgcttggatcaagaagccgtcaggtaatgaacagtatggcgtggcacccactccgcctccatacaatgagacacaaacgaaaatagttaaatacaatcaagccaagcctta

SEQ ID NO: 29123 - DNA, 433 bp, Sorghum bicolor
  Clone ID: 9281056
ctcttgtcacaatacagtgcccaaatcctgacttcaacaaagagcaaaataggtggagaatggtgcgaagaatgctcgttgaagctgtcgtcgacctccttcataccaatggacaggtttatctgcagtcagacgtggagtccgttctgctcgtgatgaaagagcagttcctctcctacagcaagggtcagcttgtcatagacggggttagtggccaccagatcgataacccgttcggcgtggtatccgattgggagcgccacgtcctcgctcgcggagctcccatgtacaggacgatgctaaagaaagtgtgattgcattgcccgtctgagaaatttgaacattgcattgttttgtcaccatggctgcttcggacatggccaacgttcacggatccactcggttagataaaagtatcttttttttgttgttg

SEQ ID NO: 29124 - DNA, 249 bp, Sorghum bicolor
  Clone ID: 9281075
agagaaggccaaggttgcctatgagaggaggaagcaactggctaagctgcgcgtcaaggctgagaagacagccgaggagaagctgggatctcaactggagattcttgccccgatcaagtattgagaagctgtgcttttgtgcggtatcagttttgtggaacatttggcccttgtttaaagtagttttgtaatagtttgtgacagcttcagtggtaaactgttatccttctgtgccttttggttaatcag

SEQ ID NO: 29125 - DNA, 197 bp, Sorghum bicolor
  Clone ID: 9281076
atgacatacttttgaacttgttccccagcctctgttggcttgcagtgtttgcttggttggtcccagtgattttgagcccttggtgttcagtcccttaggttagggtatgtggtttgtgggccccgggcggtagtactgttaaacctttgaactttgtaatttcgttatgttggtaatgaaatttggttctcctgccc

SEQ ID NO: 29126 - DNA, 469 bp, Sorghum bicolor
  Clone ID: 9281078
tggggcccgctctcctttctcatcggctggctcgtcatcaaggacagccccctccgctatccgttgcaactcatcgtcagcctcggccagttctacggcgacgttctctactacgggaccttcttctttgatgaggccgtccatggggctgtctactgccgccccgagcccttctatttctgggcctactttgtcatgatgaacgggttctggatcgtcatccctgggtggctcatcatccagagcgttatcgagtgcaccaaggcgttgcgtgtcgcgcaggaggttgcgaagcgggaatccccaaagtcgcaatgagtgtcatcagttctcgcagggggctaacggccaccagcatcaggtggccagatattaattaggattttcgcggcacctgtcactagataataatgataattcaatctaatcgtccaggtcatggtcacactgtattgaatctggaccactc

SEQ ID NO: 29127 - DNA, 482 bp, Sorghum bicolor
  Clone ID: 9281085
gctagccactatcgcggctcgaaagggtgcatttgcactcatctatccaggtgctttcaacactacaactggccctctgcattggcagttgctaggacgagctcgcgctgcagacaaccagctctacgtagctttgtgcagtcctgctcgcgccgaaacaggttaccctgcttatggtcacagtcttgtcgcggaccctatggcgcaagtgcaggttgaggcagatgaaaaggagacgaccgttgactgggaacttgaccctgataagatcacagaagcgaggaagaacattccgcttaacacccagcgaagatttgacgtatacccagatgtgagcgagggtaagattcagtttgaagagccttaaggctgaataaagcgtcccaagccaaaattcgttccccaaaaagcatgtataagcaagtttaaatcaccaaatatgagcagaagatatctcaaaatatagagaccaaaaatcctct

SEQ ID NO: 29128 - DNA, 366 bp, Sorghum bicolor
  Clone ID: 9281100
aggcctcagctcggcgacggccaagtgtcggacgttctggaccagaggctgggaggagactacgacgccgctgaggcggccgccgtggcggagatcgccatgcagtgcgtcagtgacacccccgggctccggccatccatggccgacgtcgtgcgcgtgctccaggagaagacctccgccgttggatcgagactggaccgcaagatgttggtgtcctaaattagacgcatgccgcagattgtaaatatatccttgttggtgctagaattatgttgaggatagttagcagaagaattggcgcagtgagatgaggtaggaaaaaaaatgaagctttgagatcactagatcctgatagaaaattttgtc

SEQ ID NO: 29129 - DNA, 434 bp, Sorghum bicolor
  Clone ID: 9281111
ctggcgcggtcgggggtgcgcgtcaacgccatctcgccgcacgccatcgccacgccgctgctggtccgcggcctcgccaggctgcacccgggcgtccccgacgagcagctgaagcgaatggtggagactggcatgagcgagctccgtggcgcggtgctgcaggtggaggacgtggcgagggcggccgtctaccttgcctccgacgaggccaagttcgtcaccgggcataacctcgtcgttgacggtgggttcacggccagcaagcggatcggcacgccggcggcaagctgaccattctcctggccctgggaataataataagtcaatgtacttccttgatcgtgaatcgtgaccgaaccaacacgaaacctatcattctactattgaatgaagacaggatgcacctgtgattggtatatagagacattcgactt

SEQ ID NO: 29130 - DNA, 414 bp, Sorghum bicolor
  Clone ID: 9296080
gcacgagggttcatcattcatcagtgtcatcaccttagaaggtgcatgcaaggagacaggccacaataatgtctcagaggaaaggggcctccatggctgctgcagtgacgagcagcaagcaccatgaggatcaggagatgatgatggagctcaggagaggcccctggacgcttgaggaagacaacctcctcatgaactacattgcttgccacggcgagggccgctggaatctcctcgcccgttgctccgggttgaagaggaccggcaagagctgccggctgaggtggctcaactacctcaagcctgacatcaagcgcggcaacctcacgccggaggagcagctcctcatcctcgagctccattccaagtggggaaacaggtggtcgaggatcgcgcagcacctgccagggcgga

SEQ ID NO: 29131 - DNA, 410 bp, Sorghum bicolor
  Clone ID: 9296091
gcacgagggatcattaggcattagcgggtcgacgggcaccgagtaccgacacggtggtctgccagccacttccaggcgccagccagcagcctgcagagcagagatggcgtcgccggcactgaggctgaggctgaggctgctgctgctgctcgcggtggcggccacagcgaccgcccgtggcgccggcgccggccgcgtcgatctttggccaatgccggcgtcggtggcccgcggcgcgcagacgctcctcgtcagcaaggacctcaagctgtccacggccgggagcagctacgccgacgggaatggcatcctgaaggaggctttccagcggatgctggccgtcgtggagctggaccacgccatcaacgggacctactcctcccacggcgcgcccgtgctcgccggcgtcc

SEQ ID NO: 29132 - DNA, 463 bp, Sorghum bicolor
  Clone ID: 9296098
gtagccttctccttttgcagggctcctgctggccgggcttcccagtctctccattgctatccgtgcgtgtacctgcgccgtgtgtggtgcgcgtgcaagaccggccagacgcagcttgacgacgatggggcgcggcaagatagtgatccgccggatcgacaactccacgagccggcaggtgacgttctccaaacggcggaacgggatcttcaagaaggcaagggagctcggcatcctctgtgatgcggaggtcggactggtcatcttctccagcaccggtcggctctacgaatacgccagcacaagcatgaagtcagtgattgatcgatatggtcgagcgaaggaggagcagcagcttgtagcaaaccccaacacagaacttaagttctggcaaagggaggcaacaagcttgagacaacaactgcacaacttgcaagaaaatcatcggcagttgatgggacaa

SEQ ID NO: 29133 - DNA, 468 bp, Sorghum bicolor
  Clone ID: 9296117
tcgtgtcccgacacttttgcttccgggagcaggaaacgtcgcggggggcccccgtcttggatatttcatcagttttcgggttcttggattggatcttccgaattcttggttctggagaggagaggataggagaggagaggagaaagcggggcgctcaatttcccctactgatccttgttgcttgatcgccgccatgagtaacacgctgctccgggtctgtccttccgacttgaagatgccattcgagctcaagaagcacaactcagcatgtcttgagctcatcaacaagaccgatcagtgggtggctttcaaggtcaagacgacgaacccaaggaagtacgcggtgcggcctgcctccggtgtcgtgccgcccaggggatcctgcggcatcacaattacgatgcaagcgcccaaggagatccccccggactactactgcaaggacaagtttcttgttcagagcattgc

SEQ ID NO: 29134 - DNA, 443 bp, Sorghum bicolor
  unsure (1)..(443): unsure at all n locations
  Clone ID: 9296134
gccaacagctcattcctctcaccaccaccaccaccctgctcgttaatcaccccactaaccaagcaatcaattccctccttcccagccacaaaaccgatcggaaacgcaaacgcacgcgagacgagagcgcagcctgcctgccccctttcccccttcgtctcgtagtccagatcccagtcgctgttcgctcgctctatgagctagggaatccgatcgaggtgtcctctaggcgaagcgaagttggccggcggcggcggcggccaggatggggctgatatccgggatggtgatggggatggtggtcggcgtcnccatcatggccggctggagccgcgtcatgcgccgacgcagcacgaagcgcgtcgccaaggctgcggatatcaaggtgctcgggtctctcaccagggacgacctcaggaagctgtgcggggataacttcccgg

SEQ ID NO: 29135 - DNA, 184 bp, Sorghum bicolor
  Clone ID: 9296149
aacgcctgcgcgaggaagcggtggcccccgtcgcgcgccagttcgcgaggacgctgcggggcgtggcgggtccgagctccggcgtggctgacgcggagcttccggaagcctcgctgcaagcgcaggagccgtcgacgccgctgcaggccctggccagcgagaaaggcgaggagcgccagagggc

SEQ ID NO: 29136 - DNA, 320 bp, Sorghum bicolor
  Clone ID: 9296155
gcggcggtagcgtcgtccacaacagctgcggcggcgccatgggcggatgcggcgacgacgtcgccgagtacgggcgcccgacgtcgtcgtcgtcgtggcggacggacgagctcgtgttccaggcgtcggcgaggaagctcggtgatcatcagcatcaatggggaggaggaatctagaagcaatcgatcgaatcgagagaggttgctagctagctcactaaagcctagctagctataggctatagctagaaggatgaagatgatgatgatgatgatgggcgcgcacagcaggttgcttcttgcgacgtctctctcccaaaa

SEQ ID NO: 29137 - DNA, 424 bp, Sorghum bicolor
  Clone ID: 9296190
tgattcagatgtggaccatgaagtggggagaccatcgacgtccaactctgcaacaggacaagggcatacattaagatcacgagcttcagatgatgaggatgactctacatccaagttagaactggaaagtagatatgcagaggaaaacaagaagatgcagaaagagctggcaggaccttttaaggatgactctgtatccaagttagaattggaaagtagatatgcagaggaaaacaagaagattcagaaagagctggatctcctccggaaaacaaaggcatctgctggcggcttctcagcgacgtttgtgctgcttgtcttcttgttaggttcacttctgggatacctgatgttcggaagcaaagcttagcaagttagcagctaatggcagcacatcattttgcggcaccggcacaactctacc

SEQ ID NO: 29138 - DNA, 506 bp, Sorghum bicolor
  Clone ID: 9296202
aattcgccaggaaaatgccgaattatacaaggtatttgataaagacatacaatttttcaggatatacgtcctatcacatgatttgtttctatgcccagctctatgagaaagaagcagcaggtgaagtcaaccgagattcaacaactccatacaactttgcagttgcagagaatgccaacattcctatccatcttgagcttaatactacaccgcaagaacatgatgttgagccacctgcggctcctaaattagggttgcaactaaatccatgaagacatgcagtatgacattgcttttgttctcattgtccttgaagactggaacttgaagcagccagaaatgattgcttgtaacggggctaaacacatagcaagacaaataaagtatacatgccacagactattggcaatggtagtataaatctatctcaaataacatgcattgtattgaaacttgaaagtttatccagcaaatggtggtataaatctatctcaaacaaatatatg

SEQ ID NO: 29139 - DNA, 479 bp, Sorghum bicolor
  Clone ID: 9296227
gcacgaggggcacacccctgctgctacccctaggaaaacgacgagacggatacgagtgggggacggaggagtgatgatagctaacgcaactataccagccagctgacctgaccgcccccccccccccccccagcaagcggcagcccctgcgtcctgcgacacaggagagcgggagcagccgcgccggccttcttgtgagtgagccgtcgctctcacgaacggcgtcgggtcctcgtcgccgcggcagggcgctagggcaggcatgcgctgatggaattcaggggccaggaggaggaggagcaggagcaggaggaggaggagcccgtctcggaggagatgggcgccagctccgcgccgccgcccgccctcgcccccgcccccgcctccgcctctgcctccgcctcggggcaccagaaccacgccgccgaggcgaggtaccacgagtgcctgcgcaaccacgcggcggcgctgggcggcca

SEQ ID NO: 29140 - DNA, 490 bp, Sorghum bicolor
  Clone ID: 9296228
tgctacgccggcgctcatcgcctcacgcaggaagctcgcggtggcagcagtgatggaatcccacaacggcggcggcgggaaggcgcgggacatgttctcggtgtaccagaacccgtccctcacccgggccctagactcccgcagcgcccgcccctccgtcacagtcctcgtcgtcctcgcgatcttacccatcgcttccgcctcctccctccttgccctctcctcccgggagcagcagctcagcaagctcgccggccgagcgggtatctctgtccttgctgctgtttttgtctttaggttggtggaggcagcacttggtcttgttgcacttttcacactgctggggttcttcagggcactgatgttatacaatggaaagaaggcactggccaaggatgacaaggttgtgttgtctgaacgccagctggggcttcttgggttaaagatggcgggttcagaaggaggtgggaaaggtgagcagaccaaaagg

SEQ ID NO: 29141 - DNA, 505 bp, Sorghum bicolor
  Clone ID: 9296230
gcacgaggactcgcagtcacctctgcctgcacggctaactccgccggtggctgctccctctcaacgccaaaccccgctgcctgctgctccctcccagcggtcgactccgccgctggtttctccccctccgcgggcaacatcaccgccggttggttccactgcacggcaaactcagcggccggttgccctccaaatacggtcaacaccgccgccggctgcctctgctccacggtctactccaccaccaccggttcctcctcaaacacggtcaacaccgccgccggttgctcccgctccacggcctactccgccaccacctgttgttccccaaacacggtcaagtacgccgcagccgactactccccaaacgcctgtggctgcaactgtcccagcagtgaagtctggtgcggcaccttcatcaacattctggacagtgtgctcggcctgctgccacattcaccagttcgacggccaatatgagatgcgcaagttgctgtgccctagc

SEQ ID NO: 29142 - DNA, 531 bp, Sorghum bicolor
  Clone ID: 9296236
gcacgaggctgacagcaagattgccgacaccgaggttggtgttctgtccaactacaaccctggccaaaccggcaccaacggtactcttatcatcgacaacgtcgacatgacctccgtccccgtcgctgtcaagaatggcggtactgatgccaccatccttcccggtaacgccaagatcgaatccttcgtccaaggacgtgcctatactggtggcaacggcaaggctattcaagccacacagactcccgttgagaagcccaaggctattctcgatagcaatggcaacgtcgttaccaagagcaagccccagtacgagggtgtccctgcttccaactttgtctccgtcaagtccaagggtgccaaaggtgatggcaagactgacgataccgctgctatccaggctgtctttgacggtattcaggaaggacaaattgtttacttcgaccatggcgcttacatcttcaccgacactgtcaaggtccccaagaacatcaagatcgtcggcgagatctggcccctcatcatggctgg

SEQ ID NO: 29143 - DNA, 579 bp, Sorghum bicolor
  Clone ID: 9296238
tcaagtctgccgtcgagcgcgctggtctccagcctaccgatgtcgaggaagtctttgttggcaacgtcctctccgcaaacctcggccagaaccccgcccgccagtgtgccattggtgctggcctccccgaatcgacggtagccaccaccatcaacaaggtgtgcgcctcctccatcaagtcaatcattgtcggtgcccagacaatcataactggcaatgcccaaatcgtcgttgctgccggagccgagagcatgtccaacacgccccactacctccccaacatgcgtaacggcgcaaagttcggagaccagtcgctggtcgacggtcttctcaaggacggtctgaccgacgcatacaagaaggagcacatgggactgcagggagaggagtgtgccagtgaccacggcttctcccgcgaggatcaggacgaatactgcatccgctcgtacaagaaggccaacgctgcccaggaggctggctggtttaaggaggagattgcgcccattgaggtcccccagggacgcggcaagcctccggttgtagttgacgctgatgacgagcccaagaacttcaacgagt

SEQ ID NO: 29144 - DNA, 335 bp, Sorghum bicolor
  Clone ID: 9296242
ctggtgcagttcctgggcgccgtggcggagctggcgcgtggcgcggcggcgccgacggtccggccggtctggtgccgagagctgctggaggcgcgcgacccgccgcggccggcgttcgcgcaccgcgagtacgacgaggtgccggacaccaagggcaccctcatcccgctggacgacatggtgcaccggtccttcttcttcgggcgccaggagcttgccgccatccgcgccaacctcccgccggcgctccgcgcgcgcgcctccacgttcgacctcctgacggggctcctgtggaagtgccgcacggcggcgctggcgccggacgccgacgaggg

SEQ ID NO: 29145 - DNA, 410 bp, Sorghum bicolor
  Clone ID: 9296243
gacgaggattcagagagctgtggcagcatggaagattgttctgaacggaaggttccgtttgcttgatcgatggtgtaacttcgttgagaagtaccaacgccacaacatatccgaggatacttggcagcagctgctagctttcagcagatgtgtaaatgaagatctggaaggttatgacccacgaggtgcttggcctgttctgattgatgattttgtggagcaaatgcacagaatttatcactctactgactgcagcagtgcgatggaagcacagtgtagcatttcaagtacatttaaaggactggatcctctacctggatcaaagaggaaatgtcctcacttcaagtccaatgaagaggatgtagaactctcggatagttttacacgctccgtccatcttacaccaataa

SEQ ID NO: 29146 - DNA, 449 bp, Sorghum bicolor
  unsure (1)..(449): unsure at all n locations
  Clone ID: 9296244
gcacgaggctcttcttccctcagattaacaccactaactgcagtgacatcattaagctggtcaatgctttgttcatggaaacctccagataccttctgctttttgctagatggtggaggggatgagcctaatgcttccaaaggcttcttctgtccagaagttgccttcctctggggtgttttagaagctgctgcaggaggtgcttgcacagaagattggatctgaattttagcctcttcttgaatgccatgagattgagtctgacttaagcttgttgtggttaaaggcttangcgcactcaattgtggtgactggctttccgtgccagcaccgacttttgaagatcccagggcttgattgacttgttttgcatgcattgcagcaaaagaattctgtgaagattcagagttttggctaacagtttccttattcatatgtactgatggagc

SEQ ID NO: 29147 - DNA, 497 bp, Sorghum bicolor
  Clone ID: 9296253
gcacgaggcacacaaaggcgcctgccaacacaaccacggccagcaacctaccaaccacccgttagccgttaccttcatcaccaacttgccacacgattgccccaaccgctacaaccaccacataaccacataccacacatcgagaaatatggctcgtaacaccaacgtcttggtcttcgctttcgtcgccttcttggccctctgggttgtcgcctgccaagccaacctgaccaccaacccaaccgtggaggccgcttccttgcccaagcactcgctcatgagcgacgacgccaccgacaacgacgaatccaccgcggtgccgctcgacgacatcaccaactcgacttcctcccggtcgtgctcgcgcaccaaatgggagggcttcacggcgggcctcctctgccaggacggcgtcaacggccgctgcgtctatcgcgtgcccattagccgtgccctgagccaaggggccaacacgttttacgttgctttcgccaacg

SEQ ID NO: 29148 - DNA, 503 bp, Sorghum bicolor
  Clone ID: 9296264
gcacgaggccgagccggccggtagctccactcaacactcacaactaaccagtagctagctaggccatggctgctccctgcagctgccatggctgctggctgctcctcctgctgctgctgctgcttgctgctgcgggtgctcttggtgcagagggcgcctcccttgtgatcgtgcagctggacgcggagtccctgctcccttccgcagcagccgcgtcttgccacacgccagagcaaagacctgaggccgggacggccacgaggatgcccatcgtgcaccagcacggcccgtgctcgccgctggccgacgacaagcacgggaagaaggcgccgtcccacacggagatcctcgtcgcggaccagcgccgcgtcgagtacatccaccgccgcgtgtccgagaccaccgggcgggtgagacggcagaagcacagcgccccagtcgtggagctccggcccggcacgccgtcgtcgacccgctcttcgtcgtcgtcgctgtcgtcctcg

SEQ ID NO: 29149 - DNA, 489 bp, Sorghum bicolor
  Clone ID: 9296272
gcacgaggctccgtccggtcgtccctggccgccgggtttcttctccgtcgccggctatgcgcgtgaggagggaggaggagccgcagcgcgtggatccaggggcagcagcgtccatcccgcgtgagaagggagaaggagccgtcttagagcaagcctctcaacatgtcgtgggccgcagtcgagaatgatcctggtgtttttacagaaatgttgcagcagatgcaactgaagggtcttcaagttgatgaactctactcacttgacctggatgctctcaatgatcttcagccaatatatgggctaatagtactatacaaatggcgaccttcagaaaaggatgagcgtcctgtcatcaaggatgcaatccaaaaccttttctttgccaaccagataattaacaatgcatgtgcaacccaagctatcctttcggttctcttgaactctcctggcatcacccttagtgatgaacttaaaaagctgaaggaattt

SEQ ID NO: 29150 - DNA, 444 bp, Sorghum bicolor
  unsure (1)..(444): unsure at all n locations
  Clone ID: 9296275
gcacgaggggccactccgtgtgggcagcggcggcggcggcggcggcggtgatgcatgcgaggcgagcgctctggggctatccctcagaatctgccatcctgctgcttgttcccactcgcggcggccggtgatcacaccactgaaaccaacagcccttggaacaaaagcggcgatgaggaagggcgccgcggttggcgctggcccggctctcgaccggcaaccgtccttggatccgcgtctccccggggccaccccgctccccgccccgccgcgccgagtcggattggggacccttgcgcgggtgacggtgctgcggcggcgggggctggggttggggaccgtgggggntggggtccgcggcggttctagtcngggccgtggtcggccggcgcgggatctgagccgccattgatggacctttttcgagcctttgcttgcggatgc

SEQ ID NO: 29151 - DNA, 553 bp, Sorghum bicolor
  Clone ID: 9296278
gcacgagggcttaattagcttggtgtaggcgggtagtacgtacgtaggagtacgtgctttgcttgcaagatgaagaggcagtggagccacccgtcggtcgtgctcccgctgctcgtcgtcgtcttcctgctcctcacgttccggtgctccctgcgccagcacgcgcagcaggctttttctagccgccgcggcgccgccgccgacgacgacgcgggaagatacgccgtcgacgccaaactcgcggagctcgcggccgtggacccggccgcgtcggcggtgctacgggccgccgagacgctgctggagaggaacctgacgtgggcgagggctcccccggagcgccgggacgccgcggtgcgcggcctccgcgactggctcggcaggcagcggttcgagccccaggtgatggcccagctcctggacctcatcaagcgccccatcgaccggtacgcgtacgccggggagacgggcggcgacgacgtgccggtgcggccgtacgcgtcgtgcgccgtggtgggcaacagcggcatcctgctggcgcgggagcacggcg

SEQ ID NO: 29152 - DNA, 532 bp, Sorghum bicolor
  Clone ID: 9296298
gtgacgctgaggcctcgttccccaataagacttgctcggcctcttcgacgtcgacggcgtgtccgtctccccgagctcattcgtcatgccttcctcattccccgcgagaggaggacgagggctcctcctgccggcggcggttgtggtgctagtactattggatgcagtggcgccagcggcgggttgctatccgcgcgtgttcagcttcggggactcgctggcggacaccggcaactgcctcttcgtctacggcaacaactctggccaggccgggctccggccaccctacggcgagaccttcttccaccgcgccaccgggcgcgcctccaatggacgcctcgtcgtcgacttcatcgcggacgcgctgggcctcccgttcgtgcggccgtatctgagcggagggagcgcggaggacttcgcgtgcggggccaacttcgccgtgggcggcgccacggcgctcagcccggaagaaatccgcgcaaggggtttcgacaacatgggcaatcaagtggggctcgacatggagatggag

SEQ ID NO: 29153 - DNA, 546 bp, Sorghum bicolor
  unsure (1)..(546): unsure at all n locations
  Clone ID: 9296305
gctggcggatgcagaagcaggacgacgcgctggtgcagcacttctgcgaccaggtcggcgtccggcgccaggtcttcaaggtctggatgcacaacaacaagcacaccggcagcggcggcaggaggcagctgccgcagccgcaggagcagcaacagccccaacagcaaccgccgcagacgcagacgcaggcgcaccagcagcagccgcagcaggagcagtagccatggtgggagacaaggctcagcagtcagcaccaccaccaccatttgcttaatcccccgcctcatttttttatgggctccgagagggggtgtgggattaaacaagggaagtcaggagagctcctatcctttcttcccttccgtttttggtttctttcaccttatccttcattttttgtagtcacttctttcaccatcatcctcttttgcttcaacattcttgcttgcatatctttgatttcttctgttcttagtttggggtatcaattggaaggaggaggaggcactgtgcatgntttgtagctacatccctactaccttaacc

SEQ ID NO: 29154 - DNA, 658 bp, Sorghum bicolor
  unsure (1)..(658): unsure at all n locations
  Clone ID: 9296306
accttcttctgtatctgtttgctgctttccttgaacatccaaaatggatgcttcatgttgaccctacctcgtactctggtgcccagtccagcaaaaatcccttatttctgggagttcttccaccaaaagagaggtttccagaaaagtatgttgctctgatatcaggtgttccggcaattatccacccaggggcccttatactggctgtgagcaagcagaatcctccaatttttgctctatactgggacaagaagcagcaattttctcttcagggaagaacagctctgtgggatgccattctacttttatgccatcaaataaatgttgggtatggtggtgtggttagaggaatccatattggctcgtccgccttgaacctccagtcagttatagattcagattcggaaagctgaaagttggtttgctagtcttgaggggataaactgtgacccgctagtttactggtgttaatgttgtaattaacactagcatgtttgggattgacatagctttatttagctgtaatatggcctgatggtggggggcatcttaatgttatgcccaagttgtaccttagatttgtaacaatatgagatttgcttaaccccattatctgctttagatcctttattaatgtaccgatacattttgtattttn

SEQ ID NO: 29155 - DNA, 677 bp, Sorghum bicolor
  Clone ID: 9296314
gtggtgttttgattgagagcaccaagggtgcctggctgtggggtactgcttccgagcacagtgtcctgtacaactaccacctccaggacgcttccaacgtctacatgtctctcatccagaccgagactgcctacatgcagggcaaccctgacgcgactgtccccttcaccgtcaacgagaagtatcacgaccccgacttcaaggctacctgcactggcgactcgaagcgatgtgcccgtacctggggtgtccgcgctgtcaactccaaggatgtcttcatctatggtggcggtctttacagcttcttcgacaactacgaccaggtctgtgttggcgagaacaactgccaagacaacatgatcagcatcgagagctccaagctgcacctttacggtatcagcaccaaggccagtgtcaacatggtcaatgttgacggcaagtctgctgtcctggacaaggacaaccgcaacaacttctgcgcggccattgcccgcttctcttaggacgatgaggaggcgccgccttatgcgtaaattgcgaaatacccgagcattgtctgctcactgattcctgtgaatccttttgagtttgttctttttcatttttagggtatagggttttgttccaggttggaactggagtttcggatagttcaactccaagattggactagatgc

SEQ ID NO: 29156 - DNA, 647 bp, Sorghum bicolor
  unsure (1)..(647): unsure at all n locations
  Clone ID: 9296316
gtttaaggaggagattgcgcccattgaggtcccccagggacgcggcaagcctccggttgtagttgacgctgatgacgagcccaagaacttcaacgagtccaagacccgcacactgaggcccgtgttcaagcccaaggatggcacagtcaccgctgccaatgcctcgccgctgtcggatggtgctgctgcccttgtcctcgcttctgaagaagctgtcaagaagcacggtctcaagcccattgctaagattctcggctggggtgatgctgagcagaacccctccaagttcaccacggccccggcactcgccatgccaaaggcactgaagcatgccaatgtggagctctctgctgtcgatgcgtttgagatcaacgaggcgttcagcgtcgtcgctctcgccaacatgaagatccttggcatctccgaagacaaggtcaacctccacggcggtgctgttgcgctcggccacgcactgggagcctcgggcgcaagaatcacaactacgctgcttggtgtgctaaaggagaagaagggcaagattggctgcgccggcatctgcaacggaggtggcggtgcttctgccattgttgtcgagtcgctgcagtagatgatggctgccctgacagtaatgatacaatatacatnat

SEQ ID NO: 29157 - DNA, 647 bp, Sorghum bicolor
  Clone ID: 9296334
aaaaaagaatgtgattctatctctgtttgctgcttattgcttaactaggatgcgttgtaccttagggtgtctctagcagtcacccaaaataataataataataataatcctaaaaatcttgtttcgtaacctttccggtagaatcaccgccccatgatagggagtagcggtcatctgtgtatctgcttgttctttttgtgctcttttgcatgtcctgttgatgctctaccgtgatgaaagggtattcttcttcacttgccttcctgctggattgatcctgtgacctcggtcaatgtttgtgggactaatatgtaaatgcccttcaagaacggaaggcataaattccaatgtggggcaatgatcaacgaccatggctgacataagcgcctttgagcaaccaaggctgctatgggacagctccacttatcgtatcaggacaagttgatctggtgataagagatgatggggatacggttaaatgactgagcaaaggcgaagctgatcccccctctcagaaaagggaagaaaacatgattttgtttttttggttgttgttgttgttgttgaatatgttgtcgcttcgaatttttttgtgtaacctacatatttgggatattttattacatttgcaaaggcgaagctgatcc

SEQ ID NO: 29158 - DNA, 578 bp, Sorghum bicolor
  unsure (1)..(578): unsure at all n locations
  Clone ID: 9296338
catgtgcaacgcggcgcacttcgcggagcacgcggtgtgcaacgccgacgacggcggtgccgcggcgccggtgatcgtgacggacccgcggctggacgcgctgtgcgcgcggatcgtcaagtactactcgctgcggcggttcgtgcgcgagacggggcggcccgccgaggagtggggcacgcggcacgaggagggcatgttccactactcgtcggggatgcaggccgtggtggccgcggcgggcgtgtgcgggcgggtgtccgtgttcgggttcggcaaggagcccggcgcgcggcaccactaccacacgctgcagcgcggggagctggacctgcacgactacgaggccgagtacgagttctaccgggacctcgaggagcggccggagaccatacccttcctgcgggactccggcttcaggctgccgccggtcgtggtctaccgctgaccgaccatcgattcagatcaacggccgtgtcagtcagtgccaacgtacatagtccattggtttgacacaaattttgctactcaatcaatcaaaacgcgttgtacaaaagcgcaagatggaacccaatntg

SEQ ID NO: 29159 - DNA, 661 bp, Sorghum bicolor
  Clone ID: 9296356
atcaaagtctttgggttccggggggagtatggtcgcaaggctgaaacttaaaggaattgacgggttcagctggagcgctgacaggcaatgattcatacacgtaccattggtctcagcagaaaccccataccgtacccggaggctctgtaaagatcattgaccctacgactttcccgattgcgaaaggcttctcggccgctcttgttgttgttcagcctggtgcactccgcgagatccattggcatactacctctgatgagtggagctacttcctccaaggcagcggtagaatcaccgttttcaaagcagcctcgtcggctcgcactttcgatttcactgccggcggcgtcggatacatccctgcagcaaactctcactatgtcgagaataccggaacagaggacttgatcttccttgaggtacttcaggctcccaagttttcagatgtttcggtggcacaatggttggctttgacacccaaacagattgtcaaggaccacctgaaggtttcagataagtttttggactcgttgcctaaggagaagcagttcatcaagacgggagacgtgaacatgacggccattgcagacgaagcttagtgtccatcaattagagctgaggctgcgggtatctggctcaaattacatacaagcttctcaga

SEQ ID NO: 29160 - DNA, 599 bp, Sorghum bicolor
  unsure (1)..(599): unsure at all n locations
  Clone ID: 9296361
ctgctgtccatcccggccaccgttttctccgacgccggcgcgctggtggactccggcacggtgatcacgcggctgccgccgtcggcgtacgagccgctgcggtcggcgttcgccaagggcatggagggcctggggtacaagacggcgccggcgttctcgatcctggacacctgctacgacctgacggggtaccaggggagcatcgcgctgcccgcggtgtcgctggtgttccagggcggcgcgtgcctggacgtggacgcgtcggggatcctgtacgtggcggacgtgtcgcaggcgtgcctggcgttcgcggccaacgacgacgacaccgacatgaccatcgtcgggaacacgcagcagaagacgtacagcgtgctctacgacctcggcaagaaggtcgtcggcttcgccccgggagcttgctgatccggccggcatccggccataatacatgaataacccctgatcacctgcatccaccaaagtggtcagcagtgatcagtggtacagaaatacagattgaagattataatgtcctccagaaatacagattgaagattacaatgtcctcatcgtcactgtaagatggtacgntttgt

SEQ ID NO: 29161 - DNA, 609 bp, Sorghum bicolor
  Clone ID: 9296367
actttggtcttatgggtgatggccagcctatcggtcgctacgatgatatgtgggcaggatggtgcacaaaggtgattacggatcatctgggcctgggtgtgaagactggcctaccctacatctggcacagcaaagcaagcaacccgtttgtgaacctgaagaaggaatacaacggcatcttctggcaagaagagctgatcccattcttccagtcagtctcccttccaaaggaggccaccaccgtccaaaagtgctacctcgagttggccaagcaggtgagggcaaagctcggcaaggtggatggctacttcaacaagcttgccgactccatggtcacgtggattgaggcctgggacgagctgaaccccccaaaaggtggagcccccacagcaaatggccctcccaagaagtaaaagacgatatagtataaacttcacttgttcatgtggaccgtcatactgaaaggaaatactgtttttggttagtgctgatggactgagatcactctgctgcaactcaaaattttcacgtcccgggaaccgtcctgccggttatgaggcgtttacagtctttcgcttctgagtgtgatgcaatcggattggattacct

SEQ ID NO: 29162 - DNA, 624 bp, Sorghum bicolor
  unsure (1)..(624): unsure at all n locations
  Clone ID: 9296374
tcgcaccatgactccgagtgttgttgcgaaaatttcttctacgatcagcgaattgattcagctaggagccaagactcttatggttccaggaaacctccctattggatgtgtcccagactatctgatgatattcaagagtgataaggaagaggattatgaaccacagacaggttgtcttaggtggatgaacgagttctcacagtaccacaacaagcttctcgtggaggagcttaagaagcttcgcaagctccatcctggagtaaccatcatctatgcggattactatggagctgctatggagattttcctttcccctgaacaatatgggatcgaacatcccctagtggcttgctgtggtggagaaggaccctatggtgtgtccccaactataacatgtggattcggagaatataaactgtgcgataacccagaaaagtatggatcatgggatggcttccatccatcagaatctgcatacagggccattgctacgggcctgctactaggttcctacacaaggccgtcaattgcttccaccaccacttcatgtccacagcttatggagctcggctcttctgctgaatacaaacccctctacgacctgtaatcatttgtatnccatga

SEQ ID NO: 29163 - DNA, 407 bp, Sorghum bicolor
  Clone ID: 9296379
tgtcatgttggagcatgttcaggctcatgttgctcccacagatgttgatccaggtgctggtattcagtggttgccaaaaatacaccggagatcatctgcatttaagagaacgggtgcattacttgaaagggtatttatgccatgccaaatgtatttccgctacacaaggcataagggaggaacccctgaactaaaggttaaaccactgaaagagctgacatttaactcaccagacataactgctggtatgacatcacgacaatttcaagttatgatggacgtattgactaaccttctctttgcaagaactcccaaaaaaccaaagagtaatctaagctatcccctggacaatgatgatgacgacattgaagaagcatccgatgcagttgtacctgatggagttgagg

SEQ ID NO: 29164 - DNA, 490 bp, Sorghum bicolor
  Clone ID: 9296627
acaacgacaccgacattgacgccacctacgcggcgtcgctgcgggcaagctgccccgcgcaggccggcggcgccagcgacggcgcgctcgagccgctcgacgacgccacgccggacgccttcgacaacgcctacttcggcaacctgctctcccagcgcggcctgctccactccgaccaggcgctcttcggcggcggcggcgcgacggacggcctggtcagcacctacgcgtccagcgccgaccagtgggggagcgacttcgccgcggccatggtcaagatgggcaacattagcccgctcaccggcaccgacggcgagatcagggtcaactgccggagagtgaattaattagctagctcacaaacacattgcattgattgcatcgtctgtgtgtatattttgcaaagaggcagagaagaattgaagtggaggtctaagctcatatgtatacaactattgtatactattcaatatatttcgtgcaaaatata

SEQ ID NO: 29165 - DNA, 306 bp, Sorghum bicolor
  Clone ID: 9296629
cgccaaagccccaaagcaaagcaaagcacgcaatggcatctccgggcaccgccgcagcgctcctagtcgtcctcgccgccttgctggcccccccgcctgcggcgtgcgcatgctcggcggcggaccgcgacgcgctgctgtcgatccgcgcggcgctatcggaggagcgtcgtctgggcgtgttctcgacgtggacgggcacggactgctgcgccggctggtacggcgtggcgtgcgacccgaccacggggcgcgtcgcggacctctccctccgcggggaggccgacgacgcggtcatggcgccgg

SEQ ID NO: 29166 - DNA, 459 bp, Sorghum bicolor
  Clone ID: 9296650
gcacgaggctgaactacgctgacgcaaagagcctccttgtcattttgcccctaacaaaacctccaaccaagctcatacctacgaaccctcaaggccacttaatcgacccgactaaaccgtcagaatggatttcggaaaccttggaggaaccttcggcaacgttggaaagtcgctttccaacttcggggcctctgtcaccccctttgcgtcgcgcactttccagtacaccaaggagcagttcggccagactgaggacaagacccagctccctcccgactacatcgaccttgagaagcgtgtcgatgcccttaaacaagcccaccgcaagatgcttgctgtgacctcacaatactccaacgagggctacgactacccccctaacatcaaggaaaccttccaggatcttggccgcaccgtcagcgaaaaggtcagccttctttccaccgccacctcttccgc

SEQ ID NO: 29167 - DNA, 225 bp, Sorghum bicolor
  Clone ID: 9296653
gcacgagggtctcgacgtctgagcagtttgtttttattacatttctgatttcttcgttgtgtaaagggcctgtaaattattaggcaagggggagagtagcttgatctgatttagctctgcaccatattggtagaacgacggtgccctgagtaattttaaccatcgttgaatcaattcctttagtatgactgagaaaagggctgacaaaaaaaaaaaaaaaaaaaa

SEQ ID NO: 29168 - DNA, 553 bp, Sorghum bicolor
  Clone ID: 9296694
tctcaattcacagtcaccatgttcgctcgccagagtttccgctgcgcgcagcccctgaagcagagcttccgcaagtactctgctgaggctgcccccaagaagtcgaacctcaccccgatctacgtcgccgtcggtctcgctggtgtcggtgttggtctctaccgctacagctccggtgacagctctgtccctgccgctattaagctcgaggaccggcccaaggtcttcaccggcgactgggtggacctcaagcttgccaacattgagatcctaagccacaacaccaagcgattccgctttgagtttgaggacaaggaggctgtctctggtcttcccgttgcctctgcgctcctcgccaagtacaagcctgagggtgcggagaaggccatcctccgcccctacactcccaccagcgatgaggacacccccggctaccttgagctcgtggtcaaggcctaccccggaggccccatgtccgagcacctccattccatgaacgtcaaccagcgcctgtcgctcaaggggcccctccccaagtacccctgggagggcc

SEQ ID NO: 29169 - DNA, 181 bp, Sorghum bicolor
  Clone ID: 9296715
agcttgtctctgctctaattgagtgccacaagaaggcatatgagattgtcactgagctcgcccctgtcattgagggtcttcagtccgaacaagaagccgcttaccgcaagagccgagaggaatcttcttagaacggcgacagccggagagatgatatccatgaaagccgttgaagatcttg

SEQ ID NO: 29170 - DNA, 394 bp, Sorghum bicolor
  Clone ID: 9296732
ttcagtgcgaatttgccaagcaatgttggcagtcaataggtgtggatattccagcagttgcagaaatgccttctagtatgcacttcctaaaagatgcaattggttctcggttcttcatggagtctataattctcttatgctgggcaatttggactaccaggaatgctttcatttttgacaacattcagccccaagtctcttctagcaggaccagctttatcaaggagctcaaagtgctcaagttcagagtaaattcaagatctgaacattcgtttcttccaatggcttttctcctgttgcttagctggtagctggttagctggtagtctctttctgctgtgtttttttgtttcttttaaggttcccctgagtggatcctgttgttttacactgt

SEQ ID NO: 29171 - DNA, 585 bp, Sorghum bicolor
  Clone ID: 9296737
actggtcaaatactattcttctacgcgacatgggatctctagccgagaatttggcggagactacggccatcgccactcggttcacgacggtatcagctatatgatcaagagtatacgatgggttgaaaacggcgcgcaaccacaggctcgacttcgcggaaaagctcgacgtgagcgcatgcgtaaagctatgcgcgaggtcaaaggaagcctcggtaatatcaacggcattgatctcgacaaagacaaagagggacgactaagaggaggaatatctgccacatggagaaaaaaggagcccgagtcatcagcatcgaagaataatgacaccgtagcagaaggcgacaagcagaatcagtcatctgcagacgacgaacaagacaaagaaaagagcgaggaaaaggttcaggacgtaaacatggacgatgccgccgaaactccagccacaggggagaagacggatcaatgacctggtcgtcacgatttgtcacatgttgattaaaggcgttggtgtcattgcattgcagggcagagaaaccaaggtcttgtagcattagaatacccctcttatgataataacaagtt

SEQ ID NO: 29172 - DNA, 665 bp, Sorghum bicolor
  Clone ID: 9296754
cgccccgttcggtggccccgagcggctggcgtggctgtggcgcgcgttcctgccccccggcgccacgcgggaccacgaggctgccaacgtgcccgccgcgatcaggcgggacgcgggcgcgggcgacgaccggtggcggacgttcccgcccacgctggtgtgcgtcggcggatgggacgtgcaccaggacaggcaaagggcgtacgccgacgcgctccgcgccgcgggcgccgaggaggtcaccgtggcggagtacccggacgccatccacgcgttctacattctggacgacctcgcggacagcaagaagtttgtgggcgacgtcgcggagttcgtgaaccggcacacatcgcagaggaagaaacgcgcgctagaccacgcggactagtgttatctgtttgcgaggatcgcaagaaatcgtaggactgaagaagcttctttggtgggaaatggttacccgctggtttagatcgattgtgtaggctccaaaacttcacttcccagaatcaatcaatgatcgggttcatcgcagaggtttaccgtctccaacagttttcggtgtcatttacagtcagactgccccttcgtggtttatgtaaggcctttctaatagtggctttttgtttgttgataagagcttacaggtggtggaggttttattccac

SEQ ID NO: 29173 - DNA, 593 bp, Sorghum bicolor
  Clone ID: 9296759
cccctgggaggccaacaagcacgaccacatctgcctgatcgccggtggccccggtatcacccccatgtaccagctggcccgccatatcttcaagaaccccgaggaccgcaccaaggtaaccctggtcttcggcaacatcagcgaggacgatatcctgctgaagaaggagctgcacgagctggaaaacacttacccgcaacgcttccgcgccttctacgtgctggacaacccacccaaggactggaccggcggcaagggctacatcacgaaggagctactgaagactgtgctgcccgagcccaaggaggagaacatcaaggtgtttgtctgcggcccgcccggtctgtacaaggcgattagcggtggtaaggtcagccccaaggaccagggtgagttgacgggtatcctgaaggagctgggctacagcaaggagcaggtgttcaagttctaaatagacttgtattagctacttgtagaatagatttgtccggtcggggatggtgtacattgatgctttggtggtttcgtgggcgcgtacttacatcccatcaattgtttttccccgcccattgtctacgcgatgcgattgtggt

SEQ ID NO: 29174 - DNA, 357 bp, Sorghum bicolor
  Clone ID: 9296760
cctcaaggccctccagctcatcgacgcatcgcctgaacacaccttcatattcgaagactctgcatcgggggtccgagctggtgtcgctgctggagtgcctgtggttggcctgacgacgaggaaccctgggatggtgctgaaagacgcaggagccagcttgctggccaaagattttcaggacccagagctgctgtccgtgcttcaagagatcgaacctgcagcggcgaatgcgtgaggctgatcggtcattgcagacacacactaacaaatgggatgctggactggtgatcagctcttcatttacggagtggaatagctatacaatcacactatagaataactacctcaggttccccg

SEQ ID NO: 29175 - DNA, 424 bp, Sorghum bicolor
  Clone ID: 9296765
gccgcacgtcttgcgggttgcggctcctgcccggtcattgctctttccgagttccgaccgcccgagcccgaagccgaagccttaaacccccttaatctgatatccgacggcccatatctctcgtttctccctatccccgtccgttccccatcttcccgccctctccccatgtcgccgacggtggccggcgcggccgccacctccggcgacgggtcgccgcgcgagctctacaccatcccggcatcatccggttggttccggtgggacgggatccacgagacggagcggcaggcactgccagagttcttcggccgggccggcggtgctgggttcgggacggcgacgaggaacccgcgaatctaccgcgagtaccgcgacttcatcatcgccaagtaccgggaggacccggcgcgccgactcactt

SEQ ID NO: 29176 - DNA, 512 bp, Sorghum bicolor
  unsure (1)..(512): unsure at all n locations
  Clone ID: 9296772
gcacgaggagaaatcttattgtgaacaaaccaacatttctcatgttagttgatactcgcatcgatacaagacgtcagcgatcatcatgatctccaacatttttgatgtgctatcgtcgcagttagccattcatccaatccaatctcttctgctcttgactattctcacacccttcctatacatcctgagcaacgagtatgtacggtattcgcgacgcataaaagggtttccgggaccaagaaactggccattggtgggcaacataccagatatcaaatacaacgcagcagagaagtatcgggaatggagcaaggtgttcggcgcagtataccaaattcagctcggaaacgagccagtgatagtggtaaacagtgctgaggctgcgagaaagctgtttggcggcaacagtcaagcattgagctccagacctgttttctggacttttcacaaggtgctttcgaatactgctggtacgacgattggcacatcgccgtttagcgaatcgctcanac

SEQ ID NO: 29177 - DNA, 554 bp, Sorghum bicolor
  Clone ID: 9296800
cgcacatgaagctgctctcaaaatcaagactgacgaaaacgacgagctcattcgacagatggatgctttgaataaccagcttacgaccgatgctgccgagatagagcagcttaaagaggaggcagctagcctgcgaagcacaatcgacacactggaaaaggcctcacagcagctggagtcgcaacatgcttctgagattgccaaagtgcaagctgacttgaacgaagcaaacaagaaggccgatacctacaagtccgagcttgataccctacacgataagcacaagcaagacttgcgtgtcattggcgaggattacgaacgcgagattgaatcactgagggctgaccttgaaggggatgcatcaagacgactgaacactctacagtcggattttgatgcccttgtcgctgagaagaacgcaaactcggagcaacacgagaaagtactttctgaacggtccagcgagatcgaggctctcaagcaggagatcaatgagcttcgggacacctctgcttcagcaactcgcagcagcgaggatgtagtcgccaagctta

SEQ ID NO: 29178 - DNA, 131 bp, Sorghum bicolor
  Clone ID: 9296805
gaggcacaccgtgacgcgcccaactttcggtccatgatcgggctcatccacggcaggacggacctgaagccgctgccggccggcggcggacctgaagaccggcggctgcacgtggtgggcgtctccgccgc

SEQ ID NO: 29179 - DNA, 548 bp, Sorghum bicolor
  Clone ID: 9296808
gcacgaggactgaaacaaggttctgagtgagtcgacagaagtacatgccgaaaattactcatctgttttggtcccttttaattagtttgttaatgcatgtgtggtatttgaagtagccttttaattagtcattgtttggtcgcatgataaagtagcagatcagaggtgctctgcctcatactctgcatgtgcacagatgcggcgaatggtttggcaggtcacctatctcgattccatagttttgccttctcccataattttttttttattttttgtagatgatttgctctctcgtaatcctactcttctgttacaaagccttgggaaattcatttcgattttagtttaggttgccaagtgaccacgaaatcagtactggtgaattaatgtgtcactgtgtttcgttcgtcttagtaaactttcaaggaaaatgttggttgttttctctactgtgggttatggagattgtagatcagtatgatgacgcatgtgtctctgctggtgcgactgataaccttgctatttttcttcttgcttggaacatgacc

SEQ ID NO: 29180 - DNA, 474 bp, Sorghum bicolor
  Clone ID: 9296819
tacacttgctcaaatatacagtagttgaacttctgtagtttattgaatattagcattgacatgcatgttacctctttccttgtccctgtatagattcgccttgagaataagattccaatcaataatggcatattgtgcttaagcgcgaaaaatgtgagtgtcattggggggactgtccaatcattgtatgaagaatggcagatgaaccagaagtactctggcttatctcgtccatccttgaggttgtctcaaagtgatgatggagttgggcctccaccatttgagaagttagacattgaggcacgtccctgcagggcaaccaaagttcaagcatatcctggtaaccatcatctcttgttttttgtttccactcatgctgttgactaaagagctgtggaagtatgagtttcttaccttaagtaaatacagcaacaataaagccttttagtctcaactcccaagcagtttggggta

SEQ ID NO: 29181 - DNA, 575 bp, Sorghum bicolor
  Clone ID: 9296840
ttgcctacagcatcatgtatggaaattcatatgaaacatcagcagctcaagtttatgaaactgctcctcctaagaggcttgctagtttgagtagaaactctttggtgaccttggctagcagcagttcgaggagcagcagcagtatcagcattcaagagcatgaactgcctgagcatctccattctccgtgttcacctgatgggtttatatccgcaccaccatccggctcttgcgtgcctaatgcatcatctgtgcctatgagatcattgtcgatgatggatttgcatcgtgtgcataggtcaagttcctcagttggtctcaaagataggaaataggaaatacgaataggaggattttccatttgtttttgtcatctttttgctcgaggtttctagtaccatcttctctaatagaactaaggttggcaaggaggtttctggataaataagggagcactttaagtttggcgaggaggtatatttgtgtttgtaaaatagttctttactccattgtaaattagcataatgtactaatatgaatcctctactcatgtaaccagcatcttcacctgtaaa

SEQ ID NO: 29182 - DNA, 653 bp, Sorghum bicolor
  unsure (1)..(653): unsure at all n locations
  Clone ID: 9296850
gcctatgatgaccagaagtgtggctacgttgtggcgttggttcgagaatgcctgcggtactacaccgttctacgactggctcttccgcgggcaacagtcaaggacgtcatatatgacgggaagctcatcccagctggcagcacaatctacttgaatgcatgggcatgtaacatggaccccgaggtttggagcgatcccgatgagttccggccagagcgctggctcgaacagcccgatgcgccactgcacagctacggtctaggatacaggatgtgtgctggctcgctgctggctaaccgggagctgtacctggtatttctgagaatgttgaacagcttcgagcttgtcccggattcggacgtggacgtgcatcctgtgcgaggcagctccgaccctaccagtctcgtgaccatgtgccgagcttacaaggtcgtgttcaagccgcggaatcaaggcatactgcgtgaggcgttgaaggcggcagatgagcgattggccgagcatgagaagtcgtgagttgagctgtgggtgagtgagtggagtgatgttgagtgcacgtggcaggcggaatcattgcggctgcagctgcggtaggagggagcagctggcacgtctgcttnctatgtagtactcattggacgtctgctgcagtc

SEQ ID NO: 29183 - DNA, 625 bp, Sorghum bicolor
  unsure (1)..(625): unsure at all n locations
  Clone ID: 9296860
cgaagtcgtgcgaaagcacntggcccgcgtcgagccactggagaaggaaaacgcctctctccacgacaaagtcgaccgtcttgaagcaatccttgctgccggcgacagggtcgctcgtgcggctgccactttaggtgaacagcggcacatcgatactttggccgaagaggacgaagaagaaggcgacgatggggacgctgcctctagccttcaacgacacaaaacaaacggcactggtgccgcgaaagatgttgtcggtactcagttggcagccatgcaggagaccttgacccagctcgccgagctcaataacgaagcgattgtcgaaagcaccaggaccgctcaacgtcttactgccgaccaagaacagctctccctcccaccgccaccaccttcttatcaatagactgcggtctagaaaaccatgatgatggtgataatgtatgagaattatgacatgcatacgtctctaacctaccatataccattttaatctccccttctccttacggtgcttctaaggcccgttgttctacattatacctcaatacactgcattatacctagtttacgcacttgtgttcttgcggtcagcactcaatgcgtgactatcactgtcgtcaga

SEQ ID NO: 29184 - DNA, 645 bp, Sorghum bicolor
  Clone ID: 9296863
ggcagccgccattgccactgtagtggcggcgaggaataagcggatcaggttggagctgacgggcatccgttgagaaagctagcaccaccggggacacaatttttagccagatgtctaggggggggcttggtttgatcttccctttcattttctttccttctttttttaacttatatgtttgcaaaaaaaaaaaagaagagattttttaggttctttgagccattgccatgggttggcattggctgttgtcagattggattggtttggtttgtgagaggtggaagagatgaatgaacaaagcagagggctgagctttcctatggagaggagagcttaggttaataagcccaatgccagtgcccaaacagggcacatttcacagtgaactttacttcaaagttgcactgtttgataaaccatttgttgatgcaatgttgcattgcatatggtgagatgctgctgctgcagagagaagatgcaaaacaagtggtaacaacacttgagaggttgagggttttgccattgtttatagagagagctgtttccctttttcacttgtgcaagtggatgtgagagtggtgtttcatttctgcacttgcaagggttacattcgtttgtaacaaaccctttgtacttgtgtaaccc

SEQ ID NO: 29185 - DNA, 431 bp, Sorghum bicolor
  Clone ID: 9296891
gcacgagggtcatcatggctactgtgtggagtctcttattgaagaatttaagacgcaactggatgatgcattgactgaggaactaaaagattccatggttgagcatcttaagaaggccatatattcatgcacagctgatgagttcaatcagtatattgagctcatcaaaagtgaatctgacaagcttgctgattggctcttggagatcaaacctgaccagtggtcagatgctttttttaagggatcacgtcatggacagtattcttgtaatgtttttggcactgtgtctgagtggattcccacaagatatgagctttcagttgtgcaattggttgacacgataaggtgcaagctgatggagatgatgtacacacgcagggagtcttccaatgcatggactgaggtattaacaccggcagccaatcagaaac

SEQ ID NO: 29186 - DNA, 491 bp, Sorghum bicolor
  Clone ID: 9296901
gcacgaggcttcgcttgcgtaggcagggcacagccatgggaccgtctggcagaagctggctcctcgtcctcctcgtctgtgcaaccctgtgcgcccatgtctcagcagcggcgtccgacacgacggtgttggcggcggagcggacgcggcggaaggaccccctcgacgggctcaggtactacaccggcggctggaacatcagcaaccggcactacctggcgtcggcaggtttcagcgcggcgcccgtgttcgcgttcgcggcgctctggttcgtcgcggtcgcggcggcggcgctcgtcgcctgctgctgcagctgttgctgccgcggcgtcggcagcagcagctactcctactcgcgccgggtgttcgcgctctcgctcctgctcctgctcgtcttcactgccgcagccgtcatcgggtgcgcgattctgtacgacgggcagggcaagttcaacggcagcacgacggcgacgctggactacgtggtgagc

SEQ ID NO: 29187 - DNA, 537 bp, Sorghum bicolor
  Clone ID: 9296903
gccgtccagcctcgtgtgccgggtgtggccactcgtgcgcggccgcggcggctggttccgcctctggttcgacccctccgtgctggtcgcgccgctcaccaggtgcttcgccgagcggatgacgctctcctacgacgccgacgccgacgactaccgcaacgcgcccggcgtcgagaccagggtctccgacttcggctccacctccaccctccgctacctcgaccccaacctcaagctcctgacggggtacatgaacactctggcgagcacgctggaggagaaggccggctacgaggagggccgcgacctgttcggcgcgccgtacgacttccggtacgggctggccgggccggggcacccgtcgcaggtgggcagcgcgtacctgcagcggctcaggctgctggtggagtcggcgtgcgcggccaacggcgggcgggccgcgatcctggtggcgcacagcctgggcggcctgttcgcgctgcagctgctggcgcgcagcccggcgccgtggcgcgcggcgcacgtgcagcgcctcgt

SEQ ID NO: 29188 - DNA, 549 bp, Sorghum bicolor
  unsure (1)..(549): unsure at all n locations
  Clone ID: 9296907
ggaagaattgtttttctttcccggattatttatcttgtggcagtaaacttgcatctgtattaacggagaatgatgctaggctgatgagatgctctgctatgcaagttttctcacttaaaacttatacttataacctattcctccttacgtcttgaacaggtaattctgatattatgatttatgaggtagttaaccaagattcatcaaatagttgatgaggtgattacaaactgctgacattacttttggcagcatatagtgtatagattcctcaaatagttgatgaggtgattacaaactgctgacactacttgtttgattatattgcttgttaggtgatgtttatgactgatttctatttattgctacagaaatgtatttcctctatgtcaatgtgtttgcctttaactgttttattgtgtgcctcatatgctgtgatgaactcttaggtagcacctgtgcttaaaagatgtttttctcttcacaggtttttctgttagtgattttgttctctggttatctgctccactangggaaaaatggcaagca

SEQ ID NO: 29189 - DNA, 526 bp, Sorghum bicolor
  Clone ID: 9296912
gcacgagggtcaacaagattgcggatcgcgttgcaccatttgcggtcaagtgtggaattattgcaaagaatcggatcgcttggaaagatctctcaactataccgtcgaagcctgcgctattctcactctggattctattcctacctcggatggactttgtccttttaacactactttggaatcgtgttgtttcgaacaacctacgcctcccgtgacacctcccgtagctccacccgtagaacccccagtaacacctttggctcctcccgtaacacccatcgcacctccggtgacacctcccgtagctcctcccgtcgctcccacgtgtactaccgttcccaccattgcctgttcttcgagcgtcgattgtccaaaatattttgcttgcgatggaacccgttgtcaaaacaaccaaggtctcagttgcagcaacggtatcacttgtcagagcaacaattgtaccgccgcaccttcgtgtttctgcggacccacttatagttccagtcaactctgtttggatgccatt

SEQ ID NO: 29190 - DNA, 528 bp, Sorghum bicolor
  Clone ID: 9297379
cgcaagagctgagctagcctagcagcgacgacgacacgatcacgatgcagcagggcgatcagcagatgatggagtgcagcggcggcaaggagcagcagatgcagatcgtgtgcgtgcggagctcgtccacgggcggcgaggaggtggtgggggagtgggccgcggcggaggagcagtcgtcgtcgcggtcgtcggcgctgtcgctgttcaaggagaaggaggaggagatcgagcgcaagaaggtggaggtgcgggacaaggtgttctccatgctgggccgggtggaggaggagaccaagcgcctggccttcatccgccaggagctggagctcatggccgaccccacgcgccgggaggtggacgccatccgcaagcggatcgacaaggtcaacaagcacctcaagccgctcgccaagacatgcctcaaaaaggagaaggaatacaagatgtgcctcgaggcctacaacgagaagagcagcgagaaagccacgctggtcaacaggctaatggagctcgtaagcgagagcg

SEQ ID NO: 29191 - DNA, 532 bp, Sorghum bicolor
  Clone ID: 9297380
gcacgaggcattggaagtttgctctcacgcaagaagccatatgaaaatgaatggaattccttttatcatcagctagtttggcaaataggaaacaacccagatctcaacgctgtgaggaatgccctcgatcttagcatcaactatttaccaggaaatgtaaagaactgctttctatattgtggcctatttcctgaagaccaccagattagaggagaagagattattagattatggataactgaagactttatagaagaaagggggccaactagtataactatggaggaagtaggagctgaatatctcaatgaaatcgctcaacgttctctccttcaggtggtccagagagatgcttatggtaggtcagagatatttcaaatgcatgatcttgtcagagatatagttgtaagcaaaagtgcacaagtgagaaattttctgttctggataactctcgtgttacaatgcatagcagagaagcacgccgtttatcagtactgaaatctgacagcattacagatgctcttgagggtgg

SEQ ID NO: 29192 - DNA, 501 bp, Sorghum bicolor
  Clone ID: 9297381
gcacgaggcaaaaaatggcttccatctcgcaggtcgtcaccctcccgctgccggctctccccgagggctggagcgccgaaaaggacttcaaggccgtcggcaagctctccggtgctgtgcagcgcagcatcgagcctgttggaccgcacttcctggcccacgcccgccgcgcccgtcacaagcgaaccttttccgaggacgaccggatccaggcccaggagagcgccaagaaggtcgaggatgtcgacgacggcgaggagagcgaggccgaggacccgatgctgctgcagctgcaggccaaggactggaagacccaggaccactacaaggtgctcggcctgtccaagtaccgctacaaggccaccgaggaccagatcaaaaaggcccaccgcaagaaggtcctcaagcaccaccccgacaagaaggccgcccagggccgcaccgaggacgaccagttcttcaagtgcatccagaaggccaccgacatcctgctcgacccca

SEQ ID NO: 29193 - DNA, 572 bp, Sorghum bicolor
  Clone ID: 9297385
cagaagcacatcatttgagggtcctctcgatgaaatccctgatgaaaacagcccgcagattttacatcgcaagatgttcctgcgggcgtacctgaataagctgtgttcagacccaagcaagatggagttttgggagtatctcgacaaagttggcatgatgcacgtcggtcttggccgaaaacaccccctacacatcgaatacgtccatctgggcgcctgcctaggcttcatccaagacatcatgaacgaagccatcctctcccacccgcgcctccacatccagcgcaaaatcgccctcgtcaaggccctcaacaaggtcatctgggtgcaaaacgacctcatggccaagtggcacgtcaaggacggcgccgagttcgaggcgcccgattcggacattgagattgagcgcgagggatacctgcacgggaagaagattctgagcgatgaggatatgaaggaccatacgggtgctgagggatcgcctgatggggaggagaaggcgataccgcaggggacgtgtcccttttcgggtgtatcggctgctggagcttcagtgaagcatggagattctg

SEQ ID NO: 29194 - DNA, 467 bp, Sorghum bicolor
  Clone ID: 9297386
gcacgaggcttaaggaggagcttgagtctgcccttgccagtcttacatcacagcttggtgagaaggatgaagttctactttcttttgatgaacacaaaacagagctcattcatctgaagggccaacttttgggcatggaaaaaacacatagtttaatgcaagattctctcacacagagtgaagaaatccaaagggacctcaactgtaagaatcgctctcttcagtctcaggtttcaattctggaaaaccagttaggaacagttgttgaggccatgctttccagtgaaattgaagctagttatatgagaagtcaggtaagagaggctgttgtgcagcttaatatgttaagaaatgagtttgagaaactccaactcaaaagcaaagaggctgatgaattattacgggcacacatgtctactgaagcagaattagctgatagaaatagcacacttgaagcagctatccat

SEQ ID NO: 29195 - DNA, 578 bp, Sorghum bicolor
  unsure (1)..(578): unsure at all n locations
  Clone ID: 9297390
gcacgaggctcaaacctctgtcgtcgtgcctctgtagagaacgaagtaaagctactactttgctcggcccaaatccacagctgccaccatgccgactcctggactgctctacgtgacgatgcagccgcagggcgcactgcccgaggcgcaattccacgattggtacaacaccgaacatggtcccttgcggttacgtctccccttcatcaccaatggcttccgcttccgcacgaccgacggcgagaaacccgagtatgttgcgctctacgatatcaccgatatggccgagttgacccgcaagacctacttggacctgcgcaccgatctgatcaaaacggagcgggaaaaggccaccatggcccagatcgacgtgggtcggttgctctacgatctggtctatgagcagagctcgtcaaacttccgcccgctcgagacccaagccgacaccgaccccgagacccgcggaagtgttcttgtcgccgtgaccaccaccacccacccagaccctgaatcgcaggcagagtatgatcgctggtgtcgcgaggaacactntgacatgctctcgcgcgtgccgggct

SEQ ID NO: 29196 - DNA, 504 bp, Sorghum bicolor
  Clone ID: 9297395
gcacgagggccacggctgcgccgcgtcgctgtgcgccatggcggcgctgctggcgggcgccgtctggctcgtcctcgccaccacgagcgtggccgcgcacatggcggccgccgtcatgctgggcttcctgtggatgcagtcgggcttcctcggccacgactcgggccactacgtggtgatgcggacggggcccctgaaccgcgccgtgcagctggtggccggcaactgcgtcgccggcatcagcatcgggtggtggaagcgcaaccacaacgcgcaccacatcgcgtgcaacagcctcgaccacgacccggacgtgcagcacatgccgctcttcgccgtctcgccgcgcctcttcgcgtccctcacctccgccttctaccgccgcgccatgcgcttcgacgccgccgcgcgcctcctcgtcagctaccagcactggaccttctacccggtcatgtgcgtggcgcgcgtcaacctcttcgcgcagtcgctgctgctgctgctggt

SEQ ID NO: 29197 - DNA, 503 bp, Sorghum bicolor
  Clone ID: 9297400
cgacacaagaccaactacttcattgagtacttcgccctcgacctgattatgcaggatggtgagtgccgcggtgttctcgcctacaaccaggaggacggcaccctgcaccgattccttgccaaccacaccgttctcgctactggtggttacggacgagcctacttctcttgcacatctgcccacacctgcaccggtgacggtatggccatggttgcccgtgccggtctccccaaccaggatctcgagttcgtccagttccaccctaccggtatctacggagctggttgcctgatcactgagggttctcgtggtgagggtggttacctcctcaactctgagggtgagcgattcatggaacgatatgctcctaccgctaaggatcttgcttctcgtgatgttgtctctcgatccatgaccctggagatccgtgagggccgtggtgttggtgctgagaaggatcacatctacctccagctcagccatctccccgctgagatccttgc

SEQ ID NO: 29198 - DNA, 558 bp, Sorghum bicolor
  Clone ID: 9297424
gcacgaggctcctgccctgaagaaagctgatatcggtattgctgttgctgatgcaactgatgcagccaggagtgcttcagatattgtcctcacagaaccagggcttagtgtgatcattagtgctgtgcttactagtcgcgctattttccagcgtatgaagaattacacgatctatgctgtctcgatcaccattcgtattgtgcttggatttatgctccttgccctgatttggaaatttgatttccccccattcatggtcctaatcattgcaattctaaatgatggtaccataatgactatatcaaaggatcgtgtaaaaccatccccactacccgacagctggaagctggctgaaattttcacaactggagttgtccttggtggatatcaggcaatgatgactgtcatcttcttttgggctgcatacaagacaaactttttcccaaaaatatttcatgtcgaaagccttgagaagacagctcaagatgatttccaaaagcttgcctctgctgtttacctgcaagtcagcaccatcagccaagcccttatctttgtgac

SEQ ID NO: 29199 - DNA, 505 bp, Sorghum bicolor
  Clone ID: 9297431
ttcaattccctgccccccacgagccacgagcacgccgcctccccacgccacgccccctcagcccgggccggcgctcccccgagaccgccgcattcacatgatgtaccatgctaagaatttttctgtgccctttgcacagcagagggctcagaataatgaacatgcaagtaatattggaggtattggtggacccaacgtaagcaaccctgctaatcctgtaggaagtgggaaacaacgcttacgatggacatcagatcttcataatcgctttgtggatgccattgcacagcttggtggaccagatagagctacacctaaaggggttctcactgtgatgggtgtaccagggatcacgatttatcatgtgaagagccatttgcagaagtatcgccttgcaaagtatataccggaatctcctgctgaaggttccaaggacgaaaagaaagattcgagtgattccctctcgaacacggattctgcaccaggattgcaaatcaacgaggca

SEQ ID NO: 29200 - DNA, 540 bp, Sorghum bicolor
  unsure (1)..(540): unsure at all n locations
  Clone ID: 9297442
cgcagctgattgctacactgatgnctgtgtacgccgactgggcattcacttcgatcaaaggcattgggtggggctgggctggtattgtgtggctttacaacatcatcttctacttcccgctcgatatcatcaagttcctcatcagatatgctcttagcgggaaagcatgggatcttgtcattgagcaaaggattgcgttcacaaggaagaaggactttggtagggaggagagggagctgaagtgggcacatgcacagaggaccctccatgggctacaggcacctgatgccaagatgttcccggagaaggctgggtacaatgagctgaaccagatggctgaagaggcgaagaggagggctgagattgcaaggctgcgggagcttcacacactcaagggacatgtggagtctgttgtgaagctgaaggggcttgacatcgagaccatccagcagtcctacacagtgtaaactttgcctgtccagaagaagttttttctttttatttttcttttttgcccaccgaacgtgtgaatttgatggt

SEQ ID NO: 29201 - DNA, 370 bp, Sorghum bicolor
  Clone ID: 9297457
catccgcgacgagcagcggtccgccgagagcaacctgtggctgctgccgacgcccaaggtgttcggcaacaccacgctggtggtgtcgcggagccacaaccggtcctactccgccaagaacatgacgcagttcctccgggacatcggattcgagcaaggcgtggagccgtaccgcgcgcggatacgaccgctcgtcgaggccctgccggagcccggcgtgcccctgacgtgcctcgtgggcaccggcgtcgtcacggtggagagcctcgtgtacggcgacggcggcttcgacgaggaccccgaggaggtggtctacggcgacggggacgggacggtgaacctggccagcctcgtgggcccgatcaaggca

SEQ ID NO: 29202 - DNA, 599 bp, Sorghum bicolor
  Clone ID: 9297458
tcgtcgacgacaaggtcgggtctccatggcacaccatcctgttcgcgcgggaggccgagaagaaggcggatgcggcgtcgcggatcatcgcggcgctggagacgctggagggcgcgttcagggactgctccggcgggaggtacgtcgactacttcggcggcgacggcgtcgggttcgtggacgtggtgctgggcagctacctggggtggttcaaggtgttcgagaagatggtcggcgtcagggtcctggacgcggcgaggacgccgctcctggccgcgtggggggagcggttcgccgccgcggaagcggcgaaggacgtcctgccggatgacgttgacaaggtgctcgagttcctgcagcagttcctggattaggtgggcgccaccaccatgtgctccggtgtcgaactcccaatgtttgctttggtcattttcagtgcgctgttctgttaatgggtcgtcgggtgtttcccagttgattcgatagaattgaggcctgattttacccgagcatcaagctgaattattccaggttctagacaggaaccaccagtaaaatcatgatgaaacgtttcacagagagtggttttgggtttcata

SEQ ID NO: 29203 - DNA, 393 bp, Sorghum bicolor
  Clone ID: 9297459
ggggacatggtggtgaacgcgatgatggccgcgacggtggcgcacgcgtcgacggcggcggcggccccggccgaccagaagaagaagacgccgccggcgccgccgccgacggtgtaccacgcgacgtcgtccctgcgcaacccggcgccgtacgcggtgctgtaccggacggggatccggtacttcagcgagcacccgcgggtgggcaaggacgggcgcgcggtgcgcacgcgcaaggtgcacttcttcggcaccgtggcgggcttcaccgcctacatggtgctccgctacaggctgccgctggagctgctgcgcctgctcagcctgctctgctgcggcctcctcttctcgcgcctctacgcggagctggaccgcaagtacaggttcgtcatg

SEQ ID NO: 29204 - DNA, 530 bp, Sorghum bicolor
  Clone ID: 9297468
ttgagctgaacatgattagcttatactaatgtactaactgattcatctactgatgtgcaaatcatattcaatacatgcattgcaagttacaaggttacaatttgcaagtgcaattggtagtgccatctgaaagttctattctagtaaatacttggatttgttaaaattatctgaatattctaaggcaatacttggattatatttttgcagtgcttcttcttccctcaagccggctgattctattggttttgctatttctttaagcattggattaacagtgactgatcccattgatcatgtcataagccagctgactgatcccattgatcatatcctgtgaccttgaagccaattcttgaagactcgtgttgtgaccctgaaaaacaaattcttgaagccacttcttggacagccaatgatgtagatgagtagaggtgttttgcgtaattaattgcctgctcgtcacaatggttattatttcttccagaatgtcccattctgatgtgtaaggtgatgtgcagctccttctc

SEQ ID NO: 29205 - DNA, 524 bp, Sorghum bicolor
  Clone ID: 9297470
ccaaggaggagattgagcgcatgctgtctgacgccgagaagtacaaggaggaggacgaggctgagggccgccgtgtctctgccaagaacggccttgagtcttacgcctactctctccgcaacactctcaacgaccccaaggtcgacgagaagattgaggccggtgacaaggagaccctcaagaccgagatcgacaagatcgtccagtggctcgatgagaaccagcaggctactcgtgaggagtacgaggagcaccagaaggagctcgagggtgtcgccaaccccatcatgatgaagttctacggagctggtggtgagggtggcatgcccggtggcatgcccggcggccccggcggcttccctggcgctggcggcgctccccacgctggtggcgatgacggccccaccgtcgaggaggtcgactaaattcacaaagctgttttgataccccaacatcagacttgagcttccagattggtattccgtctacgatgtgtggaggcctactctaggggatcaaggaga

SEQ ID NO: 29206 - DNA, 295 bp, Sorghum bicolor
  Clone ID: 9297471
caatccaaggcggcgctggcgtcgatcttgagcagatatttggagaagaagtgactttacaggatgttttggagttattcgtcaagcacgacctatttgaacaattcagtcttcggctggtggccaacaagaagattggccacttattcgtcaagacgcaagagcttcgagtgcaagtcagtgtcgctagcatcctagatctatcagaggaacaccaccctctcattctggcagcagcattgagattcttgaagaagcaaggaccaaaacacttgctacaccgagagaggtttgt

SEQ ID NO: 29207 - DNA, 124 bp, Sorghum bicolor
  Clone ID: 9297481
acacactgtaatgtcatcattgctccagaatcaaaggcatgagttgatgaattcaatagaacagaacaaggatctcactcaaaaacttgctgaacaaagtctgaaggcagaagagttcaaaaac

SEQ ID NO: 29208 - DNA, 649 bp, Sorghum bicolor
  Clone ID: 9297484
cgccgatctactcgaggcattgcgagtgccacccaaggctgctcggttgataggcgtcagtctaggtggtgttaccgtgctcaacacctccctcctctaccccgagcgtgtggccgcgttcatcgcttgtgataccaactcctctgctcccgagtcgaatcggaaagcctgggccgaccgcgttgccatgtctgagcaagaagggtcaacgaacccagagaccaacgagcccatcgttggagaagagctggcagaagccacgactcgacgctggttcgtacccgagtcttatgagacccagccagaggtcctcgctccagtcaaggaggcagtccgcaccaacagtctgaagggatttgcgcacagtgtcaatgctttgtgcgcatatgatattcgcgaccgcatggcctcggccactgtgcctgggttgtttgtcgccggggccaatgatggagtgcttccccagaccatgcaaaagatggcagccgacctgaagggaggtgctgagctgaaaaccattgacaaagcaggtcacctgccaatggtagagcagcccgaagcctttgcagatgtggtgaccgactttttgggcaagattgatggataagcattgataaatgggggtcagacgaaagggtgaaaaccatga

SEQ ID NO: 29209 - DNA, 599 bp, Sorghum bicolor
  Clone ID: 9297490
ccctggccggcatgaccaccaagaacaaggtggcggcgctgctcctctgcttcctcgtcctggccgcgatcgtctccgccgagatcatcgatgccaatggtgtcgacgacgacgacggtggtgatgaagagcagctagacaaaggcggcagcggcggccaccacaaccacaagggccacaacaaggatggcaagggaaacctgaagccctctcagtgcggcggggagtgcaagcggcgatgctccaagacgcaccacaagaagccgtgcctcttcttctgcaacaagtgctgcgccaagtgcctgtgcgtgccgccgggcacctacggcaacaaggacacctgcccctgctacaacaactggaagaccaagagaggaggtcccaaatgcccatgatgcatgcatgcatgcatgggcctttcttcctgttccagcttcctgttcattctccagccacgccggcccgcccatgtcttctattccttcctggacaatagtagtacctaggaataatagcaggttcttgtttcagagtaggatccagtttgtttgggccttaaaacctcatagtatcctctgaactcaaacaaaaaaaaagca

SEQ ID NO: 29210 - DNA, 631 bp, Sorghum bicolor
  Clone ID: 9297491
cacgtcgagcgcaagaaccagaactcgcgcaagaagaagaaggccgaggacaatgctcgtctgcgcaagctgctagacgacgcttccgccggcgacgagcgcatcaagcgcttccgacaggaggccaacgccgccaagaacaagaagaagtttgagaaggaggccgccgagaagaaggccgccgaggaggctgctgccaagaaggctgccgaggaaaaggcaaaggccgacgctgaggctgctgccaaggctgaccgcgaggccggcaagaaggccaaggaggcggccaagaacgcgctcaagaagaacaagcgtgtgctcaagggctccgtcaaggacgccaactactttgccgccggcggcgatgcctctgctgcccagatcgacgccgtgctgggcgatgtcgagctggtccagggcaagattgaggctgacgagattgctgctcttgccggcaagctcaacggcctgacggtggcggacgagatcaagggcgtgtggagcgccgaggtgaagagactggttgatgccggcaagctgaaggagggcgatgcgaagactctggcgtaaaaacaaaaagcgtgtttgggaacgggggtgtttgataaaagcgcaatgacagtatagacgg

SEQ ID NO: 29211 - DNA, 508 bp, Sorghum bicolor
  Clone ID: 9297498
tttaattgcttattattgtagctggatatgagaggaattcctaaagatttttaattcccactatggtcgtaaagattggatacttcccaacattttgaaaaaatggtaagtgaaaatctattggttttactgattatttataatctgaagttcattgctttgttttatagtgctgcgggtgttctatttttatttcaaataatgtgatcataatgtgatgtagtcctacaggaatttgcagcaaacaaattagcccttcgtcttgcaattttattgccagtcatcaatgtgttgtggtccttggcacgctgcacgcccccacaaccttgcaagacaggctacatcgccccacaggcgacctctggggcgacaatgtggacccctgcgccctctccgtgtcccagctcaagggcgcaatgaccaacgaggtcttccgtatcacctgactcggcagcgagggcgacctccgcaaggagcagagaagattgttacataccttagctctgcg

SEQ ID NO: 29212 - DNA, 606 bp, Sorghum bicolor
  Clone ID: 9297502
accgctgagatccgacttgccatgcagaaggctatgcagactgatgtcagcgttttccgaacccaggagagtttagatgagggtgtccgcaagatgaccgagattgatgccatgtacagccaggttggcatgaaggaccgcagcatgatctggaactctgatctcgttgagactcttgagcttcgcaacttgctcacctgcgctatccaaactgccacctctgccgctaaccgaaaggagtctcgtggtgctcacgcccgcgaggatttccccgagcgagatgacgagaactggatgaagcacactctttctttccagaaggagcctcacggcaaggtcgacctggcctaccgaaaggtcatcgccaacaccctggacgaggccgagtgcaagcccgtgccacccttcaagcgtgtgtactaagcgtttgcgaatccggacacgaggaagtacttgggaaggagtttttgttagcttgttgggaaacttggcatgcatgattctacgcagggcagcgtctcctttgtgacaagatgtgcggtatatatatcctttgggaagaggaggcgggtatgataagaagcagcgagagaatggtctctgttg

SEQ ID NO: 29213 - DNA, 493 bp, Sorghum bicolor
  Clone ID: 9297503
agttcgaatcaatgcagcggacccaaaccttactgcgtcaacggttattgtcacgactacagctgtttggataatgcttgcagaaacgtcgacattccttattgtaacttggcgacaccgtgtcccgtcaattcggtgtgcgaaaacacggcgggaagttattgcgtgggatccgtgggtggtcaatgcaccagcgacggagattgcaatcctgcttattcttgcgacaattgtatttgctcttacactgcacccgatgctttacaagacgtcttggtacccaattgcggtatcgctcaaaccatcaactgcggaagtacggtcagttttgccatgcaagaaagtattaccaccacgtccggattgacttgtcctacgagcgtcatgaacgtaggatatcccgtggcattcattagagtcataggagcatttttgactcaaaacgttaccttgtcgttttcgactcaattcaatactaccgctcccgtagccg

SEQ ID NO: 29214 - DNA, 219 bp, Sorghum bicolor
  Clone ID: 9297509
aaccatcgagcgctaccagcttggcttcctgatttcagcccttggctgtaacctgtccaaccttctggttttcacgcccatgactgttgagatgatgatgaagaggcacaagatggagaaggacctcggcatcggcactgaggtcgggtactcgaagaacgcggagactgcaaagaggagccccaccctggcagcgatgaaccggaagttcgggatgat

SEQ ID NO: 29215 - DNA, 346 bp, Sorghum bicolor
  Clone ID: 9297522
gcacgagggccgtttcagttctccgcctcttccgcccacgcgcgccgctctttccgaactgaacccgcgctcccctcggcctcgcttcccccctctaaccgccttcctctccccctctcctccccccactcctcgccgtctcgtgccccgccgcccggcagcagcggtccaggcagaagcgccgctcttcggcggccgggatggagaaaaaggagcacgagccgcggaagctcttcatcggcgggatcccacgcgtggggctcactgcggacatggtcaggggccacttcgcccgctacgggcacgtggtggaagcgctggtcatggcgtacccggacgggttcag

SEQ ID NO: 29216 - DNA, 248 bp, Sorghum bicolor
  Clone ID: 9297530
cgctctcgtattatctccccgttctccggtcctcttcgcgtgcgcattgacgacgaatttctagagcgccgtaccgcgcacgactcccgagccgagcccccaccgcgaagccgcgccagaatcgggaggcagccagcctttgccttgccttgctccgcggcgagaggagggtggtggggggtgatgtacccgctggtgacgggcacgccgccggcgcggctgccggcggcgccgcgggtggacaaggc

SEQ ID NO: 29217 - DNA, 523 bp, Sorghum bicolor
  Clone ID: 9297538
gcagggtaggtcgtgggcaccatgctgccacgggcggagctcctccctccgctcaccgaatccccacaaccccctttctcaacctggcgcgccctaccccgatccatccaatccacgtcgaatctgccaaggcggcccccgactcccaccactagatcgcgggctactccctctccaaggggattggggtggggaaaattcatcgcctccaagcccttcaacgtggggggatttgactctgcgatctacttctacaacgacaggaagagccaccaggatggcggcatggcgctgcctacatctcgctctccatagccctaactgcgattgtgagaggccatgtgcagacaactgccagcaaagccagcacgcgccaagccaaaagcaacctagcggagcggatgtggcctcaagtcaaaatgtagtgtgcaaaattagcaaaagcatggtgcgagatgtggagaaggctggaattgaattgcttgcaggtgttctgagttgaaggactctatgttgccgtggg

SEQ ID NO: 29218 - DNA, 189 bp, Sorghum bicolor
  Clone ID: 9297543
caggaatatcaccccaatattgaacgctgtcgcctgaatcactgtctttctcagagaccgacttggaagcctcacagcatgaagcgacagaggcggccttgttccattcggggtaattgaagggagttgcaggattaacagcctgcttctcaccatacatggaacgcacggggccctcaaagatggact

SEQ ID NO: 29219 - DNA, 467 bp, Sorghum bicolor
  Clone ID: 9297566
cttcctgcttcttggccggcggggcggtggcgatgacatcgtcgaagaccttcttcagtgtcagattcacctcgttgatcttcttgtcagcttctggggacgattgctgaggcactggtggcgaaggagcggcttccacggcggctgtgatggtagcaacaaggatgattagtaggaggatcatcacggcgaggtcgtcgcggtcaaggacttgtttgatcagaagccgagaaggaattcaaggtggaggtagaagccatcggcaaagtgaggcacaagcaccttgtcggtctcatcgggtactgtgcggaaggccctaaacggatgctcctttacgagtttgtcgaaaacggcaacttggagcagtggctgcaaggcgacgtcgggcctgtcagccccttgacgtgggagacacggatgaatatcgccgtcggaacggccaaagggtccattacatttgggaagct

SEQ ID NO: 29220 - DNA, 450 bp, Sorghum bicolor
  Clone ID: 9297572
tgacgacggaacgaagagctttgccatcatcaaccagaagggcattgaccctctctccctagacgtcctggccaagaacggcatcctggctctgcgaagagcgaagagaaggaacatggagagacttcagctcatctgcggcggaattgcccagaacagcgttgacgacctaacacccgatgttctcggctgggctggtcttgtctacgagcagaccctgggcgaggaaaagtacacctttgtcgaggaggtcaaggaccccaagtctgtcaccgtcttgatcaagggacccaaccagcacaccattgcccaggttacggatgctgtcagagatggcctaagaagcgtctacaacatgattgttgacaagagcgttgttcccggcgctggtgccttccaggttgcctgtgctgcccacctcaagagcgatgccttttccaagacggtcaa

SEQ ID NO: 29221 - DNA, 530 bp, Sorghum bicolor
  Clone ID: 9297573
caaattgccataattaacacacacagctagctgatcgatcagtgttggtgcactacgctcacaagctcgatcgtaactagctagctctggtcagctcagcttcgtctccgatcgtcggctgtttataatttgctcatcacggcaatgacgacggcgacgacgactaagccggcggcggaacgcagcgggcggcgctacgcgctgctgctggcgctctgggactcggagtacgccaaggaggtgtacggcgggtactacaccgtcttcgtctccgcgttcggcgacggcgccagcggtggcaccgacgagaggtgggactccttccgcgtgatcgccggcgagttcccggcgccggaggacctggcgtcgtacgacggcttcgtggtgagcggcagcccgcacgacgcgcacggcgacgagccgtggatccggcgcctctgcgcgctcgtccagaccgtccacgccatgaggaagcgtgtgctcggcgtctgcttcgggcaccaggtcctgtgccgagcgctgggcggaag

SEQ ID NO: 29222 - DNA, 535 bp, Sorghum bicolor
  Clone ID: 9297579
cgcgcaccaaaatcgcgtgccttcctcctccagattcgcttccctccttcccactccaaagcaccaacccgattacccgagctcccgccggccgcgctagaccctgcctccgccgcgccgcgtcgctgcctcggacgccacccgcgcgcgcactactcctctcgccatcgcgctgcgtggcggcgtcaaatggatatgggaagcgggcccgcgctccagtacctcctgtgcctcgcctgggtcgcggccaccctccctatcgccgccgccgcgctgccgatccccacggccgccggcggccgtttcatccacggcctgctctgcgccttctcgtcccgcgggaagacagtcaggccctcggtctcgtcctcgtccaagacgagattcaccgttccacaaaaattcttcttgcatttttacgtggtgggtgcggttgtgacgactagcttgctacttgcaatatggttctatgcatacatgaaaatgacacctttgatgccggaaccatcgagttactccacaattgctagccatc

SEQ ID NO: 29223 - DNA, 461 bp, Sorghum bicolor
  Clone ID: 9297595
gggcgtgagcccgggtcgaacggcctctagtgcagatcttggtggtagtagcaactacgtgatcgactggaagaaagtccgcacatacgtcgtccctgaaggcctggatacattcaagctcactcctttcgtctctaaacgcatggagccgacaccctccgcatacaaaaagcaagttgaacggaacgggcgaacttacacggtaatcgacagcctcaagggtcatgatttcctggatcagtggtactcgagcaatccagatgaggttttggcgcgcgaatcggccgagcagcaggccgcaggcgagttgaagacgccgaagcaataaagcaagactcgaattagccacgcaaactcgcgctgagttatatgccacttcgatccaattggttgaacacttgaattgccacctacatcaaaacactcgacggcacccacacccagatctacccttacatcgc

SEQ ID NO: 29224 - DNA, 272 bp, Sorghum bicolor
  Clone ID: 9297613
cgctgggcatccagggacacccgcagtacaccgtcgacatcctccacaacctcatcgaccgcctcaccggccagaaggccatccggaggagcgtcggcgaggaggcacgccggacggtcgcggagaccggcgggccggaccgcgcgttctggacggcgctctgcaagggttttctccggggcggaggagatcgtacgcagcctgctctgccggcgatgcgggagacgacggcggcgccggaggtgaccagctgcgccgtcgctggctgcggc

SEQ ID NO: 29225 - DNA, 569 bp, Sorghum bicolor
  unsure (1)..(569): unsure at all n locations
  Clone ID: 9297616
cggctatgtcctcctcttcgactacctccggtgcatggggtacagcaacgtggaggtcatatcccacaagaccttcgccgccttcccgccgctcagatacctcatctacaccgccacgtatttaagcctgcaccacagggagaaggactgcaatttctgcctgttcatgcctctgttcgacgccctcggcgggaccatcagctccaaatcgtgggagcttcagaaacaggtcgaccaaggcatgaacgacncgggtgccggacttcgtgttcctggcgcacgtggtggacgtggtgtcgtcgatgcacgtgccgttcgcgttccggtcctgcagctcgctgccgtggtccacccacctcgtgctgctcccgctctggcccctcgccttcggcttcatgctcctccagtggttcttctccaagaccttcaccgtcaccttctacttcctccgcggccggctccaccagacgtggagcgtccccagatatggcttccagtatttcatcccgtcggcgaagaagggcatcaaccggcagatcgagctcgccatccttagggcagacaagatg

SEQ ID NO: 29226 - DNA, 125 bp, Sorghum bicolor
  Clone ID: 9297629
gcacgaggcacacacggacacaccacacgcgcgcacggtgcacgaacacaactgattcaaactgctagctaagcatggcgagcggcggctactactacgaccagagcgcgggctacggcggcggc

SEQ ID NO: 29227 - DNA, 588 bp, Sorghum bicolor
  Clone ID: 9297647
gcacgaggctaatatttacaattttcaaaactggaataattctttcgtctgaggaagctcgcagtcgcagtacaacaccgaagaccgagacatgtcaggctcagaaccctttccgctgctaaacacggcaaacgatcagctgcatcagcgtcgtcccgcagaccaagcagattcctacgtcagcagcagcaacaccacagccacccaagacgccatcaacaacgctcggaggcgacgtaagagtagtcttttgggcggcgagatcagaggtgacacgggtgctccggcattggcttctagtcgtgccagtctcgaggcctcagataaccactccaatggtcactccggcggccgcaagcgcctctccaaacgacggcgtgctcgtggcctcatcggtcgagccaggcagaccatgatcaagcatactttcgtcctccctgccgtcctcctcgccttcttcctcgttggttatgccatcaaccctaccgagtccaaccctatccaccacttcatcttcttgtcgtacaagctccctcaagatgaccccaacgagcctgcgcagtacggaaagggacgctgggatatcgc

SEQ ID NO: 29228 - DNA, 109 bp, Sorghum bicolor
  Clone ID: 9297657
ctttcaacgaatcaaagactcttactgctgggcagagtcctactgttgtatacacagatgttgggccaattggtattggtatatgctatgacatacctttccaacaatt

SEQ ID NO: 29229 - DNA, 439 bp, Sorghum bicolor
  Clone ID: 9297665
actgctagaggaaaggacttggacctcctttgtttccaggaaagtatcggaagaacggagtgagggttggtgagacgaattaatggatcaacatcatctaatgaccacatcgagcgagggatgccacgaaacaggcgcatagctgtatttctcacttttcttttgagaccacggaggcagcgggatgggatgggatgggatgggatgggaaatggatggtaatggagttcaactgggagtggttggacctcactgtcgcttttgtatcaaatatgccggcgttccgagggagtccgaactaaacggactaattatctgctgtattgtgttgcagtggcaggttgccgagttggacaacagacagccatacattcacatgcgtgtacatgcacgtacatgttgggcttgttgtgtcaacattgggagccaagagggcttc

SEQ ID NO: 29230 - DNA, 410 bp, Sorghum bicolor
  Clone ID: 9297680
gagggcgccgacggacgaggtggcggccgggggcatggtcgggctgttcgcggcgtgcacggcggtggcggcggcggtggaggaggaggtgcgcgagggggcgcaggagcggtgggacgcgtgcgtggcgagggtcaaggaggcggtggccaacgggacgctgtccgtggccggctccccgaggttccgcgtctacgacctcgactttgggttcggcccgccggcaaaggtggacatggtgtccgtggccaagaccggcgccatctccgtggcggacgcgcgtccaggaggaggtggcggcgtcgaggtcggcatctctctgccggcggcgacgggggacatggaccgcttccgacagaccgttgcacaagggatggcgtggctcctttaatttaatttcgatcggctcc

SEQ ID NO: 29231 - DNA, 536 bp, Sorghum bicolor
  Clone ID: 9297695
ggggcggccagcaccaccagcgggaggggccgtcgtcgtcgtcgccgtggggcgtggcgctcgcgctcgccctcgtcctgctcctcgtctcctaccagtcctgcttccaggacctgtggttcccgctggtcaaacgccggtgatcgagctcagtccaagccttgcaggcggcatcacaagcttcctgcagtgctgctcgatcgcgcgcgccgcgccggagatggggaagaatcaccagctagcatctagtaggatgctcctgttagcagagcagtggaggcggtgtgatttcgacaaacacacttgctagctggtagctacgtgactacttaaacgtatttagagcggatttatttcgatggacagattgtcagttagttcatctacacagactgtgatcagtagtagtataaagtgtaattacttaatgtaatgatagatactgaataatataataataaagaaaatggcagaaaattcttgcatctgtcaaatgctgtatactcctattatagtagtagtagtagtatatacaa

SEQ ID NO: 29232 - DNA, 247 bp, Sorghum bicolor
  Clone ID: 9297708
gtgggcaagggtatgggcagggtggtgggagcgggtatgggtctgggtatggcgagggtagtgggtctgggagtgggtcgggcaatggggtggtgggtatagggagtggacaggggtatggtcatggttctaactccggtggaaaccttgaagtcataaatgtttcttgttgtatcctgcagtgtattttgttctactagtagaacatattatctttcctttttctgtgtaaaggaaatagtttgtg

SEQ ID NO: 29233 - DNA, 525 bp, Sorghum bicolor
  Clone ID: 9297713
gcacgaggcccactcgctcctccgcccccgccgccgccgcaatggaggaggagccgccggcctcggacctggcggcgcgcggcgacctgcgctcggcgcttcccttcctccccgtcgtcctccgcggcggcgcgctcttctggccgcccgcggcgcaggagtcgctccgggcgctggcgctcggccccgacgtcagccgcgtcgcctcgggggacgtcctcgccgacgcgctcaccgacctccgcctcgcgctcgccctgcccgcgctgccccagcgcgctgccgacggcctggcgctcttctttgacgacctcctctcccgggcccaggcgcggggctggttcgccgaggtcgtccccaacctcgcacgcctcctcctccgcctccccactctgctcgaggaccactacgccaaggccggccacggcgcctccgggctccgggtcctggcgtcgcaggacgcgggccttgtgctcctcagccaggagcttgtcgccgcgctgctcacctgcgcgctcttctgcc

SEQ ID NO: 29234 - DNA, 534 bp, Sorghum bicolor
  Clone ID: 9297733
gcacgaggccccattgaagtctcagaggctatatcgcaggatactgtgccttttggttatggatacatgcggtttttagatgtgtctttggctgctgaaacctgtgaagagctctttacagcaaacgctcctcggattgacttagcattgaatggtgttgaggttttcatgaatgcaagtggaagccaccatcagttaaggaagcttaatcttcggattgattgcataaggaatgcaactcaaacatgtggcggtgtttacatgtatgctaatcatcagggatgcgatggtggccgtctttattatgatggttgttgctgcattgcggtaaacggtgatttgatagctcagggatctcaattttcgttgaaggatgtagaagttctggatgctctggtagatcttgatgctgtatcgagttaccgagcatctgtttctagtttcagagagcaagcaagccacagaaaaaatgtaccttttgcgaaggtaccatataagctttgccaatcatttgagagtggaatgattgcgact

SEQ ID NO: 29235 - DNA, 553 bp, Sorghum bicolor
  Clone ID: 9297741
gcacgaggtttccttttttatacatgcaaacgatgcatgccgtggcgagtagatgctccaactgcggcagctacggccatggctcgatagcctgccgcatcgccaccgcagaccaccagagagggagtgaagccgccaccatgcgctgcggccgcggtggcgccgccgccgccgcagggctgaggctgttcggggtgcagctccatgccgcctcaacatgtagcggtggcgccgccgctccgacgacgccgacggcaccgtcgttgcagctgcacaggagctacagcgtggactgcggctgcctgagcctgcagggcggctggcctctgcctgtcgcgctgtcgccgtcgtccggctgcgacggttgctacctctcggacgacggcggtcgcgggtcggcggcgttgcgggagcgggagaggaagaaaggggtgccgtggagcgaggaggagcaccggctgttcctggtggggctggagaagctgggcaggggcgattggcgcggcatctccaggggcttcgtcaccaccaggacgcccacgcaggtggccag

SEQ ID NO: 29236 - DNA, 597 bp, Sorghum bicolor
  Clone ID: 9297745
gcacgaggcacgactggctctccaaattggaacttcgatggtcccagggtcagcgcctcacttcctgagccctgtacacagagtcaactacgagacctggaatcactctccgaggctttccgctatgccgccctgttatacacggagcgtctagtgagcccatcgctaccttcaggccaccagagtatccagagccttgtcagccaggtggtctattacgcaacgaacctggacacaggaagtagcgccgagaagtttctactctggcctcttttcgttgcgggctgcgagtgcgtcaatgaattacagcaaaacatggtgcggtccaagtgtcgtgatatcatgttccgttctggttacatgaacaacttggcggctctggaggtgctggagaagttgtgggcccaagattcggcgggaggagagccgttgatgttggggaccaggaccggggatcaacgcggaccgttcaactggaccaaatgcatcgggggacccggagtggaggtggagtggatcatgttttgatgtgcagggatcttcggcgattgacatgtgaaggcgtttgtgctcggactggactgaactgggctgaga

SEQ ID NO: 29237 - DNA, 411 bp, Sorghum bicolor
  Clone ID: 9297765
gcacgaggcaacattacatctttactcacaacatagtatccttcactttgtacaaacccttcttatctaacctgcttataatacgcccccagcccatccatcatggacgtcttgctcaacagctctggagaccttccagctgcaaagcactttcctatcaatcctcccagcacattaaagacccgcgcccacataagtcgaaaccacttcgtccgcgccacagcaaagcgtcagtcccagcacaaaggcgccaacctgtgccgcgagaccgggtttccctgcacgacttcgaattacggagaagcgcactgtctgcgctgtggacaacaggatagcaacacaaacggaggcgcgcgccggccccagctcaaaaagattctgcactacgagatctggacggggaacttgcag

SEQ ID NO: 29238 - DNA, 599 bp, Sorghum bicolor
  Clone ID: 9297786
gaacggcgccggcgccggcgccggcgccacgaagaagagcagcaagcgccgctccagcctcttcgacatggttaattaaaaaaacgctactcgtatctgaaatcgttcggttaatttgtgttccttcctttattttgatctgcctggaagatcaaattaattaattatacttctgagaaacatgcattaatttcgatgcgtggcaggttcaggaatgtgagagtggaagcagacacgtcgtgctcgtcgtctccaacacgtcaggttgcaaggccgccggaagctcgaactctctgtctcccaaggcatcagtttcagagatggacgaggagcagcaagcacatggacggtaccattgctccccgctgaacctggagcttggcatgtccctatcatcgtcgtcgtcgtcgacgacgccgtccattggaacctagcttgtgtgcgtgccacttacactgcccaccgtcgatccacgaatcgcaagatcgaggagtgaaaatggcaacaagtgtgctgaagctgaagctgaagcaaattcgacaaccgacatgcatgaagatgcatggttgtaaacgaaacttggatcgatgtaatgtaaa

SEQ ID NO: 29239 - DNA, 224 bp, Sorghum bicolor
  Clone ID: 9297790
ggacctgattcagaattggagtcacctggcgcacacgttaatggatctaggaggatctggaagactcggcataatgctcctttttttttccatttcgttgaagtgaacatgaaggcacgattagtgaccacttggcacagaaacatctccgtggtgcagtttgtgaatccaggagcattcctctgcccgtagatttgcatggtagaagtttctttcccccttcc

SEQ ID NO: 29240 - DNA, 552 bp, Sorghum bicolor
  Clone ID: 9297800
gtggtgcttggttacagacaacagtggcagtaaagcaataaccttgcttctctaggttttctgtgagtaagctcttgcccattacttgatgtataacaaatgtataatttacttttctgctaatttctttctagttaatgtttttcccttttttgtctttttgttcagatgacatcagatatagtagtgaagttgaaattcttatcctgatcatacaagaaagaaaatccatacttgttgccctctagcacatctgttccagcatttgttcaatgatcacatgatctacagatgccatatgggagaacaaaataatggcagaagcaaagtattgatactaatcctacccgaaacttgtagatggctatggtgcagaattaactacctgctgttttgttgtagcctaggagtagttggcctacattgagctgagaggaaaggaagtagctatgaggtagccatttattctattaagcaaccgtcacattttcatagttcggagtgcatactctgtaatcacatacagtttaacaatgttatgtattgtgatca

SEQ ID NO: 29241 - DNA, 567 bp, Sorghum bicolor
  Clone ID: 9297804
tccgcccagccaagcaatcccaatcccgcaagaagcgcgctcagagcttcagcttcaaccagccgctccatctcgatctctccttcacagacctcggcggctcccaagccctcgcgcagatcctctcctcctcagacgacaacacagccccttccaccacaccgtcatcacgcagtttcgctcctctgcgggtaatatacgaactcgacggttcaaacccctccttcgacgttgatacgtcgcaaccgcctgatttgatctcagattatgattgcgtttcggacagtgaactcgatgatttgccctctcagcgggagtttctagatagtgcagctacgcctggttcggagacgtgggtggtgctaggtgacgactcgtagcaggtccgaactcggaatacacaaactgcagttttgtggttctgagtcaagatagcgatgggagagcctcatcgtcggactggtcctcattaaacctggcgctgcttgggatgtttctggactggggtgaggcgctggtgctcgcaggaattgcttgagcatcgcgatggagttacttacgggtaac

SEQ ID NO: 29242 - DNA, 490 bp, Sorghum bicolor
  Clone ID: 9297809
aatcaagagcatgattcagtggattgctgcatcacaggctctccggccttttgttaattactacacttttgaggatgcatctctggaaagattagaggaggtgatccagtggatactacgccatggctggacggtcagtgagttgtggcatatgctcatcgaatactcgtctcagaggctgagaggagaaacgtacaagggtttttttgcttggctacttcccagcaacaggcccaacaatgaagtgcattacatgtctgaatagccccagctttgtgaggtcagaatctgtgaggcgcgtagctctctaggagcgctgtctgttgagtgtgtagttgtctgggcgcgaacagagctacggagggggagaatattagtctatgcatcctggtcggttagcatactagtctatgcatcctggtcggttagcactctggacgctgtgtgtaacaagtagtgactgagctgagtacatgggtgatcgatgaac

SEQ ID NO: 29243 - DNA, 470 bp, Sorghum bicolor
  Clone ID: 9297830
accgccgagaacgatcttgggctggttgcaggtcgatcagatcggcggagatcgatggagctgcagctcgcggccgtgctcggctccctcgtcctcggcggcgcggtgctggtgctgttcttcggcaagtggtggcagccgctggccagcaccgaccggcgcgtcaaggagctggccgacgcggtggaggccctgctgcggctgcgggccgaggtgctgggccacgacccggcgccgtcgtcggatcccgtgcgcgcgtggctacggcgcgtgcaggaggcgcaggacgagttggcgtccatcaaggcgcggcacgacggcgggcagctgtacgtggtccgcctggtgcagtacctcttcctccccacgggcccggtcgcggggctggccgagcagcagctcaaggcggtgtgggcgctccgggagcaaggcaccgcgatcctcgacgccgcgctggccacgccgcaggc

SEQ ID NO: 29244 - DNA, 431 bp, Sorghum bicolor
  Clone ID: 9297838
gttcctgcaaagaagaacggactactacgattcaaccttcagctccactgccgaaaacccaccaagaacaagatctcgaagcagccagacgacaaccagccaggcagcagtccagagtctaactcagcacagctgtgaagcaaagtagcaggctctcccagccggtggtcagcagccatgagtaccatgaagttttgccgtgaatgcaacaacatcctgtaccccaaggaggaccgggagcagaaggttctcctctacgcctgccggaactgcgaccaccaggaggtcgccgacaacaactgcgtgtaccggaacgtggtgcaccacagcgccggcgagttcacccaggtgctccaggacgtcgccggcgaccccacgctgccccgcaccaagtccgtgcgctgcgcctcctgcggccacggcgaggccgt

SEQ ID NO: 29245 - DNA, 470 bp, Sorghum bicolor
  Clone ID: 9297845
gcacgagggccacgaccacgagacgcaacgccacagctctgcatcagccagccgccatcgatggtcgccgtcttcaacaaggacgtcctgagctggtacctcatcacgatcaagctcagggaggccgtcgacgccaacctccagaagtccccgccgccgccgcgggagcgggacctgccgctgcggatcacgaacggcgccgacgcgtcgccgccgccaccggtccagcgccagtcggaacaggaccggccggccaccaggtcgcgggcgctgtccccggcgcacagccccaagccgcaggactcggaatgggtgatcgccatccgcgggaagctcgcgcaggcgcgcgccgaggaggcggcctgcccctgggcgcgcctctccgtgtaccgcgtgcccaagtgcctccgcgacggcgacgagcgcgcctacacgccgcaggtggtgtccatcgggccactccaccacgg

SEQ ID NO: 29246 - DNA, 592 bp, Sorghum bicolor
  Clone ID: 9297850
cgcgactccgctcgccctttccatctcgctcccaccgccgccggccagcttagccatcgggaccttccaatccttcgccggccgttttggttcaggggctgctctcttgatcgtatcggtgtcgacgccccctccccatccatgacgacgcccggctcctgccccgcgaccaccgccgccacccaccctcccgtctgcgacgctggcgccgcaagtaggtggatcgcaaaaattggtgcggccgcgactggtgctcttcggcgactccatcaccgagcagtccttccgccccggtggctggggcgccgcactgtctgacacctactcgcgcaaggctgatgtagttgccagaggctatggtggatacaacacaagatgggctcttttcttaatacatcacatctttccactggatggtttagcaccccctcttgcaaccactattttctttggagcaaatgacgctgcccttttaggaagaactagcgagcgacaacatgttccagtttcagagtataaaaacaatctcaaaacgattgttaatcatttgaaggtaatttctttacgatatttattagttaactttagctgg

SEQ ID NO: 29247 - DNA, 560 bp, Sorghum bicolor
  Clone ID: 9297857
gcacgaggccggctccggccaccatgaactcctactccggcgaccgctcctcctcctcctcctcccgccccaccaccacctccttcgactcctaccagttcgacttcggcatcaacgcctcccgctcctccggctcccgccccctccgcgaccagcggccgggcgcggccaccaaccctccagcgaggccggccaccggagcctcgtggacgcaccagcccgccagcgccaagccgtcgtggacccaccagccttcccccgccacggcgtcggcggccaccatggcggggcccggatcccggccaacctccatggtcggtgacatctttggccggagctggtcctccgccgcgccctcctctgggctcggcatcccgcaggccaacaaccccggcctcttcagcgacctcctcggctccgcgctcggctcctcccgcgcccagtccaacgcgccgctcagatccgccgccgcgccgcaggtatccaggccagccggtgcgaaccccaatgccaacgccagcagctcttccttctcgatgggcggcatggcgggcgcgctc

SEQ ID NO: 29248 - DNA, 537 bp, Sorghum bicolor
  Clone ID: 9297862
gcacgaggccacacacggctgctagctagtgtacacagagtcacagacagaccagtaggccaagtgatcgagtgaacatttgtgtcggctacgtaggcgcagcaatggcggtgagcaccaggaggcggcacagcagcagcaggatggtggccgtgccggcgccggtggttcttggagtggccatggtcgtcgtcgtcctggccagcagcgcgaccggcgcgagcgggcagctgaggatggggttctacgccgagagctgccccggcgtggagcgaatggtgggcgacttcgtccggcagcacgtccgccgcgtgcccaccgtcgccgccgcgctgctccggctgcacttccacgactgcttcgtcaggggctgcgacgcctccgtcctgctcaactccaccgccggcagcgtggccgagaaggacgcgccgccgaacctgacgctgcgcggcttcgacttcgtcgaccgcgtcaagacgctcgtcgaggaggcctgcccaggcgtcgtctcctgcgccgacgtcctcgcgctcgccg

SEQ ID NO: 29249 - DNA, 551 bp, Sorghum bicolor
  Clone ID: 9297864
gcacgaggcgcactcggcactctgcccgccctccactacacagaagcagcacactgcacaggcaaacagcgcaccgccgttgcgttggctggcagtgacagctagccatggaacacctgccactgacctcgccggccaccgccgcggcgtcgctgtccccatcgcagggcgctgggaaggtgctcgacgcgtacaagacggcgctggccacggcggcctccgccgcggcgtacgccgtgatggcgcgcagcatggcgcgggagctgctgcccgacgagctgcgcgccgcggcgcggtggtgcgcggcggccgcgcgcgcccggttcggccgcggcgacaaggagcgccacaccgtcgtcatccgccaccagttcgacgcgggctacagcgagaaccacctcttcgacgcggcgcgcgcgtacctggccacccggatcgacccgcgcgccatgcgccggctctgcctcgcgcgctcccgcaccaaggagcccgacggcagcggcaggtggaacacgctcctgtgcatggagcccgggggctccaccgtcgac

SEQ ID NO: 29250 - DNA, 451 bp, Sorghum bicolor
  Clone ID: 9297873
tgcctaggatgtggctgccgaatcaggatgcgccgggcctcgccatggcaagggccttcggggatttctgcctcaagaaccatggccttatctgcacacctgaagtctactgcaggaaactgtctgagaaagatgagttcttggtgcttgctactgatgggatttgggacgttctgtcgaacaaggaggtagtgaagctggtgtcatcggcgaccgacccatccagggcggcgaggcagctgatcgaccgggcggtccgagcgtggcggcgcaagtacccgacgtccatggtggacgactgcgccgtcgtgtgcctctacctgaaccggcgggcctctcctggtcctggtcctgacgagagcctgcgagtcccaggcacaggagacgacgtgaatccgttcacgggcagcagcttccgcagggctctgacgagtaacggcggcggcggcga

SEQ ID NO: 29251 - DNA, 573 bp, Sorghum bicolor
  Clone ID: 9297882
gcacgagggctttgccaccatcaggaagaaggttcactccacgttgtacgtgtgcgtgttcggttaattctgggctgcaccggccggcctgcacgatggccatggagatggagggtcgtcgtcgtcgacgtctccttgtgtgccttgtgatgatgatatccgcgcaaacaatgctagctgccgtggcggccggcggcgtccagcagaaggtcaagcggcggccggcggcgatgtacgtgttcggcgactcgacgctggacgtcggcaacaacaattacctgccgggggcggacgtccccagggcaaacaagccatactacggcgtcgacttccccggattccccaccggaaggttcagcaatggcggcaacaccgctgacttcgtcgcaaagagcatggggtttgtgagtagccctccgccgtatctgtccctggtggccaactccagccttgtgctcgtgcccaccgctctcaccactggtgtcagctacgcttccgcaaatgctggcatcctcgactcaaccaacgcaggcaagtgcatcccgttgtccacgcaggtgcagtacttcagcg

SEQ ID NO: 29252 - DNA, 561 bp, Sorghum bicolor
  unsure (1)..(561): unsure at all n locations
  Clone ID: 9297892
gcacgagggtccagacatagcaaggattgacagactgagagctctttcttgatcctcctcccccagggcagtaccagcaaccaccaccaccaccaccaggccagtatggtgcgcctccaggacctccaccaggacattatggctcaccaacaccccaaggacagtacggagcgccaccaccaggccagtacggagcccctccacccccgccaggccaatatggagcacctcagccaagtagttatggcggcccaccaacccagccctctcttggttatgcccagcaaacagccaacatcgatatgacgagcgatgttgaagctatccgcaaagccatgaagggctttggcaccgatgagaaggccctgatcaacatcttggccaagaaagaccctatccagattggaactatccgtgcacaatacgaccagcgcttaatgcgcaacttaatccaagatctagagaaggagacaagtgggtactttgaaaggggtttgattgagattgctcgaggacccttggtcgctgactgctacaatctcatggaagctatncaaggca

SEQ ID NO: 29253 - DNA, 624 bp, Sorghum bicolor
  Clone ID: 9297918
cccggatggcgtgtagcatgggtcattggccccaaggaattcatccaggccattggctcctgcggttcctacctcgatggtggctgcaacgtgcccttccaagaagccgccgtagaaatgctatccccaccccgcgttcgcaacgagatgcgcgcgctgcaaatgcacttccggaccaagcgcgactacgtcattggccgtctccaggaaatcggcttcaagttcccgtacatgcccaactcgacgttttacctgtggctcgatttgagcaatctgcccgagggcatcaacgatggattgaacttcttccaggcttgtctcgaggaaaaggttatcgttgtgccgggcatctttttcgacttgaacccgagtaggcgtagggatctgtttgactcgccttgccatcactttgttaggttgagttatggaccgaggatggatgtgttggagaaggggttggattctattgcgaggatcgttcagaagtacaaggatgagccgcagaagcaccgtgctgtgtcgcacaggccgcgtggtactggtgcgcctaactagacgtacatcgtgcatgacgtaggtgggatgaatgagagttgtgggctagacaaggctgaggccgactcg

SEQ ID NO: 29254 - DNA, 503 bp, Sorghum bicolor
  Clone ID: 9297919
cgcctctacggctaccccggcgccggcgccggcaacgacacgacggacccgtccctggacgcgacttacgccgccaacctccgccggcgcaagtgccgggcggcgagcggcgggtacgccgaggacgccgtggtggagatggacccgggcagccacctgacgttcgacctgggctactaccgcgcgctgctcaagcacaggggcctgctccgctccgacgccgcgctgctcaccgacgcggcggcgcgcgccgacgtcgagagcgtcgtgggcggcgccgaggaggtctacttccaggtgttcgcgcggtccatggccaggctcgcgacggtgcaggtcaagaccggagctgagggggagatcaggaggaactgcgccgtcgtgaacggcggctagctgtgattttgctcttacatttgggtgggtgatttatacttggtacaattattatgttaaaaaattttgttacccttgctcgttgttagagtattatcattacttgt

SEQ ID NO: 29255 - DNA, 634 bp, Sorghum bicolor
  Clone ID: 9297924
ttgggtcgatgtggaggcagattttggtgctggtgacagtggtggcacaaccacagagctggatggcctgccaccgccaccatctggattaacagtatcagctgccaaggccaaagggatggatacctacaagggagggcagtacgccgatgctatcaagtggctgtcatgggctgttgttctaattgagaaatcagggaaagatgctgacattgtcgaggtgttgtcttcaagagcttcctcatataaggaggttggtgagtacaagaaggccatcgctgactgctcgaaggtgctggatcaagataaggagaatgtctcagtgctagtgcagcgtgctctcctttatgaaagcacagagaaatataggcttggtgctgaggacctgcgtttggttctgaagattgaccctacacataggctcgccaggagtacaattcaccgcctgaacaagttggccgactagggatgtctttctagtgccctgatgtaatattgtacaaccactgtactgcatccttcgcatgagatctgtgagttatttgaattctttagtctttactatacttgtggctttgggggaatagtttgcaattatgttgttataaagtatggaattgcaaatttacataca

SEQ ID NO: 29256 - DNA, 386 bp, Sorghum bicolor
  Clone ID: 9297929
tcatgagggggtcggaagcaagataagcaagcaacgaggatgcaagaacatgttggatgcatgcatggaggaccagcagatatatggtcgaacttatgcatgagagagagagagagagaagaagaagatctttatatcgatcattgggtacgcatggtgctctacaaacacgaaattgaaggcgttgggtcgtatacctgctgctgcatggggagggcgtggccaggcgccagcccatgcatgcatgcgtcgtcgtgttctacggccagccagcccggccggcccatacacacagcatggagatggaggtgcggttcaagaatcacggcggcgtacgcgtcacgccgccctgtcatcagatggaatggacggatgatgcggacagt

SEQ ID NO: 29257 - DNA, 606 bp, Sorghum bicolor
  Clone ID: 9297934
cggtggccgcaggataaagaaatagttccaaaaactgtcaatgatgtgaagctcatcaatgctggaaggatactggagaatagcaaaactcttgctgaatctcgagtcccagttggagaagttcctggaagtgtgattacgatgcatgttgttgtgcggcctccccaatctaacaaaagtgagaagcaacagtcaaactccccgaagccgaacagatgtggatgcacgatattgtgacgttgatgcaagtagcaatgtgtatatcggtgtccacagggatcacaagttcatttaacaattgattcttgcatctattcttcacagcctaagtgtagagatggtgttacggcgaatcacatctgtttgagaatttgatgcttgcgatcgtatgtttgagtgtgcaggaaggatagttcacggggtcctggtaaaacccttaaaaacggtgtggaggagtcaaggaattggatgtttgctattgtgtaatgtgtagagatagtgataccagaagtgagttgctgcatagtacatcggagacaatctttttcgtagctcgattgcgtatatcggtatatgtcttttgtaatagaaaaaagatgacggctg

SEQ ID NO: 29258 - DNA, 691 bp, Sorghum bicolor
  unsure (1)..(691): unsure at all n locations
  Clone ID: 9297937
agttcgggtcagatttggataacccgatcaaccgggcggcgccaacctttgctgctaaggttgatgcgcaggggctactgaactccctggctgcggaagggaaaattacttacacggttgtctataccggggcgttcctggactggggactccggattgggtttccgcttgacccgcgcaataagaaggctacattgcatgatggtggggagaggctgtatacgactaccaccctggggggtgtcgggaaggctgttgtgggtgtcctgaatcatcccgaggaaacgaaaaatcgggtcctgagggttggagaggccgttacgacaattaaggagcttctggccctgtcgcaggaggttgtggggcgtgagggctggacgattactgaacctgatacggcagaggaggctgagaaggcgcttgtgaagattaagcagggggtgtttacgcttgatacactcatgccatttgtttatagagccatttgggggaaggacactgggggccattttactaccacggataatgagttgcttggacttgcggtgctcgacaaggcgggtctgaagaggcttattcaggatattgttggtgggaaataagtctttgagttacatgaagaccaaattctaggtaggaataacgaaggacttgtttctagaatcgaccaagctgttncacgagtgcagag

SEQ ID NO: 29259 - DNA, 641 bp, Sorghum bicolor
  unsure (1)..(641): unsure at all n locations
  Clone ID: 9297941
catttctttaaacttattgtgctatcaaatttttactgtaaccacaatgcaggactgttctaattccatggttattgtgcttattacaccacctccagttgatgaagaaggaagggaaagatttgcacggtcactttatggacaggatgcgaggaagctacctgaaaggacaaatgagatggctggggtctatgctggttattgcgttgaactagccagagaaatgcatataccctgcattaatatctggtcaaagatgcaggagacagaaggatggcagaaactttacctaagtgacggcctgcatctgactccggaaggaaacgcagttgtccataaggaggtcgtcgaaacattgagaaatgctggtctgaaagcagaacacatgccgtatgacttccctcatcactccaaaatagacgggagttgtccagaaaaggcgttccaatgaactgatttcaagctgtgtgatgatttggagttttggatcctggattgaagattatgatgcccttgaattaaatgatttcnaagttgtgtgatttttggagtttgaaatcctgtcttgaagattgtaatttgctcaggcttctccaaatgctggttttgcttcttctacacttacattttggattaaggaa

SEQ ID NO: 29260 - DNA, 325 bp, Sorghum bicolor
  Clone ID: 9297952
actcgatgggcgcgaggaagttcgccatcatcaacgtggggctagtggggtgcgtgccgacggtgcgggtgctggacgcggcgggggcatgcgccgacggcctcaaccagctcgccgccggctttgacgacgagcttgggccactcctcgccggcctcgccgccaggctgccgggcctcgtctactcgctcgccgactccttccgcctcacgcaggacaccttcgccgacccgggggcgtcggggtactccgacatcgccggcgcgtgctgcggcagcggacggctgctggcggaggcggactgcctgccaaactccacggtgtg

SEQ ID NO: 29261 - DNA, 604 bp, Sorghum bicolor
  Clone ID: 9297959
gcagtccgtgacagatctacagggaggcattggaggcttcgccggcaagaatgctgttcaggtctgccagattctcactagcaagaacgatgcccagctcagagccatggcacagtcctaccaacagcgattcaacaagcctctcgacagcgtattgaaatctacgttttcaggtcacatggaggacgtgctccgtctcctggtccgtcgtgctgtcaaccggcccgaggcggaagccgtccgtctagaagaatccatggccggcttgggcacaaaagacgagttgcttgtacagcgtgttgttcgttgtcactgggacaggaactttatgaacgcagtcagtgccgcgtacaagcagatttataagaaggatctcgtcaagagaatagaaggggaaacacgtggtgattatgaaaggttgatggttgcttgtgtgaagccttgatgaattcatttatcattcgcctgggaggtactctgatcgcatcttttgatgcaattgtttttttttgttcgcgtgcttgctttggcagcatgggaagggataccccaagttggtcggttagaaatagtttttttttattcttcgttcacacgaaggagg

SEQ ID NO: 29262 - DNA, 503 bp, Sorghum bicolor
  Clone ID: 9297965
gcacgagggtcaagtgcgccaagctcggcaacaccaaatccacggaccaggtcctgaacgaggtgcgcgtgctgtcgcaggtgaaccaccgcagcctggtgcgcctgctcggctgctgcgtcgacctggagcagccgctgatggtgtacgagttcatccccaacggcaccctcgccgaccacctgtacggctccatgaaccgcccgccgctccggtggcaccagcgcctggccatcgcgcgccagacggcggagggcatcgcgtacctgcacttcgcggcctcgccgcccatctaccaccgcgacatcaagtcgagcaacatcctcctggacgaccggctcgacggcaaggtctctgacttcgggctgtcccggctggcggagccagggctgagccacgtctccacctgcgcgcaggggacgctggggtacctggacccggagtactaccgcaactaccagctcacggacaagagcgacgtctacagcttcggcgtcgtgctg

SEQ ID NO: 29263 - DNA, 540 bp, Sorghum bicolor
  Clone ID: 9297976
gcacgaggagactctctctcctctccatccatcatcccctttgaactgttgtcaatctcagtttgaaccctaaaaacacatacacatacttctatataccccaaacactcatccacaatgcctagctctctcgaccagctcaaggccgccggcaccaccgttgtcgccgactctggtgacttcgcgaccatcaagaagtaccagccccaggatgcgacgaccaacccttcgctcatcctcgccgcatccaagaagcccgagtacgcgaagctgatcgacgcggccgtcgcatacggcaagaagaacggtaccgaccttgagaaccaggtcgatgtcactcttgacaacctccttgtccagttcggcaaggagatcctccagattgtccccggcaaggtctcgacagaggttgacgcccgcttctccttctccaccgagcagtctgtaaacaaggccctgcgcatcatcgacctctacaaggaggctggcattgacaaggaccgcgttctcatcaagcttgcctcaacatgggagggcatc

SEQ ID NO: 29264 - DNA, 463 bp, Sorghum bicolor
  Clone ID: 9298011
gcacgaggctctgccgccgaggccgcgagccccttgacccgccagaacagctctttcgacaattatggtgtcggcatggagcgtatggaatcctgccagtcccaagccgatgcgctcttcgtccccgatatgtctcctgcttctgtcaacatgtactctgccggcaagcaatacacctctgagcaagatctctttggtctcggcgccaacctcaccgctgccaacgttcagcagtacgtcgactccaatgggaacactctgatggcatcccccgagtcgaccgacatggagcgatcttgctccaacgctagcatgtcaagtgttcgatcaaatgcttccaacttggagcgacgtgctaaggaggcccgagagcgagttctgcaggcggccaagaccatccagctcgcccccaagcccaaggaagagcttgccaaggaagccagtgctgctgctgccaacaggg

SEQ ID NO: 29265 - DNA, 590 bp, Sorghum bicolor
  Clone ID: 9298031
tcacaggtccaggctattgccgccgccgaggccggtgcctacctcatctcccccttcgttggccgtatccttgactggtacaaggccgcaaccaagaaggagtactccaaggaggaggaccccggtgtcaagagcgtccagcaaatcttcaactactacaagaagcacggctacaagaccattgtcatgggcgcttctttccgcagcgtcggcgaggtcaccgagcttgctggctgcgactatctgaccattgctcccaacctgcttgagcagctctacaactcccaggatgaggtgcccaagaagctcattgccgaggacgccgccaacctcaacattgagaagaagagctacatcaacgacgaggctgagttccgcttctacttcaacgaggaccagatggccgtcgagaagctccgtgagggtatctcgaaattcgccgctgacgccgtcactctcaaggacattctccgtgagaagatccagcaggcataaattgcatggtccgataatcggccagggaatgaggatatgatataatttacgacgttttcttccagattaagcattgagacttgacgggaactacg

SEQ ID NO: 29266 - DNA, 518 bp, Sorghum bicolor
  Clone ID: 9298046
cactttcttgtatttgcatataatgtttttctatgatgataaaaccagtatcgtcgcccatgctgtctctggtctttatatgcatggtgcagctgttatgcttggatactccgaattattgcttctaaaagtattcagttctttaatcatgctcaagcattgttcttgcagttggagcagattttggagtattgtaaggctatccagtgtatagtatagtggagttgcttctacttgcctcctctatctctgctcaatttcttccaatctactctacttctcagcctgcagtttactatgtagttattaatctggatgcagtcaaacaatactctgcaagaccaaggcaactgcttgagtagtatagcatgtctaaatgacattgatatccggtaaacttaaacctacttgcgtcagaagcaggttagcagctgtgtgaacgattggcgagcttggtcttcgttttcatgtgaggcattcaaaccttgctgcgaaagcaatcggcatttaattatttc

SEQ ID NO: 29267 - DNA, 104 bp, Sorghum bicolor
  Clone ID: 9298055
agcacagcggcaacatcagcctcgaggatgtcgttgagatcgccaagtccatgaggctcaggtccatggccaaggacatggccggctccgtcaaggagatcctc

SEQ ID NO: 29268 - DNA, 563 bp, Sorghum bicolor
  Clone ID: 9298066
ctgtctgctatcgaagaagacccctgggagaaccttactgagacgtatgatctcttcgtcaagaagctgaatctgaagcccacactccccgaactggagctcgttcgaaggaccgccgagctcatcggcacacgtgctgctctcctttcggcttgtggtgtcgctgctatctgcaagaagaagggatacgaatcttgccacgtcggtgctgatggctctgtgttcaacaagtacccctacttcaaggagcgaggagctcaggccctgcgagagattctcgactggcctgagaagaccgacaagaaggccgaggaccctattgaggttcttactgctgaggatggcagtggtgtcggcgccgccctgattgccgccctgacccttaagcgaatcaatgagggcaacatggcgggtattcttcatcccgagaacttcaaataagcatgagcagggatcgactgatgaaaggagtgtgatgggtatcaaaggttaatattaggattggacggaaaacgaagatagacgtggacttgaatgaaagcaagaatagagacgaaggcttt

SEQ ID NO: 29269 - DNA, 609 bp, Sorghum bicolor
  Clone ID: 9298081
cgttgtgcttatattagattgctgtcggtgtcaggagattacgttttctgttctttactattccaatgagtgattataatataaattagtgcagctggaatgggaatcttgcatagaaacggagggagtacgtaggcataataactctgctgtcgtttctgtgactcttccgtatgccggcgcaaattacccaatcttgacacggggaggtagtgacaataaataacaataccgggcgcgttagtgtctggtaattggaatgagtacaatctaaatcccttaccgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtggtctcgggtcgtccattgatttgatcggtgttaattcttacacaggtaggtaaacaaagagctttgagaatttttctttactgttgctattgtt

SEQ ID NO: 29270 - DNA, 635 bp, Sorghum bicolor
  Clone ID: 9298082
tcgtttcgtcactatttcgacttttttattctcttttcacttcctttttctttaccgtcacggcgtcgatgattactaccttttctctctggtttattttcagcgagtcaccttggcaaactaaactggtggatacgtttcaatcctggctgttgagccctagatgggcagccaagcaaggttcgaccgcttgagcggtgcgaagcctatacgtttattctcagcgcgatcgaaagtgcttcatcgcgcgactacgatatataactgggccgggtcggtatctggaaggaattttcccaggagaggaaaaagaggagtcggttgcattttattactatctattttcgtcacatcctgtacatgaaatgaggatgaagggagttgctggggatatcagagcatatggcgtttttttgttgttttgtgcctgttcggacgggcggtatggcttgaagagttcgccattttttgtgtgctttgtactggttagagcaaagagcattcgggttgggttcggtgtttggggatattcaggggttttagaatctgagcggcatgcagggaaatgcgccgggcttgtatcgttcggttggaaaagtactgagcgaatgggttgatgagtaccgtttgcctac

SEQ ID NO: 29271 - DNA, 587 bp, Sorghum bicolor
  Clone ID: 9298106
gcacgaggattcgacgaagattttgaagctgaactctctgaaaaccatgaagcaagatttgaggtttccatgctagcacaaagtcctgatcgtgaattcacagaggtgttcattaatacagaattatacgctcgtgtttcggttgctgttctctttcatcagctttggaaacaaatcaaagaaaagagtatattggaaactgcagaagctcttgaatgtggcaaactatttctattagaacttctggactctgcggtgaacaacaaagatctttcaaaagaactctacaagaaatatagcagtgtacataggcgtaaagttcgtgtgtggcaaatgatatgtgttctatcgcactatgtagaagatgatatagttggagaagtgacatctagcattcacatttgtctttatagaaataatttgcctgctgtccgacagtacttggagacgtgtgctgtactcttgtacttaaaatttccaaccttggcagaggagcaacttattcctatttttcatgacaaagggatgcgacaacaggcactatcttcatatgtttttatagcagcaaacgtgatacttcactcaag

SEQ ID NO: 29272 - DNA, 615 bp, Sorghum bicolor
  Clone ID: 9298174
cacggagtggcggaccaagtacgacgaacgtgttcatggccatatttcagacaagaagagctggagcggcatggaaggctattccaaggtaaatgccatggagtggttcattcgcaagggcgatgccgtctccgaaaacgagccttacatcacatcctttgtctggacaggccttgtggcacacggtcgtatccgcaagatgcgcatgaccatctactgcgaccagtcgtccgaagaagcccccattgataggaacgccaacgtgcaagtcctggcccacgttgaggccgacgtcagccatattcccgagcatctgctcaaccgtcgccagggcaaagacgggcagatgtactatgaactcagctgcaagatcgaggctgtctatctctccgcctcgactacgtatacgctcttatacaacaatcagcggtacgatacggtcacttgcgaatacgtctaagtggcctagatgaggctttttcttcttcttgttcttttgctttctctcacgtgctatttatttggtgtaaaaggtcaatctgggatgatatagcgaatcatctgtatatagaattccccctaggtaggcaggacaaggtcacggttgcaacgcac

SEQ ID NO: 29273 - DNA, 523 bp, Sorghum bicolor
  Clone ID: 9298216
cttccattaacccctagcgtgctccctcccctgcccccgcctcccaccgcaccccgtggcgacgactgggcggccgtcgctgccgccctacgccagttgccgaggtcttcttcgggcccttacacggcgacgagcaccaccagatactctgagcctgggtgctgaaagttccttctggagttcgttacattaggattcgtttttgatgacttcatcaagaagcaacagcaggagcagaagtaggagccgcagtcgcagcaggagcaggagccgcagtcctcggcgaagagataggttgcgcagtgaacgtgcaccccgccgtagtcgcagtcgcagcaggagccgcagcccacaccgtcgcagagaacggcgtggctacagggatcttgtatgcaagaactgccggagacctgggcacttcgctaaggagtgcccatctgcgcctacgtgcaataactgtaaccttccaggccactttgcagcagaatgcacctcacaaactatttgctggaactgcaaagag

SEQ ID NO: 29274 - DNA, 459 bp, Sorghum bicolor
  Clone ID: 9298219
gcacgaggggagcttccgcctcggcggcggcgccgcgccggcgctggacctcgcgtcgcttccgtcgctgccgcggatcaagagcggcaggaaccggacctcgctcatcctcgccgtcgcgttctcggcgttcgtcgcgctcgtcgtgctcgcgggcgccggcgcgtacggcgcgtaccggtacaagaaccgcgacatcatcgagccgtgggagctcgactacggcccgcaccggttcaagtacgccgagctccggcgggccacgcgcgggttccgggagcgcgagttgctgggttccggcgggttcggcaaggtgtaccgcggcgtgctccggggcaagtccggcgagaccgtggccgtgaagcgcgtgaaccacgagtcccggcaggggctccgcgagttcgtggcggagatcgcgtccatcggccgcctccgccaccggaacctggtccagctcca

SEQ ID NO: 29275 - DNA, 492 bp, Sorghum bicolor
  Clone ID: 9298230
gcacgaggaattttgctgattcatgtcccagagagagaaattatctttgaaaggactcagatagagacttgtggtacagacttgagctaaaatgatgcaaaaaccaagaacatgtggtggggcgttgtgtagcgatttttaggtgacaaaatcggcctttaatgtttcataaacagacaagatgcctccatgacttggtggaccagaggatatgtatggtggcccataacaatcctggtgaacgaaaacagctcgacgggttcataccatatgggagtatgggaccatatcgagtccacttctatatgaataggcctttagaagataagatctatatccaattatgagcatgactgcttgaacgcattcaacagtaagtatggcatcaacatcagcaaaagctgggttatggaccagcaagtggtgcatcaagctatcaaacatgtggagcatctatatgtcctgtaaacatacatgtggcttttggaagtg

SEQ ID NO: 29276 - DNA, 529 bp, Sorghum bicolor
  Clone ID: 9298239
tcgccccgcatccaccctccaagcagcaagcagcagcagccatcggccatggccgcggcggccttcctctccgccagggcggcgcccgcgctgctctctcccttgcgctcgcgcaggctgtaccgccgcctcgtcgcatcctcgtcctccgccgggggtcaaggtggtggcgggggagtggagttccaggggaaggtgggcttcctggggctcgggatcatgggcgcgcccatggcatccaacctcatcagcgcaggctgcgacgttacggtgtggaacaggaccaagagcaagtgcgatcccctcctcagcctcggtgccaagtacgagccttcaccggcccaagtcgcttcatcttgtgacgtgacattcgcgatgcaggctgatccacaaagcgcggctgaggttgcatgcgggtccagtggagctgctgaagggctggcccctgggaaaggctatgtcgatgtgtcgacggttgatggtgctacatccaagctgatcgctgaacgcattacaagtaccgggagat

SEQ ID NO: 29277 - DNA, 310 bp, Sorghum bicolor
  Clone ID: 9298278
gcacgagggaacaacaacgacagactctgaacatctttccatcgcagccaatgcatgtggccgagccaattcctgctaagggtgttagcatgggcatggtgacagccagcatgcttcccaatggcaactcttattcacccaagagacaagagcaaggtggccagcacaggagtgtcgctgctcctgcaggccccgttgtgccggtgcctagtaacaacttagccaaggataacaggaatagccttactaagaaggaagaaactagcggtggaaagggtgcagcatctgcaggtattgttcaggagagagt

SEQ ID NO: 29278 - DNA, 562 bp, Sorghum bicolor
  Clone ID: 9298287
gcacgaggggaaagtctctgaccagtagttctgctggttcagcagatacagatgatgtccataatctgccattatcatcacgtcgagaaacattttccagtgacgagtataaaccagtcggtgagccgattaagaagtacggtgttgaacttcaagcttcaggggaggcagtatatgtagatgacattcctgttccaaagaattgcctctatggagaatttatttacagcacacaaccccttgcttatgtcaaaagtataaaattcaaatcttctttagcatcagagaagatcgtctcttttgtttctgcaaaggatattccaagtggaggacaaaatattggatcatccttcacgtttggtgacgaaccactatttggttatccaattgctgagtatgctggtcaagctctaggcattgtgattgcagaaacacagagatatgctgacatggcagccaagcaggttattattgaatatgacacagaagatttgagcccagcgatcataactgtggagcaagcagtggaaaagagtagctactttgatgtccccccagaatt

SEQ ID NO: 29279 - DNA, 556 bp, Sorghum bicolor
  Clone ID: 9298288
gcacgagggtagaacgaggcctcgctggcctgcctataactcgcctctcgtcactccccaaaaagacttcgacactctccataccaccaattccctgtacacatccctggaaccagaccctataccccgcgatggcctcgactggtgcccaagaaaacgcacaagtgcctgcaagcccacagcggagaggaggcagaggccgtggacgtagcagaggtggaaacggcggggcagaagatggccacgatagctttggggggaggggacgtggacggggcggctttcagagccgtggacgaggtcgcggcaacagagatggcgcgggcggtcgtggtggacatgcgccagaaaagggcaaggcgcctgcgatagaggcagaagagaatggacaggctccgcctgctctcgcgaagccgaacctacagcaatcggacaacgaagacgacgacgccgaagtctgcttcatttgcgcctcgcccgttcagcacacagccgttgctccttgcaaccaccggacatgtcacatctgctctatccgaatgcgcgccctgtacaa

SEQ ID NO: 29280 - DNA, 511 bp, Sorghum bicolor
  Clone ID: 9298296
gcacgagggctaaatacacgcagcaccctcacggcctcaccgcacttcgcaaagctacgtcgtctctcgtagcagccacacacgcaccaccatggcgacgaccatcatcacggtgacaaggaaatcccagtcgttcgtcgtgccgtcgtcgtcgtccgcgccggtgccgacgacggccgaaacgctggagctgtcggccatcgaccgcgtgccggggctgcgccacacggtgcggtccctgcacgtgttccgccgcaaggcggacgacgacgccgccgccgccgccgctgctgccagcaggaggcctgcggaggtgatccgggcagcgctgtcccgcgctctggtggactaccgtccgttcgccggccgcttcgtcggctcgctgtacgccggggaggcgtgcgtcgagtgcaccgacgagggcgcctggttcgtggaggccgtcgctgactgcagcctcgatgacgtgaacggcctcgacgactacccgctcatggtctccgaggaagag

SEQ ID NO: 29281 - DNA, 644 bp, Sorghum bicolor
  Clone ID: 9298304
ttcgggcgcgacagaaccgaaagcctctagcggacattaccagcgaaggtgtcttgacccagttgatgaatgtcgcccaatcagactataatgagtccggtctcggccgcctggaacctgctggtagacctcgcgcttcagcacctccaatccaggtgtcttgccgcagctggggctctgaggctgaacgtagcgaagctttgtttaacgcaccaatccgcaagattctctatggtcctaccttctttgaggagaaggctctcgtggagaagaagcttcccgtggaattatggcccactcgtgagatgctgcctaagcctgatcatgagaagaagggcttcaccaacatctctgttccttcaatgcggcgctttgttactgacagtggcaagctagctaagctcgatgaactgctgttcaaactcaagaggaggtcgacagcgtcaactagcaacgcttgtaatatcaaacgcaagactttagagccgcacaggctcacgggaagacgaagggagttattcatgtatctgctacgttactcttttttctttttttcttgttgtcaggcgaaggaaccgtcaatagggggagttggaagtgaaaatgccgataaaccatagcagggcagcaaagcatcgtattgg

SEQ ID NO: 29282 - DNA, 413 bp, Sorghum bicolor
  Clone ID: 9298314
ccgcaggtgatgaatccttgacaagagagtggcgcccctccttgatgtcatggggaagtcaagattttatcttggcgatgtaggcaatggtgcggcaatgaagatcgtggttaacatggtcatggggagcatgatggtttccttctcagaagggttgctcctgagtgaaaaagttggcttagaccctaatactcttgttgaggttatttcccagggtgctatcagtgcccccatgttctcccttaagggcccatccatggttaaagctgcatatcctactgcctttcctctgaagcatcaacagaaggacatgaggctcgcattggccctggcggaatcagtgtcccagtccattcctacagttgcagctgcgaacgagctgtcaaggctgcaaaatcgcttggccttagtga

SEQ ID NO: 29283 - DNA, 319 bp, Sorghum bicolor
  Clone ID: 9298330
tcgatgttgccattgccaaggtttggcaagctaggaccagggcaatcaagtacaatccagatgtcaaggtccatgtttgcttctttgccaacactcgccacctcctcacacgggagcttccaaacgatgggggcttctatggaaattgcttctatccggtgactgtaacagcaactgctgagggtgttgctagtggaggattgcatgatgtgattaggatgatacgggatgggaaggctaggctgcctttggagtttgccaaatggtccatgggtgatgtgaaggtagacccatatcaactgacattcaagcacaatgt

SEQ ID NO: 29284 - DNA, 564 bp, Sorghum bicolor
  Clone ID: 9298337
tgccatctcgagttgcgtcgtcaacaaatgtaaacaagaagcccgttggagcggacgccttccctgctctcccagcagccgcaaaacccaccagtacactcttcagtccaggatatactggccgcgctctaacgcgcgataacagcggtcgcaatacaccagtgagcaatccttgggccggcccatctggggcaaacagcggaacatcaacgccagctctggaggatgtcggtgcggcagggaagaagaagggtaacaagggcaaaaagcaaacactcttccaatggggttaagcaaccatcatgtgcattctaagatataagcaagcatagacacgacacggaagcacaagggtagtgctggtcttgcgattctgagctttacttctaggtttgccaagctgtttatacagaaatgaatgattcatagactgacgggttctggtctcatggccgcctgtgccaacgaaaaaggcaaaaatgttgttgggtggaggcacacagcatgtactgcatcacgcgcactctttcttccaaaggcacgcttatcataggccaaacctca

SEQ ID NO: 29285 - DNA, 374 bp, Sorghum bicolor
  Clone ID: 9298346
agcatggaagccacccagcagaacatctcggacatcgtcgttgctcatgatgtcgcccccgccaccttcatgggccacatgtccctcgccatgaacaaggtcgccgctatggagagcttcgtcatgcaggcagatgggctaagacagcagaccctccacaagctccaccacatcttgaccaccagacaggctgctcgttgtctgcttgccatcgccgactacttccaccgcctccgcgcgctcagcacgctctgggttgcaaggcccaggcaggacgacggcccggggctgcagtagtacatgtatgatgaaagctcagctcacacaataaaatgacgaagaagaagtacaataatacatgcttgtgcaagatc

SEQ ID NO: 29286 - DNA, 319 bp, Sorghum bicolor
  Clone ID: 9298383
gttgactgcaccaatgaacgggcctgcaacaactgccgtcagccagggcacatagctcgggagtgcaagaatgacccggtttgcaacctgtgcaatgtctctggccatgttgcccgcgtctgtccaaagacgactttggcttcagagatacagggtggcccattccgtgatatcctttgccgcatctgtggtcagccagggcacatcagccgcaactgcattgcaaccatcatctgtgacacatgcggtgggagggggcacatgtcttatgagtgcccgtcggccaggatattcgatcgcgggctccgcaggttatgag

SEQ ID NO: 29287 - DNA, 500 bp, Sorghum bicolor
  Clone ID: 9298393
ggcacgaggattccatctagctagctagccaaataatctcgccagtccagcacgacgcgcggcggtgcttggccgtccgtcggtccggccggcgtacatacatactgctccgtacggggattgccggagaggccggtcgccgggagaaacgccctgcgagggagagggccggcggcgggaattggtggagagacgagggagatggggatgaggcccgggtgggtaggcgggctggtggaggagagcttcttcgtgggctgcgcggcgcacgagaaccggaagaagaacgagaagaacatcttctgcctcggctgctgcgccagcatctgcccgcactgcgcccccgcgcaccgccaccacctcctcatccaggtgcggaggtacgtgtacaatgacgtggtgcgccttgacgacctcgagaggctcatcgactgctccttcgtccagccctacacgatcaacagtgccaaggtggtcttcctcaagccccggccgcagtc

SEQ ID NO: 29288 - DNA, 362 bp, Sorghum bicolor
  Clone ID: 9298399
gcacgaggatcttccgcgcgtcggcggcgtccagcgacggaggggcagtcccaggctcggcggcggcgtcggcggctccccgcaccttctctcgccagtcgcctcgcgccctcgcctgcgtcctccgcgcaccggccgacgatcctgtcagaaaggcaccacaaatagcaatatgaagtcttcgaaagttaagaaagaagaagctgattctgatgatgatgatgatttcacgccaatatcacagaagaaaagtgcaggtgctgctggaagtaatgccaagacatccaaggttaagaaattaaaagatgaaaatttggaagatctcaaggaggttaagaaaaggaagaaacgagttggtgcca

SEQ ID NO: 29289 - DNA, 599 bp, Sorghum bicolor
  Clone ID: 9298404
gcacgaggcacaaacaaagatccatcaaatctctactgcccgcttcgaagttaagactagatacttgcttccagtactcagtctccagagtcatcatgttcaaaaagttgaaagacaagatcaagggtgatgacagttccacaagaccttcatacgggacggatgaccacaaccagaactcgaataatccttattacaactcgccccaagaacaacaacacaacatagcgccaacggaaaagtaccaagcccctcctggcccgccaccaaaccaggcttcatcatcgtccaagtctgagtactctgcacctccaggacccccaccacaccacggatcttcgtcgtatactgctcctcccggacctccgcctaaacgcgagtcctcaggctacgcacctccagcgggaccgcctccttcgtacccgcagcaaccgcctcctagttgggatcctccgccataccacgattggaccgtcatccctgacacttcacttttgcctccgccaccgtcgatgggctacgatagttcccctactgccaacgcgtctaccgaggaaggtgatcgtgccttggcttggacgaacatgaacccattatgg

SEQ ID NO: 29290 - DNA, 464 bp, Sorghum bicolor
  Clone ID: 9298410
gcacgaggaaaaaaagaaaaagaaaggaggagtaagaagtggactggcctagcccaccaggcggcccatgtgcgcctccccctcatagcgtggcttagaaattcctctatcaaatcccctccagcgctgctcctctctagttctccaccgctcgtcctccacagctcatctctccacggctccgtggcttctcccctctctctccagtgccctgctctgctcccctccctctctctctccctatgcactgcgggctgctctgctcccctccctcactgctcctcttccagatctacagccgccgccatcccctttcagatcgagcagactacggtgagtagatggcggaatcgagcagacggcgacgaggagatggcggaatcgaggggggcgttagcacgcgcataaggcggcaaggcgccgccttacccctaaagcgagccgggagtgccccgacgcttaag

SEQ ID NO: 29291 - DNA, 542 bp, Sorghum bicolor
  Clone ID: 9298411
gcacgagggtctcttcttctctcaccgactcttcaattgctttctcccaatctctcgtcttctcaaaaacaccttctcccatcaaaccacatccaaaatggtcaaggccgtagttgctggagcttctggaggcattggacagcccctctctttgctcctcaagtcctgccagcacgtcaccgagctctccctctacgatgtcgtaaacactccaggtgtcgctgctgacctgtcccacatctcaactcccgcggttgtaaagggcttcctgcccgccgacgatggcatgcagaaggccttcaccggcgctgacattgttgtcatccccgctggtattcctcgcaagcctggaatgacccgcgacgacctcttcaagatcaatgccggcattgtcaagggtctcgttgagggtgtcgccaagtactgccccaaggctttccttctcatcatctccaaccccgtcaactcgactgttcccatcgccgctgaggtcctcaagaaggcaaacgtcttcgaccccaagaagctcttcggtgtcaaca

SEQ ID NO: 29292 - DNA, 440 bp, Sorghum bicolor
  Clone ID: 9298460
gcacgaggaccctaaggcggccggctgccggcagtgtcccgccgcccccgccccgcggctgcgcccctgcctgggcccgtcgcagcacacggtcgccagctccgccttcacgagtccgccactggcctccgtcatccgtcttcctctcccccactccctctcgcattctctggtgatgatctgagtgtttcttggtccagtatcttcgacgcgcccgacacctgctcgacacaatgcatccaggggaaagtagcaagagatctgtgccttcagcgctcggcagcggaggctgcatcgacgccttgcctgacggcgtacttgggcacatcctcggcttcctcccagcgccggaagccgtgcagacttgtgttctcgctcggcgctggcgccacctctggaggaccgcaactggcctgcgcatcggttgctgcagcagtgag

SEQ ID NO: 29293 - DNA, 547 bp, Sorghum bicolor
  Clone ID: 9298484
agaagttgcaaggacagcttgatgtgcttgatcgccgatgggagatttcaaggagaagggcattggcatccttcaaatccggagataaacaggctgcttatcgttatgtgaggcagtctaaattattctcacaaagccggagcagatgcacacagttgttggaaaggattgaagaagtcatcagtctaattgctagtgctgaatcaaataagaaggtctatgaggcaatacaaattggtatcttggcaatgaaggacaacaatgtcagcatagatgaggttagcatccacatgaaggaggttgatgagcttgttgctgcacaaagagaagttgaagctgcccttgaatcagtacctctccagtcgttagatggtgaaggagatattgaggaagagttcaacaagcttgaagcagaattgcaggatgacattccacatattcatgttcaagaaccaatggcaccttccaacaaggaatcacctgatgaagtggttgaatcattgagccataacatgtcaagaattagactggagcccatctaaaagct

SEQ ID NO: 29294 - DNA, 650 bp, Sorghum bicolor
  Clone ID: 9298490
tgggatggctgtagtagaccagactatttggattgtgcttgcctgttgtgtgacggttctgatagcagccagggtagttctattatgcttttaaaaggtttatctaaagctcagagtttggtgttgatttctgtacccgagaagattattttcgaaagtgatttgagatggtgccctatgtttagcaatttaaagaccttgttgctcgatgactactggtgtacacctgatgatttcagtgcattagcttgtattcttgaacactcaccatttcttgcgaagcttacacttgaactcttttctgaggggcctaagtatgaagtggaaatgaaaggaaggtgcaatctgatggagagatcagctaaaatttcagaaaaccttaacatcgttgaagtcaagtgtcaagttgttgatcagagagttctcaaagttctgaagttcctgtgcacctttaacataagtttcactttctgatatgaggctctaggaaattcgggctgtctagggatctactatccttcgtcgttaggaaattcaagactaaagttcactgcaacaaggttgccatctctagtgcacctaactgggcatgttgtatgctgtcagttagacctatagttatatgaactaggagaataacctgcgcgttg

SEQ ID NO: 29295 - DNA, 698 bp, Sorghum bicolor
  Clone ID: 9298501
ttggcggtgtcgcacccatgccaagtgcagagactcaagcgtcctcacgaatctacccatgtatagcgtgttctgggactcaccactcaacacgcagcgctccaagactatctatttcgagctaaaagttattggcataggtcgtggtggtatctccttctcagaagcagacgctggcattgccataggctttgtcgcaccaccgtatcccacctttcgtcttccaggttgggagcgtgccagtcttggtgtgcatggtgatgacggaaggaagtatgtcaacgatgcatggggcggcatcgacttcacctcagctttcaagcctggtgatactgtgggtatcgggataaccttctcagttccccggaacccaccctcatatgaagagtcgcagcagggaaggatgttggatattgatgttttcttcacgcgcaatggagtgaaggaaggcggctgggatggcaacgaggagctcgacgtgaggagcgagggaggtaacactgggctgagaggagagtctgatctcttcccggcaatcggtgtgtttggtggtgtagatttcgacgtcttctttcatccatcgcagtggctctatcgcccgtattgagactgcctgggcgtttactatccactcgaggtaaagtcgtatattcctagagtgaggtaaagtcccttgaccttgtcctacacgctttaca

SEQ ID NO: 29296 - DNA, 628 bp, Sorghum bicolor
  Clone ID: 9298514
cacaactctagatgtggttcgtgctgagaccttcgttgctgagatcgttggcgagaagaaccctggcaaccttaccattccagtcattggcggccactctggcgagaccattgtcccactgttcagccaggccaagccgagcgtacaaatcccagctgacaagatggatgcacttgtcaaccgtgttcagttcggcggtgatgaggtcgtcaaggcaaaggacggcgctggttcagctactctctccatggcctacgccggataccgattcgctgagaaggttatcaaggcctccaagggcgagaagggcattgtcgagcccagctttgtctaccttcctggtgttcagggtggtgatgccatctccaaggccactggaaccgagttcttctccgtacccatcgagcttggccccagcggtgccgagaaggccatcgacgttgtcagcagcgcgaacgaacacgagaagaagcttctccaggcctgctacagcggcctctcgggcaacatcagcaagggtgtccaattcgtcctcgaacctcctcagtagatgatataaacctacctaaggaatgatgggagaaggctgctcatgaagatacgtgtggaatagttatgaatatatgcc

SEQ ID NO: 29297 - DNA, 633 bp, Sorghum bicolor
  unsure (1)..(633): unsure at all n locations
  Clone ID: 9298517
gacgaggaagaagagcggcgncggcggtgggttcttcccccagatcgtcctctcgctcggcaaccggcggaagggcgcgccccatagggcgccgctcgcgtaaactgccatgcatgcgctcgtacgtacagaccccgttacgtcgcctttcgacgttgccgctatatacctgttaattatgttgtttattactgttacccttaggtattagcagtgtcattagcagagtacttaaagtgtaataatcctatgtagagagaagagaatgtgtgagggagagatatggcagtgctggttggttggttggttgcagctgagctgagagggatggatggccttttctagctactagggccatgcatgcacctcgctgctgcagtgttttgacgagacttgagaggagggaggcagcgacgccaaaagctagctgctgctgggagcaacatggacctggcgttgcaagcccaggtaggcacaggctcctcgtcgtgggcgggtcccccggtgcaggccgggtcgatcgtccgtccgtcgcgagggtgtatagcgggtggctaccaattttgtacttgatgcaacgaggggggcggttgctccatggcatgcatgcttacaccatgttaagaccagaac

SEQ ID NO: 29298 - DNA, 545 bp, Sorghum bicolor
  Clone ID: 9298575
gcacgaggctcactttgagttgattagttcttgtttgcttgttggtcaattcactttgctccttcaacatgtcgcattactctagtcctggcgagaaggacctcaagcatgatctcgaaaatgatcagcctgctttgaacaacatcccttccatcgccggtgaagcccaagttcacgatgatgtctttggtgatattaccgatgaaggccccaactaccgcgctgtcggctggatcggcaccgtcgctctcatgatgaagacccaggtcggtctcggtgttctgtccatcccagctgtcttcgacgtcctcggtatcctccccggcatcatctgcctcatcgtcatcgccggcatcacaacatggtccgattacatgattggtgtttttaagcgcaaccatcctcaaatctacggtatcgacgatgcgggctttttgatcttcggtcgagttggacgtgagattttcggcatcgccttctgcctcttctggatctttgttgcaagctctggtatgttcggcatttcaatcggtctcaacgccgtc

SEQ ID NO: 29299 - DNA, 112 bp, Sorghum bicolor
  Clone ID: 9298626
cgtgaaggacaacttcatcaagctcgtcttgtggtgggacaacgagtgggggtacagcaaccgcgtcgtcgacctgatcctccacatgttcaagacccagtagagatttttg

SEQ ID NO: 29300 - DNA, 655 bp, Sorghum bicolor
  Clone ID: 9298647
agagctgaacagggaacagtccgttaaacagcagctacctgtgctgaaaacagaacttgatggtctgcaacaggaacttattcatgtgaggactgcttgcggactagagcagaaggggaatttggaattgctggaacaaaggaaggcaatggagaagaatatgctttctatggcacaagagactgaacagatgcgcggtgaattagctaaatttgaagttagaccatggggcacaggtggaacatatgggatgctgatgggtagtcctgatgtgaccttcactaagaacccatatgaagatagctacaatatccatgcgggggtttctgagaaaggtcctttgcatcctcctgaatctggttcatgggggacatatgacaagaatcgccttcattaccgctaagatcagaactttgtcattggagaaagagttaccttctaggttttaatggtcatatcacatcgtttacagtacctaaggtttatatatatctgcttgctttacaattatgagttgtcttttctgaatgcttctaatcacaacttttcccacactgtcttaaagtatggctaatttgttaagttgttgataccaagatgtaccagagtgggtcatacatgccccattgccccatgtggcatagctaccgtaaag

SEQ ID NO: 29301 - DNA, 606 bp, Sorghum bicolor
  Clone ID: 9298654
gccatcgctgctgagatgaagcgccctgagcattacactcgatctctccttatctgccaagctggtgtcacactcacttacatcgtcatcggctgcgtcgtctacctctactgcggctcctacgtcgcctcaccagccctcggttccgccggccatctcatcaagcgcatcgcctacggcatctccctccccggtcttctcgcaacaactgtcctcgtcattcacttcgccgctaaatacgtcttcgtccgcctcctccgcggaacaaagcatctgtcttccaacagcgctatccattggggaacttggctcgcatgcaccatcatcaccactgtcatcgcctacctgatcgcctctggtattcctgtctttggtggtctcgtctctctcgttggtgccctgctcggcacgctcatgtcgttccagctgtacggtttcatgtggctgtatgacaactgggctaagggcaagcgggatcccaacatgaagtggtaccttatggttgctttcagcatctttgttattgtctcgggtaccttcctcatgatcggtggtacttacggatctattgttggaatcattgactcgtacaaggcttcaggtggc

SEQ ID NO: 29302 - DNA, 132 bp, Sorghum bicolor
  Clone ID: 9298672
ccaagaacacatcctcaggagggacagaaggaaattcgaatcctccagctcattcagctggagtgagtgtcgatgaaagggtctcccaaaatggtgtcaagaaagcacttgttgcaaatgcagtgaagcagc

SEQ ID NO: 29303 - DNA, 510 bp, Sorghum bicolor
  Clone ID: 9298695
agaccgagaagggaaagagatgagctcctcctcctcggcgtcggccgtgccgccggaggacgacgtctgctccgtctgccacgaccgcttccggatcccgtgccaggcgaactgctcccattggttttgtggagagtgcatcatccgtgtttggcatcatggccctgctgtacatgcttgcaagtgtcccatttgtcgccgccttataaatctgctagtgcctgctgctttatcagagcaggaggatgatccacaagctcaccgtattttaggagagattcaacactataactgtatatttggtggagcaccacgcagcctgactcagaggttgcaagacctacccttcttcattcgaagactgttcagagaactaatggatccccagcgaactctcccacttgtgttcagggcacggatgatgatgatggtaagtcctataggatcaaactattcttttggttcatattcctcgtcagtattacgctgggaagttactaagattaggaa

SEQ ID NO: 29304 - DNA, 184 bp, Sorghum bicolor
  Clone ID: 9298699
gaagaaacacagatgcactaacagaagcgaggagcaatctatccttagattctcttctagtttagctacttgatcgatctcgtatccagcaatccagcttcaggcacatggggagcattagcaaaagcacggccaactgcgccaccgtgccgcagccaccgccgtcgaaggggaagctcatcac

SEQ ID NO: 29305 - DNA, 131 bp, Sorghum bicolor
  Clone ID: 9298704
gagctgagcacgacgaagcccggaccccctcactcaccacgcccgggcatggaggactggctgttctactacctcaccacgctcctctgcctactctgttgactcctgctgtgtgcgcgcacccgaggcag

SEQ ID NO: 29306 - DNA, 353 bp, Sorghum bicolor
  Clone ID: 9298709
gaggtgaagtcaagcctcgggagcctatagacgacaaggtcgatgtgattacgctcaagtccaatacaacaaatctagaaacacggtcttgctcctcagcccccagtccaagagttggaactgcgtcatctgtcctcaatggcaaaatgtacttgttctctggacgcgggggtgtcgatatggccactatagaggaacaaggcgccgtgtggtgctatgacactccaagctcatcatggacaaagatcaccccagctgatccctctgcccctatcccaccagcacgcagctaccactgctcgactagtgacggcaaagagactttcttccttcatgctgggtgcccggcaaag

SEQ ID NO: 29307 - DNA, 387 bp, Sorghum bicolor
  Clone ID: 9298712
gcacgaggctcactcccaaacggcttccttctctatcttctagtcccactcccccagccccagccagctccagctcccagtcacaaaccccaaacccctcacttgtcatcaacctgcgctgcgctttgcttccgcttcttcctccaccttcccttcctcccttgcactccaccacgcctcggacctcgccgtaccgctctcttctcttgatgcaaaccttcccttactgctagctaattaatttgccatttctttcgggggggatccggagggcgatggacaaggagaggaagcagggtttcttttcggcgctcaagggggaggtcgtgcgaggcctctccccggcgaggtcccggggggaagtcgcggctgcttccgcgcagccga

SEQ ID NO: 29308 - DNA, 453 bp, Sorghum bicolor
  Clone ID: 9298716
gaaaacttttgacttatgttctttctgtttctctgtgaagtgattggttatgcatagtatttttgggggcatatttctaattatgttgctttgaaaatgtattttgttgtatgactacgtacgtgtttgctttgaggaatggtgtggtccatcatattctcactctcacatttttgtttggtttatggagtggaataggttcattcaccaccaccttatgccttgcatatgcaaactaataattagtacaaacattacgagggatgtactcatggggtggttcctcaaaataaacactcgaagtgcaaccccacccccacagctgtggcaatgcccatttctcctttgggtctctctaagaaagcattttaaatgttggaattgatatatgtttgaaaagtttacctatctgaaaattacagacagttatcatgtgggaatggggctgcaaaa

SEQ ID NO: 29309 - DNA, 277 bp, Sorghum bicolor
  Clone ID: 9298737
aaaaagcataataataagtaaacgaagagcctgggttaccttgcctagcaacagatcgatcgtgctctccggcggaacgaggtcgcgacaaggcgacacctttctgtttctgccccgcgccgaggttggcttgtttgtcgtctgccggccggcctgagcgccggacgagagaggggaggcccgccggcgtcatcgtcatcgtcctcgtcctcctcctacatgccactcaaggtcagcgcagccatagcccccacctgagtccctgccagccgaggcg

SEQ ID NO: 29310 - DNA, 580 bp, Sorghum bicolor
  Clone ID: 9298743
cgccgccgcccgtctccggtacgacggcgacgcacaggtgtcgtgcagggacctttccttcctgatacaggaaggcagggctcatgagtggcacgccagcagcaagcagtagcctacaggcagccctctcatactgcgtcaggcaagtccgcgcctatgactaccaccactacctatgccttctccacctgcctccggccatgcgcaaggcagcgttcaccttccgtgccttcaacgtcgagacagcaaaggccatggacgtcgtgtccgaccctcggactggcctcatgcgcctcctctggtggaaggacgccgtcgacaaggtctttgccaacaagctggtcgagcacccggttgcccaggcgctctcttcggtcgtcgcagaccacaaggttagcaagcactggctcaagcggtccgtggaggcgaggataaacgacgccaaccatgacgagggcaccattcctgagacgagcactgagttggagaggtacgcggaagacacccagtccaccatcctttacatgaccctgcaggctggtggcatacagtccactgtcgctgatcatgccgcctctca

SEQ ID NO: 29311 - DNA, 138 bp, Sorghum bicolor
  Clone ID: 9298751
ggccgatggctacatcgggcctgaagcacgcagtgtctgtgccttgctaccagtcagacttgcccaaaagtataagcttcttactctttttggtgaacgcgatccctcgtcactaggccccgccggcgctggcaatat

SEQ ID NO: 29312 - DNA, 455 bp, Sorghum bicolor
  Clone ID: 9298764
actccgccgtgattctcttcacgccatcatcaacagtttgcgtgatcccaattacggtacactccgtgccctcacccttcacttatggagagttatggacaacagtcatatgaacggtattaattgccataaccttgctgtcatttttggtcctgcccttatgggccctgaccccagcaccgccatcgccgatgcgggctggcagatcaaggccatcgacaccatcctccaaaactcgttgcagatctttgacgaggattagttagaattgtatatgcgtcgaaagtttggtaaggggtaagaggacctaatggatacagcttgctgagggaagaagggttttatttctgtcccatgttgactgttctgttgcatgacgtcccatatctaatgcatgttcgtctactttgtgcttggaacttggtgtaagattattactggacagtctacctaag

SEQ ID NO: 29313 - DNA, 444 bp, Sorghum bicolor
  Clone ID: 9298777
atgaccgtcgacgtcgcctcgccgctcggcgccggcggcgggtacgcggcgcagcagatggccagcgccgtcggcaagctcgccgacctcgtcgacttcgtggacaaggcggaccatctccggcagcagacgctgcggaacatgcacaagatcctgacgccgcggcaggcggcgcggggcctgctcgcgctcgcggactacggccagcggctgcgcgcgctcagctcgctctgggcggcgcgcccgcgggagccggcgtaagtgtaacggaacacccccgcgtcggcgacggcgacggcgacggagaagaggaagcggcattacaggcacgtgcgcgcgtggttggctttggctgccgccccggacggccggcggagcaaggctgcggcggtcagtgcctcagtctcctctccttccagctctgcatctggtatttgtggtacg

SEQ ID NO: 29314 - DNA, 604 bp, Sorghum bicolor
  unsure (1)..(604): unsure at all n locations
  Clone ID: 9298783
cagcccctcgggaacgccatcgtcatcaacaccggcgaccagatcgaggtgctgagcaatggccggtacaagagcgcgtggcaccgcatcctggcgacgcgcgacggcaaccgccgctccattgcctccttctacaacccggcgcgcctcgcctccatggctccggcgatccccgctgcggatgccggtgacgacgactacccgagcttcgtgttcggagactacatggaggtgtacttcaagcagaagttcgaggccaaggcgcccaggttcgcggccatggcggcggcgggggcgacgacgaccaagtgacccttgcggcacgcgcgtgcagccacacatgatctcagcttgggaggctaaataattattcatagtcaagttaatcctgcgattacggtaggcgcttgtatgtaagtaggaagtcgagggcaggtatacactccttcaggaacgacggcctagcagctgtggcgtctgaggccgaggccggcatggcgccgcccaccggctagaccaagagatcgttttgtctagtcgtagctgtcgtaaactccactctactttttttttcttaaaccaggttttgtacatctatagatnc

SEQ ID NO: 29315 - DNA, 626 bp, Sorghum bicolor
  Clone ID: 9298789
gtcaggatggacgagaggcttccagatgcagttttcaaggttgcatctgttgccgaggctcacctgcacaaggcgcgggagctggcatcgtccgtgcctaaaaaggcgatccctgtgctcctcccagccgtgccagcccaggtcctcctggataccttgcgaagatgtgagttcaatgtgtttgattctcggttgtcgaggggagtccacggggtctctcctctgtggtatcagctcaagcttaactggaatgcgtggcgaaacaagtactgatgaagaaccgagcaagtttaacctgttcaaccatgggaagaactgcactgaactgcaggctgctgctgttccttttagcaaagctttattgagcttccgatgaggttttgctgaaacacttcgttatataaccaagattgaataagatgagtagggtctgctacttgtgccaaacttggcgactttgagcaatttttgctgtggcttctggcttgggaggtttatttatttgtttggagtgcctcttttacatacatgaagctgttgaatttgtgttgtgctgtacgtaccacagtattatgtggagtctgttgtgttctggctgggctccattttgaacacttacaacatga

SEQ ID NO: 29316 - DNA, 547 bp, Sorghum bicolor
  Clone ID: 9298791
cactcaagcgaaccgaccagaaaagtgcaaagcgcagcgaccgacgcgtcccgaccagctgacgtggtaggcacaggacactagggaagcagccgatggaggccgcgctgatgcagcaggcggcggcggcggcggcggcgaggtggcggtgcgtgggggacgcgtcgctggcaggacacggacagcagcacctagccggcgtcgtccggctcggcgtggcgcggcgtgcggccagccgggcggtccgggccagtagtagcaccaggctgctggcccccgtgcgcgcgctcgtctccgaggccgccggcgagcgggcggcggagggcgaggaagaggagggcgcggcggtgaggctgttcgtgggcctccccgcggacgcggtggtctcggacggccgcggcgtgagccgccccagggccgtctcggcggcgctgcgcgcgctcaagctgctcggcgtcgacggcgtggagctgccggtgtcctgggccgtcgtgcagccaggggccgggggatggttcgagtgggccgggtaccgcgccgtcgccgc

SEQ ID NO: 29317 - DNA, 549 bp, Sorghum bicolor
  Clone ID: 9298823
ctcaacttggactgtgatcactacatcaacaacagcaaggccatccgggaggccatgtgtttcctcatggaccctcaggtcggccggaaggtctgctacgtgcagttcccgcagaggttcgacggcatcgacgcgcacgaccgatacgccaacaggaacaccgtcttcttcgacatcaacatgaaggggctggacggcatccagggcccggtgtacgtcgggacagggtgcgtgttccggcggcaggcgctctacggctacaaccctcccaagggtcccaagaggcccaagatggtgacctgcgactgctgcccctgcttcggtcgcaagaagcgcaagcacgccaaggacgggctgccggagggcaccgcggatatcggagtggacagtgacaaggagatgctcatgtcccatatgaacttcgagaagcgtttcgggcagtccgcggcgttcgtcacgtccacgctcatggaggaaggcggcgtccctccgtcgtcgagccccgccgcgctcctcaaggaggccatccatgtcatcagctgcggctac

SEQ ID NO: 29318 - DNA, 644 bp, Sorghum bicolor
  Clone ID: 9298861
gctccacggcgggtacggcccggtcgcggagatgttcgcgcggcacgggtgcgcggtgatcgcgtcgggcgtggaggcacagccggacgccacggcggaggatcgcctggcccggctcaaggccgcctgcgcggagcacggcgcgcgtctcgcggcggagagcgcgccactcgccgcggcgcgcgacggcgccggcgccgcgggcggcgtctggctgtccgccgggcgcacccggccgtgccagttcacgtaccagcggatgggcgcggagttcttctcgccggcgcactggccgctgttcgtgcagttcgtgcgcgcgctggagtgccccgaggaggcccatgaggacgacctgccgggcagcgctgacggcggcgctcggctcaccgtgccgtccgcggccgcggccgcccccgcggcgaagccacgagggaggtgcagattcagaccgtgtgaatcgcagggaaggcatttgtcacgtagtattcttgatgtgtagtaagagtattgggcagtaaataaatttgagctgatacttttatcagtgtgaagtgggaaccaagagcgggagtgtatgctatagtatattactaggattagtacgtactgatccattggtattattttacatcgtgataatgatg

SEQ ID NO: 29319 - DNA, 573 bp, Sorghum bicolor
  Clone ID: 9298882
tgcagacaatgcatcaaggaagagagaatcaaacgggtctgctcttcatgacgcacgcagtaaaattccaaggatgcaatcacaacacggaggcataagaagtgcagcagggaacgctctaattccaccacagcttcgtggaaggagcaatgttgttactgaagacatgagcaaactctttgtggctaaacgaaaagagtagcatcttaacactttgaaccagaacctccatttggacttcatagacacatgtactggctcccatagtcccctggatgtggcggcatgagcatgatctaacgatgttgctgactcctaaagaactgaaggaaggataccgcaacatggactattaacccacagcgggtcgtcgtcagatatcaaaatgttctcttgaacatttctttggtgctcgcttttcatgttcaatgatgctacaagcctgatgttggatgtatgcaaacttctgtaactctgttatgttatggcagctagatgctactgttatgtttaggagttagggctagatgctactccatttatattttgatcggtgatgacaatcagtcaatc

SEQ ID NO: 29320 - DNA, 702 bp, Sorghum bicolor
  Clone ID: 9298914
ctgatccgatgattcatgataacttgacggatcgcacggccctcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgtaaaaatgaagaaattagagtgctcaaagcaagccatcgctctgaaaatactcgcttctttacaacgcccatggagtggaatggacggaaaaattggactcatgtgtacatcccatgccgaactgctatagtgttggccttggctgagtgatccaggggcctgtgtagtaggctaggtgagtttgtgattt

SEQ ID NO: 29321 - DNA, 584 bp, Sorghum bicolor
  unsure (1)..(584): unsure at all n locations
  Clone ID: 9298930
gcacgaggcagcagcggctcggtcgtcgtcgcaagcaacaggcgcctcctgctcgttgtcgccttcgctctggcctgcctctcggcgtcgccgtcggcggtggtgtcggcccgccggcgccccgtgcggctgcgcctgtacatgcacgacatcgtgggcgggccggggcagacggcggtgcggctggtgaagggtccggggccggagaacccgtcgatgcacccggggaactacttcggcgacacggtggcggtggacgacctcctcacggcgggcctcgccgttgactcggcgcccgtcggccgcgcgcaggggacctacatgacgggctccatgagccgcccggtgttcgtggtcgccgtgacgctgctgctcacggcggggccctataacgggagcacgctcgtggtggccggccgcgacgacacctcgctgccggtgagggagctcgccgtggtcggcgggacgggggcgctgcgacgggcggcagggcacgtgctgtggagcacggccagggtggagtccgcgctgcacgccgtgctgctgctggatgtgcacgcgtncgtgccggcgccgagcaaggc

SEQ ID NO: 29322 - DNA, 574 bp, Sorghum bicolor
  Clone ID: 9298938
gcacgagggcacgccaccaggccagtccaacctctccaccaaggaaccaagaaccaccctgcgaccgaccggccatcatgccaagagtcgtcgtcggcggtggcaaggtcgccacctacaagggcggcatcaagggctactggaagcggcgcggctacgaccggctcgacgcggccgcggcgcagccccgcccgcgcctcccgaccgcggagctcggtggcggcggcgagggcgagggcgaggcgcagcctcagccgcagcggcaccgtcgccgcgggtggcgcgttcgccgccggcgcgcgggcgtcctgggccggcgcctcctgcgcgcgctctcgccgctccggctgctggcgcggctccgcgacgcctacgtgaacgccatgctccgcctcgcgtcctccgccgccgtggtcggctacggcgcctccacggggccgtactgcaccgcggccgccgacccgttcaaccggccgcgcccgctcaccagggactacgacgagaaggcgctcgtcgagatctacaggtccatcctcgcgcgcggcggcgaggccgggccggtgccggtgctcgc

SEQ ID NO: 29323 - DNA, 580 bp, Sorghum bicolor
  Clone ID: 9298942
gcacgaggcatgaggtcatccaattcatcgacatattcctcaaggaagtcttcagaaccgtttatgcctcccgagagctcgaggtcattcgcaagagatggcctagtggtgagttcaaatggctagaggaaacccccatcatccccttcagcgaaggtatccagatgctacgtgatgacggacgtgacgtcgaggaggaggatctgtcgactccggacgagatgagacttggccagcttgtgcgcgagaagtacggtacagactactacgtcctcgacaagttccctgccaacgctcgccccttctacactgccaaggatcccgaagatcccaagtggactcgatctttcgatatcttcattcgaggccaagagatttgctccggtggtcaacgtatccacaacgtcgatgagctccgcgccaacatggctgccgctggcatggccgaggatggtatggaagattaccttaccgcctttgagctgggtgctccgccccatgctggtgctggtcttggtcttgagcgaatcgtcgcttggatgcttgagcttggcgatgttcgctatgcatctctattcca

SEQ ID NO: 29324 - DNA, 437 bp, Sorghum bicolor
  Clone ID: 9298952
gtttcaagcaacatggatgatctgatgagaattgctgcagccgacaagaggcaagagctgagtatattttcacgagaagtcataagatttgggaatcgttgcaaagatcctcagtggcacaacctagatcgttatttctccaagctagggtcagaaattacaccccaaccagaattaaaagaaatggcaaaagcagatatgcagcaactgatgacccttgttcgacacactggtgatctctaccatgaattacatgcattggatagatttgagcaagattatcgccgtaaattggaggaagagaaaagatcagttacatttgaaaggggggacactgttcagattatcagacaagaactgaagagccagaggaagcatgtaaataatttgaagaaaaagtgtctttggtctaagtctcttgatgatgtcatggagaa

SEQ ID NO: 29325 - DNA, 610 bp, Sorghum bicolor
  Clone ID: 9298954
gtcctgctcgtcggggtatacgtcgacgacctcatcatcaccggcgctgaggaggaggaggtcaacagcttcaaggcgcagatgaaggaaaggttcgacatgagcgaccttggcttactctgcttctatctcggcgtcgaggtgcgtcaggatgccaggggcatcactctccgccagactcactatgccaagcggatcctcgagctcggcgagatggttggctgcaatccggcgcacacgcccatggaagagaagcttcgcctgagcagggagagcaaggctgaggaggtggactccacgcactaccggcggcttgtcggtagcctccggtacctcgtgcatacccggccggacttggcgtttgccgtcgggtacgtgagccggttcatggagcggcccacggtggagcatctgcaggcggtgaagcgcatcctccgctacgttgctgggactctggagtatggtcttcactacaagagggctcctggaacagcgcgcttcatcggctactgtgacagcgaccttgccggtgacatcgatacaagcaagagcaccagtgggactatgttcttcttgggcgattgtctggtcacctggcagtcaatcaagc

SEQ ID NO: 29326 - DNA, 617 bp, Sorghum bicolor
  Clone ID: 9298976
cgccagaggatgaggttctaagggagagcaataagatcgagagtgtcgactggaagagacagtataagctacgtcacaactgggccagaggtaagtgcgccgtggaggaggtcagcgtgcgggatgcgccagatgagaatggagggcagaagaggacgttggtcaaagtagtggagggcattgcaataacggctgattcggaatctggactgcgcgcatgggatcttcgaacgcggcgaccgattacgcagcgcaacttgcaggaggaaaacgaaagcgacgataatgcgccgacttcacttgcggtggacgaaagcggttctgaaaagtcctagcaagcctggctgacgcaaaagcaaatacaaacttggcagacaccacgatacgagcaaggggacgaaatacatcgattggctctgagatgtcaatcgcgacaattgatagcctcttgcctgggcgttacgattaaactctgagcggcattcccgccgacagatgatccttcgcggcgactggttagcacgacgcctcaaggctgaagcagcgccaggcacgtcccttttgctagctggagtttattgaacggcatgaaaagccaattcaaataaataaaaaca

SEQ ID NO: 29327 - DNA, 586 bp, Sorghum bicolor
  Clone ID: 9298982
gcacgaggcgaaagcgaagagccactgtcttcgacgccgtccaaggcaaagtaacgcaagacggtctggttcataatctacgagctcccaaagcagctaccaaaccgctgcgcccggatgaagtcctcttcaagcgcaaaaatgcgccagtccggtaccaggaagatgactactaccctgcccacaccaaactacctgcagaccagcaactcccttctggagaccttgcaaccgcaatccatagctacgtgtcacatctctatgcacaggctgataatggtagtgcgcgtagtccgtggaaatgcatgcgcgagactgccctcattgccatgagtatcctcatggaagaaacagcacgtagtgttcttggtgagactggtgatctggcattcacagaagctgagcaagaggacgagaatcagatacggcgtcgccagaacgaatggatcatgtttgcccagcaacagcaaatgaagcgtagcgacgaggagcgcagacctgctagcagaacgcagcaacccaccgattcagtgaatgattcttggatgtggtcggatgaaagctcaacctacacctcggacgatac

SEQ ID NO: 29328 - DNA, 568 bp, Sorghum bicolor
  Clone ID: 9298983
gcacgagggtttatcctgagtttcagaacagagggtctttccaacaaaggtttggttcatatggagttacagattctgaatttgatagggccaatggacacaggcaatccaatagtattgagcgacaagcgccatatagtcgaattggtgttcgaggcagaggaagaacttcctaccatgggagaggagatactagaggatggcatgaacggtttgtttaccgttggacagaatctcaccgtcaggtgcagaatggcggttctgaaactgcatcccacaaactgctagctcctgggcagcaagggacaaagaggaactggtgtagagcagaatcatcagattcaccacaacaggacaacacaaaagggagacctgaaactgtagatcaacctcctgggccagagtgtcatggtggttgtgaagctccctcccatgaacagcatgctcctgggcagggagcggtgaagagaggtgtatgtgaagctgaatcatcagatttacctatgcaggatgagtcctcagaaataacacttcaaagtgcagatgaacctctttctaccacacagga

SEQ ID NO: 29329 - DNA, 629 bp, Sorghum bicolor
  Clone ID: 9299007
gttcgcgacgcagaccaagctggagccccggcagaagctgcagctggcgcgggagctcggcctgcagccgcgccaggtcgccatctggttccagaacaagcgcgcgcgctggaagtccaagcagctggagcgcgagtactcggcgctccgcgacgactacgacgcgctcctctgcagctacgagtccctcaagaaggagaagcacgcgctcctcaagcagctggagaagctggccgagatgctgcacgagccgcggggcaagtacggaggcaatgcggacgccggcgccggggacgacgtgcgctcgggcgtcggcggcatgaaggaggagttcacggacgccgccggggccgcgctctactcgtccgagggcggtggcggtggcaagttcgcacacttcacggacgacgacgtgggagccctcttccggccgtccgcgcagccgaccgcagctggcttcacgtcgtcgtcggggccgccggagcaccagccgttccagttccactcctccagctgctggccatcgtcgacgacggagcagacctgcagcagctcgcaatggtgggaattcgagtccctcagtgagtgatcgatcatacgacgatcacaagcgggtcactcggttcaat

SEQ ID NO: 29330 - DNA, 338 bp, Sorghum bicolor
  Clone ID: 9299089
gcacgaggctccaggctgagaaggtcaagaaggccaagaacatggccttcgccttcgacattgatggtgttctcgtccacggtgatcgtctgatccccgagggcaagaaggctcttgagatcctcaacggtgacaatgagcttggcatcaagattcctcacatcttccttaccaacggatctggtaagatcgagaaggatcgctgcgcgcagctctccaagatccttggcaaccctgtcgagaccgaccagttcatccagtcccacactcccatgagtgctctggctgagtactacagcactgtcctcatcatcggtggtgagggataccgatgccgt

SEQ ID NO: 29331 - DNA, 599 bp, Sorghum bicolor
  Clone ID: 9299108
ctccccctcctccacccgcacagcctgcatacggacgccgccagcagcagcagcagcagcagcagcagcagcagcgatcaagcgtgcgcgcgcacgatggccatggaacttcctctcttcctcggcgacggccccgacggcgccctcttctcctccctctggtcctccttccccgacgatctgcagcagcccccgcaagagagcgtggcggagctgaagcagacgctgctggcgacgacgctggagcctgaggcggcgagggaggagctgaagcgcaaggagcagagcatcgccaagctggccgacctggtccgcgaggtggccaaggagcgtgacgacgcgcgggaccagctgcagagcctccgccttctggccgcccaggcggcggcagcggcggcggccgcggcgccggcacccgcgccgccgctcgtcacgtccagcgtgactgactccgactgcagcctcgtctcgtcccccgtcgaccccttctttgatcccgtcacctccgccgacaggcgctgcaagctcagccccgccacgcctcccgcgccggcgacggcggcggcggcggccgcatccaagcagcagtgccagcctgg

SEQ ID NO: 29332 - DNA, 201 bp, Sorghum bicolor
  Clone ID: 9299114
gcacgaggagaagaggcaggaactagaagacacgatgcgttcgcatgatctccgcgtgaatcggagaggcgaattcagataaacgctcgtcgacaagcgcggacgttgagcgccggcatcggcgtcggtcgagcgagctgcggatccgccgacgcgggcgattgttatggactgccggcaacaaagggggatcgcccgaca

SEQ ID NO: 29333 - DNA, 107 bp, Sorghum bicolor
  Clone ID: 9299128
ctgcagcttggggattcatatgcaccttaatgtatggaatttctgggaaggactctgcagctgccatcattgacaagcttgctgggcaactgaattataactgacag

SEQ ID NO: 29334 - DNA, 542 bp, Sorghum bicolor
  Clone ID: 9299132
gcacgagggtcgtccgagacaaggccgtcgaatctctcaacaagatctgcgaggagctctcaccacaacaggtggaggagttcttcatccccctcacaatccgactcgccaaggcagactggttcacgtccaaggtgtctggttgcggtctctttacagctccctacaagaaggtgtctccccccgtccaggagcagcttcgccagcagtttggcctcttggtccacgatgagacgcccatggtccgccgccaagccgcgtccaacctggccaagtttgtcaaggagatgccccccgccattgtcattgaggagatgattcccctcttccagcacctcgtttcagacgaccaggacagtgttcgattactcactgtcgagattctcatcgccattgctgagggcgtgcccaaggaacagcaggctagccatggtgtcctgttgacttctctgcgaaacctgattgaagataagagctggagagtcaggtacatgattgccgataggttcgaaaagattgccaaagccgtggatgaagaagtc

SEQ ID NO: 29335 - DNA, 645 bp, Sorghum bicolor
  Clone ID: 9299133
ggcacgtctagctggaagctttcaggtgttcatgagccactaagcatcaatgtggccacatttgagaagcctctgaggaagctcacctttgcgcatctcctcgaggccaccgatggcttcagtgctgagactctcataggctcaggggggtttggtgaggtgtacaaggccaagctcaaggacggcacagttgttgccatcaagaagctgatccatttcacaggccaaggcgacagggaattcacagcagagatggagaccattggcaagatcaagcaccgcaaccttgtgcctctgctcggatattgcaagattggcgatgagcggctccttgtgtacgagtacatgaagcatggcagtctagacgtggtgctgcatgaccaggccaaggctggtgtgaagcttgactgggcagcaaggaagaagatcgccatcggttcagcaaggggtctcgccttcctccaccacagctgcatcccacacatcatccaccgggacatgaagtcaagcaatgtgcttcttgacagcaacctggatgcccgtgtctctgactttgggatggcgaggctgatgaatgcactagacacacatctgagtgtgagcacacttgcaggtacgcctggatacgtgccacctgagtactac

SEQ ID NO: 29336 - DNA, 445 bp, Sorghum bicolor
  Clone ID: 9299138
gcacgagggctacttgccgggctgctggaattatggtgagaatggtcacaggagacaacataaatacagcgaaggcaattgctcgtgaatgtggtatacttactgaagatggcatagctattgaaggaccggagttcagagagaaaagcctagatgaactccttaagctggttccaaaaatccaggtaatggcccgatcatcaccacttgacaagcatacacttgtaaagcatttgcgtacaacattcaatgatgttgttgctgttactggtgatggtacaaatgatgctcctgccttgcatgaagcagatattggacttgcaatgggcattgctgggactgaggtggcaaaagagagcgctgatgttataattctggacgacaacttctctacgattgtaactgttgccaagtggggacgatctgtttacatcaatattcaaaa

SEQ ID NO: 29337 - DNA, 589 bp, Sorghum bicolor
  Clone ID: 9299145
caaaaaaggaaagcgcccgcctcctcgacgaatcctcctcggcgcccctcctagatcctcctcgacgcagagccccccctcatcctcctcggcgccccgctcccaaatcctcctcggcgccccctccagatcctcctcgacgaatccggtggccgcccgagcgagcgagaactctggtagctgcctgagcgccgctgcgacccacacccccgccgcgcgccctgcgacacgccagtggccgcgctccggtggccgcccgaccgagcgcgaactccggtggccgctcgagcgactacgacccgccgcccgctgcgacccgcgcccccgctgcccgagcgaccgcgtcggtggtcgcggcccgcgccgcgaacgccggtggcccccgctgtccgagcgtcgcgtcgcgttacccgcgcgaacttcggtggccgcctgagcgactgcgacccgccggtggccgcgctcgcttcccgcgcggcacccgcggcccgctgcccgcatgccccttgccccgattgagacttcgtgagacgcgccatccccggcaccggctcaccgtgaccccacctccgctgcctagcgcctccgg

SEQ ID NO: 29338 - DNA, 534 bp, Sorghum bicolor
  unsure (1)..(534): unsure at all n locations
  Clone ID: 9299165
nanagtgcgccgcaaacccccccacggcggccgccggcgatgcccttcgcgtagccgacctcccggggcgcggtcgcggtctcgtggccgcccgcaacgtccgcgagggtgaggtgctcctctccgagcctcccgtcctcctctacccgtccaccctctcctctctcgcctcctattgctccgcctgcttccgctccctccccgccgccgccacggttccctgcgcttcctgccgcgccgccgccttctgctccccggcatgcgccgccgcttcgcacccgcgcctcctctgcgccgcgctgtcccacggcggcggcgccggcgtcgccgccgcggcccccaccgaggcgatccaagagccgctcctcttcctcctctccgcctactccctcccagagtcaaccatccactccatcctctccctctcctcggcgccgcccccgcccccgggcgcgcaggacgccgcggggctccacgctgcggtggcggccctagcgccgccgcacatgcttccccagggcttctcgccagacc

SEQ ID NO: 29339 - DNA, 634 bp, Sorghum bicolor
  Clone ID: 9299187
accttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgaagttcctggtcgaagaaatgggacgggacatgggcgaggtggtagattacccccagttctttcgccatggactcaagaggagcctggagtaccgtcacaaggtgctcaagcagatgaactcgagttgcagtctcagcgagatgctagactgtaaccagaagaagtttgccatgaaatttggtttggttgcagcagtttaggtactcatcttttctctagttccaatgtagtatgttttattctcaggtgaatcttttgtttgtaccatcaggttgtattgttcttgaatatttgggccaatgataattga

SEQ ID NO: 29340 - DNA, 353 bp, Sorghum bicolor
  Clone ID: 9299191
aaccaagtgggagaaaaaccttcgcctggaatggttctcgtggcccccaggtgcgaattgaaccaaagttggaatggacactgtttggtttcagtctgaatgcctttttgttctttttcccgtttggttgtgcagaactgaggcctgcggaggtgtacttccaaatgcatctgctggcgaggcagtcggctgcagcggtttctcagcagaaccagctggtggagacgatgcagagccccgagttgtggttgcttcgggcgattcacctgaacccgtcctgccccaggtattggaaggctctgctgcagcaaatttatgtgtagccttttgtatcacagtcacaggtatcaacc

SEQ ID NO: 29341 - DNA, 705 bp, Sorghum bicolor
  Clone ID: 9299197
tttatgattggtgaatactgggataacctttttcaaccgtaaatagtttactgcacatatgatattttcacatgcttgtacaataaaatgcttgttgaattcctattagtcccatgatgctaaaatgcttagtagccaagaatttgcttatcactattggttatgcctgttttcacgtagatgtgtctttgatgagaaaggtgacacaaaggcgcaaagccttacataaattcagaattgtcttcattgcaaggtaattttttgttgtgtgtgagattttttcattcacctagatatgtgcacgaaattcgatatccttagtttttgtgtatcaagcattttgattgaaggtttgcaatggctggaaagattatttgtctccattgactttactatggacagaatagatcttttcacgaatgaacttagtcgctgctaagatatctcatgaatcagggcttgcaacatcaaagatccaatacagaacagagtggactgccccacaagcaggaaaggtgaaggcggccatggttacacaatattgcatactgagtcaaataggctggaaaataaagatggtaaagagtccatgattacacattgtttttagtaatacaacaatacatgggcaaactctaattgtcatggtgttatattttctttttggatcaacacagggcaaacttgcttttgaattaattaatt

SEQ ID NO: 29342 - DNA, 233 bp, Sorghum bicolor
  Clone ID: 9299220
gtggaggagatgcccgggcgggcggtgttcgcggggtcggtggtgtcggcggcggtgcccctggagctgtacccggcggcggggctgcgggagagctgcgtctacttcgcgcggcgggaagtggagatgctggcgccgcacgccatctgcgagtactcgatgatggatgatgagatgaggaccgtgcccatcgccggcggccactccgccgacgtggagcccgtgtggatcac

SEQ ID NO: 29343 - DNA, 405 bp, Sorghum bicolor
  Clone ID: 9299226
tccgtctccgtcacccgcggcggcgaaggggactaggggtgggacgccggggcaccgcggcggcggcggcggcaggaggaggtcggcgcacgagcggctgtacgaggcgcggcgcgccgaggccgaggagatgcgtcgccggacgtcgctgccgtaccgtcagggcctgctactcttcggctgcatcgggctcggcaaccgcagcagctacggcgctgtgcacggcctcgccaggggactcaacgccgccgccgccgtctcctccaggtcgtgactcgcgaccggcaccggcgcaagcgtccgtaggcggcggcattgctggccggctgagggtgctctgtcagtgtggtggtggtagtgttcagtggataatcaatccactgtgaacaagtgcaaaatatgcaa

SEQ ID NO: 29344 - DNA, 650 bp, Sorghum bicolor
  unsure (1)..(650): unsure at all n locations
  Clone ID: 9299228
cagctcccgcggtggcgcaacccgcccacagtgcgcgccccggacacactccctctcggcgccgcccgcgccgggtacgtcgcggcgcccgtggccgccgccggcgctgacgccgtcacgctggcctccagcgcctgcatgaagcggccgatgtccatgctcccgctgacgcccatgctgcccgccgctagctgctcgccggggttcatcgccaagcgacagaggctgcagcactgacagcagcatctggtcgacggccgacgggtgggtccacacgccagtgacggcgggatccaccgtcttctattgatgatgatgagtgaaaatgtttccacaaagccatggtggttcagttgctaactgcatagtagtgttattgagtcatagaagtaactaagtatagtcagatgctgaattatgataatgtgatccatgtgaatagcagggttttatcacacttgctcggtttttgttttttccctgttcttttccatttttcatttttgggcatgtcagtgtcgtcttaaggctgttcatagcttgacatgggagcatgattagagccaacattcttgtttgaggtgagggtattggttcaacttgtttcatgcccatagccgatggcttggnttggagtcagcaaattttgc

SEQ ID NO: 29345 - DNA, 546 bp, Sorghum bicolor
  Clone ID: 9299247
gcaacctgtgcatgggatggctcggcgacactgtcttctccattcgtgaggctgctacgcacaacctgcgaaagctgacagaggtctttggcgtggagtgggcaagcgaggccatcatccccaaggttatgacaatgggcaaccaccccaactacctgtaccggatgaccacttgctttgccatctcgactctggcctctgtagttagcatagatgtcatatccaagtcgattctccccatgctcgacaagatgaccgaagacgacattcccaacatccgattcaacgttgcaaagacgtactcggtcctcatcaacgccctgcagcgcctgccagaacagggcaccctctacacaatcgagcaacagggagccggggctgcaccgacgacgccttcgcctcggggccaggagctgatccagcagcgcatcgttccgaacctaaccaagctgcagaaggatgacgatgtggatgtccgttactacgcgacacaggcggtcgccgaggcttcaggaaccggagcgtcaggaggcggagagcccagaa

SEQ ID NO: 29346 - DNA, 718 bp, Sorghum bicolor
  Clone ID: 9299248
gaggctgatgaatgcactagacacacatctgagtgtgagcacacttgcaggtacgcctggatacgtgccacctgagtactaccagagtttcaggtgcacgaccaagggtgatgtatacagctacggtgtcgtgctcttggagcttctgtcagggaagaagccgatcgatccaaccgagtttggagacaacaatcttgtcggctgggtgaagcagatggtcaaggagaacagaagcagtgagatctttgatcctactctgacaaacacaaagtcaggggaagctgagctctaccagtctctgaagatcgctcgcgagtgcttggacgacagaccgaaccaaaggccaaccatgatacaggtgatggccatgttcaaagagctgcagcttgactccgacagtgacttcctcgatggattctcaatcaactcatcaacgatagatgaatcagcagagaaatcctcgtaatgatccttgcaggttttgattctctggagggatacaatacaatacaatacaacagcagcagctagctcaatcattttatttagatccttgcctccttggtaggaaaaaggtggcctcctcctcctccaatttagtaggaaatgttgtgattttgattccagtcacactcactgtaaatagcacacaagcatgcgaatagtagggcacaattgcagaaatgcgttctctctgttggagagaccggcgtgtatt

SEQ ID NO: 29347 - DNA, 756 bp, Sorghum bicolor
  Clone ID: 9299253
ccggtgtgagtgtgatcgctgtcaggtggagagccagtggaaggatgatgatgatgataacaatggaggtgatggggatgacaccatggaagaggagggtgaggacgatgctggagatagaggtgatgatgggatggaggaggaagagggggatggtgctaccgatggcaatgatgatttcccacatgcctacttctttgttaggtatttatgtgacaatgagggttgctggggtatgcttgctccattgccaccctcaccgaatggggacctgtcccatgtgtttgaaggcaatctctgtgggaagctgaggaaggaagaggatgccatgcctgatgagggcacttctggcatggtacattaggacgatgagtgatgaaaacatactgatctgtgtgctgcttcctttagtggaactctaggtgaaggaagcctggcaattccttcccccttgatgagctgtttggctgaaagggaatgggttcggttcatctgaaggcaggaaatgttcatgtaataccatgtaggccaaaccttagcttgtagccttgtactgtgttttggaattcctctttgggctgtagagcttctcgtgattcaattctgggaaggacatggacttggataggtgaccgagttcggcattatggtatggtatgttaatcagttttcctgatgtggtctgaacttagccggtctgaagtctggtaaatgactgtggcgcgataggaatattacctactttcttcaatgaga

SEQ ID NO: 29348 - DNA, 562 bp, Sorghum bicolor
  Clone ID: 9299269
gcacgaggctttcttcagccttgtggtaccattcatcatggtcaagctacagctcctcacctctgcccttggtttggcgtctttggcagcctcagccgcagtccctgttactgatgctgcgacaacttgcaagcaccccatcaagcggcttgagtggagacaactatcaataccccagagacgcaattacatcgatgccgtactgtgcttgcaaaaagtcgaatctgtatcaggaattccctatgctaccaaccgattcgaagatttcctagccattcacaaccaactgacggacaagatccactttgtggctcaattcatcctatggcatcgttacatggtcgccgtgtacgaaaacacccttcgtaaggagtgcggctacaagggcgctcagccttactgggactacacgctcgatgccgaccctcaaaacctcaactccacaagcatctatgcgacggaaatcttcgatcctcacactggctttggtggcaacggcaacaaggtcgtgcctactcccgaggagaatccgctgaacatcaacggcaccggtggaggctgt

SEQ ID NO: 29349 - DNA, 324 bp, Sorghum bicolor
  Clone ID: 9299270
cgacggcggcgcggagccgaccaagtgggcggcggtggcggagtactgccggcgccacggcgtggaccggggccccgtgcagtgccgcaagcgctggagcaacctcgccggcgactacaagaagatcagggagtgggagcgcgggtacgccgccaggaaggaggcctcgttctgggccatgcgcaacgacgcgcgccgggagaggcggctcccgggcttcttcgaccgcgaggtctacgacatcctcaagggccgtggcgccgacgacgggaatgcggttgcggcggcgctggaggacgcggaggagggcaaggaggaggagga

SEQ ID NO: 29350 - DNA, 605 bp, Sorghum bicolor
  Clone ID: 9299284
tcgccgacgggcaagccgtggccccgcttccgccggcggcgatgggcaactcgcaggcttcgccggcgtccgcctccagctcccgcttcgtcatggcctcgagggccttctcgaagcaggagctggacggcctccgcggcctattcacctccctcgcggcgcagtcgcagaccagcggccgcgccatctcacgctccgtcttcctcgagtactatggggtgcgggggccattaggcgacaggctgttccagttggtggcgaaggagagtggcggcagcgatggggtcacgttcgaggatttgatcatctccaaagcaacatatggaaggggaactcgagatgaggttgatgaattcatttatcaactatgtgatgtcacaggagatggtgccttaacaaggtctgatttggaatctgtcttggcatccgttcatgaaactgtatttgcagtgaagaaggaagtcgtggaaggttccaacaacagaccatttgaagcattcctcaactcggcagtactttcagaggatgctgaagcggtctcagagaagtctatgtcattatcagactttaggaacctgtgcattctcttgccatcattgaggaag

SEQ ID NO: 29351 - DNA, 393 bp, Sorghum bicolor
  Clone ID: 9299307
gcacgaggctcctctggcgtggatgagcagcacccctcctggccttgggcgagcagcaccacctcaaggctcacgaatctcctggcctaggcgagcagcacccctccggtggactcaagctgcgcggggcctgaccatctccaccgccttcgacgacgacgaccaagcggatatggcggatctccaccgccttcgaccatccccaccccaacagcggcgtcactactcctgcctcaccctagcaccggaaatctggcggatccaccctcagggctcacggatctagcggatccagcctcaaggctggtggatctgccaagctcaccggcaagaacgctagatccggcctcgacgaatggaggaacgacagcggggcgggcgtggatccaacgg

SEQ ID NO: 29352 - DNA, 664 bp, Sorghum bicolor
  Clone ID: 9299327
gcacgaggatcgtctccgagagcggcgagaaggcgcccaacgccgtctaccgcggccggctcgacggcggccggctcatcgccgtcaagcgcttctcgcgcctctcctggcctgacccgcagcagttcctcgcggaggcggcgggcgtggggaaggtgcggcacaagcgcctcgtcaacctcattggttgctgcgcagagggtgacgagaggctgctcgtcgccgagtacatgcccaacgacaccctgtccaagcatctcttccactgggataagcagccgttaccatgggaaatgaggctgagggttgcatatttcattgcgcaagctctcgaccattgcaatgccgagaacaggaaaatctatcatgatttgaatgcttatagagtactttttgacgaggaaggtgatccccgcttgtcaagttttggattaatgaagaacagccgtgatggaaaaagttatagtactaacctggcttacactccaccagagtttctgcgaactggtaagatccccttggtgcttactggttactgttacattctttatttgccaatgcccttgttggcaccctggtgtagatcatttgagctaattataagtccaatcagtaaaagttcgatgaagttaaaagctcttttgagctagtatgcctcttggga

SEQ ID NO: 29353 - DNA, 638 bp, Sorghum bicolor
  Clone ID: 9299341
ccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagcgttttcgccaccgtcgagatgttcgccaagtacgacaacacactcgctttcttctccggaaatgaggtcatgaacgacgagaaggataccgacaagtccgctccctacgtcaaggccatcactcgtgatatgcgaaactacatcaaggcccgc

SEQ ID NO: 29354 - DNA, 571 bp, Sorghum bicolor
  unsure (1)..(571): unsure at all n locations
  Clone ID: 9299347
gcacgaggcctttctggacttattggcagctttgcatattcacatcggaatgtttttgggaggaacaagaaattaaatctctctttggaaagggggcaaatcgattcgatatttagattgaactttactgacccttggattgatggcgacaataagagaacctccagaactgttatggttcagaactctaggactcctggaacacttgtccatggtggtgatcatcctgaccatgggcccataacaattggacgtgttactgctggcttggaatacagtcgaccattcagacccaagtggagtgggacacttggcttaatttttcagcatgctggtgctcgtgatgataaagggagtccggtcataagggatttctataacagccaattaactgccagtggacatgattatgatgatactctgctagctaagtttgaaagtgtctacacagattctggagaccatagctccacaatgtttgttttcaacattgagcaaggtctccctgttcttcctgagtggcttagcttcaacagagtgacagcacgtttgaggcanggatatgaaattg

SEQ ID NO: 29355 - DNA, 627 bp, Sorghum bicolor
  Clone ID: 9299415
cagttcttggtgcggctggtgagctcgtaccggtactccggcgagctcgtcgacgacgagctggcgagggcggaggccgcggagctgcacgacgcggtggtggccaggaagcagccgctgcacggcgacgtcgtgcgcatcgtcagctccaggagcaagccgcagctgaaggcgacgttcgagcggtacaggcagggccatggcaaggccatcgacgaggtgctcgaggaagaacgccgcagcgaccagctcgcggcggtgctcaagacagcggtgtggtgcttgacgtcgccggagaagcacttcgcggaggtgatccggagctccatcgtcgggctcgggacggacgaggagtccctgacgcgggcgatcgtctcgcgcgccgagatcgacatgaagaaggtgaaggaggagtacaaggccaggtaccgcaagacggtgaccagcgacgtcaacggcgacacgtccggatactacaatggcatcttgctcactctagtcgggcccgagtgaatcaccatggatggatgattgatctatatgtaggtttgcgacttgtagcttgattgtttttggtttgattgaacaaaatgcctacacaactgctgagtgaaaatggtgatattt

SEQ ID NO: 29356 - DNA, 593 bp, Sorghum bicolor
  Clone ID: 9299422
gtccgtctggcaggtcgaccccagctacctccctgagatgccctccgaggccgagaagtacatgaaggacggtgccggcaagggccccggcatcaacggcaagggatcacacttcgacactgacagcggtaccgccactgccagtgttgccatgggctcttccacttccacaggctctgcctctgcctctggtgataatgatgatgacagcggcgctgctagccttggcttcggtgccctgtatgtctccgctgccgccactctcttcacccttgccggaactcttttgctgtaggcggcaggcgtgccgtgtctttatttgttttccttgttagtgtggggattgccttgtggtcagagttatgattcaggtccccctcctggttttcacgataggcacaagatgttggggaagagcgcttgattacatagttgggcgcgctgcgctgggcacgccgggttcgtattttttcaacaggagcattggcgtctagcccaggcagggcagacgacccggaaatgattataatgctatctgggcagttctcgcctttgtcgttttagttaaaaggatttggtgccgaagcacgtca

SEQ ID NO: 29357 - DNA, 562 bp, Sorghum bicolor
  Clone ID: 9299428
aagttcctggtgacccagccggagctcgtggaaagccaggcagtggctatggctacggtgttggcgtccgcgtggactccccactgggacctctacggcttgagtacgccttcaatgataagcaagcaagccgattccactttggtgttggctacagaaattaacctgtaaattggtcacattcagattcaaccttgttcttctaagcattttgggctggtagaaactagaaactagtgccatgccttccattttttggcgatgccaaagcaagttttgcttaggtcagatttcattttttgtaacatatagttccttcacttctgtcgagtgttcttcagctagagaaattaaatggacccttactggtagatcatcctacctctgatatctggaaggccctatagtggaacacaagaaggtacgaagaaagagggatgaatgctgttgtaatagcattgcacattcctagcgcatttatgcatgtgtatatgtgctctataaaactgaaggagctgagtagaggatttgctttttgtcacatggatgacatgatttgttc

SEQ ID NO: 29358 - DNA, 676 bp, Sorghum bicolor
  Clone ID: 9299432
caacctggaccagctcaactccctcttcgcccagaacggcctcacgcagacggacatgatcgccctctcaggcgcgcacacgatcggggtgacgcactgcgacaagttcgttcggcggatctacacgttcaagcagcggctggcgtggaacccgccgatgaacctcgacttcctgcggtcgctgcggcgggtgtgtcccatcaactacagccccacggcgttcgccatgctggacgtgaccacgcccaaggtcttcgacaacgcctacttcaacaacctccgctacaacaagggcctgctggcgtccgaccaggtgctcttcaccgaccgccgatccagacccaccgtcaacgtcttcgccgccaacagcaccgccttctacgaggccttcatcgccgccatggccaagctcggcaggatcggggtcaagaccggcggcgacggcgagatacgccgcgtctgcaccgccgtcaactagccgctcatcagtcatcacatcagttgatcatcatcatcatcatcatcagtagtgtaggctggctggttgctggtactgtagcttgcattgggggtccaattccttccattcgttggcgtagaagcgtgcgtggggttgattccttcttttgtttatatacgtacgtttggcgttgtgggatggattttgttagcaatg

SEQ ID NO: 29359 - DNA, 535 bp, Sorghum bicolor
  Clone ID: 9299439
gcacgagggcgcgctctcccggcggtgggcgagccagtggctccgcgcgctggccgcctcccgggtgctcgacctcacggaccgagacttcgcccgcggccagccgccggcgcgggccgcggccacggtgagccgctgcctccggctccacgccgagcacggcgcgccgctcgacgtgctccgcgtggcgctggcgtccccgccgtcgtcaggggcagcagggccgagcgacggctcgttcgggcgggacgtcgtcgggtggatcgcggccgccgtgaggaggggcgccagggaggtcgaggtggacgtcctgcacctgacggcgttcctggagctggagctccccggcgacctgttccaggtcaggaactcgctggagcgggtggcgctcggcgggctcagcctccgcgccgtccctctccccgcggcgggcctcgctggcctccgctcgctctccctcagccacgccgacgtcaccgacgaggcggtccggggcattctcgccagctgcggggcgctggagtccctcagcctg

SEQ ID NO: 29360 - DNA, 592 bp, Sorghum bicolor
  Clone ID: 9299448
gcacgaggcttccacgtaccccggcggccggcagtagggaggcctaggagagaagggagaacaagatggtcggactcctcccggagaccaatgccgcggcggagaccgacgtcctcctcgacgcctgggacttcaagggccgccccgccccgcgcgccaccaccggccgctggggcgccgccgccatgatcctagtggcggagctgaacgagcggctgacgacgctgggcatcgccgtgaacctggtgacgtacctgacggggaccatgcacctgggcaacgccgagtccgccaacgtcgtcaccaacttcatgggcacctccttcatgctctgcctcctcggcggcttcgtcgccgactccttcctcggacgctacctcaccatcgccatcttcaccgccatccaggcatcgggcgtgacgatcctgacgatctcgacggcggcgccgggtctacgtccggcggcgtgctccgccaacgccggcgacggggagtgcgcgcgcgcgtcgggcgcgcagctgggcgtgatgtacctggccctgtacctgacggcgctgggcacgggggggctcaagtccagcgtctccggctt

SEQ ID NO: 29361 - DNA, 518 bp, Sorghum bicolor
  Clone ID: 9299450
gcacgaggctgggttccaagccggagattttcgtcctcgaagacctcacatggagaagcacgaccgagcttgagagtgatgttgttgtcgaagtaggagagatgtccttttatctccacaagttcccgctgctcagccggagcggcgtgctgcagcggatgatcagcgagtaccagcctccggcgggcggcggcggcggcggcatgtgcacgctgcagctggacgacatccccggcggcgccaaggccttcgagctggcggccaagttctgctacgacgtcaagatcgagctcaacgcgctcaacgtggtgtgcctccgctgcgccgccgagtacctgcgcatgacggacgactacgccgagggcaacctcatcacgcaggccgagtccttcctcgccgacgtgctcgccaactggaaggactccatcaaggcgctggagacctgcgagggcgtcctccccaccgccgaggacctgcacctcgtctcgcgctgcatcacggcgctcgcctccagggcc

SEQ ID NO: 29362 - DNA, 543 bp, Sorghum bicolor
  Clone ID: 9299470
gcacgaggaaattaggcttatgctcaagtatttctgacaaaggcattgcgtttattagttcaaattgtggaaaacttgtggagcttgatctctaccggtgcaactctattactgatgatgggttggcagctttagtaaatggatgcaagaggattaagttactgaacttgtgttactgcaacaaaatcactgatactggtttgggtcacttaggctccctggaggagctcacaaaccttgaattgaggtgcttggtccgcataacaggcattgggatctcctcagttgcaattggatgcaagagcctgatagaactggacttgaaacgatgctattcagttgatgatgctgggctttgggcccttgctcgttatgctttgaaccttagacagcttacgatatcgtactgccaagtcacggggttgggcctgtgccacctgctgagctccctgcggtgcctccaggacattaagatggtgcacctctcatgggtctccatagaagggtttgagatggcactgcgagcagcctgtgggaggctga

SEQ ID NO: 29363 - DNA, 613 bp, Sorghum bicolor
  Clone ID: 9299477
gcacgaggatcgtcttcctcctctcgtcctcttccttctagctaccactagcagcaaagccaggcaaactaataagttgggagtgagtgtgtgttgaagaggatctcgattgatcatcgatcgagaagaagcgagcttattattagagagatcgacacacactagcagtctagcacctgcacggggaaagaattaaagaacaaagaagagcaaggatcaagctaagatcatcaatgagcatctcggtgaacgggcagtcgtgcgtgccgccggggttccggttccacccgacggaggaggagctgctcaactactacctccgcaagaaggtggcctcccaggagatcgacctcgacgtcatccgcgacgtcgacctcaacaagctcgagccatgggacatccaagagaaatgcaagatcgggtcgggcccccagaacgactggtacttcttcagccacaaggacaagaagtacccgacggggacgcgcacgaaccgcgccacggcggccggattctggaaggccaccggccgcgacaaggccatctacaacgccgtcaagcgcatcggcatgcgcaagacgctcgtcttctacaagggccgcgcgccgcacgg

SEQ ID NO: 29364 - DNA, 564 bp, Sorghum bicolor
  unsure (1)..(564): unsure at all n locations
  Clone ID: 9299483
gcacgaggggcggccgccggactactggtggttcgtgaagggcacggaggggtggacggggctggtgatgctggtgctcatggcggtggcgttcacgctggcgacgccgtggttcaggagaaggagggtggcgctgccgggccccgtgctcaggcggctcaccgggttcaacgcgttctggtactcgcaccactgcttcgtggcggtgtacgcgctgctcgtcgtgcacgggcagtacctgtacctgacgcacaagtggtacaagaagtcgacgtggatgtacctggccgtgcccgtggcgctgtacgcgtgcgagaggctgacgagggcgctcaggtccagtgtccgccccgtgaagatactcaaggtggcggtttaccctgngaacgtcctgtcgctgcatttctccaagccgcangggtttcggtacaggagtggacagtacatcttcgtcaactgcgccgccgtctcgccgttccagtggcacccgttctccatcacgtcggcaccacaggacgactacgtgagcgtgcacatcaggacgctgggtgactggacacgcga

SEQ ID NO: 29365 - DNA, 135 bp, Sorghum bicolor
  Clone ID: 9299500
gcacgaggggaggcttcgtcaccggggggatcggcgccgacgtgtggtgcgcgcccgggatacccttcgccgcggaggcgtcctcggtggactgcgtggtggcgcgccaccagatggtggggaggggcggtggcc

SEQ ID NO: 29366 - DNA, 509 bp, Sorghum bicolor
  Clone ID: 9299502
cactcgccgatccagatctcctccacctctccactcccccactccaaccggacgccctccgccgtcgccggcggcggtcgagccacacgcgcgcgccgcagtggaagccggagcgggcgccggcaatggagcagctgcggacgatcgggcgggagctggcgatggggtcacagggcgggtgggggcagtccaaggagttcctcgacctcgtcaagtccattggcgaggcgcgctccaaggcggaggaggaccgcatcatcgcgcgcgagctcgagcacctcaagcgccgccttgcggaccccgacgtgccacgccgcaagatgaaggagctcctcctccgcctcgtctacgccgagatgctcggccacgatgcctccttcggccacatccatgccgtcaagatgacccacgacgaatcgctcccgctcaaacgaaccggctacctcgccgtcgcgcttttcctcgatgagcgccacgaccttgtcatcctcgtggtcaacaccatccag

SEQ ID NO: 29367 - DNA, 658 bp, Sorghum bicolor
  Clone ID: 9299522
ctccggcttcggctccgaccagttcgacgagtcggaccggggcgagaagcaccagatgatgcgcttcttcaactggttcttcttcttcatctcgctggggtctctgctggccgtcaccgtgctggtctacgtccaggacaacctgggccggcgctgggggtacggcgcctgcgcctgcgccatcgccgccgggctcgtcatcttcctcgccggcacgcgcaggtaccggttcaagaagctggtggggagcccgctcacgcagatcgccgcggtggtggtggcggcgtggcggaagagacggctcccgctacccgctgaccctgccatgctctatgacatcgacgtcggcaaggccgccgccgtggaggaaggctccggcaagaagagcaagcgcaaggagcgcctcccccacaccgaccagttccgcttcctggaccacgctgccatcaacgaggagccggcggcgcagccgagcaagtggcggctgtcgacgctgacggacgtggaggaggtgaagacggtggtgcggatgctgcccatctgggcgaccaccatcatgttctggacggtgtacgcgcagatgaccaccttctcggtgtccgtgacatagtgttactgcattttgtatatcgtcgtggtgggaagaaaaatctaccac

SEQ ID NO: 29368 - DNA, 667 bp, Sorghum bicolor
  Clone ID: 9299524
atatacctcaagtcgcacccgtggctgtcagaatcggagagggagcagctgtgccggctgctcaactgccagaagctgtcgctggaggcgtgcacgcacgcggcgcagaacgagcggctgccgcttcgggtggtggtgcaggtgctcttcttcgagcagctccgcctgcgcacgtccatcgccgggtggttcttcgtgtccgacaacgcggcggggggcgacggcgcgcgcccacactcgggcggcggcatcgtccccaagggcgccgcggccatcgcaggcagcgcgcaagcagaggccgacgatagtgacgtagagggcgacgcacccgaggggaaggagaccatgaccgacgtgaaagcgcgggtgtcggagctggagaaggagtgcaagagcatgaagcaggagatccgccggctcgggaagccccggaggtcctggagcctcctcccgaagaagtgcggttttggggccaaggtgcaacaagctcagaccgccatgagtggcaaatagatcatttccctacttcatttgtttatattatataagcaggagcctcgatttcattccctaagtcctattatctgattgttatagtaactgtttctgatctagctagccctagtgttatgcaataattacgtgcagatgatttgcacgggatgat

SEQ ID NO: 29369 - DNA, 636 bp, Sorghum bicolor
  Clone ID: 9299549
tccaccgcggcgggattgggaacgggatcacggactgggccatgatggaccggctggtggcgtcgcacctcaacgggcaggaggcgcccgacgtcgcgcccgccgcggaccagctcggcagctgcttcgacgacgccaccggcgccgacgacgcggacgccgccggcctcgccttctactcggccgccgccaacaggctgctcgtcggatccgccggctccagcggcgccggcagcgacgacgacctgtggagcttcacgcggtcgtcggccgcggccgcggccgcaacgtcgacagagcggctcagccacgtctcactgtagacgacgcgcgcccggccggccgtcgtcgtcgccttactatgtacgtacgtcgatcgtcgtaaagccccctacgtgatgacatggccagcatgcccctggtacagtagtaaacaagagacaactacaccaacagcagcagcagcaagaagacagaggaaaattaaaaataaaagaaagatatctagagagagagagagagattattcaaaggtgattagagtgatgagagagagtgaaaggagacggaaagaatggccgatagattgctgatcgattaaaagctggctggcagtaagtggagggcacgtcatca

SEQ ID NO: 29370 - DNA, 735 bp, Sorghum bicolor
  Clone ID: 9299555
ggtgctgacaaaggagctgcgcgagctcgcgcaggatttctcgcggaaaaccaacaccaagttcgagttccacaaggagaacttctaatttacatgtagcctcgatcgacccaaaagttttcgcatgacaaagagttcggtacataccgcagtcagatgatgtagtagcgtatatacggatggatgtagaggggacggaagtagacaccaaagtaggtattgcttgattgtgacagaccagttgggtcaaaaaccccaacagttttttgttcatttgctctagtagaagaattaataatccaaatgccattgtacagatcttgtctctctcacttagattaggcagtttgatcagccagcatgatacagagtttgatggcctaatcaatcagatcaaaaggttcaaaatatctgatctggcaaaggtcatgaaagttgagccactccaatggaatgcaggaaagaaagtgcacacattttgtggttgccatcagctgaggcgctccaggccacattatgtccgatcccatgttggagcaccatctctggtgggcaacaacctatgagtagtagtgctaacatgttagggttctagagggcgatgaccatgattgcatagccctggcccacataattagtattagtatgtgccttctagtgcttagtccaaagcaagagcactacacatagaaaaaaaaatgcttgtgcaatggtgtaagtattacacattctgaa

SEQ ID NO: 29371 - DNA, 717 bp, Sorghum bicolor
  Clone ID: 9299563
gataatgatgtttcagacaagagtgttactgggaggaatgaacatgtatgatcgctaccaggattggcgccttgacgttgataacatgacatacgaggagttgctcgagcttgaagacaaaattggatacgtcaacacagggttacgggaggatgagattactcgcaaccttaagaaggtcaagcacccatccttcagttccttccggttcgcaacagaaatggaaaggaaatgcagtatttgccaagaagaattcgaagcaaatgaagagatgggaaggctagactgtggccatagctaccatgtctactgcatcaagcagtggctctctcagaaaaacacttgcccagtttgcaagactgccgttagcaagaattgaaatccaaactccaggcacggcgtcggtagatcttggtggaaacggcaaattcttttgtcctgtacagcccgttatatatattattattgtataaacacaatccattcgttgcatctcgcagataaaaaatgccacgttttgttcattttccaccaaactatggattctgataccctcttatctagggtgattaggaaaaggttttgcagtaacagttaggacgagcctttgctttcataatgtatctaggctctgtttggatctcatggtttcagctctcggggttctaaacaggtgattcaaaatggtgtctaatttagcctatttagaaagatcaa

SEQ ID NO: 29372 - DNA, 376 bp, Sorghum bicolor
  Clone ID: 9299612
cgcaggctcgcgtcgatcgtctcgtctccgatccgccagacagcgagctgcccgtcgagcaagggtccggtagccttcggttatagagaagggatcggcggcggcctgctacgcacgtagcgatatgatggcccggcaacaaagcgtcgacgtccaggcctgcttgtcgtctgtgctggcggcgcttctcttcgccgccgcctgcctgccggcgccggccgccgcgggggtgcacctctgcacgctgcccgaggcgctcgccgtcaccgcctccgccaagcccggccaagtcctgcacgccggcgtggactcggtgacggtgacgtggagcctgaagagcacggagcccgccggcgccgacgcggcgtacaaggac

SEQ ID NO: 29373 - DNA, 555 bp, Sorghum bicolor
  Clone ID: 9299623
gcacgaggagaagacgatggtgccccccgtgcccgcgtgagtgagggcggcggcggcggaccgcgtggcgctggagcttagccgacgcaacgagttcttggccagagcgcgcgtgcggccaaggcccaaggcctcgcgtggctccgtcaaggatctcattggtggcgcacaagaaagagagcagctcgtcattggtgagtcactcttctccgccgccgcgtgcagcgacgagtgcctcgccttcgggaggcgccgcacagcccggcgggtggcggcctcattccagccttccaggacagagcccgtcgtgctcagatggtggccaccgggacaaggaacgaattggagtgagaaatgggaatggagtttccaagggttcagttgtgaatagcccgacggattgcatcaaactaaggacctctgttgctttgacaatggatgttgtctcagctttcccccaacgatatttctttgaggcaagaattaatactttgaattcatcattgttatggtgatggatatttgggagataactaggccttatgctttgccaag

SEQ ID NO: 29374 - DNA, 513 bp, Sorghum bicolor
  Clone ID: 9299627
gcacgagggacagcggcgccacccaccacatgtctgggcgtcgtgagatcttctccgagctcgacacgaccgtccgcggcacggtgaagttcggtgatgcgtcgcgcgtggagatccagggcgtgggctcggtcgtgttccaggcgaagaacggcgagcaccgcatcctccacggcgtctacttcattccggcgctgcgcaactccatcatgtccctgggtcagctcgatgaagcgggctcgaaggtggagatcgagcacggtgtcctgcggatctgggatcagcgcaagcgcctcctcgccaaggtaaagcgcggcagcaaccgtctctacattcttcacctcgacgccgtgcagcctgtatgcctcgccgcgcggaaggacgacgatgcctggcgatggcacgagaggctgggacatctgcacttcgacacgatccatcggctcgggaaggaggagatggcccgaggcattccggtgatcgagcacgcggcgcaagtctgcgacacctgcg

SEQ ID NO: 29375 - DNA, 562 bp, Sorghum bicolor
  Clone ID: 9299634
gcacgaggatccatctcgcgccattgcttgccttgctgcgtgctagtctcctgtccttcctcgcgccattgcaagctagcaactgcaacaatataatgggtagcagggaggtgttgggtgctgctgcgccaacgacgacgacgacgacgacgacgcaggcgaacaaggtggcagtgatgagccgccgcgtcgtcatccagctgctcgtcctccttgccgtcgtcgtctttctggccccgccgctgtcgtcgaagatgccgggcagcagcctcctgaaggagatggagaatctggtgggtctgagccccgcggcggtggcggttgcgtgctgggcggcggcggcggcggcgtgggcgtacgcggtgtcccgcccgcggccggtgtacctggtggacctgtccgggtacgtggccggcgcggcgcacgaggcgtcccgcgccaagacgatcgcgcacttcgggcggtgcgggcggttcagcgacgagagcatggcgttccagaagcggatgctggagcggtcggggctcggcgagcggacgcacttcccggcgtcgctcatcag

SEQ ID NO: 29376 - DNA, 499 bp, Sorghum bicolor
  Clone ID: 9299646
gttggactggcggctggccggcggccgacgagatcgatcatggaccgcttcgccgagacggagggcaagagggcgcacgacccgctgtacagcccgcggcgcgcagcgagggcgacggccacgggcttccccgtgggcgagcacggggaggtgctggcgggaccggtgatcgtgggcgcagggccggcggggctggcggtggcggcgtgcctcaccatgtggggcatcccgtacgtgctcctggaacgccatggcggcatcgcctcgctgtggcgccaccgcacgtaccgaaggctgcgcctccacctgcccaagcgctactgcgagctgccgctaatgcccttcccgccaagctacccggcctacccaaccagggagcagttcctcgcttacctcgaggactacatcgccaccttcggcatcaggcctttcttctgccaggccgtcgtcagcgccgagcacgacggcgacttctggtgcgtccgcgccgtcaacggcg

SEQ ID NO: 29377 - DNA, 130 bp, Sorghum bicolor
  Clone ID: 9299656
gcacgaggcctccgtgagcgaggcgctcgtgagcgtccgcggcgagaccgtcagcgggaccccgtcctctagcgccgcccgccgcgacggtgcccgggatctcctcgtacgcacgccgtccgtgcgccgt

SEQ ID NO: 29378 - DNA, 680 bp, Sorghum bicolor
  unsure (1)..(680): unsure at all n locations
  Clone ID: 9299691
atgtgtcttttagtctatagaccttattttctcagatgtatgggtcntgctccaaccccagttggacgtcataattattatgttagttttattaaacaaatatccttgatcggagcctttgcttcaagaactggggaacaaaatctacagatcacacaactgatccaggaaaaccaagctgagttcctgcgtgtaatcaatgatcctgctgggagagctgaagagagcttgccagatcagttcggtggtgctggaatgcatcggacaatagcagtgaaacctgaggagaatgaagctatacaacgtcttgaacaaatgaccttcgaccgagatctagttctggaggttttctttgcttgcaacaaggatgagcatttagcggccaactatctgttggaccacatgtccacatgaacaagtttgatgacgaaggagatggtttgggaggcgcatgatgggcacagatgtaatggtggagcccgttggattccatttgcaacacgagtgttttgaaggctgattgtcccccgttttagggtattgggggttgagatatattttgagttcactagtagaaaagagtacaacgctgacgccccctttttataccacagtcggttgtagttatcacgtgcctgtggtataaaaaaagtggcgtcaaaactaccaaccgtttgtga

SEQ ID NO: 29379 - DNA, 595 bp, Sorghum bicolor
  unsure (1)..(595): unsure at all n locations
  Clone ID: 9299711
gctctccaccaccaacgccgcctcgctctccctcgccacgtcgccggcagccaggaccacggatgttaggaaggactttgccggcctatctgttgccgtatctgtggccatcctgcttatcacccaagctttgctcctctgatcgcaaaagagcacccaatggcagaggcaactgcaaggccagcagcaaaatggcctggcttttgtggaccaaaagcatccaagtaaccaaaggggagatgcaccattccaaggggaaaagctaggagaggcgacgatgtggaaggcactatcttgaggacagaaacaccgtgtaaatgcgaggcaggcacgacggcgaggccattttattccttggttacttgcagaggagaacgaacgagagaactagtttgttcatctgagatttatgcgaagacgagacggcgatgcatggagagagggaggggtggctttattcactttgccgtggtctaggcctttcctaatgcgaattttatctgtaaatatcgattggttcattcatttatttttagctccatttagctgatcattctccccctgatccccagggtgattattggtcgaaatgnag

SEQ ID NO: 29380 - DNA, 472 bp, Sorghum bicolor
  Clone ID: 9299737
gcacgagggtcagggcggctcacgcttgaagaccacggacatggagacagtgtacgagctcgggggaaagatgatcgaggctcttgggaaggagaaggtgcagagtggggatgtgattgcgcttgacaaggcctccggtaaggtcaccaagcttggccgctccattgggaggtcgcgggattatgatgctgttggcccgcacaccaagtttgtcaagtgtcctgatggtgagctccagaagcgcaaggaggtcgtgtactgtgttaccttacatgagattgatgtcatcaatagcaggacacagggttttcttgcactgttcactggtgacactggtgaaattcgtgcagaggttagggagcagattgacacaaaagttgcagagtggagagaggaaggaaaagctgagattgtccctggtgttttgttcatcgatgaagtgcacatgctagacattgagtgcttctgcttc

SEQ ID NO: 29381 - DNA, 148 bp, Sorghum bicolor
  Clone ID: 9299741
ccggagacgacggccgtgacggcgctcgagggaccgacgaccggcgccgtattgccggtgtcggcggagcagtcactgtccacgtcgaccaccaccaccaccactgactactcggcggcctcatccatggagaacaacgcggacagct

SEQ ID NO: 29382 - DNA, 568 bp, Sorghum bicolor
  unsure (1)..(568): unsure at all n locations
  Clone ID: 9299746
gagagagggagagaggaggaggtccggacgggagagggaagaaagagagagagaggcgcgtgcgttcgtggtcggtgccggtgcgcgtggcttggtggtggccgtgccgtccgtccgtccgtccatcccgctctctcctcttccggcgccggcgacagcgggagggactccccggtgaggaatggctgggatgagggctccgctcggcgtggtggcggtggccgccctcgtcgtcgccatcttcatgcccgccgccgccgcggcgcaggcaccggcgcccgcgcccaccagtgacggcacatcaatcgacctgnggatcgcgtacatccttatgctggtggccctggtgctcacctacctgatccacccgctggacgcgtcctctccctacaagctcttctaatccctgctccttttttcgtttggtcatgcggtttatgggtgcgatagaagttttagctgcacaagatgtttaggtgaggttgggaggtttagaatgatgattgcaatcatctgatcttggtatgtaccgaaggctcgaagccgttggtgttctgattggtctgta

SEQ ID NO: 29383 - DNA, 247 bp, Sorghum bicolor
  Clone ID: 9299749
gcacgaggcttaagtggtgctcttgttggtctgcctggggtgaatggtttgtcgacagaacaacgtaaaaggttgacaatcgcagtggagcttgttgcaaatccttctattgtgttcatggatgagcctacatcaggattggatgctagatctgcagccattgtaatgaggacagtgcgtaatattgttaatacaggacggactattgtttgcacaatccatcaaccaagtattgacatatttgaat

SEQ ID NO: 29384 - DNA, 562 bp, Sorghum bicolor
  Clone ID: 9299757
gcacgaggcttctgctgtagcaaagcagaaaaccaagggcacatgctctgctgcaacaggaccgcaaaccatgacacctcgctctgctggaaagaagcgcaaatctgtaaatgaaccttcaatgaactcattctcagcattgacggaacaaaaaactgggaagccatcctcaccaatgaagaggaaagaggcatccaaaacacctgctgcaaaggagaaaaccgacggcacgccgtcagctacaaatacccaaacagagagcacgccctctgctgtagcaaagcagaaaacaaagggcacacgctcagctgcaacagggctggaaaccatgacagctcgctctgctggaaagaagcgcaaatctgtaaatgaacctgcagaggcaaaggagcatggatctgggaactcattctcagcatcgatggagcataaaacttggaagccatcctcagcagtgaagaagcagaaaactgaaaagttgtccactgctgcaaagaagcatggatctgggaactcatcctcagaatcgatggagcagacgattgggatgcttctctcagca

SEQ ID NO: 29385 - DNA, 606 bp, Sorghum bicolor
  Clone ID: 9299778
gcacgagggaacgacgggtgccagtggcggaagtacggccagaaggtggccaagggcaacccgtgcccgcgcgcctactaccgctgcacgggcgcgcccgactgccccgtcaggaagaaggtgcagcggtgcgcgcacgacgcggccgtgctggtcaccacgtacgacggcgcccacaaccacccgctctcgccctacgccgccgccatggcatccgccatgctcgcctcgtcgtcgtcctcctcatcatctgctaccgccgccagctgcgacgacgacgcgccgcggctggccttccccatctccgtgctgccaccggcgccgcaacgctattcgtgcagccgcgacgtggccataggcgccggtccgccgccggctgcgcctgcggcgacgagtcacggcgacctcgtcccgatggctaacatcatgcagaaggcggtcggggaccccaacttccgcgcggcggtgatggccgccgtcgccagctacgtcggtgagcagtgcggtggaagaatatctcgacgacatcttcaccttgccacctccctgctaataactgatgcatgggctcacagatactgcgtgaggatagggaacaaaaaaatt

SEQ ID NO: 29386 - DNA, 579 bp, Sorghum bicolor
  Clone ID: 9299793
cagttccgtgcgtgccagaggaacaggaaccgccgctgcgctcgagaaccgcagccggcagctccctccctccctgggcgcgttgctgctgctgttgatctgcgagctccggtctgcatatcagaggagattttcgtttattttggtttagatgaagagaaaaggaaacattggaagctgcgctgtttgagcgcaaaaatgagattgaaatgctgaaaggtgcaatggcctcagctgctaagcagtttgaggttgaattggcacatcgtgatcttgaaattgataagtgcaaggatgagcttggagtactctcagagaagtatttgcatgataagtctactctcgaggatgagcttacaaagctccatgcagtcatcaagaatatggaaggtgacctagaaaaaattcacaggagaaattgcagctcaagtctcggattaaagaacttgagcaggcagctcacagcttagaatattcagcttccgagatagttaggctgcaagaaataataaggaataaacaagaagaatctcttgaaaatgagaagcggatttctgtcctcaatcaagatattgctga

SEQ ID NO: 29387 - DNA, 578 bp, Sorghum bicolor
  Clone ID: 9299794
gcacgaggggaaaacaatttactgctgatcagaccgagacaatgatgatgcccagcggcgccattgacaaaagcatcagccacatcctaggtggcctgatgttctcaggcctcggcctatggcatctcttcaaccacatcaggctcttcgtctcgcttccctcaacatcctcctcatcctacgtcgcgccggcatggttcccggcgccacgagtccgccacctggagctcatcgtcatgctcgccggcggcgtctacgggttcgccacccagatgctggcctactcgccgatgcccttcaacgccgacggctccatcccgccggaacgcctgccgaaccacgagcacgccatcatgtacgcctcgctcctcgtctacgccggctccgccatctacctcgaccgccaccgccaccgccaccggcacacgacgctctgcatgctcctcctggcggcggtcttcgcgcaggagctgttcgtgttccacgtccactccacggaccacgcgggcgtcgagggccggctccactggttcctgcaggccgccgcggcgacgtgcctctccaccgcgctcctcggc

SEQ ID NO: 29388 - DNA, 464 bp, Sorghum bicolor
  Clone ID: 9299819
ttcatcttcgcacgtcacaacaacaaatttcgattgtcatccctaatatcgccgtatatacgttgtgtcgcgagtctagcatctctagacagcatcatctcgtctcgaccgtctcgtctccattgccgcgtctcgaagctataatccgctcttgacggaactgcatcatcattgtgtcatgcgccgcaattgaacgtattccaaattcctaaacgctttacctttgtctcgggtacgatctctcgacggtctatctcgctctacatagcatcctgttggtagcctgcttggagataattggcctatcttgtcgtgaagctacaatcgctgtccacccacaatgcgcttcggtcgaaccctccgcgagtccatctatccgccatggaaggacaagtatatcgactatgcgaagctcaagagcttgttgagggaggatgttgccgatgacgataaccagccgtgga

SEQ ID NO: 29389 - DNA, 296 bp, Sorghum bicolor
  Clone ID: 9299822
caggaatacctctgaggagaactttgagtgggttgagacgccaccggcgccctcgcccacgacgcccgccttcgactgcggcgtcaagacaacttcgtacccgaccattgcgaatgctcccctgcccgctgaaggttccggtcgtgactcgttcaacaactatgccctcatctcgctgctggtgggcatccccgcctacatcacctggagctggggtatgggcttcaagacatgggttttcctagccctcgttctgttcctccctatcctaggacccttctggtggctcacctctg

SEQ ID NO: 29390 - DNA, 578 bp, Sorghum bicolor
  Clone ID: 9299830
gcacgaggcacagcgactccctcccccaccttcttcttcctcctcccatccccgacgggtgcttcctactgcagccgtcaccgatctgctcatccgcagcatgactccgcatcctggccgcctcgtcctacccccagtggctccttctctcttattcccgccgcctgctgtccatcatgcctccttccgcagacacggtgatagcctactctgctgcacagcgccgcctccaggtgcctcgctcgtccgtcctctccgcctccctccgccggcgaaagtttgggctcgctccgccgctgctgttccgggtgattagatcatccctggcggacgactcccggcggcaccttccccatgacgcccaacatcctcctcggcacctcctaccgtagtatcatagacgtcgccaactcctacgccggttgtgcaacaatgagatatgatgagagtatcacattttctggttatatctcgaggtcgtgggtactaagaattagcagctattaaatttatttatctgctctgcctggccaagtgcttacaccatggaacacttctatcatgaaagtaagaaatat

SEQ ID NO: 29391 - DNA, 419 bp, Sorghum bicolor
  Clone ID: 9299841
gcacgagggcttcctggctgccttttcgttcgtggcgagccattaattgttgctgcatcttgacgacgagcccgcgaggagtttgatttgatatggaagcgaagaaccaaaccggtggcgacgaggagtgcagcaggccgcagcagcagccggtggtgatggactcgccgagggcggctcaggcggcgacgcggcgcaagaagatgacgaagcagctgacggggaagcgggacgacacggcgatgcacgcggcggcgcgcgccgggcagctcgcgtccatgcgggagatgatgtccggcaaggacgccgaggagctcggggcgctgctatcgcggcagaaccaggccggggagacgccgctgttcgtggccgccgagtacgggtacgtggccctggtgggggagatgatcaggtgccac

SEQ ID NO: 29392 - DNA, 294 bp, Sorghum bicolor
  unsure (1)..(294): unsure at all n locations
  Clone ID: 9299842
gcacgaggacggctcggcgactcgcgaatcgcgattcgcgagccccccaaaagtcccaaacccgtagccgtagtaggtctcgtctccgccccctcctctcccccaacccgatccaacccggcggcgcggcggcggcagcgatggcggcggtgacgaacgccgacgtggaggtggtcgacttcgacctcgacgacgacgacctcatggacgaggacgccgggccggatccagcgccggcccccgcccctgcctcccgcctncgctccaccatcgcgggcgacgacgcgccgcgta

SEQ ID NO: 29393 - DNA, 244 bp, Sorghum bicolor
  Clone ID: 9299856
gcacgagggagaactagtctcgagttttttttcgattcgtactccaatcgatctacgtcctcgccggaacaagaagaaaagagagtcaatcggagccgcagacatttgattctccattctccatctccctccgctatcgaatacttctctctacatccacccccattcgattatcttgtataaacactcaacatgggacaggacgtcaaggttatggtcgttggagatggtgccgtccgtaaga

SEQ ID NO: 29394 - DNA, 445 bp, Sorghum bicolor
  unsure (1)..(445): unsure at all n locations
  Clone ID: 9299870
gcacgagggccaatcgtccgtccccggcgccctccgttggtcacccgaaacccaagccgatcagctccgcaccagcaccagcaccccgtgtcggcgatggcaacaacgttgtgcatccgttccacggactgcctcgccggccgcgcctccttcggggtgcgcgcggcgcccgcgctcgctccgcgttcgccaatgcagcagcaaagtcagactccagccacggcttctccgcctcatgtggccatgaattcgcggtcggtgcgtggacgggcgaacgggcagcagcgacgtaggcaccggcggtctcccccggcggctggggccggggccggctcgccaccgcacaagcgcgttatggataacgtcgtgatcctacgcaggggccaggtcctgatggataaggccacggcgccgctgacggcgacaacctcggccccnaggccga

SEQ ID NO: 29395 - DNA, 430 bp, Sorghum bicolor
  Clone ID: 9299879
gcacgaggatgcaaccagacagcagtacacgaaagataaaccatgaatgtaccaagtgaatcgtgccagagtcaagctacagagtaaataggctgttaataaacgactcactgattataatacaatagtctgacagtgaaatacatatcaattgctatgatgtccttcaggacatattgcatgtttattcatctgttaagcagtcatcaagcagaacgttgtgcgcctattagccgcagcaggatccacaagcaggtagagaactgtggtcattggattggatgtcagatagagtgcgaggaccgcgtgaaccacctgctccggcggcaaatgctgcacctgcaccaccacctgcaccggcatatgggccccggccaccaccacccccgggtgcaccatcccacttgttaccaggaccatatcctttctt

SEQ ID NO: 29396 - DNA, 545 bp, Sorghum bicolor
  Clone ID: 9299890
gcacgagggtccaggactatgccctgaagcacagccactggactgccgtcgaatcacttggtgcatggtgtgctcgtgagggtgtccccgccatctctggtgtcgacactcgtgagattgttacctatctccgtgagcaaggttcctcgcttgctcgcatctcgattggcgaggagtacgatgccgatgaagatgaggcttatatcgaccctgaggctattcacctcgtgcgacgagtctccacaaaggcacccttccacgtcagctcctcgttgggagacatgcacgttgctctgatcgactgtggtgtcaaggagaacatcctccgcagtctcgtttcccgcggtgccagcgtcacctgcttcccttacgactacccgatccacaaggtcgcccaccactttgacggtgtcttcatctccaacggccctggtgacccaactcactgcacgaccactgttcacaacctccgcaagctctttgagacatcgccgctccccgtcatgggtatctgcatgggtcaccagctgattgcccttgctgct

SEQ ID NO: 29397 - DNA, 573 bp, Sorghum bicolor
  Clone ID: 9299902
gcacgagggtcgtcggaagctatcaggtgtatgcgatgccaatattcgaaagcatcaagatattctggtgacaagatacagattaccgcaaggattactactccgtctcgtggcccgatcggcttatgtcgcattcacgctgttcatcgcggtgaccttcctgttcttcggcgacctcctcggcttcttcggagggtttgggttcacgccgacctcctacttcctaagctgcagcagccttccgcttctttagatttattaccagtgacgaaactcgttgtacatgagtttgtgatatccacaagtgcagaaaagggacctgcatgcctgtcagctgttatatgagataagtgagagaatgagatcaccttggagacagattacagataagtgttatccacaaatattgaaggcatagcatttattctgcatatatgtgttaccagtacaatacttaatctaaattaagaatgcctgtaaagcacggtataggatataaacacttgagagtatatctgaaaattgctagcataatctttacaaagtctcttatagcgacacactaacgtactt

SEQ ID NO: 29398 - DNA, 546 bp, Sorghum bicolor
  Clone ID: 9299923
gcacgaggaaagaagttgcattggctcatgtaaggaggctgagatctctgatactaatgttgaacgagtcccaaatcttgggattactgtggattttggtaatagtaaagctggtagctcaggctttatgacagttgatgggggaaacagttctgctgcagtatcaattttgacatcttctgcgcatcacaaggcacccaagcattcagaagcaagggcaataaatacatcaatgaccaaaggaacttacactgtggatgagagttcatccggcatggatgatgcttgtaatgaacatggttcatgtaatgcttccgccatggaatgcagtgataattccgattccgagtctgaaattttccgagtcaagcgcaggtccacctcatttgacaaacctacttctgaaacaaagacgtcaaccttgtctgaacagcaggttctgaggcgactgaagaaggtacatcctgaagtacagcaggccagtaagcgtccagaagaatatgataatggctcagttcactctgcccgtatgagccagaagagctc

SEQ ID NO: 29399 - DNA, 590 bp, Sorghum bicolor
  Clone ID: 9299928
gctttctgcagctcaatagcaggcctcctctcctcccgcgcagtcctacaaggagtcggcgtcggcaacgcagatgcctccccaacatccgccctccttctccacatcctgcaagacacatccggccgcatcgcaacgatcattttcgcccaccgcgtcggcacagcccttgcgccagaatgcaagacctaccggctagccgcagacgtgtttaacgatcttgccatgatcttggactgtctgtcgccgatggtggccgcaggtgttatgcgagtctcggtgcttagtaccgcaggcgtgctgcgggctttgtgtggtgttgcagggggcagttcgaaggcgagtttgagtgcgcattttgctaagtgggggaatttggcggagcttaatgctaaagactcgtcgcaagaaactgtcatttcgcttgttggcatgctggtcggctccgtggtagtatcacacgtcacagggttcacaacaacctggatagccctcctaaccctactagccctccatctcagcctcaactacgccgccgtccgcgccgtccaaatgaccagtctgaaccggcagcgtgccaacatcgtcct

SEQ ID NO: 29400 - DNA, 496 bp, Sorghum bicolor
  Clone ID: 9299930
gcacgaggcccaactgtccgccgtcgcgcttcggcctgccgccgtgccgcctgattcgtccgcccgcccacggcagcggccagcgggggccgggcaccaccacctcgcgcggcgcggctggcggtacccggccgtccggccggctgggctggctgtgttcactgcgtgccagggtgcttaggaatgacgacaccaccaggtgacagctgtgcagcagcagcagcagcagcagcagcagcagcggatgagtagtcctgttggagggccgacgatggaattaaacaagagttgtttggtagcggaggcccgcgtcaatttaaatgatctcgcatggggtagttattgctgatcaattgggcggtcggggacggagttagcaaaacccttgcctttgctgatgaaagtctgaaactttcaggagatcagattcagtaaaataaataaaaggctgttcattcaggtacaggtacgttcatggcttcatgcgccttgttcg

SEQ ID NO: 29401 - DNA, 311 bp, Sorghum bicolor
  Clone ID: 9299935
gcacgagggtcgtctccccacctctctcggctcctcttcttcgcctgtactgctccgcgccctcaccctacgcagccagtttgctcgctcgctcgccgacgcgcgctgagccttctccacccttcttcctccaagtcctccgcagattggaccgcggcccgctgctgccccgtcggcggccccccgcaccgacccgatcatatcctcgcaggcgaattgttcaggctgaattaatcggaggaagctgcgcattggctgtttttatctcagatcatagtgataaattgacctgagagactgagatttgcgag

SEQ ID NO: 29402 - DNA, 185 bp, Sorghum bicolor
  Clone ID: 9299939
gcacgagggcggcgtcagccgcgccgcgtatacctcgttgcggtacgcgtcaccgaacgcgaggctcaccgcgtccgcggagctccgcggggacgagcagctcgtcttgatctgcaccgtgtacgtgcacgcgcgccgcgccacggcggcggcggcatcgtcgggctcggacgcctcgcctgccg

SEQ ID NO: 29403 - DNA, 462 bp, Sorghum bicolor
  Clone ID: 9299942
gcacgaggcccatttgctccaggccagcctgccggcgccggcgccgccactccttagtccgtacacacacatatagtactgtagatactatccccgccggcgcaccgccatgtctgccgccactgcttgcatgcccctggtccctccgtctcctctccatggatcatcggcggcaatggcggcggccgttgagaggcggcagcagcccggtgccatggagaccaccaagaccgccggttccgagggaacggtcgtcgtcaagaggaacacgcacggagacctctgtcgttcatgaccaaccgttctcgatagcctatagctctcctcgctagctgcagcagctgccccggtgtcccgccgccgtaaccatgaacgtccggtggtggttgaccgactgactggccggccggccggccagcctcctcctcctagtatttttcagtattatgtgtgccgttgttc

SEQ ID NO: 29404 - DNA, 354 bp, Sorghum bicolor
  Clone ID: 9299951
gcgcatgatccccgcgcgctccccatcccggtgcgcttgctgaagccccgcggtaggactgctcggttccgtgtcgttgtgcctcacaatgaccgcgcgccggcgcccccggcatcaggtcgtagaatgctgcaagcaaagccgggagagtcgtcgtcgtcgtagtcgcaggctcgcagcccccacgtacagggtagcggagtcaattagagcagcagactactggatctggaggttgtattgtatttgtagttctcattcacgggtccacttcttttgttttgtcttcatcaaaattgtacgtagcatgattgttattgtagcactttgaagtttgtagtttgaaaaatattt

SEQ ID NO: 29405 - DNA, 647 bp, Sorghum bicolor
  unsure (1)..(647): unsure at all n locations
  Clone ID: 9299955
ctgcaggcgtcgtacccgcacgccgccgtcgcctacgccgactacttngactccttcctcaccctcctccacaacgcctccttgctcggttttgacgcggcgagcacacgcaaggcctgctgtggcgccggcggcggcgagtacaacttcgactggcggaggatgtgcggcttcaacggggcggcggcgtgcgcggagccgtcgacgtacctgagctgggacgggatacacatgacgcaggcggcgtacagggccatgtccaggctcatctaccacggcaagtacctgcacccgcagatactgagcttcccggagaaatacggccagacgtagactcgcaccatcatcaatactagaacctgggagcgtagaatttaggtagaaatatactcgaaactcagagtacaaataaaggctccgactggttcagttagaagtcttggtagtactagaacctgggagcgtcagtcagctgtatcggtatatatatatgctacgagctctgggtagctctgtactctatgcatcaagctgtgagcaaaatacaggctgcagcatcttgctggtgcagtcagctgcagtgcatccatgatgagcgcagaatacaaacgtgtataccagaaggatgcagaagaagaaacgtcaac

SEQ ID NO: 29406 - DNA, 667 bp, Sorghum bicolor
  unsure (1)..(667): unsure at all n locations
  Clone ID: 9299969
actggcaagtgccacattacgtcgcagaaccacggatacgcagtcgacccgactacgttgacgagcgagtggaaggagtacttcaccaacctcaacgaccagtcgaacgagggtctgatccacgcttcgcgccccatcttcagcgcccagttccatcccgaggcaaagggcggaccgctggactctgcctatctgtttgacaagtacattgagaacgtcaagcagtacaaggagcagcagtcgagcttctcgcagaggagcaacaagcccagcccgctcctggttgacctgcttgccaaggagcgcgttggtgtgcaccccgatgcgccagactttgagggtcacgccgccggtatggacagccagcaagtcactgttggtggacctgttgcgccttcgtaccagcctattacgcagaaccctgttgcttctgcagcgtagagtcagccacgtaggcagactggggtataaggagaggtggaagaagcgtcatgtttccgttttgttttgtgcgttattttgcttgatcaagggtttccggtattgtgagcaggacgtgtgtcgggcgttttacttttccaagtagggaagatggatggatggatggtatatgaccgagatggaatatcncgggtctaaattgcaagtctgatggacgttgttttct

SEQ ID NO: 29407 - DNA, 730 bp, Sorghum bicolor
  unsure (1)..(730): unsure at all n locations
  Clone ID: 9299982
catcacattagttggcattgtgatgttatttagctaggagcatattgtattttgtttctgttcattaattaccttagcttacaacatatttctaactcatcaagcttgtcaacagagaaaaaaatagagaaatgaggaggaggtaaatcagaagttatacctacagctacagagttgacaccctcgaaggctgtagaattgccttctccagaggaatgaggttgagattaagagtaaatcaaaagttatacctgtagctatagagttgacaccttcatcttgagctggagcattgccaccatcaaaggctgcagaattgccagtatcaccaccctcgatggttgcagagttaccttctccagtgagctggagggaggataactagccaggacgatcatgcttggggagctcacccgctgatcacgattggagagcttagatcaggcacaaatctgcttctggtggccagcgcaagggaggtacatggagcaaatcacatgcgagtagatggggatgcggtacatggagcaactcacatgcgagtagatggggatgcggaagtggatcgcacgtcgccccgatggcttactgccgccgcgccggcggcgaggtccttcggctccgcacgaaggagatttttgaatttattggtggcggtgtctccacaggagagagagagagagagaaatttaaaatattgttgctgtaagnactaataataccgctgggt

SEQ ID NO: 29408 - DNA, 645 bp, Sorghum bicolor
  Clone ID: 9299990
tctctttgttgacggtctttaacttagaaatccgaccgtcaattactatcaaaaatagggaaatttggcaaaccaacatcacaaatacatttatttctaacctagttccacatgtatttggaagattgtatttttttacaggacatgtgcacaaatacatgaggacaccacaaaatggcacttttcgacacatgattacgctatcaaataaccaagacgtcaagtgaagtttctctagagcaattccccctgatgcaagcctcatgagaagaggcccaaggtccaacatgtgaagctagaggccgaggggcgccacctagggaccagcggtcccttgggctggccggcccctggctgagccctctcggcaccgcctttgttgtgctgctgcatggtgctccttggggtcagtggattgaatgcttatgcatagattgtgggagagcactgtaacaccctaggtgttaagtatgcacttagtctcattaactcctccataagcattctcatcaagcatagcatcacatgagcatgccattcattcaagtgtgattttatgtgctttgtttcatgtgaattaaatatgctaaaaatagtatgcttgttccaaaatccttgtgatgcccaaatttggttaaaatatgt

SEQ ID NO: 29409 - DNA, 669 bp, Sorghum bicolor
  unsure (1)..(669): unsure at all n locations
  Clone ID: 9300009
gtgacggtgcgctccagtggacatatctctcgccggagttagagagctggccatgcacatacctaggcagcgctgagatcggtatcccgctagactcattcttcaaacgtgcccgacactacagtaggactagtcgcagttccgccgggagtccatcattccaaacagctatcccaatgacggaaataacaacccttttcgccgaagaatcgtacatactcttcctcttccccttctctgcaggctcgaacgcaaaatggcacgcctccatccttctgaagaaaggatgcaccgtgacagcgcagttaaaggcgtgggcacatgcgctcctcgcggcgagggttctatcttcctctccttctgcgaatacttgctctttagattcagagaaagagttctcagaagggatcgccctgcacaagacgagccaggatgtgtttgaagtcgtggcgcgtgtactgggtgctttgaaccgcggtggccggtttggggggtatgtggacgctttgagagagggtgggtgggatgttgatgttggggctttggagacgaggggtgggaggagggttagttctgagtagggctcggtagctgctgtccaaggatcgtgatgtattgtagttgatacatctggctagagggggtcctcactnccaggttatagtgact

SEQ ID NO: 29410 - DNA, 396 bp, Sorghum bicolor
  Clone ID: 9300012
ggaagaggacgagaagctgctccggacgatcctgaacgcggtcttcccttccgtcgggaggccggcggtggagaggatggtggcgtccatggccaagcaggtggcctccggcgagaggaagcgggacgggaggaccgtgtccaaggaagtgcagcagcggcagctcaaggacctggagtttctgaagcagaataagctggagtcatcgtgaagcagcggcaagctgaaacttgtcgtggacactctgtagtccaagaaacacaaatcacgcgatgtggtttggcggttgtaggcttgctcggttccttttggaacgacggattcgtgaaggaattttgtaggattagaacggaattctaatatgaatctgtcatatactcatatgtgcagcccttt

SEQ ID NO: 29411 - DNA, 566 bp, Sorghum bicolor
  Clone ID: 9300020
ggtcttcaccccgatgctgctcatcctcaccatggccttggggagctcgtacccgaacctgaggccgaagagtccccgaacattgccggcgtacttctgcaccacgccctgcgtggcggcgtcgctccacagccgctggtccgactccaggaccgcgccgccgtcgcggacgttcttgaagaagctcacgtcgaacgcgccagggctaccctggtccagcgccacccgccgcccggccgggtcgccgccgctgggcggtgggcacagcgcccggagctgcgccagcgacgcctggctgatggtcgggtccgcgttgcccgtcgccgtgaagttgtacagccggtagctgaagaactggcaatcggtctgcccgatcgtgtgagcgcctaccaatgtgacgaggtcgtggtctgtcagtccctggtccgcgaacttcttcctctgaacggatacaggatcggcaggcgatggcaaggcgttggcgccagaagctgacgagagtctcccgtctcttctccccagcggcactgaccagcttggcccaccagtcttttacattacattta

SEQ ID NO: 29412 - DNA, 581 bp, Sorghum bicolor
  unsure (1)..(581): unsure at all n locations
  Clone ID: 9300023
acgcaccccggcgctgtgtctcgacgtcgcactacggcncagggcgcgcctgcgccagcccatcccgcgcgggtggagcgcatgcgcgtacgtcatccacggcgaggccgccttcttcggcggcagtgccagtgacggcggcgccactaccgtcaccaccgccgccgcacgcacgctcgtcgtgttcggcaacgaaggtgacggcgactgcgtggaggtgcggggggctgatgcatcagcggggcagcaggacggcgcgagggtcatgctggtggcggcgcggccgcacaacgaagcggtggtaagggacgggcccttcgtcatgaacacccgggaggaggtggaacaggcacgggaggactaccgccgccgccgcaatggcttcgagatggctgatggctggacctccgaccacgcatccactgttgcaacacattgataggatacactacctaggctagctaggcgcgcgtggatggatcgcaagtattagtgtatctaagttaagttgtgggattttgcccaaaaaaatgttggcttcgtagcatataaggaaagtgtttgcaataatgtgaaatatt

SEQ ID NO: 29413 - DNA, 535 bp, Sorghum bicolor
  Clone ID: 9300076
gcacgagggcagccacgcaccactttcctggaaatctccgtgatgccacccgacagcagagaggaaaaagcaacagggaggccggaatctttcgatcgagggcaccaccggcggcgggggtagtagcacaggaggggagccgtggagcgatccggcgggcatctgcgcccgatgtgggcgtggggctgcgtcgagcgcgtggccgcgggcctcctcggcggccccctcgccggcggcggccgctggaacaccgccgtcgccgtcggggtcacggccgccgcgggcctcgcgctcgtcgccatcgtcgtctcttcccgcagaggcgggctcaagtctccgtggtggcggcggcggaggaaggcgccgcttacggcccaggagtggcgctacctgttcacgccggaggggaagcttcaggacggcggagtgaagcttctaaagaaagttcggagcggagggattgaaccgagtatcagagctcaagtctggcccttccttctaggagtttatagccttgacagttctgaagcacaaa

SEQ ID NO: 29414 - DNA, 202 bp, Sorghum bicolor
  Clone ID: 9300139
ctagtaccaaaattaatttttcatatgatgaagaacagaaggtctggatcccacaagataaaaaggatgcaattgtcttgattcttgtccacaggcagaaagatctgcaagcacatatgcatgactggacagactgggctcagcagaaagtgatgcatgtcgcacaccgacttgcaaaggagaaggatgaacttcagtcact

SEQ ID NO: 29415 - DNA, 295 bp, Sorghum bicolor
  Clone ID: 9300154
gcacgaggttcgcttctaagagaggaacctacaggggaactgcagttgcttacagcgccgttgaaatcaatcgatggtctgattttgtttgaccggccaaaatgtagcctcccagcggaggatgtttcttcgatggcagcgtcttcgtcgaactcggaggctgtggattttgatgctgcatttgcagacttggatggaaagattagggagcgtttgtctgagaactcttgcagttattgcttacagcctctgccaagtttacattaccggtcacaaaaggaggcagatacttttc

SEQ ID NO: 29416 - DNA, 524 bp, Sorghum bicolor
  unsure (1)..(524): unsure at all n locations
  Clone ID: 9300176
gcacgaggcccctcggcggcgtccagcgacggaggggcagtcccangctcggcggcggcggcggcggctcctcctcccgcctctcgccagtcgcctcgcgccctcgcctccgtcctccgcgcaccggccggcgaccctgcggaagcaatggagtggtggggtgctgatgttctgtgctacttccgaacctgaaaggagcttcttgcaatggcgccaggaagcagcattgtgactgtagtccccgagtcggactgtggtgatgacgatgggctttctgaggcacttgggggtatccggcttgacgtagactctgcaagtaaaccatggtctacatcactagccaatgttgcattatcatcactgtctggcttgaatgatttgctcgaatgtccagtgtgtaccaactcaatgcgcccacctatactccagtgcccaaatggccacacaatctgctctagttgcaagcacagggtggagaaccattgcccaacttgtcgccaggaactgggaaacatcaggtgctt

SEQ ID NO: 29417 - DNA, 414 bp, Sorghum bicolor
  Clone ID: 9300177
gcacgaggccgaaaccgacgaaccgacgtgaccggatcaaaagccggaggcaggcagcaactgccaacggccggttccggaaggccggggggttgcgcgcgcgccgcgatggggccggacggcggcgtcgtcgtcggaggagtgatcggggtcctggtctacggggcgctggcggtggtggcgctgcggctggtgctgtcgtacaagtcggcggcgcacgcggtgcggcgggcgtggcggtgggcggacgagtgggcgcaggcgtaccagtactacgaggtgccgcgcctcgtcgccgcggccggggacggcggcggcgcggagaacccgctgttccggaaggcggcggcgtacgtggcgtcgctgccgtcgctcgaggacgcggacgccgcctgcgtgctgtcgtcgggcgcc

SEQ ID NO: 29418 - DNA, 433 bp, Sorghum bicolor
  Clone ID: 9300187
gcacgagggttcggttcatggcgtgtttccggagcaagctgtggtggatgtcgcagcggatgggggacaagggcggcgacgtcccacacgagacgcagttcctgctcgtggagtccaggggcgccggcggcgaggacgcggcgtacgtcgtgttcctcccgctcgtggagggcgcgttccgtgccagcctccagggcggcgcgggcgacgcgctggagctctgcgtcgagagcggggacgccggcacgcgcgcggcgtccgtcgagcgcgcgctcttcgtgggcgccgcggagtccgatcccttcgcggccatcgccggcgccgtcgcggcggccaagtccgcgctcaggacgttccgggtccgtgccgagaagaagctcccgcgcatcgtcgactacttcggctggtgcacctgggacgccttctaccaaga

SEQ ID NO: 29419 - DNA, 368 bp, Sorghum bicolor
  Clone ID: 9300198
gcacgaggcgccgaggtgcagcagtggatcaaggacctcgccgccgacgagctcatggcggcggtgcgggcgcgcctcaacggcctcctcggccgctacgcggggaggttcccgcactacgacgtcaacaacgagatgctgcacggccggttcttccgcgaccgcctcggcgacggcgtcgcgccgctcatgttccgcgaggcggcgcgcctggacccgggcgccgcactcttcgtcaacgactacaacgtcgagtgcggcaacgacggcaacgccacgccggagaggtacgtggagctcatccgcggccttcagcgcggcggcgcgcgggtcggcggcgtcgggctgcagggccacgtcacgcaccc

SEQ ID NO: 29420 - DNA, 303 bp, Sorghum bicolor
  Clone ID: 9300207
gcacgaggcatacggcattcagaaaaaaatatttcgcatggctcagtacagagacaatatcaagtatgaagaggacttctttgtgaattcacgaggaaacaggctgttcacctgcagttggacgccgaggaaatcacagagcagagctctgatctttatctgccatgggtacggaggtgagtgcagcatatccatgggagatacggccgctcgattagtacaccgtggctatgctgttcacggaatcgaccacgagggccacgggaaatcttcaggctcgaaaggctacatatcgagcttcaa

SEQ ID NO: 29421 - DNA, 627 bp, Sorghum bicolor
  Clone ID: 9300208
ctttcaccgtcagatcccctcattgatctgtcggacgtctccttctccatctcccctatcctctcttggtagagataatcatcctccatctatccgagctgatctgttcggttgtggacacttaatcctctactctctcacaagctcgatctccatccacgtcacatccttagactcttcatcatgtctgcggagcctgaacacactcatgagaagaagagggtccatctccaggacgcctcgggtgctgagaagaaagatgagctcgatacctcaactgcgattctcaagaagaagaagaagcccaactcactgattgtgaccgacgccgttaacgatgacaactccgtgattgctctctctaacaacaccatggaaaccctccaactcttccgtggcgacacagtccttgtcaagggcaagaagcgcaaggacactgtgctgattgtgctggctgatgatgatctcgatgatggaagtgctcgcatcaaccgagtggtgcgacacaacctgcgagtgaagcacggcgacattatcacagtccacccttgccccgatatcaaatatgctaagcgcatcgcggtccttcccatcgctgatacccatcgaggtctgaccggctctctt

SEQ ID NO: 29422 - DNA, 541 bp, Sorghum bicolor
  Clone ID: 9300211
gcacgaggggcaaagaccactttaatggatgtcctggcaggaaggaaaactagtggagctattgaaggagatattaccctgtccggtttccccaagaaacaagaaacttttgcccggattagtggttattgtgaacaaactgatatccattctccgaatgttactgtatttgaatccatcacctactctgcctggctgcgtctttcctcagacattgatgatggtacgaaaaagatgtttgtggaagaagtgatggcccttgtagagcttgatgtgttgcgcgacgctcttgtgggtctccctggagttagtggattatcaactgagcaaagaaaaaggctgacaattgctgtggagctggtagcaaacccttcaatcatcttcatggatgagccaacctctggtctcgatgctcgagctgcagcaattgtcatgcgtacagtaagaaatacagttaacactgggcgtactgtggtctgcacaatccatcagcccagcatcgacatatttgagtcttttgatgagcttctgcttttgaaac

SEQ ID NO: 29423 - DNA, 719 bp, Sorghum bicolor
  unsure (1)..(719): unsure at all n locations
  Clone ID: 9300237
gtggacttgcatgagggctgcacgtttaaccaccgatatgtgaagcccaacccttacgaagtggaaaatgctacatggatgctcactgttttcaagtgttttgggcagcacttctgcctgcactttgaggcgttcctgctggggatggcgccggtgtacatggcgtttctgcggttcatgggtgaggagagcgaggcgcaggggttcgggtacagcctagaggtgggtgggggcgggcggaagctgacatggcagggcacgccgcggagcatcagggacagccaccggaaggtgcgggacagcttcgacgggctcatcatccacaggaacatggcactcttcttctcaggcggcggtaggcaggagctcaagctgcgggtcactggccgcatctggaaggagcaagggcaatgaaaagcatcgcaatcccgttctcccgtccctggtggcgcaccgtgctcatccgggggccgcttctgctgatctgctcctcgccatggttttagtcccattccgtgttcgtcctgtgcatttgatgtatgtacaaatattttggatacgttgtagcctagactagactgtctccagacctcattaacacgtggggaaagccccggcaaaacctgtcagtctgacatgtgctcatgttgatgccttttgccttgtctggttgtccctgcaaggtaggcgtttttgttancaagtgttgatacctgtgc

SEQ ID NO: 29424 - DNA, 655 bp, Sorghum bicolor
  unsure (1)..(655): unsure at all n locations
  Clone ID: 9300248
ctgctcaaaaagtacaatctctcagcccaagatgaagtaattgctagtgcccgaaaaaagtttgaagagggttccctggatgaagcagttagggagctaatcaagattgatcaagaatatggttcggtaaactcatgtccttacaccatttggctcataggcctcattcaagcaaggagaatagatgatgccctcaagatttttcatatacttgaggagtctggcattgatatcacaccagcttgctgtgctcatcttagcaaatacctgtgttgggaaaaaaatctagattcagcagttgatgttatgctctatacattgaataaacgattcattatgtcaagacatgtaggcaaccggttacttagtagtctttgtatccgtcacaggaggaaggacgcacaggcccttgcatggcgaatgcatcttgtaggatatgatatggatgcatatcttcgtgagtctacaaaaggtttgttatacaataaatagaaatgtcagtagggtttgtaggactacagagcttgctctcgagagggctgctgatattttgaacattttctctgtaccaatttgttctaggtaaccccaaagtagggtttgattcactgagttcttagctcttgtagtggattttataacccactnttcagtt

SEQ ID NO: 29425 - DNA, 596 bp, Sorghum bicolor
  Clone ID: 9300275
ccggcgcgcgggtcggcggcgtcgggctgcagggccacgtcacgcaccccgtcggggaggtcatctgcgacgcgctcgacgcgctcgccgcggccacggagctgcccgtctggttcacggagctcgacgtgtgcgagcccgacgacgccctccgcgccgacgacctcgaggtggtgatgcgcgaggcgttcgcgcacccggcggtgcagggcgtcgtgctctgggggttcatgcagggacacatgtggaggcaggacgccgcgctcgtcaacgccgacggcaccgtcaacgacgccgggcggaggttcgttgaactccggagggagtggacgtccgacgcgaggggacgcctcgacgccgatggccagttcaagttcaggggcttccacggcaactacgtggctcaggtcaccacgcccgcggggacgaagatgctcaaggcgttcaccgtcgacaaaggggacacgcctctcgtcctggacatggataactgaacatcgccgcctgacaattacagtacatgcaccactgataatatgagtgctgatgtattgtactggctgagcctaagtatattaattgatgtgatatactaa

SEQ ID NO: 29426 - DNA, 673 bp, Sorghum bicolor
  Clone ID: 9300282
ggaggaaccgtggtgcttcagctgcatcggaaggaccctctctattgggacggtgccgtgttgcttgcccctttttgcaagatgttcgataacatgcgtcctcacccgatcatcgtcagcacactgaagatgatcagcaccgttgcgcctagctggagagtcatccctgccatagacatgattgacaaagtctgcaaagatccccagttcaagaaagagatccgttccaacccgtacatgtacaaaggaaacctcgcactgcaaacaggccgcgaactcctctccgtcggcctagacaccgagaagaacctgcacgaggtctcgttgccgttcttggtcctgcacggcactgacgacgtcgtcgctgatccttgtgggagcaagctgctgcacgagagggcgtcgagcagggacaagacactgaagctgtatcccgggatgtggcacgtgctcatgggcgaactgccggaggacgtcgagcgcgtcttcgccgacgtgatctcgtggctcgacgacagggtgggcggtacagctaccgttcccggcggcatggcagatcgtcatgagctagtagagtgtagagatgcagtagaatagaacacaggccggttgtaaataagttacaaggatgtattgagcctttccaagcatttttttgaacacaataggctaa

SEQ ID NO: 29427 - DNA, 688 bp, Sorghum bicolor
  Clone ID: 9300283
tgtcaatcagcttttgactgagatggacggtatgacctccaagaagaacgtgttcgtcatcggtgccaccaaccgccccgagcagcttgacgctgccttggtccgccccggtcgtctcgacactctcgtctacgtgcccctgcccgaccaggcctctcgcgagtctatcttgaaggcccagctgcgcaagactcccgttgctcccgacgtcgacatggccttcattgccagcaagactcacggattctccggtgccgatcttggcttcgtgactcagcgtgctgtcaagctcgccattaaggaggccatctctctcgacatcgagcgtacccgcgcccgtgaggctgccggtgaggatgtcaccatgggcgagggtgaagttgaggaggaggaccccgtccccgagttgacgcgcgcccacttcgaagaggccatgaagactgcccgtcgctctgtcagtgacgtggagattcgccggtacgaggcctttgctcagagtctgaagaactctggtggcagcagcttcttccgcttcccgtctgctggtgaggtgcagaataacgacacctttggcgaagccggtaacgacgacagcctctacgactaaacgggtttttgacattctagggggcctcagttcacgacatccatattccattttctcctccacttaagctgtgctatgcag

SEQ ID NO: 29428 - DNA, 521 bp, Sorghum bicolor
  Clone ID: 9300313
gcacgaggctcaaataaagccggagtcagtggtggcaggcgaaggtcagcgtgatccttcaacggccaacaacaatagtggaagtagcagcagcggccggaagatgaagccgtcgtcgtccgggttcaacttcgccggcgggacgcagcagcagggccagcagcagggcgccgccgggggccacctctcgcggatctccgaggacggctgcgccagcttcccggccggcggcctggtgggcgaccgcgctgcaggtggccgcggctctggcgagagcagcagcggtggtgctgccgcggcggcgcgctcgtactccggcgggttctccattgttgggccgtgggaagagtccagggacatcattaccaccctcggcgcatacgaccctcagtttagcggcgccatggcgggtacggcgctggagatggcgggcatggacaggtacatgcagctgcagcatgaccaggtgccgttcaaagtgcgcgccaagcgcgggtgcgccacgcaccccatgagcatcg

SEQ ID NO: 29429 - DNA, 508 bp, Sorghum bicolor
  unsure (1)..(508): unsure at all n locations
  Clone ID: 9300315
ctcgcgaagatggaagaagcgatgcgtaagcagcagcaagagctcactgcactaagacatcaactgcatgaggttgagcgtgaaaaggctgatggttctcagctagtgcagcaggattcttttggaggtagattgctggcacggctatcagagatgcctgcaggccttgatcaatcaatggcaatgtccatgtctatggacttggatacaggagatcagccagccatgcaagacgtcaaggtaataaaggaggatcctcaccagcagggccacatacggaatcaaacagccacagcagcaagtgcttgcacagggtctgcggtgcaagaagatgatgtcaggctgtccgggtatcctgaaaagactgtcctcancactgtgtttgaggagggagacgaagatgatgcagagaaggaatgtggtcttcaagaggaggtacgcaaggaggttgtataggagaactttaagatggacacaacacaacatacactttctgagccagacgatc

SEQ ID NO: 29430 - DNA, 512 bp, Sorghum bicolor
  Clone ID: 9300322
ctgaagcgcgcccacgagctgatcggggtcaaccaggccccgacggccttgaccctgctccatgagcacatcaccaacaagcgctcccgaagcgctgccatcgcctctctcgagcctgttatgctcctgttggttgagctctccgtcgagcagaagaagggaaagctggccaaggacgccctgtaccagtacaagaacctttcccagaacaccaacatttcgactattgagctggtcctgaaaaagttcatcgaactcgcggtggagaaggttactgctgcccagcagaaggcggacgaagttcaatctaccattgaggctacggctgctacctccaacattgacgacctggaagccagcgagacccccgagtctatcctccttgccaccgtctctggcgagcaatctcgtgatcgaaccgaccgtgccatcgtcactccttggctcaagttcctttgggaggcttaccgaaccgttcttgacatccttcgcaacaatgctcgcctcgaggt

SEQ ID NO: 29431 - DNA, 548 bp, Sorghum bicolor
  Clone ID: 9300327
tgccgtctcctctactgctcgcctcaaagcacccaaatgacgacaatagagctcttgaggcgctttctccgttgggttctgataatgagggcgatagcagacgccgtagccgacgtgcccgcttccatgactcggaagatatcaccactcaacttgcacaggccctcaagggaagccgccgtcccgacaccgagccgctcattgaaatcctaccaagtttgacgcatgatcaagtgatgaagcttcgtgcggactacaaggcacttgtcaagacgggttctgagcgcaaaggtgtgaacatcgccaagcatattcgtgctcgtctcaaagatgaagatccgctattgatgaaggcctgctactccgttgctctcggcatgtgggagagcgaggcatactgggccaatttctggtaccagggtgacaagactcgcagggagcttctcattgagtctcttatgggacgcaccaacggtgaaatacgttacatcaaggatgcattcacagacaagaaatatgacaacagcctcgtcaagtgtatgaaggaa

SEQ ID NO: 29432 - DNA, 483 bp, Sorghum bicolor
  Clone ID: 9300331
gcacgaggagctcgccttcttagcctgagctcctgtcaagcagacagacaatcacaagcacgaaatctactccgatccaatcttcggtttgaattgttgatcttgatcccacaaccacaagctcggtcatggctccatccagcaagcttgtcaagacgagctcactcccgaagcaccagcgcagtcttgtccagccgctccattctcccaggcacaagcgcgtctctgccttgtgcccggctgcacctgagtcgttgctccaagagttggtcaccgccgccgccgcctgcgacgcccatcatcagccaagagcaaagcgcgcctccgacgagactctcgccgtgcacgctggggagaacctcgggaagaagggcgcggacgtggttggcactggcactggcaccgagacagactcgatcgccaccccgatcgtgagcggcacgacgcactggttcaagagctccgaggacctcatcgccttca

SEQ ID NO: 29433 - DNA, 568 bp, Sorghum bicolor
  Clone ID: 9300369
gcacgagggtcgccattatctacgaggccgatgagcccagcgagggccgcacaatcacctacggtgagctcctgcgcgaggtgtctcgtgtggcctgggttctccgccagcagggtgtgaagaagggtgacaccgttgctatctaccttcccatgattccggaggccattgtcgctttcttggcttgctctcgtatcggtgccgtccactccgttgttttcgccggtttctcgtccgactctctccgggaccgtgtcctggacgctggctccaaggtcgtcatcacgaccgatgagggcaagcgtggaggaaaggtcattggcaccaagcgcattgtcgatgaagccctgaagcagtgccccgatgtcactagcgtcctggtctacaagcgcaccggcgcggaggtcccctggaccaagggccgtgatgtctggtggcacgaggaggtcgagaagtaccccaactaccttgctcctgagccggtgaactcggaagatcccctcttcctgctctacacctctggttctaccggaaagcccaagggtgtcatgcacaccacggctggtta

SEQ ID NO: 29434 - DNA, 527 bp, Sorghum bicolor
  Clone ID: 9300370
ccacgaaccaccagcaagagagcatcaaggaatattgatggcgaacaatcccaacgacctgccgtggtttgatcggcggacggtcctcgacgaggtccagctgctcgccgtggaggacaacaacaacgccgaacatgggtggaccaaggcacagatcaaggattccttgattgccagacatcacgaccagcagcagcagctgccaccgggcttcgacgccgagtttgggagggtgctctctgacctcctccgtggagaccaccttgtcacgggagacaacccgcagtgctacaagctgcacaccgtcgtcccgcatcatctcccgccgtggtttggtaaggatgctgtcctgcaggaggtcgagaagctcgacaaccaaaacaacaacaatgatgggtcgacctgggcaccgatcaggaattccttgttggaaacataccaccaccaccagcagcagcagcagcagctgccgccaggcttcgacaggttggtgcgcaagatgctatccgtgctccgaaacagaggcc

SEQ ID NO: 29435 - DNA, 550 bp, Sorghum bicolor
  Clone ID: 9300387
gttgacctctcgataactggccggtgtccagattccagaacaaaagaaacctgcactagacatcggcaaggggtagcgttggcgtgccatggattccgccagggcgatcaaaggcgagcgagatctgccggaggcagagaaacgccggccaaccgttccgggcactgtcactgccgtcttcttgctctcgttgccgctgctgctcctgttcttcctcttcggcgaccgagccgtcgcctccatcgccggcgactccctggttcggcagcagagctccggcaatgcgtcctcgtcctcgtccccggagacgacaatggaccgcgacactctccacgatcggctcctcggcgggcttctctcgccagacttcgacgcggcgacgtgcctcagccggtacgaggcttcgaagcgatggaagacgccgtcgccgtcgccgttcccggtgtccccttacctcgtccagaagctgaggcagtacgagtcgaaccatcggcggtgcggacctggcaccgcgaaccaccgcgaggccatggcgcagctcatgtccggc

SEQ ID NO: 29436 - DNA, 493 bp, Sorghum bicolor
  Clone ID: 9300393
ctcctgctgctgctgctgctgccggtggcgagggtcgacgaccaccactctttggatctggcggcggttggcgagagaaggagcgtgagagagattccgctagagattccgcagagggcggtgctccggcacggacagagtctggcgatcgcccgtccggcggcccgccgagactgcagttggccggctccggcaacaagcccagctggagagaccgacaagcagccaaggaatccggtggggcagcaaacgacaatgctccccctccggctagaggccctggacctcgcgattctcgcgatttccgtgacgctcgcagctctccccgcgactctcctcgtgattctcctcgtgattctcctcgcgaggactcaagacggggcgagaacggcaagactgagtctcctgccgctcctacagagagcctgcctactcgaacctctggcaagtgggttcctcctcacctgaggaacaagtcatgaagggaatgaag

SEQ ID NO: 29437 - DNA, 220 bp, Sorghum bicolor
  Clone ID: 9300444
ctgggtgacacttctactctgtcggacccttcggttgttgacaagatcattgccacggtgcacgctgcccgtggcaaataagatcttcagatgaaccgaaatcaagacgagcgatattcacagccatgaaatgaaagcgattaatcaggacgttatgatgagttgattagcattattgggtggacacaattgtccggaggagcagtcatattcatataaa

SEQ ID NO: 29438 - DNA, 143 bp, Sorghum bicolor
  Clone ID: 9300445
cactacacacggcggcaggctccggcactctccgaccctaatcctattcccatggaagaattccagttgggcttctatctcggctacaccatgggggccatgggcggcttccgcaaacggcaagttcgagggcatgatggagg

SEQ ID NO: 29439 - DNA, 648 bp, Sorghum bicolor
  Clone ID: 9300454
cctcaaggatttagagaagacctataaccgtggcgacaggttcgaggccacgatgaagtactcctttctgcaccccgtgacagagctacctatccaaggccagcctctgcccgaaggtgttaagtatgcctggctgccgcgtatccgctgcctggactgtacaaccaagctctatacacctggcccagatatgacggttaagaagtttgagacccatctcgatttctcagggcacaagaatgctgttgctaagcgcgtggcgagggaggccaatccttgagttttcgattcattatgagggcgcttctcaagcagcatgtgaaacagaggtttcgccactgtaacgtataccttgctgcccggccttgttgtcttgggctgcatcttgctcaatgacaaaaggggcgttcttggctctttgcatatttacttggcctcgggattttcactttcaaagacagagagtttgtgactggtggattttcatcattgctttgtacataaaacctcgagttctgtgagcacagaagggaatgacggggtcatgaggaaccgacgaaacgaacagctgtctccctctcttcaggttggtctattattcatttggagtctacgggagaactgggcgctgtacaattgggctaagac

SEQ ID NO: 29440 - DNA, 393 bp, Sorghum bicolor
  Clone ID: 9300457
ataacagtacggcgctgcgaatggcacgcatcctagagcgccacccaaagatcgagcgggtgcactaccctgggctggagagcagcccctggcatgaggttgcgacgagtcagatgtcggggtacggaggcgttgtgagcttcgagctgaaggcggacttgcatggtaccatgagctttgtggatgcgctagaaatccccttcatcgcgacctcgctaggcgggtgcgagagcctggtgcagcagccggcggtcatgtcattctggggacagagccaggaggagaaggccaagaatggcatcaaggacaacatggtcaggttcagttttggaattgagaagtttcaggatctcagggatgatatacttcaagcgctaaacaggatttaattac

SEQ ID NO: 29441 - DNA, 574 bp, Sorghum bicolor
  unsure (1)..(574): unsure at all n locations
  Clone ID: 9300465
tgatcaaagggctgaaggtactgcacaactcatgcctttcagatctgaggaagctcatagaggctcactttgaagaagtaggcagcaaacagcagcagcatcagttcaccttccttctcctcggggacccgtccggtgctcccgtgtccagggacaaggaagcttcggtgcagataagcaggctgcctcactggaacaaccagccggacagctacctggcgtgcctgcgcgcggccaagaagccggctgtggacaacatgcccttcagcccactggacagcaagctgaacacggttttgaaggacgcccacctcgccggtgcgatgtcacccaaggtcaaccagatgagctcgcccaaggtcaaccagatgagtcccaactacatccgggagctgagagcttgagctcccgtggcatcttttacagtctgtcgtggccatatgactggtgtatcttcttctatgtatgatcgatcganctatgttctatgtaagattgattgctagtctggtttctttagccggaacggaactactaccacccatgaccaagatagttgtaatttcaaactatg

SEQ ID NO: 29442 - DNA, 628 bp, Sorghum bicolor
  Clone ID: 9300469
tcacgttcgagatcatgtacgagcagatcacccggtgcacgcgggagcatggcctcctgccacaagtgaccgacaccagcgagccgggtgcccggccgtccaacggcacggcggccaaggtcaaggccgtgctggtggtctccctgaagccggagtactacgacaagctgcacagcgtgtactacaccaacgcgacggcgaccggcgaggttgtcacggtgtaccagccgagccacgaccaggaccagcacacggaggcgcgcgcgcacaacgagcgcgcccttgccgagatcttcctgctcagctactccgacaggttggtgaccacggggttctcgacgttcggctacgtcgcgcactcgctggccgggctgcgaccatggctgctgatgctgccggaccggaccacgaacagggccgccgtggcttgcgtgaggccagcgtcggtggagccatgcctgcactcgctgccgtcgctcgtctgccgggcggaacaggatgttgacccggtggcgcatctgccattcctgcgacactgcgaagatgtgggcctcggcctcaagctgttcgattgatttcgctcctgcatagatgcttgcttcttcgcaatggtactatctgtacattt

SEQ ID NO: 29443 - DNA, 412 bp, Sorghum bicolor
  Clone ID: 9300472
gctaacccaactccttaatgactcacttggaggatcctgctacaccgtcatgattgccaacattatcccctctcatctttgctttggcgagacacaaaacacgcttcattgggctgatcgtgccaaggaaataaaaacaaagacccagactactgcaaacgaagaggttctggatcaaccagattctgaaactgctgtgcttgtactggagcttcagagggaaaactgtgtgctgagggagcagctggcgaagcaacaacagaaattactgattgccgaagctcagttacttgcttcaaaaaccttgccacaacaatctcctgctcgctcttctcatgtttcaactacaggctcaactcaaagaaagaccagacgatctatcgtggctgggaactacttcaacactacagac

SEQ ID NO: 29444 - DNA, 493 bp, Sorghum bicolor
  Clone ID: 9300477
ggcgaagggagttggccatggagagcacggcagccgatgctgcctgcttggcctcgacgcgcgacagctggctcgcccacggcctggggctcactagcacgcggctaggcgcgcgtagcccccggcggctcgtggcctgccagctccggcggctcggcggcccggcgtggcccctggcggccaggcgcgcgcggtcccggcggctggcggcctctcgtcggccagcgcgggcgtggtggcacggcgggcgcggcccacggctccggcgggcgcgtggctcgcaacgagcagccagggcgtgcggcccccagcggttgcgcgcgcggtggccacggcggcctgagctggctcgtggccctgcggctggcggttgcgtcctgggccggccaggggcacgagcgcggctcccctgcaggcgcagcaccgggcaggtgtatggcctgcggctgctgtccgcgcgcacggcgggagcggtctggcccgtcctggcgcg

SEQ ID NO: 29445 - DNA, 530 bp, Sorghum bicolor
  Clone ID: 9300487
ttgatatctccttctacctaatgcttcttcatgccaatcaaggcgagaagtttgggctgctaaaaactatgttcagtgcattctcatcttcattcgaccccttggattatcatatgatatggcatcagcgttcgattttggaagctgttggtgctttcagttcaaatgatcttcacctgctagatttaagttttgtttatcaattactttgtcttgggaagtgccattgggctatctatgtcattctacacatgccgtatcttgacgatgccccatacattcatgaaaaattaatcagggaagttttatcacagtattgtgagtcatggagtagagatgatgctcaaaggcaatatattgtggaacttggtataccagaagaatggatgcatgaagctctggctctttatcacgaatactatggagataagcagggtgcactggagaattttattcagtgtggcaactggaagaaagctcatactattttcatgacttctgttgctcattctatgtttctgtcatctaac

SEQ ID NO: 29446 - DNA, 552 bp, Sorghum bicolor
  unsure (1)..(552): unsure at all n locations
  Clone ID: 9300491
gcacgaggactccacgcccgccgctcgctttcccctccctcctcgtctccgagaaactctcgcgcgcctccgcaacggacgcctcggcacctccgcccccccgctcgtcccgtccctcccagttttcagagtggtcttgttgaatttctataccaacagcactgccattttcacagtattgaaaagctattgctgtttcttcactcactgacctgcaagctctggtaatttagaagaaatatgagttgcttctgagtgttctggctttgttaaataaatagattctcttcatagagtgctaacaaatggatcgccatgatacttctgggtttgttagtggaggatgcaaggacacgaaggggctgctaacaagcatatatttctaactatttcattgcattatgtaacctagaagtgatgctgactgtactttcccgaaaaagatcagtctaatttggtggtattctctgctactagcagcaatggatcatacgcttgaacacttagggtataccaganaatcttcgaattcagacaccctaggaacctgga

SEQ ID NO: 29447 - DNA, 210 bp, Sorghum bicolor
  Clone ID: 9300513
tgcgaaaggcacagagagatgcatcagctacaggcgagctgaaaagccccagccaccggtttacatcaccagcaccaacggcaaagaagcgtactttctgggacatcggaggcaacagcccttcagttcttgctgccaatggaagaaagacttgaagccatgtagcaacagagacaccgaagaaaggttcttccaagctgcttcagccag

SEQ ID NO: 29448 - DNA, 607 bp, Sorghum bicolor
  Clone ID: 9300521
gacgcgtcggcgtgcgcctctcgccgttcaccgactacatggactgccatgactctgacccggaggcgctcgcggggtacatggtggagaagctcagcgaactcggcgtgctctactgccacatgatcgagcccaggatggccatcgtcgacgggcgccggcagatcccgcaccgtctgaggccgttcagggagaagttcaggggcacattcatcgccgccggcgggtacgacagggcggaggggaacaaggtggtggaggaagggtacacggacctcgtctcctatggaaggctgttcctggcaaacccggacctgccccggaggttccgcctccccgacgccgacgcgccgctcaacaagtacgaccgcaacaccttctacacctccgaccctgtcgtcggatacaccgactacccattcctccacgacgacgacggcgccgacaaataaatgatctatatcgtcgacgccgccctcccagtgctgtgttgctcttcaaatttcaattccacctctgcatatgcttcctagttcctccctgctgtgttcagccaatttatacatggcaggcagggggtgcaaataaaattaagcttaaccggacc

SEQ ID NO: 29449 - DNA, 428 bp, Sorghum bicolor
  Clone ID: 9300528
gtggcggtgagacacttggtgctatgggttcatcaggatctgttatgaacagcactggaaccatggagagtggggcattcgattcttccaattttggtgaaggtaccagcaatgttgcgcatcctgctgaggctcttggtcacacagtaatctctgctccagaggggagggtacgtggtggtaatattatggttatgctttctactgggatgaatattggaaagcaattaagctgcaatatggatgcaagcacttctactggcaattggctgtagcatgtaaaacaccaatcctgttcaattggctttgcttatgtcaactgaaaataaccttcggttctttccattctgtatataggagtcaggcatgttgataacatagcgtttatgttttataggggacttgcgtgttttgttgtagttttaggt

SEQ ID NO: 29450 - DNA, 547 bp, Sorghum bicolor
  Clone ID: 9300556
gcacgaggcctgcttccctctcgtgatatcgtcctccatcacctttgctctgctctgctcaccaagtgctcacctcaatctcatcccatggccggtggtgccgtgtctgcttcgctcaggaccctcgtgctccttctcctggccatcgtctcttctcccctcgccgggcggcgcacggccgcagcgctgtcgaccaagtactacgacaagaagtgccccggcctacaacccgcggtgcgttccgccatggcgcgggcggtggcggcggacccacgcgcgggggcgtccgtgctccgcctcttcttccacgactgcttcgtcaacggctgcgacgcctccgtcctcctcgacgacgcgcccgccggcgagaagggcgcggcgcccaacgccaactccctccgcggcttcgacgtcgtggacgcggccaaggccgccgcggattccgcctgcggcgggcccggcaccgtctcctgcgcggacgtgctcgcgctggccgcccgcgacgccgtgtcgctgctgggcgggccgtcgtgggccgtccggctgg

SEQ ID NO: 29451 - DNA, 574 bp, Sorghum bicolor
  Clone ID: 9300584
gcacgagggaaccccgattgatttcaatcggcgcaggcggagcagttcacatcccataatcgtcgccgcatccggtccctctccatagctggatctcggccccttccaattgcagcctggtgcccctgctccgtgcatccagtaggcgcctcaacatcaaatcggcgagcaggaggcaacccaggtctacttcgccgttgtcgcctgctccttgggacctcgacaacgacctcggacgggctagatgctgccgaacgcgcagccgcctccatgccgccttggtatcatgcatcttacaaaccacctgaaggagttggacgagatgactatcaaacttaaggcagacttcgaggatatgaaattgaagttagagcttgaccgttccatcgctgacatcggaacaaaacaaaagcgtcaacaaaatgaccggtacataatatctcagcgaaaactgttggatgaagggtctaccattgagcagaatgacgctgctatgagtatgcaggtcgcactgcgtcagatgctgatgcaagcattatgtgatcagcgtgctgcctttgccgagaagatgaag

SEQ ID NO: 29452 - DNA, 556 bp, Sorghum bicolor
  Clone ID: 9300587
gcacgagggagacagcggctgcctacctgagggctatcgaagaaggcgcagacttcatcgagaccgatatacttgcatcaaaggatggacacctcatctgtttccatgatgtaacgttagacgcaacaactaatgttgcgaaccatacggagtttgctgacaggaagaggacctatgaagtccaaggagaaaatgtcaccggatggttcattgtggatttcactcttaaagaacttaaatcactgagggtgaaacaacgactcagtttcagggaccaacgatacaatgggaagtatcagattattacttttgaggagtatatcttgattgcgctttacgctgacaggatagtcggaatataccctgagatcaagaatcccatcttcatcaaccagcatgtcaagtggtcgggtggaaagaattttgaggataagtttgtggagatgctactgaagtatggctacaaaggtgaatacatgtctgaaaattggctcaagcaaccgctgttcatacaatccttcgctccaacttcactgatttacatctccaacatgac

SEQ ID NO: 29453 - DNA, 260 bp, Sorghum bicolor
  Clone ID: 9300589
gcacgaggaagatttgtagctatcatagctttacaaagtcgcatttcatctaaaggccgcatacatcattttctaaggcatcttagtaggcagccatatttacagttaccaatggtggtatagcagttctgctctgcttatcggacagggtctttgtgtctctcacacactattaatcatatatgactggctaatttatttttctacataatcaaagaatgattccatatattaatgtgttcttgacaaaactaatggtg

SEQ ID NO: 29454 - DNA, 450 bp, Sorghum bicolor
  Clone ID: 9300610
gcacgaggcccacatcctgctcgcctcccacaatgctgtccaggacaattaggcggagcattgcgtcgcccttgaggcgcaatgtcattgcccctgttgcgcgccccgccttcaggtcggtcaccacggacgcggcttcatcgcataccgacccggccaatgtgcctgcggccgatgatcagccattcgaagtccgcctctcggacgaggccttcgagacatacgaactggacccgccgccatacacactgaacgtcaccaagcacgagctgaagaagatgtactacgatatggttgctgttcgacgcatggaaatggctgccgacagactgtacaaggagaagaagattcggggtttctgccatctctctaccggtcaggaagccgttgccgtcggtatcgaacatgccattgagcgtgctgaccaccttattaccgcttaccgctgcc

SEQ ID NO: 29455 - DNA, 618 bp, Sorghum bicolor
  Clone ID: 9300620
cccgaatgttgtaatgcgatttatcttacactcagtgaaggaactttattcggatctgagggagtactacgacagtcgagaagaattaggcgagtttgcatttacagagtcgcctactactgttaagtttgtcacgatgttggaggctttgaaaccttttggatatagaggaggcggacagctatactacctcaatcctgctcctgggagtcagccatcaactgggttagtacagatggacgggttagtacagattgacggacaagaagaggtagatcaattgatgcttgctcatgaaaaagagaggattaaaacttgtcatctatacctagtgacaggatctaacgacgatttccacgctggcatgtcggacatggaaacagactactatgaggaataagaacaaggatactagatgaagaagatgaaggcaacagtcccgtgtcgtgaagaaacatgctctccatatgctgaggaagaagaacaaggcgacagtccctctgcgcttcattatttttaggttgcattatgtttcagtttgaagttagattaagtgtgtcacatcttttaaaaaagttaggtttgaagtctgattatattattttaagatgcatgtat

SEQ ID NO: 29456 - DNA, 271 bp, Sorghum bicolor
  Clone ID: 9300622
cattcataagaaactatgttattgggattgggccgtggaaggacacaattgttcctccaaacccaaaagataactgtttaggacagcccactgatctcgtcgcacgagcacatgctctgaatcttcaggtgcatccatacactttcagaaatgagaaccaatacctgcacttcgatttccatcaagacccttattctgaatatgagtattggctcaacgagatcggcgtggacgggctgttcactgatttcaccggtagtctgcacaagta

SEQ ID NO: 29457 - DNA, 612 bp, Sorghum bicolor
  Clone ID: 9300637
cgctgtcgggcgcgcacaccgtcggcagggcgcgctgcgtcacgttccgcggccgcgtcagcggcggcggggacgacgaccccgccgcgtccatcgacgccggcttcgccgcgcagatgcgccgggcgtgtccggacggtgcggacggcaacaacgtcgcgccgctggacgcggtcacccctgacaggttcgacaacgggtacttccaggacctggtgcagcgacgggggctgctgcattccgaccagcagctcttcggcggcggcggcggcggatcgtcgcaggatgcgttggtgaggaagtacgcccgcgatggagccgcgttcgcgagtgacttcgccaaggcgatggtgaggatgggtaacctggcgccggcgcccgggacgccgctggaggtcaggatcaactgccacaggcccaactagaactagctaggctacacagatcgatggtgcggcattgttgctagctacgaagctagtagcagacagtgcagcgcattagctcgtagatatacatatacatacatacatctgccaaagatggttgtgcagaaagcatatgcaatgcatgataggattattcgttactgtgttcatatcatacccaagg

SEQ ID NO: 29458 - DNA, 519 bp, Sorghum bicolor
  unsure (1)..(519): unsure at all n locations
  Clone ID: 9300654
ntggcgcgggggctccggcacgttcgccgatgacgtggtgagctgcggcggtaccggggtcagacggtgtgctgcctcacgaggtgctgcaagtccaggagcgcatggcagcgtccttatatgtgggtgagggcatgggtcgcagctgaagggccgtgacccggtcgcgtccgcaacacgatctgggagaagaccggcttctaggactgccggtcagccggtgtcagcctaagcaccgccgctgccgcccacctttgacggcaatgcctgccacggccttgttgagcacgttctcgccttcaggaaaaatagaggagcttttgcttgattactggccttaatccttcaggattaattcgacaagttgttttttctttgttatgtattggttcttctcgttctagtcgtgatcgctaaggaagagagtagagattaaaagcctctattttggcattttcccccagagaggctcggtcattgtactaccagtattatattaattcatcttgattactacta

SEQ ID NO: 29459 - DNA, 407 bp, Sorghum bicolor
  Clone ID: 9300668
gttttggccggagcagcttgagttcgtgagaatggcatccaggtttggagcaacgatcataccatttggagtagtgggagaagatgatatatgtcatttgttgttagactacaacgatcttctgaaggttcccttctatgatatgctcgacaacgccttaaaccgcgatggactgaagctaaggactgattccatgggagacgtaaaagatcaaagaatgcaccccctagtgcttgcgcctaagttaccagggcggttttacttcgcctttggaaagcctattgaaacaagagggagagagaaaggactacgagacaaagaggaggcgcagcgcctctatttgcaagtcaaatctgaggtggagagctgtatcaactatctgaaggagaaaagggagctggacccct

SEQ ID NO: 29460 - DNA, 194 bp, Sorghum bicolor
  Clone ID: 9300679
cgcactcgtgaggagattcagcgcatgcgcagcacaaacgaccccattgccggtcttaagcagaagctcctagactggggcgttacctctgaggaggagctcaagtcgattgacaagcaggctcgctctgacgttgatgctgaggtcgccgaggctgagaacatggccattccagagcccactggcaaggtcct

SEQ ID NO: 29461 - DNA, 563 bp, Sorghum bicolor
  Clone ID: 9300743
gcacgagggctcctgcgtcaacgtctgtcacactttcatcttcacatacatcataattatcgtcacacttcgccccagctacccatcggaccgttagacgcaattacagagcctgtacccagagatccacctatatcccagtaatgtcgagatgagacactactacggcgggcggatcgtctggtgctctgactcgcgcaactactcggatgccgaattgccactggacttccgggcgtcgtagctttgaacgttcggcgttcggcgggaggtcgcatgcgtgagaccaacgggtggtgttgacggacgcgagccagctttgcggctgtgtcttgactattcgacgtagccagatgagctggtgttgatggggcaggattgctgcttcgtggcatgaaacgagagcgtagatatctgaacaccagtttcatatcaagatccttctcccattcctcttgagtgaacgtgttgctcataggagtgtcttgtcgtgacgtttgcattgcttcggccgaaggttcagatctgccatgaatgttgataggttgtgatgatgtctgaat

SEQ ID NO: 29462 - DNA, 604 bp, Sorghum bicolor
  Clone ID: 9300752
gcacgaggatccatctttgctttaacgacttagttaagccactcaagcaacaaaataatccatttggagtgcctttttttttgaggaatcaggaggagccagaggctcctactcatttggattggcattatgttgcagtttctggagtctgcaatctgacagtaatattgttttgtgttaggttcaagcatctcaggcttttcactcaatgagaattttcaatgaaactaaattttttatacacatttatgttttcccaattaaactgttctgtgtgattatgctcgacatattgtcgattaattttataaggaggtcttattatactctacttttttgtatcttcttgaaaatgcatgcactgtccagttttccaacatttactgttgtagttactgaaaatggtctttgcttctgtagtcggttgctgtttctggagctgcagcggtatcagagaataatcttgttgggagagtgaaattggattatttctcatttaccttgaaatggagcaaagttggcaaactccacaccagtctagtgcagaccgtgctgaggattttgctgaaaagtttgtttgtaccttatgtgaactcatatctcg

SEQ ID NO: 29463 - DNA, 522 bp, Sorghum bicolor
  Clone ID: 9300754
gcacgagggggaacgccgccacgcaggcggagttccccagagcggaggaagggttcgcctgctagggcacggtctcctcctgcgaagtcaagtgcgtcgcacagggacagggacaggtcgccacccagggataaggtgaaggagcgtatcaggtcgccgcagtctcctgctaaggccagcctgtcgcacaagggcagggagaggtcgcctcccagggagaaggcgaaggaccagcgggtcaggtcgccgaaacatatgcaggagcagtcacgatcaccctcacctgctaggcggcacgtctctaggtcgccctctcctcgcaccaagaggctgagaagagcccagggtgagcgggaggtggcgcaggttactggcagtgaccgccggaaggccagtcacagggaggagcaggatatagtgaggcacagggagcatgatgcggggagggatgcttcaagagacaggaaggtggatcgggaggcagtgcaggcaacgaacggtgatcatcgcaagtcctctcaa

SEQ ID NO: 29464 - DNA, 676 bp, Sorghum bicolor
  Clone ID: 9300770
gacgagcattggcatcacccttccgattgttctgctggtttgcttcctgtagccttatcagttggctataagctccttctggatctcttagaagctcattgtgtggacctggtccaaaatgttaaatggttaagcaaagatgcattgagcaatcaaagactggcaaatgatgattttgaaattggtgtttcgcaataatacctttttcaactagtgttccttgatgaataacagcaatggtgtcagcatttcgaacagtgctcagacggtgtgcaactatgactgttgtcctatttgtcatgaccctgtcaagagcttcctgcacaatcctttcagactcggcatccagtgcgctggtagcttcatccaatagtaggattcgtggatctttcagaatagcccttgcaatggcaattctttgcttctgcccaccagaaagctgtgtcccatgctcaccaaccgaagtatcaaaaccctgtgaaaatatcagaaacagaagagatctcaatgcatgctgcataactaaccgagccactgagaagttaaattgtattttatttttctattaaaatataaccagtaggggcacaagcacctcctgtttcttcattaaaaaaacactgggagatgtaaagcttgctgcttgaacagcatcctgacctgaggcattttagct

SEQ ID NO: 29465 - DNA, 674 bp, Sorghum bicolor
  Clone ID: 9300820
tctgcttcttcaagggagcaaagggtggaccgtagtgacagaagggattctacaagagagaaaccaacagatcatgaggagagcaatggaggatcaggaaggtcatccaggcgtggtcgatcagtgtctccagaagagcacaggcatcgggccaggcatgaatcccatccatcaccgagggtgtccagaagtgcagcatgtactgaggttctgtgatatcttacccttcatttctccatatgggcttagcgtacttttgtagttttgtttcatgaatgtttcctacagtcctgctactgtctactgttaagttgatagtctccaccaattaagtacggagtgagaaaattgaaaattatttccattcccatggatttttttactactaattgtggattgtgaaatctgcagtccttaaactcccacttctcatgcatgcactatacatacaggacctctcagttatatcaatcatattggcgcctgtaaactgcaatctaacatcattacattttatttcaggatattaactctagaggaagcgaagcatcccggtcagtgctcaaaactaacctctcttgtgtcccgttatacaatgtaaatccttattagaatcaccattcgctgcaaatattattttgtatatgtacatgtttttatatgaccaggcaaaa

SEQ ID NO: 29466 - DNA, 324 bp, Sorghum bicolor
  Clone ID: 9300833
gcacgaggtggaagtctaaacttgtctagagcaattggagatgtggaattgaaacagaacaaattcctgcctcccgagaagcaaattgtgacagccaatcctgacattaacgttgtggagctctgcgatgatgacgactttgttgttgtagcatgtgatggcatttgggactgcatgtcaagccaacagctggtggatttcatccatgagcgtataaacatggagagcagcctatctgccgtgtgtgaaagagtgctggacagatgcctggctccatcaacgatcggtggagatgggtgcgataacatgaccatgatcctggtg

SEQ ID NO: 29467 - DNA, 605 bp, Sorghum bicolor
  Clone ID: 9300835
gcacgaggatgcactcacccaaaatgtcctgtcaagaaaatggtggagcgttctctagaaggtcatataacggagatagtctacagaggttctcatagtcacccactgcctcttcccaacagccggccaagtgtccctttgtcgcatttcaatgattcagaagctgatggtaacttcagttccaagcctgggcctggctatgactcgtcaacttcacagggaattgctccaaaaggtcagttccaagatgtgcacagcggagctcttgaaacaaaactgtctggctctcttactacaactgagattgctgacacgtctgttatggagtctatggatgtctcatcaacactctcctccaatgagaagggtgatagggccatgaatggtgccgttccttcaaccaatgacatgaacgaagacgagactgaatctaaaagaaggaaaatggaggtttctgtcgctagtaacactgccaacattgtcactgatatggcagctatggcatcaaggactgcccgggagcctcggattgttgtgcaaacaacaagtgaggtcgacatccttgacgatggctaccgctggcgcaagtatggacagaaagttgt

SEQ ID NO: 29468 - DNA, 618 bp, Sorghum bicolor
  Clone ID: 9300845
gtttttggcgactggcctgtcatgcttctcggcagtgatgtatcagatctaccagttcaaacccacggccattacaatccaaggtacattcatcgttttgattgcctacttcctgggcaacgggtgggcaaagatcctacctcgtggtgataaactcgaggcacggtggaggagtggcggtggtcaaggagccctgccattctatgtgaaagtggcaaagcttttgaatgatggaccatggtctttgaaggaacatgccatctgttcgatcacggccacatctgcctccaacgcggctattaccatccaggtcttcgctgcccaagatctcttttatggtatgcctttgagaccggctcaggtaatcttgagcgtgatttcgatcggcctgtttggctacggtttagctggcttgatgcgtccaattgcggtgtggcacactgaagctgtctactggagtactttgcccaccgtgaagagtctacaagcccttcactggcaggacgtgaagaactccaagccactccgggtgttctggtacgctttcggtggcatggcgctctatgagatcctgcctgcgtatgtcttcccttggctgaactcggtctcgattccatg

SEQ ID NO: 29469 - DNA, 515 bp, Sorghum bicolor
  Clone ID: 9300846
gcacgaggctcgccgagcacgtgagggcgtgctccggctccggtgccggcacgccggtgaacatccgggaggccgtgaacggcacggtgctcaacgtcgtgtcgaacgtcctcttctccgaggacgtcgtggacctgcgtgatgaccagaagcaggcacagtcgttcaagagcctcgtcgtgcccgtgctcgaggaatggtccaagcccagcgtctccgacgccttccctttcctggcgccgctggaacacctcctcggctcgcgccgccgcatctccacgcacctagccaagctgttcaggttctttgatgaagtgatcattgagaaacggttagcttccggcaagaagcacaatgacatcttggatatcctcctctccaagatggccatgtccaagctcacgcgccaacagatcactacatttctaacagatatgttcatcgcggcgagtgacacgagcacggtgacggtgcaatgggcgatggcggagctgcttcaccacccagacaagatg

SEQ ID NO: 29470 - DNA, 576 bp, Sorghum bicolor
  Clone ID: 9300847
gcacgaggctatgacaaggatgattatgcacaagagtttggcattaagattagcgatcgtctggcatcagttgaggcacggattttgccagctccacggcttaagtacaatgagactggtcgagagaaggactgcttacctagggttggtcagtggaatatgatgaacaagaaaatggtagatggtggtaaggtcagaagttggatatgtgtcaattttgctcgcaatgtgcaagacagtgttgttcgtgggttctgccatgaacttgcactgatgtgccaagcgtcaggaatggatttcgctcgggagcctgttcttccacctctatatgcacgtcctgatcaagtggagcgagctctgaaagctaggtaccatgatgccatgaacgttcttggacccaaacacaaggaacttgatttacttattggaatactacctgacaacaatggctcactttatggtgatttgaagcgtgtctgtgaaatagatcttgggatagtttcacagtgctgttgcacaaagcaggttttcaaaatgaacaacaaacaaattcttgcaaatcttgctctgaagatt

SEQ ID NO: 29471 - DNA, 492 bp, Sorghum bicolor
  Clone ID: 9300848
gcacgaggatgaagtcacagttggtattggccgtactctccggccttgtgttgttcgcttcagcaaccgtttacttctctgaggaattcggtgaaggatgggaaaagagatgggttgagtcatctcccaagaagccagaagagatgggtaaatggaccgttagcgccggcaagtactttggtaacgaggctgccgaaaagggactgaagactactgaggatgctagattctacgacatctccgccaaggctgatgctcctttctccaacaagggcaagactttggtgatccaatactctgttaagcacgagcaatctattgactgcggtggtggctacatcaagctcctcccattcgatactgatctctccaagttcggccctgacagcccatactacatcatgttcggacctgatatctgcggctccaccagaaaggtccacctcatcttcacctacaagggacaaaactacctcttgaagaagagcgtcc

SEQ ID NO: 29472 - DNA, 575 bp, Sorghum bicolor
  Clone ID: 9300850
gcacgaggatttttcctccttctaccattggcaaattgatggaagaagtgtgtgttagcatccccttctaacaaccacttattccctgccctctgtttccagtagatttcctcagatctatttgatctctccagattatcctctacttcaattctttcctcccattcctgggaggtcaaaagcctgaattcagcaatgtgatccaaatctttaattctttggatcatggcttctttttcccttttctgaatcccaatcaactgtaaattccaaccccttaggtatttcctcatggactggaggcaaccatgccacctatccaaggagtagtcttgcccagtgttaaaaaaatcccacctttcccgaaccatgttagagaaaccctccctctgcaaccattgctcatcaaaataaaaatagcgaggtctggactccccttgttccccagtattgagaataatagggcaatgatctgaacctattcttgtcttagtccatgcaaagcaagtggggtaaaaattttcccagctggtagtcgagagaaccctatctaacttcactaatgttgggttttt

SEQ ID NO: 29473 - DNA, 562 bp, Sorghum bicolor
  Clone ID: 9300853
gcacgaggctttcttggctgactccaactactacaccgcaacttcttgtgccccttgttccagccatcacaattgagcatggctaggaagtgctcaagttgtggaaacaatggccacaactccagaacttgcagtggtcacagatgccaagtgaccagcattagcatcaacagcactagtactactactagctgtggtagcttgaggctgtttggggtgcagctgcaggtaggctcctctcctctcaagaagtgcctcagcatggagtgcctgtcacctattgcctgctatggagctgctgctgcttcgtcaagcttgtcgccttctgtgtcatcgtcttcgtcttcgcttgcctcgatagaggagagctcccagaggatcaccggagggtacgtgtcggatggcctcgtggtcagggttcaggacaggaagaaaggagttccatggaccgaggaagagcaccggatgttccttgccggcctagacaagcttgggaggggcgattggcgaggcatttcccgacactttgtcacgacacggacaccgacgcaggtggccagcc

SEQ ID NO: 29474 - DNA, 609 bp, Sorghum bicolor
  Clone ID: 9300859
gccaagggggacagtcgcgcaaatgttgcgagcggcggcgtcgaggtgcgcccgcggtgccgtccggcggctgtcgtcgtctgcggcggtggaggcttcgccagtcgccgtggggtcgcggcggaagcctctcctcgacgagggtgactggtcgttccatcgggagtggtggggcgaggaggacggccctggcgagggggcgcagaccgtcttccgccgccactccgagtgcggcaacggcgtcgtctccgtctccgcctatcccgcttcccgtccggctagtgagcattggccagccacggagagatggcttcaagaaagaaatgcaagactatacccagaatcagccagttctgaccagtttaaggtactaggctaccagtggcgagtgatgcgttttaatgaccatacacggcaaagcactgcaaaagtgatgacatgttataggacttcgggtcagagatcattgttcttgatgcagcaaccacatgttttagctgttccttatgtcaagagtatggtatcagcaggattgatagcacttccttgttcttcgtatgatctaccacaggcagcaactggacagaacactatgaaaattctgtgcat

SEQ ID NO: 29475 - DNA, 600 bp, Sorghum bicolor
  unsure (1)..(600): unsure at all n locations
  Clone ID: 9300867
gcacgagggctgcaagaagttttatgtgcatggaacaaacaagcccaactgcattactcctacagtcctagtacactacagcacacggagtacagtagttgaaatgaagagagaattggtttgaaaattcttctgaatgcatggaatctttcacgtgccaacttcagaagagccctgtgcctgaacgtcacaagaaacaaaacctcgctgcctgctcactgttgtttctgaatcctctttttttttttcattcacatgcatccaaaactgtatcaaaacatctggcgcgctcaccaacgccaacgccggccgcttacaaaagttgttgtcgcaggaacagcagcggcttctcgcgtggagcatccatgtacagaggagtgacaaggtgccgtgctgccctctgctcgcccatttttgcaccccacctgctgccttttccaacaccccaaaacttctgcgtgcctctgtgggagtcctgaatttttctgatctcaccaacacgcacacacacgcacacgcatnctcctgctcgtgtagtaaccttttcttgtcctgcttgttccccatgcaaacgcacgcaggcatcaccagcacgggaga

SEQ ID NO: 29476 - DNA, 163 bp, Sorghum bicolor
  Clone ID: 9300870
tgggctcacatctctgccagatgtagatgcactttgggatgcctgtgtggggaagatggtctctgtgatggaagacaacttctccaggatgcagacagcaaaccacttgcttctcatcactgattatgctgctttgctttctgccacaatgcggcggtatggt

SEQ ID NO: 29477 - DNA, 517 bp, Sorghum bicolor
  Clone ID: 9300879
tggcgcgcggcgcggcgcgcgtgcctgtcggagctcctcggcgccccgcgcgtgcgcgggttccgagacgtccgggaggccgaggccgccgcgctcgtcgccgccgtggcggacgagtcgtcttccagggacggtggctctcccgtgaacctcagcgacaggcttgttgcgaccaccaaccggatcgtgcggcgtgtcgcctttggcgacgacggcggcggcgacgtcgacagcgtccggactagggctgtcctggaggagacgcagaggcttctgggcgctttctttgtggccgattacatgccgtggcttggatggctggacgcactccgtggcctgcggaggcggctggagcggaacttccgtgagctcgatgcgttctacgagaaggtcatcgacgagcacatcaacaagggcaccaaatccaaggaggagggggactttgttgacgtgctcctccgcctgcacaatgacccggctcagcagaacacgttcggcagccgtagccagatcaaag

SEQ ID NO: 29478 - DNA, 559 bp, Sorghum bicolor
  Clone ID: 9300882
cgctcggaagtcgctgcgacgaggtgctggattttgacttgctaccaaatcaagctgccgcaaaacccctcgcctgcggcttcgcgtcggccgccgccgctgccgacactttgccgcgtgcctcgcgcccccgcgctgccgatgcgatcagcgacgcacgccagatccgagcttctgtaggaccttcagccgtcgccgtcccatgggggactgcgttgtcgaggacggccacgggcaccaccaatcggaggcggtggagggcgcggttccgttgacggtagccgtggagctcgatgagcggtcgggagagtcgcgggaggagggtggcgggcagcggaagaaggttggtgggatccgaagggagccgtcgttctcgcggtggtgcagggacccctctgacgccgccgcctccaataccgccgctgctgcggcgaccagcgacagcgacgactcaaaggagttcgagctgccgctcctgccatcctcctcgggcggcggcagctcaccgatggacattgaggcgggggcgacggcgagatctgatgatctgccgatctcg

SEQ ID NO: 29479 - DNA, 536 bp, Sorghum bicolor
  Clone ID: 9300884
gcacgagggcccgctgcctgcgccaacccaccacccatccgtttctcgttctcctgcccctgcccctgcctcccctcccctccttaacaatggcagtacaggcgcagtacccgtccaatctcctcttccacgacagaggtgagccggacaggaaggggatggacatgcccaggccgccgcagctcgccggagtctcgccggcggcagtctacttctccagcgctggagcgactgggaacaatcggaggaagcgacccagggaggccatggccatggcgccgccgccggcggcggcggcggctaaggaggagtacgtcaatctgttcacactccagccgcagcagtcgacgtcgtcgttcgccaacgtggcgctcttccacaaccagagcagggtctcgtcgccggccgcgacgacggcgctcgtgtccaccggcctccgcctggcattcgacgagcagcagcagctacaacagcaggagagcaagcagatgaatgcgttgcgctactcgtcgtcgtcgccctcgctgttcgtctct

SEQ ID NO: 29480 - DNA, 619 bp, Sorghum bicolor
  Clone ID: 9300886
gcacgaggtttctttcttatgtgagcttgataatatatcatagacatagatactataccatagacgcattctcttctcttccatctctagtcatttcttcaccaccaagaacaatcagccatgccttttgcgacagaactcaccaaacgactcggcatcagagtgcccgtcgtccaaggcggcatgatgcacgtgggcaccgccgacctcgcctcagccgtctccaatgccggaggcctgggtatcatcaccgccctcatcttccccacgcccgaggaactgcgcaaggagatccaacgctgccgcaccctcaccaagaaccccttcggtgtcaacatcacccttcttcccgccatggtgcccccgaactacgccgcatacgctcaggccatcatcgacgaggggatccaggtcgtcgagacggcaggaaactctcctgggcctgttatctcgcagttgaagaaggccggcatcatcgttcttcataaatgcaccacgattcgccatgctcagagcgccgtcaagcttggtgtcgacttcctcagtatcgacggttttgagtgcggtggacacgtcggcgagagcgacattacaaactttatcctgctcagcaaggccc

SEQ ID NO: 29481 - DNA, 590 bp, Sorghum bicolor
  unsure (1)..(590): unsure at all n locations
  Clone ID: 9300887
gcacgagggctgggtcgacgagcggaccatgagccccgcccggnaacggcgccggcgtgcccgtcgccgtcaagaagctcaaccccgagagcttgcagggcgtgcaggaatggcagtctgaggtgaatttcctggggaggctttcgcatcccaatctggtgaggctgctggggtactgctgggaggacaaggagctcctgctggtgtacgagtacatggccaagggcagcctggagaaccacctgttcagaagcgagccacgcaagggcggagcagccgtgcaccagccgctgctgccgtggagcctccggctgcgcatcgccatcggcgccgcccgcgggctcgccttcctccactcgtcggagaagcacgtcatctaccgggacttcaaggcgtccaacatcctcctggacacgcacttcaacgccaagctctccgacttcgggctcgccaaggatggccccgccggcggcagcagccacgtgacgacccgggtcatgggaacctacgggtacgcggcgccggagtacgtcgccacgggccacctgtacgtgaagagcgacgtgtacggcttcggcgtggtgctgctg

SEQ ID NO: 29482 - DNA, 593 bp, Sorghum bicolor
  unsure (1)..(593): unsure at all n locations
  Clone ID: 9300907
ctcttgcggttttacactgcactccccttttctgcgtctctcgctatcaattgcctgctaggaagctctctctcattgcctttgtgctcaacaagctacaatcatggtgcacattaaccgcgtagccacctccaaggagattgaggaggagaaggcccagtttgacgacatcaccaagatcggcaccatcaacctgagcccggacgatgagcttgacgacttcacggcaaccgtctatggaagcaagtacgcttcggaagacctgcccaggcatgagatgccagagcgagagatgccgcctcaggtggcctatcgcatgatcaaggatgacctcactctcgacggaacaccaacgctgaacttggcttctttcgtcactacctacatggaagacgaggctgaaaagctcatggtcgatgccttctccaagaactttatcgattacgaagagtaccccgtcagtgccgatattcagaaccgatgtgtctccatgattgcgcgccttttcaatgcgccgagcacagacgaggccaatatcatcggtacttcaacaattggttcttccgaagccatcatgtntgggtgtgctagcg

SEQ ID NO: 29483 - DNA, 515 bp, Sorghum bicolor
  Clone ID: 9300909
gcacgagggtcccagatcgaggaatggcagaggccaatcttgaatgacaagaggctacctgaatggtatccagttgccctgttcaacgagctctactacctcaacgctggaggcacaatctggacagacggacagcctcccaagaaggccggcttcgcttcgtcgttgacgggcaccgagccgttctcgatcgacacgctcctcgcggaagacggcggcactggcggcagcgcggtggacggcgtggtgcgcgcggtggcgtcggcgaaggagctgtcccactccgcggcggcggcgttcggcgcggcgctgctccgcgacggcgaggacaacgtggggcagttcctgtacctggaaggcatggagtacaacatgtacaacacctacgacgtgcacttctacgcctccttcgcgctgctctccctcttcccatcgctggagctgagcctgcagcgggacttcgcgcgcgccgtgctcctccacgacccacgccggcggcgcaccttcgacggccg

SEQ ID NO: 29484 - DNA, 414 bp, Sorghum bicolor
  Clone ID: 9300919
tgggcgattggaagggacgagaacgcctggcctcgtccccaggagttcatcccggagaggttcttggctgctggccaggaggtgcactcgtcaatggtgaaagaggcgtatcggccgtttggtgccgggcgaagggtgtgccctggaatggagtacaccgccaggtctgtgccgttgctgttggcatcgattctgcacagaaatgagtggagactacctgctgatggtgatggggttggattggagggcatggacctcagggaccgctatggcaccgtgctgaatcccgcgacccccttgcatgctgtgctggtgtctaccgtgtgatgtgttggtctacatgtaacacatcgtaagggggaaaaataaagtgggaacaaagtatgtatgtctatatatgttttgtaccacaag

SEQ ID NO: 29485 - DNA, 685 bp, Sorghum bicolor
  Clone ID: 9300921
gaatcccagacccagctgccaagaagccagctgattgggttgatgccaaggagatccttgacccagaagacaagaagccagagggttgggacgatattccagctaccattgctgacccagctgccaagaagccagaggactgggatgatgagctcgatggtgagtgggaggcccctcaaatcgacaacccagagtacaagggtgagtggaagccaaagatgatccccaacccagactacaagggcgagtggatccacccagagatcgacaacccagactttgttgatgaccccaacctctacgcctatgacaacattggtgtcgttggtttcgagttgtggcaagtcaaggctggaaccatcttcgacaacatcgtcgtgaccgactccctcgatgaggccaaggagtgggccaagaagaccgtcgctgcccgtgagggtgagaaggtcgccagagagtctgagctcgcaagagacagagccgccgagcccgaggaggatgctgaggaggaggaggacgagcacgctggccacgaccactcccacgacgacctctaaacgacttcactattttgtttttcttccagccgcaacagtttttgctttttatcactgtaaactctacggactgcaaactccaacgactatttgccaaccttcatttatgaaatacaccagcaacaagt

SEQ ID NO: 29486 - DNA, 592 bp, Sorghum bicolor
  Clone ID: 9300926
catatctaccgagtatatgtgcgcagaagttatcggtcagttggcaaacagtcagaagaggaactgatgagtttttcagttccttgtggcgcgagcacgaagcgtgatgaagaagtatgggccaaatcgtttatagctcgcatgaatgagaagctcaggcgatgcaaccatgtctgggcatccataaggctagaggtcgaggttttccagagccagtctcaggtaatcgtgttgtagttgaggtcagtatgccttttacgggctgacgacatgaactcgtaatacaatggaccagcaacgtatctcagaagtattgctgccctgggccatgaccatgagcacaaattgctgcagctatcgggtacaaataaacgaataggatgatacatgcaggtcattgacatggacgtggagtcaagcccagcatcgagtcggagacttggaagcaagagactgaagaagcccaatactcgagtcaccggcccagaatggagtaagtagttagagcccagctgcgtctggagactgctgtacccaacagctgtaatcgctatatcagagagggtgagataaacaaactcattagacttgt

SEQ ID NO: 29487 - DNA, 227 bp, Sorghum bicolor
  Clone ID: 9300932
gacgacgccgccatggcgtgccccgtgtgcctgtgcgtgcggacgggcagcgtcgaggccatcctctgctgagccgagctttccccgcttcatcatccgggtccggtcgtccgccctcgtggccggtgagtgcgtgcatgatgacatgatgtgcaggaatccatccatcaatgccttcccagaaaatgagaaggaagaaaaaaaaaaccgtaggaaagatagaattt

SEQ ID NO: 29488 - DNA, 363 bp, Sorghum bicolor
  Clone ID: 9300944
ccgcgccgccgccatgatccaccgcctcaccaggaagggctacttcctccaggagttcaggaacgccgttcgcaagatggggcgcgtcggcgtgcgcaccggcggccgcggggagatccgccggaactgcagggcggtcaactcagatgctatgtgatgtgatgacgacggacgtgcggtgagtttaatttcagattgttgtagcgcgccaacgtggggggatgtgggcacacactgcctgtttttttttttttttgcttatttttatttgttctcgtcttatttacatacattgtatttagaggagtaacgtgggtcacctatggggtgtaattagtatatatacatatatacatgtataac

SEQ ID NO: 29489 - DNA, 662 bp, Sorghum bicolor
  unsure (1)..(662): unsure at all n locations
  Clone ID: 9300947
gtcttcaccatcaactactcnggtgcagaccaggcttccttcacactcaacttctcgcgtggagcctcgcagatcatcggacagtactaccagcttatccgtcttggaaagcgtggttacagaaggataatgctgaacctgacacgcactgccgactacctggccgcaaacctcgagtccatgggcttcgtcataatgagccaacgcggaggcgaaggtctccctctcgttgcatgccgcattgatgaggacctcggcaagcaatacgacgagtttgccattgcacaccagctccgtgagcgcggatgggtagtaccggcctacaccatggcgccccactcggagaagatgaagatgctgcgtgtcgttgtccgcgaggactttaccaaatctcgatgcgatgctctacttgcagacttcaagcaagcattgcaaacactcgatgcgcttgacgccaagaggatcgaggaccagagacaacacgcatttgccatgcgccgccgctccacgctcgtcagtcccatcttcaagaggaaggcgacagagcacttccaagaggaccacagtctgcagggtaagaccggcaagacccatggtgtctgctaaagcacactttgacaacctattggctggtccattggaaaagcgaaaatgatgacgac

SEQ ID NO: 29490 - DNA, 224 bp, Sorghum bicolor
  Clone ID: 9300965
tgatccttctgttcagcgtgccgtacaggccgctcagcgagcttcggagaacgcatttcgcttgcctagagtcgatgagcaggtccacaaggcggtcatggctgccaacagggcggccacagccgctcgagtggcggcgatcaaggcagtccagaacaggatggatgggaaattttgtgacacctatgtgtgaattgtgtgcgaagaaccatgtttctttcctc

SEQ ID NO: 29491 - DNA, 281 bp, Sorghum bicolor
  Clone ID: 9300966
cgcctctttttggaactatcagagttacctgatcttcttctatcctcggttctcatcaaaaagaaggatgggaatcggaaactggcgtctaggagataaggaaacagaagcagcaggaagctatactgtaatttcctagcatgatcaatcacgccggctgaaaaaaaaagaacaaagcaaagagaagcaataaattatgtatcttgttatcatatttctcttatcatcttagctttatgttgacacaaagggatggcaaagtagtttcccgtcattttcag

SEQ ID NO: 29492 - DNA, 410 bp, Sorghum bicolor
  Clone ID: 9300976
gatccgctacaaggcgcagttgtgtcggtgaccttcatcaaaggaggcgaagctttcaatgtcatcccggaatccgtcaccatgggcggcaccttcaggagcatgacgaacgatggcctatcctatctcatgaagagaatcagagaggtgatagaaggacaagccgccgtgagccggtgcgccgcaacggtggacttcatggaggagaagatgaggccgtacccggccacggtgaacgacgaggagatgtacgcccacgccaaggcggtggccgagagcatgctgggcgaggccaacgtgaaggtgcggccgcaggtcatggcggcggaggacttcggcttctacgcgcagaagatcccggctgccttcttcagcgtcggcgtccgcgacgaggggacggggaaggtcca

SEQ ID NO: 29493 - DNA, 299 bp, Sorghum bicolor
  Clone ID: 9301124
accacatcaacaacggcgacagggtgagcatcgcgggcatcatggacctgctgctgctggtggacgaggaccacttggaggaggtatgggcggtggccatcatcgccaagacgtgcgtgagcgccaagccgtcgcgccgccccacggcgcgctacgtgctgcgcgccctggagagcccgctgcgcgtggtgcgccagggctcctcccggtcgagctcggcacggcagcagctgcggagctcgtcgtcccggagctcgtggcagtccgtgttccaggggaacaaccaccgggtgcagagc

SEQ ID NO: 29494 - DNA, 340 bp, Sorghum bicolor
  Clone ID: 9301134
acttcgctaagtatgtgccaaacacaatgcgaatgacacatgaacatgatattgtacctcatctgccaccttattacttcttcctcccaaaactgacgtacaagcacttccccagagaggtgtgggaacacgaagtcgatggcaacacaacctatcaagtctgcgatggcagtggtgaagacccaaattgttccaggagcgtgtttgtgctgctctggagcgcttctgaccacttgacctacatgggagttgagatagcggccgacgactggagcacctgcaggatcgtcctggggcgaaagcgtcgaagcagctcaaagggagccttgccagcgacatt

SEQ ID NO: 29495 - DNA, 121 bp, Sorghum bicolor
  Clone ID: 9301152
cgagtggctgccggcgtcagacgatacaggcggcgacgtcgacctctcggaggtgctccgtctgtcctgcgagatggctgtgccgctggaggtccgcgtgcgcccgaggagcggcatgtga

SEQ ID NO: 29496 - DNA, 578 bp, Sorghum bicolor
  Clone ID: 9301211
cggctacaccatctactcccttcctcccgctcaggaccacaagcgcatctttgacggagaccagggtcccaacactggtggaatgggctgctatgctcccactcgcattgcgcccaaggaggtgcgggatgagattgaccgcacgatcatccagccatcaattgatggcatgcgacgagacgggttcccctttgtcggaatcctcttcacgggtctcatgatgaccaagaatggtcccaaggtgctcgagtataacgtccgcggcggtgaccccgagactcagactctcctgccccttctcagcaaagataccgatctggctcagattatggtcgcttgtaccgaacactggctggacggtgtctccatcaaggtcgagcccaactactcgaccaccgtcgtcgctgtcgctggcggttacccgggctcctacgccaagggcaagcccatcactctggatcccacacccgctgggtccctgatcttccacgccggtacaaccctgtctggtaacgagctgcagacttccggcggccgtgttattgctgccaccgctactgcggctaccctcgaagagg

SEQ ID NO: 29497 - DNA, 466 bp, Sorghum bicolor
  Clone ID: 9301220
gcacgagggcggcaagcctgacgcggaagcaggggaaggagagagagcgagcgagatgagatcgagggtggcgctggagccgctggcggaggagcccggcggcggtgaggaggaagcggcgcggcggcgaacgggactccacgcggcgctgcaccggtgggcgcgactcctctccgggggcgcggcaggtgacgacgcccgaccggccgccgacctgcgggtgctcctctccgtgctcgcctgcccgctctgccccgtgcccgtcctcccgcgccttccccgccacgtggcgtcgtcggcgcagtacatcatcgagcagttcacggccaccacggggtgcgggaagctcgaggacggcgccgtcaagagcatgtacgcgtgcggccgggtgcgcctctccatgctgcaggatcccagcggcggggggtcaggcgtcatcggcagcggcggcgggcgcggccacgag

SEQ ID NO: 29498 - DNA, 577 bp, Sorghum bicolor
  Clone ID: 9301238
gcacgaggactttgtgtcatacagcatgaggatttgcagatgatcctaatctgagtttactgatccttgttctttcatcatgctttattgctttgggaaaagaaaacctaacgaaggcatttagactaaaatttagaattcataatataaatttaataagaagagctcttccaccgtatcaatctgatcgtgggcagatacattgggctaaagtaacttcttaatctttactgaccagtttaataataaaggctggccttgtaacttgtaagttctcctgagatagttctgccttctgtttcctaggcgtacattctgatttgttctggtagattttactttattatgtaaaagagataatctctatttttgttggaagcacaattgttatacctttcaactaaaaaatcataattagactaaaatttagatggcatgtgttttcataaacaacttttattgtcatttgcaggctatttttggtttagcaacagataataacctttatgtcaatgatggttatgccacctcaatatttaaaactgggattggaaagtctatcttagcaactgagaac

SEQ ID NO: 29499 - DNA, 481 bp, Sorghum bicolor
  Clone ID: 9301247
gcacgaggccaagatatagctgcatcagatttctgcagcaagacaagaaggcgttgacagatgatggatcgacatatggaggactccagcacgttcctacagtgggcaatgaaccatctccagcaccaccagcacccggcagcaacagcaggccggtcagctggaacttcagcgccgcgtcggcgctgccagcggacgaccgcggcgccgtcgcggtcgccctgccggacgccacggcggcggtcgcgagggtgcaacaacgtgctgcgtctgcgtctgcggggaggagagggggcagcgccggcccatccgctgcggcaacgtcgccggggcctgtgcaggaccacatcatcgccgagcggcggcggagggagaagatcaaccagcggttcatcgagctctccactgtcatccccggcctcaagaagatggacaaggcgaccattcttggggacgcggtgaagtacgtgagggagctgca

SEQ ID NO: 29500 - DNA, 520 bp, Sorghum bicolor
  Clone ID: 9301258
ttctccttctccctctccggtgtccggaggagcggagcggaggaggaggagaccctgtggcagggcagccttctcccctccccacctcccctccagacttggttgtgcagtagggtttcacgttcctccgcacccatccttctccgcatcccgcatcctccatggccgatcccgacgagctcggccgccgcctcgccgcggtcgccgtctccgagtctcctaccgccgccgcggctgcgctcgagaccagcaacaacaacctcttccaggtgatgcgcgccgtcgaggatgcggaggccaccatccgccagcagctggaggagaacagccggttgaaggacgagctgatgctcaagacgcaggagctccacagaattaggtcagaagccacaaaccaagcttcttctcgtgggatccatcacgatcgcgctctcgccgcccacacagacacctcctccactgcccccattgggactaccgctacagcagcagaggccttcaaatggggagctggggagcc

SEQ ID NO: 29501 - DNA, 552 bp, Sorghum bicolor
  Clone ID: 9301272
gtcgcggcggagctcgggaacgacacgacggcccgggaccgggaggaggaggtgcggtggttcgtgatgggcgacgacgacaccgtcttcttcccggacaacctggtggccgtgctgcgcaagtacgaccacgaggagatgtactacgtcggggcgccgtcggagagcgtggagcaggacgtgatgcactcgtacggaacggccttcggcggcggcgggttcgcggtcagctacccggccgcggccgcgctcgccacggccatggacggctgcctcgaccgctacaggtacttcttcggcagcgatgagcgtgtcaaggcctgcctcagcgagctcggcgtgccgctcacccgggagcccggcttccaccaggtggacatccgcggcgacgcgtacgggatgttggcggcccacccggtggcgccgctggtgtcgctgcaccacctggaccacgtggagcccataaccccgcggggcaagacggcgctggacgcggtccggcccctggttggcgcgtcccgcttcgacccggcgcgggtgctgcagcagagc

SEQ ID NO: 29502 - DNA, 221 bp, Sorghum bicolor
  Clone ID: 9301277
ccgtcgacggcggcgtggccgtcgcgcacgccggcacctccacggcgcacctcgcccggttcggcgtcggcgtccgcgccgcgcgcgtggtgacgcggatggaggagtcgtggaccatcgacgacgtggcgttcaacgtgccggggctcggcccggacgccttcataccgccggaggaggtcaggaggagccggtcatacggcgccgccatcgccggtggc

SEQ ID NO: 29503 - DNA, 353 bp, Sorghum bicolor
  Clone ID: 9301330
ggcgaaaggttaggcaagacaactatagctgcatggcaggcaaggaagagaaaactgccgcacattccacgagtactacagcctataaggctgtcgatatcaacagggagaatcgagcggcagattggcaggaggcagagaaggcaaagtatcttgcaaggtttcagatggaggaagcaaagatccaagcttgggaaaatctccagaaagcgaaaattgaagctgaaatgaaaaggatagaggctaagatagagcgaaaacgggcgcgcgagcaggacaggctcgcgagcaagctggccgcagtaagccaccgagcggaggcgaagagggaggccgcggaggtgaggaggaac

SEQ ID NO: 29504 - DNA, 307 bp, Sorghum bicolor
  unsure (1)..(307): unsure at all n locations
  Clone ID: 9301336
cgtcggggaaggagggggagtgcgacaaggccagcttccgtgcggcgtccacggtgcacacggtcagggtcatggccccgaggatgagcgagagtgactggagacgggcaccgcggcggcagtgngcaagacgaagcggacgaggtggggctcggtgctggaggtgcggatacgacgttgcggcagaggagagctcacgtcgccgtagtagaatcgacggttcgtcgtctccgttcgcttaatataatatttatccacggaacaccaacgaaaatagtagtaatggtggaaggcatgatatcctgct

SEQ ID NO: 29505 - DNA, 328 bp, Sorghum bicolor
  Clone ID: 9301342
gcgacggcggcgtggggatggacatggacatggaccaacaccgcctcggcgagtacgagggcgacggcgacgaggaggacgaggaagaagaagggggcagcagcatggacggcgacggggacgacgcgtcggtggccagcgagggcgactgcagcgtcggcaccgccgagaagagcacggtggggaggctggtgcgcttcatcggggagaaggtttggggcgcctggaacttgattgggctgccccacctccgccgccgctcgccggttcttgtagattagggggaaggaaggaaggagaccgccaacaaggaggtggaggtcagtac

SEQ ID NO: 29506 - DNA, 528 bp, Sorghum bicolor
  Clone ID: 9301378
gccttcgccggtggtacgtaagatcctcgacagcgtgccgaaatctgccgacgcgagcaaatacctcgttcagacaccggccggtgacatcttgcaagtttggaggtccagggaagaagtcgactcggaaataccggcagagtatccaccggactacgtggtggacgaaagcatagggcctcaggacccatgtttggagctcaacaccattgagatgcagctgtacaaggttgacctccatggacacagggtggagctgatcaagagtctgccggagtatgcattgtttcttggctacaatggttctatgtgtctaccggtaaaggatttccctgggttaaagccgaattgtgcctacatgactgacgactccatggagtatattaatttctggaagcataaccgtagagaaattggtatttggagtttggcagagcgaagcatgtcgaagcttgttgatgcctcacagactatttatccttggctgaattggccatctcctatatggattcaaccatcctttttata

SEQ ID NO: 29507 - DNA, 574 bp, Sorghum bicolor
  Clone ID: 9301394
aggaaggcagcaggcgcgcaaattacccaatcccgacacggggaggtagtgacaataaatactgatacagggctcttttgggtcttgtaattggaatgagtacaatttaaatcccttaacgaggaacaattggagggcaagtctggtgacactgctagccctgctcgaggaccagcaactgcagcacgtgatcaccgtgactgctgacctgcacgcgcagttgacagctgtcactcaacgtgtcactcagatgtctgcactcaacaagcagcagttgacgcagttgtcacgtgatgtgatgctattaatagcacagctgcagacactgctcaccaacacggaacaacacgcgcgccattcactgaacaccaccagtcacgtgatcactcagctcaatcacgtgctcgaggcccgcagcaaacgacactccaaaaatagcaatagtgccaccagtacaccgagtggggacagtactgcgactaataatagcagcggggaggagagcagcggaacaactccccctacccccgcacataatacggcaaagagcgaggatggacgcgtgttctaaata

SEQ ID NO: 29508 - DNA, 398 bp, Sorghum bicolor
  unsure (1)..(398): unsure at all n locations
  Clone ID: 9301401
gcgngtcgccgcaccctttccccgccgcacagattccatgaagatttctcaactccaattaacagctacccgattttcaaaagagaataattctgacgaggatgacgagctcctttctgagctcagagataagtgggatgcaatggagaacaagtcctctcttgccttgtatggtgctggagcaatcctcactgtctggatatccttggttgtagtcaaatctctcgactctgtcccattgctcccaggcttactggagctagtggggctcagctactctggatggttcgtgtaccgatacctgctttttcaggaaaatcggaaagaactggcggagcttatcgatgatacaaagagaaagattattggtgacgatgattagctgtttactggtttgt

SEQ ID NO: 29509 - DNA, 583 bp, Sorghum bicolor
  Clone ID: 9301426
gcacgaggctgggactgcttttctagctctatctcccgctcatcttcccccaacactattgaggacttgtggtttcccaaccagagccccaactcctctcctcagattcagtgccagtcaccaagccttgatcgcaacattccattgatctccgaggatgccaacggaaaggcccttacaacccttgatgatttccccgctgcttctgccttcactggaccccgacgacagaacagcgatggtgagtccgcacgggaccacgacctctacaagaaggctgctcccttcgaggatggactctaccactgcccctgggaaggccagcccagctgcaaccaccgacctgagaagcttaagtgcaactatgacaaatttgttgactctcacctgaagccctaccgctgcaaggccgattcctgcgagggtgctcgcttctcatccactgcttgcctgcttcgtcacgagcgcgaggctcatggactccacggccatggtgacaagcctttcctttgtgtctatgagggatgtgagcgtgctgtccacggaaacggattccctcgccagtggaacctgcgtgatcaca

SEQ ID NO: 29510 - DNA, 400 bp, Sorghum bicolor
  Clone ID: 9301440
gcacgaggccacgccgcaccaccaccagctcccgcacgcgcaaccccacccccaccccacccatttcttgtccctttgcttcgctcgtgctcgtgcagccgtgcccgagatcgcccgccaagcatggcagccggcgccggcaagtcgtcgaaggaggcggaccccgcgcggtgcaggaggcacccgaagcaccggcacgcggccggggtgtgcccgttctgcctacgcgaccgcctgtcgcgcctctccgccgccgccgcctcctccggctccggacgctccgcgcgcgccgccggctacgcgtccgcgtcaccatcatcatcgtcggcctcctcccctccgtgctcgtcgtgggaggcgaccgtagcccagtcgtcgtcggcacaggcgccgaggccgg

SEQ ID NO: 29511 - DNA, 352 bp, Sorghum bicolor
  Clone ID: 9301486
cgcgtccgcgtcaccatcatcatcgtcggcctcctcccctccgtgctcgtcgtgggaggcgaccgtagcccagtcgtcgtcggcacaggcgccgcggccggcccgccgcgggagcctcgcgctgctgctgcggcaggaggggagggaggcggctgcgctgtccgagggccgccgagcggagcaggaggaagaggaggaggaggagaggaaggcgaagcggggcaacttctggacgcggctgcagcagcagctccaccacggtggctggcacaagaaagacgacgggtgctcggtggccgcagagaggcagaacgccgccgccgcggcgcacaagcgggcgccggtggtgtga

SEQ ID NO: 29512 - DNA, 335 bp, Sorghum bicolor
  Clone ID: 9301511
gcgaggcgcaggccaagttcgagctggtgtcggcgtcgcaggtgatggcgcccgcgggtaaactcgagggtggtgtcggcctcggccagctccgacacagcggccttctcttccacccgtcgaggagcatccccgccgtgatccatgagaatttggagcggtggatgtctggcgccgcttggcagtaccatcagtgactggaacgacttcttctgggcagtgcacccaggtgggcgcgccatgctagacagcgtcgaggaaacgctcgagttgagccccggcaagctcacggcaagtcgtagagttctagccgagtacgggaacatgtctgggcc

SEQ ID NO: 29513 - DNA, 454 bp, Sorghum bicolor
  Clone ID: 9301555
cttagcaatagaggccatggctgatggtggagttgctgctgggcttcctcgggaccttgcccttggtcttgcatctcaaacagttcttggtgctgcaaccatggtgagccagacaggtaaacatccagggcaactgaaagatcaggtcacttctccagcagggactaccatagctgggattcaggagctcgagaagggcgcatttcgtggaacactgattagtgctgttgttgctgccgcaaagcggtgccgcgaactgtcgtagagttcgatccatattcattttggcggatttcgacaaggctgcatttcgttgatatacattcgtaggtctgcaaggtgcaaattgtctggaatattagattaataatgtattggtggcttcagagcggcgagatgtaatcatggtattttgcagaatcaagtaagtacatgtttccgtgcaaagattagt

SEQ ID NO: 29514 - DNA, 252 bp, Sorghum bicolor
  Clone ID: 9301589
ccaggaggaggaagagtcttcctagaagggagattatgaagtcaaacccaagcgtcgctcggcgaaaaaatctgaatcggactagtctcagcacttcagcgccgcatagcaggttattctgctcgagtggaccttcttctttgtatttcggtctcggcggtgttgtgtgatggcacaggaagagtgccttgtttttttattaaggattccaagggtttaaggtcgttccacatgttattatgatatagattg

SEQ ID NO: 29515 - DNA, 389 bp, Sorghum bicolor
  Clone ID: 9301631
gcacgaggcaccctcacacgcacgacttccttccttccttccttccagcgccgcaccacgccatcaggcggcgcgggcagcccattcctcttcctcctccacttcacccctaacctccgggctcgattccagaactactcaagctgggcgggcagggaagggatattttctgctctcgacctatttttggaggagtaaagaggcggcgaggtgacgtgacgacttgcaccgaagacttgcgcgtcgggagatccgtctagaggtggatcggtggttgcggctgagttgggagacccggagaccttgaggagcgatgcagagggaggtggggccgcaagtggaccctgcgctcttcctccaccagatccagccgatgcctccccacgccg

SEQ ID NO: 29516 - DNA, 604 bp, Sorghum bicolor
  Clone ID: 9301642
cgcaagtgcctggagtgcatcggccggccagtggctgagtccaggcgggacgcgctggggcgagggtcgcgcgtcttgcgccggcttctcagcgcggcggaggtggagctggtcatgaggagcgagcgggagtgcgccgcgaaccagctgcgggcggaggacgtgtacgtcaacggcaccaagctgtcgcctgaggagctcgtggtgctgcaggggtgcccgtgcccgccgtctaggctccggccggggttctattggtacgataaggtgtctggcttctggggaaaggaaggacacaaaccacattgcataatcactgcaaatctaaatgttggaggttctctagatcaaaaagcaagcaacgggaacactggaatattgattaatgggcgagagattacaaaatctgaactgcaaatgcttaagttggcaggagtccagtgtgctgggaaacctcacttttgggtgaacgctgatgggacttaccaagaggaaggccaaaaaaactgttaaaggaaagatctgggataagcctatagtgaagcttcttagtcctgttctgtcattgccaacacccaacaaagcagctaatcaatcaagcgaa

SEQ ID NO: 29517 - DNA, 248 bp, Sorghum bicolor
  Clone ID: 9301643
ctcagaccagttcaatttcttgcaatttccacatctcccgatccacccatggcagcccctaccgtcgtcttactgccggtgtggggtgccggccacctcatgcccatgctcgaggccggcaagcgcctgctcacccgcggcggccgcgcgctctcactcaccgtgctcctcatgccagcgcccacggaggaggtcgcggccgagctcgacggccacgtacgcagggaggaggcctccggcctagacat

SEQ ID NO: 29518 - DNA, 572 bp, Sorghum bicolor
  Clone ID: 9301653
gcacgagggccggccggcctgtgaggcctgtgagtctgctgcgaccgcggccggctgactgactctgccaggctaactggcgcgcacgcacgcccgcacgcacaccctcgcgcttggagcgttgcgaggatcggatcacagttcactttcagatcgcaaggccaccgcccaccggccggctgcttgctgcctgctccgcttgtcgccattgctggcgagctactagctagctagcttccgggatcggacgacggagagcgaggtagcctctgcggccggcgccgccgctggcgtgcagtgacgacgaccgagcgcgagtccgccgtgcgtgcgagctcttctcccgccgcgcgcgatgatgggcgccgtgacctgccggagccggacgagccggcgccgctgccacgccgccaccgccctcctcgccgccgtcctcttcgccgcggccatggttgtggcaacagggcggccggtccgtttgccagcggcggcgctggcgaggaggcggatagactcgtcgtcgacggcgatgatcatgaacgccggcggcagggcagcgaccaccaccacga

SEQ ID NO: 29519 - DNA, 504 bp, Sorghum bicolor
  Clone ID: 9301766
gcccgaccgaaccccctaccccccgtggaggaatcctccccccgatgcggcgccgatagggaccggtggaggagcgggaatggcggggcacggcgagaagcggcgccggacgggaggggcccacgaggaggagccggaggaggaggaccgcatctcggaccttcccgacgtactgcgcctgcagattctcagcctgctgccgctcaaatcggccatccgcaccggcgcgctctcctcgcggtggcgccgcctctgggcgtaccgctggccggagccgtcctcggttaccatccgcctcccgcccggcggcggcgcggcgggggcgggggcggtggcggctgcggcggcgcgcgcggaggcgctcgcggggatcgaccgccgcgggcgccgccgcgtcgacggcttctccctctccttccatggcgggcagctcacgcaggcggacctcaaccgctgcgtccactacgccgcggcgtgcgaggccgaggacctgcacctccgcgt

SEQ ID NO: 29520 - DNA, 497 bp, Sorghum bicolor
  Clone ID: 9301772
gcacgaggattgagaagattcgtcgcgtcgctgacaactgctcttccctccagggtttcctcatcttccactctttcggtggtggtactggttctggattcggtgcgctcctgctcgagcgcctctcaactgactacggcaagaagtgcaagctcgaattcgccgtctaccctgctccccgcgtctccacctccgtcgttgagccctacaacgctgtcctctctacacacagcaccattgaaaactccgactgcacgttcctggtcgacaacgaggctgtctacgatatctgcagacgcagcttggacatcccccgccccaactacgagcacctcaaccgcctgatcgctcaggttgtcagctccatcacctccagcttgcgtttcgacggtgcgcttaacgtcgatctgaacgagttccagaccaacttggtcccatacccccgtatccactacccgctcatcagttacgcccctgtcatctcggccaagaagagc

SEQ ID NO: 29521 - DNA, 619 bp, Sorghum bicolor
  Clone ID: 9301793
gcacgaggacttatcaacctcctctttccaacaccttggtcctttgcgtggcatatcaacttcatcactaatcagctgtaattatggctccttatactgctaaatggggcatcttggctaccggtggcatcgctgagtgcttcactaaggacattcttacagacccaaccgctcgtgatgtcagcgatgtgcagcatgagattgtcgccgttgcctcatccagctccgtcgatcgcgcacgcgactttatcaagaagattgatggcccctcatccgctgctgtctacggctcctacgctgagctagtcgccgacccaaacgttgacatcatctatgttgctacgcctcacagccaccacttccagaatgctatgctggccctcgaagctggcaagaatgttctttgtgaaaaggcactcaccgttactgctgcacagaccaagaagctgtatgaggtcgccaagtccaagaacctcttctttatggaggctgtctggacacgatacttccctctcagtatcaagattcgagagttgatccagtctggtatcattggtactgttcatcgtacattcgccgacctctcgttcaacaagaatactgatagccaggatcttga

SEQ ID NO: 29522 - DNA, 592 bp, Sorghum bicolor
  unsure (1)..(592): unsure at all n locations
  Clone ID: 9301809
ctttgacgtcgaggtttctacagcatacgttttctttccagaccttctgggcttgatccaaaggtcgttccgctctttagcatcggttttaatagttcttcattcttcgggttcttcgagtcggcttctttcgagactcttggcccatccggtctttcaaccaaacacaaaaagcatccactacgttcttcaccatggccaacttcagcaagcccgcgagcatgatgactatgctagtcgcccttttgtccattttgcagttcactgtcgctttccagcatggctcgcaccaccacgcccaccctgctcgccacgcagactctgccattgaggctcacatcaacgagatcgagggtgagctaaccaagcgtcagtcgcagcaagggttcataaccatcactggtgtgtgcagctccggtactgcatccaacggccagtgcaatggcggcaacactgctgcgccccgtctcgagctccgtactttggcgcgcaacgccgaccagtggaacttgtacctcctgngtatggagaggttcatggccaaggacaagaacgacaggctttcgtactaccaggtttctggtgtccacgg

SEQ ID NO: 29523 - DNA, 609 bp, Sorghum bicolor
  Clone ID: 9301835
aatctctctatcatgtccagcccgagaccgaaaaggaggcaccaaaggttgtagcctccatcaacaagtatcgcacaggtgccgacgagtccacgagtatcatctgtcagtttcctaagcacaactccgttggtattgcgactacctcactgcgcatcgccaccgacgtcgatggtctttacactggtggccccgcgatacgtattcagggctccaagggtgaaatccaggttactggccctgcattccggccgaccgagtacaaagtgatcaagtcggacgccaatggcaaggtggaagtagtgaactgtccaattcctacagatcctaagcgcaacaactggggccacggtatgttctgggaggcggatgagtgtgcacgttgcctacgggatggtaaaaaggagagtgcttcgatgccttggtcagagagtatagtcatcatggaggtcatggacagcgcactcaagcagggtggcgtttcctaccccgatctcatcaccactgatatcttcgaccccaacagtcctctcaatactggcaaaaaaatgaaaatacgacgtgtaatgttgggcatgatactagaattaatgatgaaataaaagtcga

SEQ ID NO: 29524 - DNA, 683 bp, Sorghum bicolor
  Clone ID: 9301856
ggaggcggcctgtgcaccaaagaagaaaatggctagaggtgttgaagttccacctcgtaggaagctaaattttgattcaggtgactacccagttaaaaggttaagttttgatattagtgattctgaagaggaggatcaatatctccaagtgattcacaagatgatcctggatatattaattgtagatggccctcttgatggacagcaagaaactggaaagaatgtgacagattcaggcctacatggaagctgcaagacacctgattcgaagcctctactcactggcattgcatccacgtgcccaggtgcacctttgagaccatctcttaaagcgttgaaactcagcccagacatttgtcggaagattgacttcgatgcagtcagtgactccaataaagaaaataattgatggttctgcccctcttgattgacaataacaagtaatgaactgtgcattttgggattgaatgatctgccccaggagacagcatttggaacagctttaatctgcctatctgacaatctcatgtatcagtatcctatatgccgttgtggtagctttagctaacccagaagctttggggattattgctgatgatagataagtacttaagtagcaagcagtttaagttatacatgtaatctatatttgcttttcctttgtaactgtccttgtgctagtt

SEQ ID NO: 29525 - DNA, 578 bp, Sorghum bicolor
  Clone ID: 9301867
tcatctcggccaagaagagctctcacgagagcttcaaggtctccgaccttaccttccagtgctttgagcccaacaaccagatggttgtctgcgaccctcgcaacggaaagtacatggctgtcgcacttctgtaccgtggtgacattgttccccgcgactgctctgctgccgccggtgccctcaaggccaagtcttccttcaacttggtcgagtggtgccctaccggattcaagctcggaatcaactacaccaagcccatcagcgttccaggcagcgaactcgcttcggtcgaccgaagtgttgccatgcttagcaatacgactgccattgccgaagcctggtctcgcctcgaccacaagttcgaccttatgtactcaaaacgtgccttcgtgcactggtacgtcggtgagggcatggaggagggtgaattctccgaagcacgcgaagatttggcagctttggaaaaggactacgaggaggtggccaacgactcgcttgatgacgagggcatcgaggagggagagtactaagttagtgctaagacccgagcatccatgagcaatcagagagcatggcga

SEQ ID NO: 29526 - DNA, 546 bp, Sorghum bicolor
  Clone ID: 9301870
ccaaggaaaggaagccgctggtgagctcgagtcgctccgtcccgaacacattgagtcctacctcaaggagaacctctactacaaggttgttggtgttgacggtgagcttaacgcggacgacatccccaaccttcacatcagcgtcaagtgcaacaaggccaagcctgctgcttctgacgatgagcttcctgacctgagcgctccttacgaggttctcgagagcgtcactgctcacctccctgctggaaagcccttcaagtacgtccccagcgcgctcgacatccctctgccagacggcgatgagtacaacgagcctagcagcgacggctcgatgccccagagcccctccaacggtgtcttcccctacccatccatgccttgggaggagcagggctactgtgtcaccaagcagaccatcgagtacgttgacgagtctggtaacttcctgtactctgagatgtaaggtggtgaagccgttgcgtagagagagagtgtgatggggtcgtgaaagaagcatttgaatgattgtgtatgaaggatctttat

SEQ ID NO: 29527 - DNA, 706 bp, Sorghum bicolor
  Clone ID: 9301892
aacttggggatatattgaggcaataagggagatcgagcagcaaattcagcaatctgctgatgttcagtttgatgatattgttgttgcgtgtggcagtggtggaaccattgctggccttgctttaggatccagattgagcagcttaaatacaaaagtccatgcattctctgtttgtgatgatcctgaatatttctatgactatgcccaaggcctgattgatggacttgattctggtttggattcacatgatatagttagcataaaaaatgctaagggattaggctacgccatgaacacagctgaggagcttaagtttgtcaaagacatagctgcagcaacaggcattgtccttgatccagtctacagtgggaaggcggtttatggattgctaaaagacatggctgccaatccaaccaagtggaaagggagaagagttctgtttatccacacaggtggtcttcttgggttgtatgataaggctgaccagttgtcatctttggctgggagctggcgcagaatggatcttgaagattctgttccacgcaaagatggcactggtaagatgttctgatcagtatggtccacttccatgaaggctcattcttgcaaacattcatcatagagtttttactcttacatttgtgcaagaaaatgcagaatggatggttcacattgtatagagcactgatgcaatttaagaataaag

SEQ ID NO: 29528 - DNA, 708 bp, Sorghum bicolor
  unsure (1)..(708): unsure at all n locations
  Clone ID: 9301894
tanagcattcattcactcactctaatattgagcactgtgttttaaggtagcatttgttcttttgtttttcatgtatggctttccgtcccccttgtaacttgatgtggatccatgcttttgattaatgccttgagtgaagtagcatgaagatgtttatgctcagttcaaaagtgtttgatctggcatcagtcatctcttccacagccatacgattgtgacagtgaaagtgatgtgttccatgagttttggcactggtgttttgctctccaaattcatcagtggaacataactagtatattcacccctggttactaagtgctaacagttttgttgattttcatcaattggattcatgttgtacatctgggtgagtcactttttgactgcgtgattgatggtctggcacagatgagaatggcagtgcatggttgttgcatattggcataattctcaggttcaacagttgataatgagtatggaattcttcaaagtttgttttgtctctcatagatattgcctggttactctaccagacggttggtgtgaacgataagtgcctgtgtgggtgaggggatgcaacatttctttgtactactttaacttttttttttttgagttcacccattttgttgtgtatgtatctaggcacatttttatatttatatgcatagcaaaatggatgtactaaaaaaaataaaaacgaactta

SEQ ID NO: 29529 - DNA, 379 bp, Sorghum bicolor
  Clone ID: 9301901
gtgataccttgtcaaaggaaaagtacatgtccaaggaagagaagcagacatcaatcaatcattttcatgagaagctttttaaactgaaggacatgatgaagacagaggctgggaaaaggagagctgagaaaaggcataggttcatggaggactttgtggctgaattctacgaagagtggagtggcagggcttgaggttgaactaccaggttttaaacttgtgtgagagtgtgcagttggccaaccatttctcaacagctgatgatgatgttgtcgacctggcatattttctgttgatgaagccaggcaaatatacaatgcaaagcctattagattggctgaacaatcatacggccccgtgttaagcagtcaacccacta

SEQ ID NO: 29530 - DNA, 650 bp, Sorghum bicolor
  Clone ID: 9301906
cggcgccaagtgcgtcgtgacggtgggcgcctggacgaccaagcttctcaggtccgtcgccggcgtggagatccccatccagccgctgcacacgttgaccctctactggcgcatcaagcccggccgcgagcgcggcctgaatgccaaggctggcttcccgaccttctccagctacggcgacacgcccgtctacggcacgccgtcgcttgagctcccgggcctcatcaagatcagctgcgacggcgggccgccgtgcgacccggacaaccgcgactgggcctccggcgacagggagatcaccgaccgcgtggctaggtggatcgcggagttcatgccgggccacgtggactccgccggcgggccggtcgtccggcagtcgtgcatatgctccatgacgccagacaaggacttcgtcatcgactggctgggtggggcgttcggggaggacgtggtggtcggggccggcttctctggccacggcttcaagatggggccggcggtggggaggatcctggctgagatggccatcgacggcgaggcgaagacggcagcggaggccggcgtggaactcggccacttcaagatcaacagattcaacggtagtaaggacaattagtttatactatataaaataaataatagtgactcgg

SEQ ID NO: 29531 - DNA, 584 bp, Sorghum bicolor
  Clone ID: 9301917
gcacgaggctccccagtccggcgaacgaatcgacgaagctcgagctacgccaccaatccatccaacaccatgacggggaagaagaggacgttcgtgctctacccttcgctgggcgtgggccacctgatcccgatggtggagctagccaagcacctgctgcgccacggccacggcgcgctcatcgccgtggtcgacccacccgacaccgacgccgtgtcggccgccgcggtggcgcgcctggcggcggccaacccggccatcgcgttccgcctcctgccggcgccggccagcccggacgtcgtcggcgtgcacccggcgaagcgcgacaaggacacgctccagctcgccaaccccgcgcttcgtgacctcctgcgggactccctgcccggcgccgtcgacgcgctcctcctcgacatgttctgcgtcgacgcgctcgacgtcgcggcggaggtcggcgtcccggcatacttcttcttcgcctccgcggcgggggacctcgccgtgttcctcaacctgccgtacctctacccgaccctgccgtcgtcgttcagggaaatgggcgagacgcttgtgcgctgcccccg

SEQ ID NO: 29532 - DNA, 546 bp, Sorghum bicolor
  Clone ID: 9301924
gcacgagggccgatcacactcgccccactcaaagcaagcagcagcccgggggaaggctcgcaggcagcgcggaggaatggcgaccaagccggtcaccgtcggcgacctcatccaccgcgtcaccacctcctgcctctccaaccgcctgccctgcaactacaccctccgggactccgtcgacagcgacctggacgacgacgacgacgaccccttcgccgacgccgtctctagcagcgagaaatgccggcgatccccgtccgctgcggaggcggaggaaatcgaggaagaggagggggacgaggaggaggagaagctcaagatctgggaggaaggggagcaggagaaggagagggtggcggccgcggccaagggcgccgagcgcgcccgcgacgcggacgcgctgatggcggaggtgttcgacgccgtctccggggtgcgccgcgcctacgccgcactccagggcgcgcactgcccctgggaccccgacaagatgcgcgcggcggacgcggccgtcgtcgccgagctccgccacctcgcgcgcctccg

SEQ ID NO: 29533 - DNA, 600 bp, Sorghum bicolor
  Clone ID: 9301928
gcacgaggggccgatacagcttcttcctcatcgtcgcggctgctaccttctgctgggagtgggttcctcaagttattgcccagttcctccagctcttcatgttcccctgctggatcgcccccaacaacattgttgttaaccagatctttggtggaaacactggattgggtctcctgcccatctctttcgactggtccatcatctctggtttcctgctctctcctctccagaccccggcctttgccattgccaacgtttccgccggtattttcgtcatgcttctcggaatcattggtcttgcttatgctggccccgagttctaccgctaccttccccttagcgctaaccagaacttcgaccactacgctcagccttacaacacgagccgtatcctcaaccctgactttactgtcaacctgaccgcctacagggagtactctcctatccttttgggacccgccttctccctgtcgtacggcatgggatttgctggtcttatctcgacaattacccacattgtcctcttctacggcccggacgtctggcgtcgatctatcgactctcgttccgaggaaccggatattcacatgaagctcatgc

SEQ ID NO: 29534 - DNA, 644 bp, Sorghum bicolor
  Clone ID: 9301930
cttaatcccttggacaacatcatagcgtacgtgcagagaagaagagccgatcgaagagggggagctagaagggacagcaagaagcggcgccgatggggtcaagcggcggcggcggcagcgacggcggcggcgaccggcaagcgcagccgctgctcggcaagctctcggagtcggagtcatcgtacagctcgtccgacgagcacctggtcaacagaaccggcacggtatggacggcgatggcgcacataatcacggcggtgatcgggtccggcgtgctgtcgctggcgtggagcgtggcgcagctgggatgggtgggcgggccggcggccatggtgttcttcgccggcgtcaccgcggtgcagtccaccctgatcgccgactgctacatttcccacgacccggagcgaggcgtcgtcaggaaccgctcctacgtcgacgccgtgcgcctctacctaggcgagaagagccatctgttctgcggcttcttcctcaacttcagcttgtttggcaccggtgtggtgtacacgctcacttccgccactagtatgagggcgattcagaaagccaactgctaccacaagggaaggcacgacgcgccgtgctccgtgggaggggacgtctactacatgctcgtgttcggcctc

SEQ ID NO: 29535 - DNA, 619 bp, Sorghum bicolor
  Clone ID: 9301931
ctcgcgtccaagcccacgcacgtctacggcaagccctggttccgctgcgagtgggagcccaacggcgcctcctcgtcctcgccgccgatgcgcgccgccaagacgtaccacatgctcccggactggggctacggccgcgtctacaccgtcgtcgtcgtcaactgcacgttcccgcgcgtccccaacgccgacaacgctggcggcaggctcatcctctacgcgcactacgggccgtcgcgagggatggggaattgaaagaaaaaaaaaaaacaaagtggaagaaacaatttagttggtcggacatcttggaagcaaaacatcttttacctactacgacagagatggctgctcaggatgtaagagtcaattcccagccttgatcctcttttcccggagccggcctgtccggggccgcaacactaatcgggtcctccgtcaacgaaatacaaccacggctggctcggggaaggagatctttggcgcggcgactacttttttgccttttctatttttttatttcattttccgcaaaagacttttttcattttcacctttgctacttctctcgacttttgcataaagtgcgacataccatctagagggtttgtctgccccggga

SEQ ID NO: 29536 - DNA, 231 bp, Sorghum bicolor
  Clone ID: 9301942
gcacgagggcgaaaggcagcgatgccaggtggagcgagcgctgccatcttcctctcgatcttatttccaccgacgaggtgcaggagggccaagaaccgatgcgagcgggtggatccttcggtccttcctcaagcagtcaggcatcccttcatcggtgcttgggctcatctctggagtggtggcgacaagaatagcatgggctcatatcttgggggtggcgcgtccgcgtta

SEQ ID NO: 29537 - DNA, 592 bp, Sorghum bicolor
  unsure (1)..(592): unsure at all n locations
  Clone ID: 9301946
tggngaaatcatccctactcagaacattgactgacatttcattccccgtcatggctgggattggtacacgctttccaattcgagtcatttcgcgccgtagccctagttcacggggcagtagggaacgatttcgtatttcactagaacgcgcaccacgagatgtgaacggcttgcaacgagctgatgctgctgcagacgattaccgtctcgagggagacaccttgaccatggacgtattcgaggctgcgcttaaggatctttctgagaacaaaattggcatcagaaaaggtcaaggcataggggctaaaaactttgtcccagatattgtcagggttgaacttgaaggacctaacagatctcctttcaacattctggatctcccaggtctcatctcctcagaatatggtgtcaatgaacctgagcccctcgggacacaggaactggctaaggaatacatctcccgacaggaaaacacaatcatatgcacaatacccgcaacatctgacctgggaaaccaacgagcttatcagatttgcaaggagcatatatcagacaagaggcgactggttggcgtcttcacaaaatgtgacaa

SEQ ID NO: 29538 - DNA, 527 bp, Sorghum bicolor
  Clone ID: 9301961
ctccgccgcccccccgaaggcggcccgcccccaccgccaccgcccaaaggcccatcccctccgccgccgccgccgccaggaggaaagaaaggagggccgcctccgccacctccaaaggtggggcatcggcgtcctcctctaggccgccgacagcgccgggcatgccatccggggccggcgagcagcaggcgaagctgaagccgctgcattgggacaagatgaatgtgcagtccaccgaccactccatggtgtgggataagatcaccggcggttcattcaacttggacgaaggcatcatcgaggctttattcggcactgcagcagcaaaccgcaagccgaaatctgcagacaccaaggaatccgccggatcgtcggccctcgggcgctcaaacacgccagagcaaatcttcctgctcgagccgcgcaagtcgcacaatatttccatcatcctcaagtccctcacggtggggcgggatgaaataatcgacgccctccgggatgggcacacagaactcagcactgaggtc

SEQ ID NO: 29539 - DNA, 542 bp, Sorghum bicolor
  Clone ID: 9301967
gcacgagggtaaggactctcaccagagcattcacaatgccgcccccttcaccatctccaccactctcttacacaacacccccttctctcaatgccttcttctgcaaaccagccgagttcaggtcaacacaccctccaatccaacatctcatcgccggcgctttagtcaccaatcttcaaggccaaatcctcattctccgccgcgcagcacacgactcatggcctctcctgtgggaagtccccggcggttgcgtcgacgaagccgacactgatctcatcgccggtgccgtccgtgaactctgggaagaagccggtctacgcgccaaaacagtaaaaggcatcgtgggcatagcacccatcaccgaacccatgcctgatgatcctttggagaaagacttggaagttctgtacgacatgcttgtatttcgagcccatgatggagtttggggcaagctaactatttgggtggacgtggagagctacgaggatgtcaaaattgataaggatgagcatgttgagtttgcgtgggtgacaaaggaggag

SEQ ID NO: 29540 - DNA, 596 bp, Sorghum bicolor
  Clone ID: 9301971
ctcctccggttcgtccccaaatcgccacccaggcgcacccaatgctggcagcctcccttctcgccctccgcctcctcctcctcgtcggcaccgccgcggcgggggcggtagggatgagtggtgggggccagctgtggtgcgttgccaagaacaacgcggaggacggcgcgctgcagagcgccatcgattgggcgtgcagtgttgacggcggccgcgccgactgcgcggcaatccagcagggtggcgcctgtttcgatccgcccgacctccagcagcacgcctcctacgccttcaacgactacttcctccgctccggcggcgccgcgagccccgccgcctgcgacttctccggcgccgccgcactcaccgcgctcaaccccagtcatgggagctgcgtgtttccttccagtgcatctccaaaaaatggtagcttcacaggaacgacaacctatggtccaactggtgcagatttcagcaacagtttctcatggaaactcaacttctggggaaggttgagcttgagcaagctgccggtgcgtcgtcgtctcctggccggcgccgggccaccgagcagcaccaaccctgcaccggcagag

SEQ ID NO: 29541 - DNA, 641 bp, Sorghum bicolor
  Clone ID: 9301972
gcacgaggcaccacaccagtccccacaccgagctgtccccatcgccgcgcgcgcacactccctctctctcacccagtgttcacgagtccagagagctcgagagctcttgcagccatggcggcggctcccctgcttctcctgctgcttctggccatgttcacagcctcagatgcggcgttctgtgtgtgcaagacgggcttgtccgaccagggatatcaggcggcgatcgactacgcctgcagcaagggggcggactgcgcctccaccaagcagggcgggccgtgctacggcagcggcaacaaggcggccgtctgctcctacatctgcaacagctactaccagatgcggagcggcatgggcgccacctgcgatttcaacggcgtcgccacactcaccggcagcgaccccagctccggaacctgcaagttcgcttccggccccagcagcgctggcaccggcggcggtgctggcatgggcaccggcggggcaggcgctggcaccggcggtggcatgggcgctgggacaggcgcaggcgcaggcacaggcgctggcaccggagcaggcacgggcatgggcaccgggacggggactagcaccggagctggcaccggcaccggcaccggcgcggggatcacgacccc

SEQ ID NO: 29542 - DNA, 599 bp, Sorghum bicolor
  Clone ID: 9301973
gcacgaggggacgccatcgacaagcttgagacgctgcccgcgtggcagcccacggccaccggagccaatgccgtcgcgccgccgtcctcctccacgcacccagactccgccgagaactccgacgacgaggcgcaggccatcaccgtcgcccacacggccttcgacttcccaggcgctgcaggagccggcgggggcggaagcggtgcgggcttcctcccgtcgtcgctcgactcagactccatcgcggacacgatcaagtctttctttcccatggctggcacgggaggtggcgaggcgtcttcgtccacggcagcgacgcagtcgtcggccatgggcttccaaagctacacgcctgacctcctgtcacgcaccggcaaccacagccaggagctccggttgtcgttgcagtctctcccagaccccatgttccaccaccagcaccaggaccggtcgcaacaaggccacggcggcaatggctccgcgcagcaggcgctcttccccggcgctgccagctactcgttcgtcggcggtggcggcggcaccatgtggggcgagcaggcgcagagccagcgcatgctgccatggaacgtgcccgaccc

SEQ ID NO: 29543 - DNA, 494 bp, Sorghum bicolor
  Clone ID: 9301989
ttggggcggctgctccccgcagggttcttggacaggaacaggggcagaggcatggtggtgaagaactgggtgccgcaggcgcaggtggtgcggcacgaggcggtcggcgcgttcgtcacgcactgcgggtggaactcggcgctcgaggccatcgtgtcggggctgcccatgatttgctggccgctgtacgcggagcaggcgctgaacaaggtgttcatggtggaggagatgaagatcgcggtggcgctggggaggtacgaagagttcgttagggcggaggaggtggaagcgaaggtgaggctggtgatggaggcggaggaagggaggattctccgggagaggctcgcggtggcgagggagaaggcgttggaggctactagggagtgcgggtcttctcaagtggcattcgcggagttcttgagagatttggacaagagcagctccgtaaacggagaatgcaattgatcaaggagtacaatttgaagttatgataa

SEQ ID NO: 29544 - DNA, 603 bp, Sorghum bicolor
  Clone ID: 9301992
tctaaagcatgctgatcatactccagaatcaagttttgtgcaccgattgctgctctcactacatgatcttcagcagaagcatgggctttaccaccatatggatatatttctgggagaaattcttggtgctgtctacctggtggaaggattaaatataaaaccatctttgcaactgaagccaataagtattgttgccaacaacacaacaaacatggacggtcagattgttattaacatgcagagtgcaagttcagtgaaagtattaagtgattttaatactgaagattattacagtcgaatcgctaattctttaggccacaaagagcggtctgcagttattggtagctttgaagaacaaaccgcaatctggagcagaccccctttgaaattggagacatgaacataaatgagcctatttttttatgtagtatgtagtaatgttggtgaagcacaaccataattgagctccgttacggagtatgcccctagcttataaaagtagttgcaaacgtggtctatctttttaagattcaccccatttattttggcatttggaagcataatatttttttgttcataaatgtaacaaccaccaattgttca

SEQ ID NO: 29545 - DNA, 399 bp, Sorghum bicolor
  Clone ID: 9301996
gtcctgggcgacggcgagcaccggagggtagtcaacggcggcgcgcacccgcggacgcccttctacggggagttcctgcgcgcggccaaggccgtgtggttgctgcacctgctggccttcgcgctggagccgccgcccagccacttcgaggccggccgcggcgcggagttccaccaggagtacatggagagcgtgaccggtgcgcccccgcacgccggcgcaggaatggtcgtcgggttcgcggtcacgccggggttccggctggggaacggcgctgtcgtgcgcgcccgggtctacctggtgccgcgtggtggccgaccgtgacagaccgatgcatggcgcggcgcaacggtaccacggaccacggatcaccccctccgacagagttgttggtgggtg

SEQ ID NO: 29546 - DNA, 657 bp, Sorghum bicolor
  Clone ID: 9302001
gttttgtttgcccgaactccgaaggtaccatgattctgcatcatgagctcaaagaccgtcttcattcaatgttttgtgagacactgagcaaagcacaacaagaactggataagtactgcgaacaagaaacccaaaaggagctcctcctaaccacccacgaggacttcagtactaaacttgaaggttggcgcatgttgagatacgccagagctttctaccgtggggtcggtggcgatgagccccaagatcttatctcaggccagactttgctcaatatgtggaaagagatggattcttcaaaaaaagacagaatggtgtacgatatccacgatgttatcaaagtatactatgggattttcctggagtcattcattagccatatcactcaaaccataatggagggttttgttatggataaagatggtcctttgagaaagatgacgactgaatatgtcctcagccttccaaaacaggaagtcagcgacatgacgagagaggacaaaacggcaggtcagcggagagcgcaactaaacagggatatcaaaggtcttgagggtgatcaagagattgcaaaagaggcgagagttaaagtggaggcattgaagcgtgattaatattgattcgatttgtattattataaccactgtaggtcccatt

SEQ ID NO: 29547 - DNA, 228 bp, Sorghum bicolor
  Clone ID: 9302018
aacaatgaaataatctcacatttgcattctttcctgaaacttgtaactgagaactggagtcaccctagtgctggttgaatattaataaagctgtgacctgaagctatagctctattggtagttacttctgaaacttttagtagttcacttctaaatttgttcttactacaacaatgcaggaacaagagcctgtgggtgttggacattcagacatgttcccagatctca

SEQ ID NO: 29548 - DNA, 494 bp, Sorghum bicolor
  Clone ID: 9302029
gggtcttacttgccccaacgctcgcacattctacaatgccagtgttatctggggtgttattggccccaagctggtctttggtgccggtcaattgtactcttggatcaactggttctggctgattggcttcgcttgcccccttatccagtggatcattgcccgccgctaccctcgctctatggcccgttacgttgtcttccctgccctctttggagctgctggaatgatcccgcccgcgactacctggtatctcgcccaatggtgcattgtcggtctcatcttcaactggtacatccgacgccgctggctcggctggtggactcaatacaactatgtcttgtccggtgctctggatattggtactgctatttgcactgtcattatcggtcttggcctgggtcttggcaacgccagcttccctgactggtggggaaacaccgtcatcaacaacaacctggatgccaatggcgatgccattatgcgggttgccccaa

SEQ ID NO: 29549 - DNA, 401 bp, Sorghum bicolor
  Clone ID: 9302030
gtgccgctgctgggcacgcggcgggtgaacgcgttcaggctgtgcttccgcacggcgtacgtggcggcgaccacggcgctggccgtgtggttcccctacttcaaccaggtcatcggcctgctcggcgccttcaccttctggccgctcgccgtctacttccccgtggagatgtacctcacgaggaacaaggtggcgccgtggagcaaccagtggctcgccgtccatggattcagcctcgtctgcctgctcatcagcgccttcgcctccgtcggctccgctgtgggggtgttcgggtcggagacgagctgacgattcaggctctgcaaatgcaattgccgggaattttgaggatggggatcggactgcatccagccacatgcggtgtacatagaatgcgattg

SEQ ID NO: 29550 - DNA, 224 bp, Sorghum bicolor
  Clone ID: 9302031
tcgacttttgcataaagtgcgacataccatctagaggttttgtctgccccgggaaagatggcgtttctacaattttctggaattggaaataattgtgtgctttttgttttgttattgtgtgatgcgccggcagatgtgatacgaaattcattcttctgactgggaacctgttttggtcgatttttttatggaggagaggaggatggggaagaaactcgtcggtg

SEQ ID NO: 29551 - DNA, 406 bp, Sorghum bicolor
  Clone ID: 9302047
gcgacgacagcgacagccacaggtcgatgcagtcgcggtggtagacatggctgcacgccgggagcagcttcaccatggcgcccacctggatgacgccgaggcagaccgcgcactccgtctccgtccagctcgcgcccttgccgctgtgcctcaccagccggttgtacatgaacggggggagcgccgcggcggcggcgctcagcggcaggagctgatcttcttcttctgacgactcggcggagcctcggcctcctgagcttgccgcgaggccgccgtcgtacgcggagggctcctgctgtggtcgccggtgcgccaggtgcctgcacagcgagacgagggcgaaggcggcggccaccgacgccgtgacggagcagaagaagaggaggttgtcgggtgacaatgagag

SEQ ID NO: 29552 - DNA, 508 bp, Sorghum bicolor
  Clone ID: 9302049
gacaacccgatgcaacagcagcatggtggcgggctcagccccaccgtgtcggccatcgggttcacgcccggcatcggcttctccgggatgcgcatccccactaggatacagggcgacgaggagcacaacggcggcagcggcaatggcgacaagccgccgccgtctgtgtcctcggcatctcaccactgacagcagcagtggagcacagattactccacccaccaccaaccaccatgggcatcgagcaatacaccatgtatcagtaacatcatcgtcagctcctcaacatgcacccttggagttataatttgctgcttcttcctatggtccggaatggacgattgcaacaagaaggagcaaggttgggaactaagcactcttttggttggtcggtcggtcggttctctagatctcttgctgcttctgtcactggtttttgcttcaagagctcactcggagcttcttcttagaaattaggcttgtgagaatgcagcacattggcttgata

SEQ ID NO: 29553 - DNA, 455 bp, Sorghum bicolor
  Clone ID: 9302062
ctggtgccttgccctgtggtcctcgctccgtccttaatccacttctcctgctgcctgcccagcaccacaccacaccatcccgtctcctctccccggccagcctccctctctctttctctgtcctcagtcctcctctcacgcttgacaaggagagagaaaggtgtagcagcagctagctgatccggccgggagcgcaggcaaaggatggaggaatacgacgggctctttccttccgcctacgtggactcctcctcatccctcctggtgcccaacggcacggcgcagggggagaggccgagagcgcggcgcaggaggcgtcgagcaccgaggtgcggcggcggcggcgacctgaacgggggaggggaccccaagaagcggcggctgagcgacgagcaggtagagatgctggaactgagcttccgggaggagcggaagctggagaccggacggaaggt

SEQ ID NO: 29554 - DNA, 184 bp, Sorghum bicolor
  Clone ID: 9302071
gaccatggaggtcgccgaggcgcccgcgcccgcgcccgacgaggacgcgctggacgaacgcggcgtcgcgctgcacctcccgaggctgctcgccggcgtggtctccggcgccctcactggcctcttcggtgtcgctggggctctgactggggcattgaccggcgcggtggcgggcatgatttcc

SEQ ID NO: 29555 - DNA, 584 bp, Sorghum bicolor
  Clone ID: 9302075
gcacgaggctaccatgtcaaaggttgtcgctaagcctaccaaggttgctgagcccgaggttgaggtccctgctagcggcggtgatgacctctcccttgatggtgcctataacactgttatgctcgcctaccacaacatccaccgtcttaaccactctgcttctgctcttgagtgggatgatgagctcgccggctacgctgagaacaccgccaacggttgtgttttcgagcacgatatgaaccaaggcaatggcggctacggccagaacctcgcttcatggggtgccacaagcgacattgatggcctcaagaacaaggctgctgctggtggtattaccaaccagtggtacaacaacgagatggccaactgggctttctacggccaggagaaccctcctgctgatatgaacattgacctctatggtcacttcactcaggttgtgtggaaggactccaccaaggttggctgcgccactgtcaagtgccctgcaggaactgttctcagcttcccctcctggtacaccgtgtgcaactacaaccctcagggtaactttggcggccgttacggcgacaacgtcctcaagc

SEQ ID NO: 29556 - DNA, 474 bp, Sorghum bicolor
  Clone ID: 9302081
ctcaggcgacggcgacggcggcccttccagcgacttccacgtcgactccgagggcctccagcggcagattgatgagctggcctcgttctccgactcgcccgcgccgtccgtcacccgcgttctgtacaccgacaaggatgtgcaggctcgaaggctatataaaagggataatgaatcaacttggccttgccgttcgggaagatgctgttggtaacatatttggccgctgggagggttctgagcctgaactacgggcagttgcaactggatctcatgttgatgccattccattctcaggaaaatgtgacggcgttgttggagctctgggtgctcttgaggcgattagtttgctgaaaaggtctgctttccttccaaaaaggtctttggaggttatcatgtttacatcagaggagcctacacgattcggaattagctgcttgggaagccgcttaatggcagggattgaagagctag

SEQ ID NO: 29557 - DNA, 572 bp, Sorghum bicolor
  Clone ID: 9302101
cgagagttcgcttcacctcagcgacagtcacacaggacagcgcacaccccacccacaaccaccaccaccaccgccgcttctcctccccaaggccaaatcccaatccccccaggccaagggaaaggaggtcccctcccctctccttccggtgaggcggcggggagctatggagccggcggcgaagacggtggagcggctggcgcagcggctggtgccgccggcggagccgaccccgacgggtccgcaccggctgtcgtggctggaccggtacccgacgcagatggcgctcatcgagtcgctgcacgtcttcaagccggacccggcgcgtgacggggtgagccccgcggcgaccatcgagcgcgccctcgcgcgggcgctggtcgactactacccgctcgccggccgcctcgccgtgtccgcgggtggccagctccacgtcgactgcagcgccgagggcgtctggttcatcgaggccgccgtgcggtgccgcctcgacgacgtcgactacctcgagtacccgctccagatccccaaggacgacctgctcccgcacccgctgccccggcccagcc

SEQ ID NO: 29558 - DNA, 558 bp, Sorghum bicolor
  Clone ID: 9302109
gcacgaggaactaacaccatggacgaatactttgttgacctgccatacccaaacttatgcttgtacggctcctgcctcgtgcttgcagtcgtcgtcgcccgtgccatcatcctcagcggcagcggcaagaaaccaggtggcctgcctccgggcccatggcagttaccggtgatcggcagcctccaccacctgctgcgggggctcccgcaccacgccatccgcgacctgtccctgcgtcacggcccgctgatgctgctaaggatctgcgagcgcacggccatcgtggtgtcctccgctgaggccgtggcggagatgttgaagcgccacgacgccgccttctcggagcggccgagcagcccgggcatcgaggagctgtcgaggcacgggcagggagtcatcttcgcgccctacggcgaccactggcgcctgctgcggcggatcctcatgacggagctgctgagcccgcggcgcgtggaggcgttccggcacatccgcgaggacgaggcggctcgcctggtctcgtcgctgtcgtccctgcctcagcccgtcgacatggac

SEQ ID NO: 29559 - DNA, 639 bp, Sorghum bicolor
  Clone ID: 9302124
cttcaaagcgcaaacacacataagaagcagggcggagcggttgtcatcagagaatgggctcgcgtcatggcctccggcgaggcggccaagccgctgccgtcttctccgcatgtcccttcctcgccttcgccgtcctcctcgccttgccgggcctcgcagccggcgacacccattactacacgttcaacgtgcaaatgacgaacgtgacacggctgtgcgtgaccaagagcatcccgacggtgaacgggcagttcccggggccgaagctggtcgtgcgggaaggcgaccgtctcgtggtcaaggttcacaaccacatcaactacaatgtctcgttccactggcacggcgtccggcagctgcgcaacgggtgggcggacgggccggcgtacatcacgcagtgcccgatccagggcgggcagagctacgtgtacgacttcaccatcacggggcagcgcgggacgctgtggtggcacgcgcacttctcctggctgcgcgtgcacctctacggcccgctcgtcatcctccccaagcgcggcgagggctacccgttcccgcgcccctacaaggaggtgcccatcctcttcggtgaatggttcaatgcggacaccgaggccgtcatcaaccaggccctgcaaactg

SEQ ID NO: 29560 - DNA, 555 bp, Sorghum bicolor
  Clone ID: 9302126
gcacgaggatcaaaccaacctcctctgcttcttgttcctccactctccttctagaaccatctggaagcaaccgtagcaatgccgctccaccaccccaagcaccgccaccacgacgacgacctcctcccctaccgccgctccgatgatgaggccaagccgcggcggccctacacccccaccttcccctcctcccccgcctccgctaaccgcctcctcctcttcttcgccgtcgcctgcctcgccctcgccgccgcctccttcgccttcgccatctccaccagccgtaaccgccagcccctgccgcagcctccgcctactgtcgccttccgctgcggacgcgccgaggactcgctccgctccttcctagcggcctcctcgcacggcaacttctccgccagcgacagggagaaggtgctcgctgtcgttggcgtacacacggagcacggcaacatctccgctgcccgacgcgctgcgctccgcgctacctggttcccgcccaaccccgaaggcatcgtaagtttagaacatggaactggattgtcttttaggtttgtc

SEQ ID NO: 29561 - DNA, 620 bp, Sorghum bicolor
  Clone ID: 9302129
gcacgagggctctgcgacccaatttgacgggcggagctatgccccgaactgccggtggctatagcttgggcggaggtgctcgatacttctcacatactcccacggcccctgcccaagtcgtgcagaacgtctctcaggcaatgagagcatttttcctttcgggacaacgaatccgatatgatggaacaggaccacggggtgaggctcagtaccgggccgtctccgtgctcgaggatgaggctatgcgtaagctggctgccatccccaagttcgctcctggtgcctatgtcgacttccagctgagcccaaccattacggctatgagccctcttgctgccgcccttgtccaggcttccaccgcctctggcttccaggctgagactgctatcccaagcctcaacactgagggattcctcgatgtcctgtcagcggatttcggccgtgctttgaaagacctgacggccatttatgccgatcttgagcgtctttcatctttgggcgatttgccgatatctctagaatcaggcaacttgctcagagttcgatttccaggcgttgatgttgaaacagtcgagcggctgtgcgatgacattggcatccaaaggggcattgtcagtcaa

SEQ ID NO: 29562 - DNA, 530 bp, Sorghum bicolor
  Clone ID: 9302136
gaagcgtggctctctcggtggtacctgcctgaacgtcggctgcattccctcaaagtctctcctcaacaactcgcatctttaccaccagattctccacgacaccaagaaccgcggtatcgaggtcggcgatgtcaagcttaacctcgccaacttcatgaaggccaaggagacctccgtctccggtcttaccaagggtatcgagtacctcttcaagaagaacggtgttgagtacatcaagggtgctggttctttcgtcaacgagcacgagatcaaggtcgacctcaacgagggcggtgagaccagcgtccgcggcaagaacattctgattgccactggatctgaggctacccccttccccggccttgagattgatgagaagcgtgtcatcaccagcactggagctattgccctcgaggaggtccctgagaccatgactgtcattggtggtggtatcattggtcttgagatggcctccgtctggtcgcgacttggctccaaggtcaccatcgtcgagttcctcggccagattg

SEQ ID NO: 29563 - DNA, 447 bp, Sorghum bicolor
  Clone ID: 9302140
gctatggccgaactaatcgcaaacccaagggtgatgcacaaggcgcagcttgagattcgacgcgtcatggcagctgggcaacaacgacgagtacatgaggcgactctaagggacctacactacctgaaagcagtgatcaaagagaccttacgactgcaccctcctgccccgttcgtcccaagggtatgcttggatgatggcatcaagatccaaggctaccatgtgccgcgggggacaatagtcgtcgccaacgtttgggctatttccagggacccaaagtactgggaggacccagacatgtttataccagagagatttcatcagggtgaccccgaccaccaccgctgtttcgacttcaaggggttcgattttgagttcactcctttcggggctgggcgcaggatgtgccccgggatgaatttcgctcatatgaacgttgagattgct

SEQ ID NO: 29564 - DNA, 685 bp, Sorghum bicolor
  Clone ID: 9302147
aggcgccagacgccgccgcgctccccgtcgccgcaatcgctgctgctgctccggctgttggcagcaagaggaagatgatcagcgggagcggtggattcggggagctagcgagggcaattgagactttcgcggatatgtacgagcgcatggaagctgctaagcagcggcacgcggaggagatggagaggcagcgaatcaagttcctcaaggatctggaactgaagcggatgcaggcttttgtggacatgcagctgcagcttgcgagggcaaaacatgccaggaagggtgatgcttcctcagagatgctcatgtctctcgctgcactgccattcctcagcagtcctgcttacctctaaattggaagagttagattgttaggagctaacgtggtgatgtcgctctcagatgaagatggatctgggctcggtggtagactgccagactggtagtagcacttcggtatagacagcctgagttggtagtgggaaactgaagtagtctattgctgatgcgcgatgcctgttctcgccagtcgcccaatcaatccccatgtgccatggtcgacgaaagatgggagaacccaacttttatagttttcgcgttcctgaaacagtcatatagttttcgcgttcctgaaatagtcatgtaaacaatgcccaaaggcctttgactgttaatttgtttt

SEQ ID NO: 29565 - DNA, 436 bp, Sorghum bicolor
  Clone ID: 9302148
tgacgcggctgtacccgaatctggtcaccaaggaggatgtcctcaccgccgacgagctggccccgttcaagaacttcttttcacggcttgcggccttggacttcatcgcgtgcgcgtcggcggacgtgttcgcggtgacggactccggcagccagttgtcgtcgctggtgtccgggtaccgcatctaccacggcaggggccgcgcgccgacgctgcacccgaaccggaagcgctacgcgcaggtgctttccgaggaagagagcatcgcgtggggcggcttccagagaagggtgaggcagatggtggaggagtacaagcgggtgagcccgcggccgaggggccggagcgtctaccggcagccgaggacgcccgggtgcatgtgcagggccgccggcgacgggagcgtcgacttctgatgcccatgttaatttgctgt

SEQ ID NO: 29566 - DNA, 170 bp, Sorghum bicolor
  Clone ID: 9302149
aaggccttgacgtcccccggagggtcggaaaggtctttggaagggcatgagttggatgacatttcttcacttggcgatgagtctttcgttcatgaagcattcgcgtacgaaaattcggaggatccctggtgttcagagacggatggatatgaaagcatgtcgcctccgac

SEQ ID NO: 29567 - DNA, 703 bp, Sorghum bicolor
  Clone ID: 9302159
tacctatcaagcccatacttccgaaggatgctgtttgagatgaactgcttttggagcgggggatctatcatcttcgcagcagtcatcaccgcaatcattttcaccgtctcagaacccgtcgcattcactttgggctggaccctgccttttgcttgggcaggcgtgtggacacttatcaccattccctgggtccaaagtgatctacgccgggagaaacaagcctgggtcgagaaccgcgggcagggcggaattccgtacgttgacgatatcgctgcgcccaccgcgcgcacgcggttcgcatcagtgcaagaggcttttgtgccctggacccgaggtaaagaggctgctccgtcagcgcctcagagggcaactcgtatgacctcccagttatcacaccccaagatggagaagagtcaaacccccacatcaaagagacaaaggaagtcgctgcgacggagccggccaatgcctcgtctgtagaggaaaagaaataaccttcagaacatcatgtacatttctgttccatgacttgacgataccgtactcgacatcagatgggccctttttcatggtggactacatacggaacgaaagcagggctttttgaatacttgggggtttgttatagattttgacttgcattgcggcgtgttattcggttgagacgtttggcagttatgcgttgcgtatagatacccacaat

SEQ ID NO: 29568 - DNA, 640 bp, Sorghum bicolor
  unsure (1)..(640): unsure at all n locations
  Clone ID: 9302164
ctcgaggcgcactaccagcgccgntacgccggcgtgctcctcgccgacttccccaccaccccgccgcaccccttcaactacacggggaccccgcccaacaacacgttcgtgcagcacggcacccgggtggtgccgctcaggttcaacacctccgtggagctggtgctgcagggcaccagcatccagggcgccgagagccacccgctgcacttgcacggctacgacttcttcgtcgtcggacaggggttcggcaacttcgacccggtgaacgacccgcccaactacaacctcgccgaccccgtggagcggaacaccatcagcgtgcccaccgccggctgggtcgccgtccgcttcctcgccgacaacccgggggtgtggctgatgcattgccacttcgacgtgcacctgagctggggcctgtccatggcgtggcttgtcaacgacggcccgctgccgaatcagaagatgttgcccccgccatccgatcttccaaaatgctgatgactgatcgttcatcatccgagggggggtagatgggcatttaacaaggttttggtgcacgtctgcgtactttcttacgatgtttgaaacaatttggtctgggatatttaattgcagtgtgccgatttttggcaagtgc

SEQ ID NO: 29569 - DNA, 515 bp, Sorghum bicolor
  Clone ID: 9302165
ggaacttttgggtaacgagtacttcatgcatgcttctggttcactatatgctctttcttctgaggtggttgaagctctagctactacaaagagtgatagcttaaggatgtttgattacgaagatgttacagtcggcgcatggatgcttgctatgaatgtaaagcatgaagacaacagagcaatgtgtgattcaatatgcactcctacctccattgctgtatgggacagtaagaaatgttcaggtacttgtaacatagctgacaaaataaagcagctccataacaccactgtgtgctcaaagagcccaacgttgccacctgaggtggaggaggaagaatagaaaccaaaacaatttttgcccttcaaagggttatgacggtggtgctccaattggtgcactggatttgtcaactcattttcatactgctgtatggttcgctggccttgttccaacagcggcacagtagagttcgtggagaatcgatgccatcacatgacgcatagtattgagtata

SEQ ID NO: 29570 - DNA, 429 bp, Sorghum bicolor
  Clone ID: 9302171
atgaacggatatggcacgcttctacatcgatcgcgggtatgaggaatcccggcttggcgagcactcgtatctagtgaggtggcagaagacgtagccccctagaccacgtctacagcaactgtttcctttttctcttcatttcgattctcaatgtacgttacgcatcatcgtactttacgatcttctttgctcaacatggggccaactggccatcgtttttcttctcatggtcttgactttacatgcctggcgtctatgaaaatgatatcagatagggtggagggcgcgtaaggaatgaggattaacgaagagtgcctgtgcaagttctttcaaaccgcgttgtctcttcttttcattgcctggtagtgagtcatgtgtgaattgactcttgctcgcggctgttttggggttttacaaaagggtgtttga

SEQ ID NO: 29571 - DNA, 505 bp, Sorghum bicolor
  Clone ID: 9302176
ggaatgatgtcattgagaagattcgccggtctgcaacacagatttcaaagaaccgtggagtatagctttcagaatgtaagatcatcagccaggacccacctgctctatctgccaaatcagttgttgatgcaatggaatttgctgcacaacagttgaacctggagtacaaacagatgattagcagagcttaccacgattcactcttcatggccagagtatcaccaatgggtatgatcttcattccctgttacaaaggttacagccacaagccggaggagtatgcatcaccggaggacatggcgaatggggtgaaggttctagccttgacaatgggtaagctgtcgctggagtgacttgtgagcgtttggaggaatcaagtcatccggtgccaaaacaaacgcataatgttatttccaacaataagctgcacagcattggcatcatcttccctgcaccaggcctgcatataaaaccaaccattcatacagggtttaggaataaagct

SEQ ID NO: 29572 - DNA, 363 bp, Sorghum bicolor
  Clone ID: 9302204
ccgagtcggaaccttccccttcgccgccaactcccgagccaagaccaacctcgacactgagggtatggtcaagatgcttgccgaccccgagaccgaccgtctcctcggagtccacatcatcggccccaacgctggtgagatgattgctgagggtaccctggctctcgagtacggtgcttccagcgaggacattgcccgaacttgccacgcccaccccactctcgccgaggccttcaaggaggctgccatggccactcacgccaaggccatccactactaaacaatgctcgaacggtcaagatagttggataagatgctgcatgctaacggcttcaaatatgtcgatttggtagcagtgggtat

SEQ ID NO: 29573 - DNA, 514 bp, Sorghum bicolor
  Clone ID: 9302243
gcacgagggacaataaataacaataccgggcgcgttagtgtctggtaattggaatgagtacaatctaaatcccttaacgaggatccattggagggcaagtctggtgctggacgagcccacgtcggggctcgactccaccgccgcggcgaggctcgtcgccacgctgtcggcgctggcgaggagaggacggacggtggtgctgtccgtgcaccagccgtcgtcgcgggtgtaccggatgttcgactccgtgctgctcctcgccgacggcagctgcctctacttcggcgccggaagggacgccatggactacttcgcgtcggccggattcgcgccggggttccatgtcaacccggctgacttcatgctcgacctcgccaatggttttgctcaagcagattacaacgtcacggcagaaggcggcaataacgtgaagcagtcgctgatctcgtcctacaacaaggtgctggccccaagggtgaaggcctccatcgtcgccgccgatcacgcgcagagt

SEQ ID NO: 29574 - DNA, 531 bp, Sorghum bicolor
  Clone ID: 9302257
cagaagtcaacaaccccagcagacttccctccatctctccagaattcacagatcctgatcgtcctgcctcccagtcgaagtatcgaactgagcctggcttcgtcctcgacctcgccgccgccgcggctccgtcctctcaaatcaaagccaatatgcagaagcacaaggtcgcgttgtgccagctcgccgtcacaccggacaaggacgggaacatcgcccgcgcccgcgcccgcgtcgaggccgccgccgacgccggcgccaagctcgtcgtcctgccggagatatggagctgctcgtacgcaatggagacactggcaagttacgcggaagacatagacggcggagagtcgccgtctatctcgatgttgtcggaggtcgccgccgccaaaaagatcaccattgtaggtggatccatacccgagaaggcgtctgggaagatgttcaacacctgctgtgtcatcggaccggatggaaagatattggccaagcataggaaagtaagtacagcagctggagaggctgttgtctgaa

SEQ ID NO: 29575 - DNA, 525 bp, Sorghum bicolor
  Clone ID: 9302271
gcacgaggattccattttccaaaaaaaaaaaaaaaagttctgcggcggcgatggcgctctcctcctcccggccgcaccacctcctccggggcttccacgcctccgcgcgggccctggcgcgggcggagccgcacgagttcgccaagcccagcgggtacctgggcagctgggagcccgcggccgagccccgggaggcgtgggcgcggctggaccggctgcgcaaggggtacgcgcgcgacgtgcgccagctgcggcggcagtacgcctacgaggtgcagctgatggacgccgagcggcagcggaaggccgacgcccgcgccgaggccgcccgcatcgccaaccaggagcgcaaggccgccaagctcgccgccgcccagacccgcgccgccgagcgccgcgcgttcgaggaggacttccgccagaccctcatgaaagaaagagctgagaagctggagagctggcgaaaaaaggagaagctcaaagagcagaagaaggcagaacagaaggagctcctgcgcaggaaga

SEQ ID NO: 29576 - DNA, 574 bp, Sorghum bicolor
  Clone ID: 9302289
ctcacggcgagaaccgacctactcgacctttctgccggcgatgcgctcctggccttaattggccgggtcgtgcctccggcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaactgcgaaagcatttgccaaggatgttttcattaatcaagaacgaaagttgggggctcgaagacgatcttttcgttgagtttaaggttacattacctgatagaactagtgatgaaatttctaaagcttgggatgaagccttgaaggtagctggtctttaggtgagaaaattattactatcgaatacataatttaatatccttcaatatctagttaaattgaatatatccatattttatttatgttagaaattctaacccagatttttagcatttatcattatatgtttaacaaactatttta

SEQ ID NO: 29577 - DNA, 245 bp, Sorghum bicolor
  Clone ID: 9302317
acctgacgtgacccccgccggcgtcagcacctgctgctgtaggtagctagctagggacgtgtctgtccattaactattccggctggccggccggtaacattgaaggcgaggtccggccgccgcgcgcggcgaaaccgatcgaccgggatccgtggctcaggagggcaggccggcgtcgaaggagatgatttgaccacaaatgacgcggttgttgttgcatcggcgtcgccggggatcgacgcgaa

SEQ ID NO: 29578 - DNA, 385 bp, Sorghum bicolor
  Clone ID: 9302328
cgtccccctccggccagcagcacgccgccatcgggtcaggtttgcgttgccggcaccgttgccgacggcgagtctggcaactacatcggcctgtgccaattcagctgcaactacggttactgcccaccaggaccgtgtaagtgcaccgcctttggtgctcccatctcgccaccggcatccaacggccgcaacggctgccctctgccgggagaaggcgatggttatctgggcctgtgcagtttcagttgtaaccataattactgcccgccaacggcatgtcaatactgctaggagggatcaatctcagtatgagtatatggaggctgctgaaggaccaattagctgttcttatcggcagacgaaacccaagagtaagaagttaaaa

SEQ ID NO: 29579 - DNA, 560 bp, Sorghum bicolor
  Clone ID: 9302330
atagctttatggcacatgcgttacagatgttggacgcattggcataggaatatgccatgatatccggtttccagagcttgcaatgttgtacagatcaaaaggtgcgcacctgatatgctatccttctgcattcaacatgagcaccggggagctcctctgggacctcaggcagaaatccagggccgttgacaatcagctgtttgtagcaacctgctcgccggcgcgagaccgtaatgtgaactcggactacatgatctggggccattcgagcctcatcggaccatttggtgaagtgcttgcggcagctgggcatgaggaagcgaccgtcatcggcgagatggacctcaccacgatacagtctacaagggagaacctcccgttggagatgcaaagaagaggagacctctaccgattgattgacgttatggtcaatgactcgatgaaatcgcgctctgataagctgtgcctcaagatgcctgcctagtcacccaccagtgtagcactgactgactgactgacatgtacgaacggttgggaactttcacatgttggaccatgta

SEQ ID NO: 29580 - DNA, 504 bp, Sorghum bicolor
  Clone ID: 9302347
gcacgaggccagcaccgggacctcatccaccaccactacatcccgcacctcatcgacgaggccacccggatgcggctcaagtcgcgggagcgacggctctacaccaaccgcgccaccgggcccggcgacgaccaccaccgcctctggacgtcgcacgccttctcgcacccgtccacgttcgacacgctcgcgctcgacccgacgctccgcgaggagatccgcgccgacctgctgcgcttcgccgcgcgacgggaccactacgcgcgcgtcggccgagcatggaagcgcgggtacctgctccacggcccgccgggcacgggcaagaccagcctcgtcgccgccatcgccaacctgctcgagttcgacgtctatgacctggagctcaccacggtgcccaccaactcacacctccgccgcctgctcgtctccaccacgcccaagtccgtcgtcgtcgtcgaggacatcgactgctccctcgacctctccgaccgcaacaagaagaaa

SEQ ID NO: 29581 - DNA, 437 bp, Sorghum bicolor
  Clone ID: 9302356
ccttgcacgaggaggagcgaggtggccggcacgaccgagagccgccgccagcgtcaggctggtcgccgcgaggccggggaggaggaggaggacgagggtcgtggctgcggccgcaggcgagaggacagcgtctgggccggggccggagccgatgatggtagaggctgctaatggatcgtcgtcggccgtagcaggtatcagcaccctcttgacatcgactgtggggaaatcgacaaatatcctgtggcatgattgtcccattgggcagaacgagagacagaatttgctgaaccagaagggttgtgttgtgtggatcactggtctaagtggttcaggaaaaagcacgctcgcatgtgcgctgagccgtgagttgcacattagaggccatctgacatacgtcctcgacggcgataatctcaggcatgggttggaccggg

SEQ ID NO: 29582 - DNA, 455 bp, Sorghum bicolor
  Clone ID: 9302395
caccggtagaatggtcaggtgtttgaagtccattaaagaattgccttttgtgcatcaccatatccgcttgtcattactcttgaggatcaccttacaccagatctccaagccaaagtagctaagatgctcactgaaacattcggagatctacttttcatacctagttcagacccaatgaaagagttcccctctccagcagctttgatgaaaagaataatcatctctactaaacccccacaagagtacaaggaattcctcaaagttaaggataaccaaaatggcagtggaaatatagctgatttgccagacacaggaagcctaagaagaatagattcaaatgctgataaccaaaatggcagtggaaatctagctgcagacacaggaagcctaagaagaatagattcaaatgctgatgaatctgatggaaaggatgaactggatgaacaagatgagga

SEQ ID NO: 29583 - DNA, 235 bp, Sorghum bicolor
  Clone ID: 9302397
gtcgtcgcacgagcattgactcgattctctgttaagaatgccgtgaggttctgtttctggactgccgaagagtttggcttgttgggtagtgaatactacacctcccacctcgacgccgccgaactcgcaaaaatccgactttacctgaacttcgatatgattgcctctcccaactacgcgctcatgatctatgatggagacggaagcgccttcaaccagaccggacccgctggtt

SEQ ID NO: 29584 - DNA, 555 bp, Sorghum bicolor
  Clone ID: 9302399
tccccatccattgaaggaccaattcatctccaactcatctccactccgaccgtcaacaccatcaccatggttgccatcgctcgctccttcagcgccgcccgcgtggccgcccgcggcttctccaacgctgcccgccagccccagcagagcaccctcgtcgctgcccgcagtgccttccgcaacaacgccgcccgcaacgtcatccagaagcgtggcatcgtcgccgagtccaccgctgccgccatggtcgctgccgctaagatccagggtgccggtctcgctaccatcggtcttgccggtgccggtgttggtatcggaacggttttcggtggtctcatccagggtgttgcccgcaacccctccctcaggggtcagctcttccagtacgccgttctcggtttcgccttcgctgaggccactggtcttttcgcgctcatgatgtccttcttgctcctctacgtcgcatagatgtgtgcattgcatggactgccggacatttggggtcaacggtatgggggtgccgcaaggttgaaaacttttcttgcggatgggtgt

SEQ ID NO: 29585 - DNA, 460 bp, Sorghum bicolor
  Clone ID: 9302405
gcacgaggcaccttagcaagtgagacgcgcgcgcgggcaacttgaaacaaacacgtcgtcgtcatggcacctgcggccaatggcgcggacgaccatgagctgctcattcttccacccgtccccgtgcgcgcactactacgtgcagagtccctccgcggcgtcgcacacgctcagccacccggcgtccgactccatggcgctcatcctctcccccttcccgaacctccaccacgacgcggacgcccggcgccattccagcgacggccgcgatcacgaccacgaccacgaccacgaggaggcctcgcgcctgaccctgtcccgctactcctcctcccgcggatccaacagctccttcccggtcggcgacaagaagcccggacgccggcggcaggtcctgcgggtggtgtcggggcggtcgtcaggccaccacggcgacggcggcgacgaggacgaagacggc

SEQ ID NO: 29586 - DNA, 419 bp, Sorghum bicolor
  Clone ID: 9302414
ttctcatccaatcgacactagaattattcaaacacacaaacacaagcttcatcccatatatataatataatacaacctcattagtagtagtcgtcttcagagtcttctcacacacaagctacaaagatcatcaagctcatcatcataacatggcaatggtggtgctcctcctcttgtccctgctccctctgagcaccctcggctctcgctccggcccgacgccggccgtgccgcaccacggccacgccggccatggcacccccaagcactcctcgccgcctccccaaccaaccacggcggagctagtacgcagcacctgcaactccacagcctactacgacctgtgcgtgtccgcgctgggcgccgacccgtccagcgccacggccgacgtccgcgggctctccaccatcgccgtgtcc

SEQ ID NO: 29587 - DNA, 638 bp, Sorghum bicolor
  Clone ID: 9302430
gtgcacccgccgggcccgctgctgtcgtgggcgcgcctcgccgtgcacgacgcggtggtcggcggccacctcgtcccggcgggcaccacggccatggtcaacatgtgggccatcgcgcgcgaccccgcggtgtgggcggaccccaccgcgttccggcccgagcggttcgaggaggaggacgtgagcgtgctgggcggggacctccggctcgcgccgttcggcgccgggcggcgcgtgtgccccggcaagacgctggcgctcgccaccgtccacctctggctcgcgcagctgctgcaccgcttccagtgggcgccggcagacggcggcgtcgacctggcggagcgcctcggcatgtcgctggagatggagaagccgctcgtgtgcaagcccacgccgaggtggtgatccctgaaagcacaaccgagttccaatgcatgatcatgttactattactagcgtttcattacgccgcataatttgtttcttctgagtcgagtggatcggtgttcaatctgcataagtggttttgtctatgttattgtttctgtttgtgattgatgggattaggtgaagagtgttcacagtgctccatttgttaggagtaccagaaatagtgaaaaacgcctgatgagaaacta

SEQ ID NO: 29588 - DNA, 197 bp, Sorghum bicolor
  Clone ID: 9302431
ttaatcgaggggtagcttctccaccatgcatatccatggacatcaccaaaataacccagattcttggtatcaagccaatttcattttgagatggagtcagaagtacactttatgcagaagccagtacatgacacttcctcaacagtgtgcttgagttcatagggagttgcttgcattcaaatatgaaagtgtgacag

SEQ ID NO: 29589 - DNA, 598 bp, Sorghum bicolor
  Clone ID: 9302432
cggggtgcgtgccggaggcgctggggttcctccccagcatcgaggtgctggacctgagctacaacgcgctgtcgggccacgtccccgggacgctgtcgtgcctgtccgggatcgaggtgctcaacctcgcgcacaaccagctgaccggcgagctcccggacctgctgtgcgacctgcggcggatcaccaacctgtccgtgtccttcaacttcttctccgggatcagccagcggtgcgaccggcagctcgggagccgcggcgtgtttgacttcgtggggaactgcgtgccggggagggacatgcagcggccgcagcccgagtgcgacgagttcccgggggaaggaggactcagctgcctccacatccccggggcgcgcccagccgggtgcgacggcggcggcggcggcggcgtgactattggcgtcggcgttggagttggtgttggcgggctgccgttcggcctgcctggcgccgccgccggaggcgtggtcaccgtcaccgtgccgtgatctgccgccgggggcggggccggccaccttgcacctcgatctttctttgggtttcgtttcttccttttgcttcgggaggcaatttatta

SEQ ID NO: 29590 - DNA, 606 bp, Sorghum bicolor
  unsure (1)..(606): unsure at all n locations
  Clone ID: 9302433
tccttcagcgtcggcaaggtccagcggttcgcgctgggggaagggctggacgggtcgggcgtggagaccagcttcctcaactgcaactcctccgtcgacatggtgatcgacaactactccaaggtcttcacgctgcgcgtcgccccgccgcagctcgacatgtccttcggccgattcgtcttcgccatctcacagggagacggctggtcacacgacgtcgggccacgcggcacttcgacggtgaggctcttcgtggcggcgcaggacaagcccatgtacgcggcgggacgcggcatgcaggacctgctggactccagccacggcctgccactcaccatcacggtcaaagcgcggtcccggtaccgagtggtggggagcctggtccggctgacgtaccgccacgactcccagtgcgtcgtgctcctcagaaggacgcccagcaggagcaacggcattagcgtcgctgccggcaaggccacgaccacctgctctgccttaagctagagtgcccgaaagacgccggtgtctcttctgcggttctgccgatgtatccggaatttttagacgtgcctnttttacacggggtgggcttaatacagaaggcta

SEQ ID NO: 29591 - DNA, 594 bp, Sorghum bicolor
  Clone ID: 9302439
cacggccgacgtccgcgggctctccaccatcgccgtgtccgcggcggccgccaacgcctcgggcggcgccgccacggccacggcgctcgccaacggcaacggcaccgccacgtcgtccaacgcgcaggcggcggccccggcggccaccgccgccacggcgctgcttcgcacgtgtgccgccaagtacgggcaggcccgggacgcgctggccgccgccggtgactccatcgcgcagcaggactacgacttcgcgtccgtgcacgtgagcgccgccgccgagtacccgcaggtgtgcaaggcgctgttccggcggcagaagcccgccggcgggcagtacccgacggagctggcggcgagggaggaggcgctcaggcagctctgctccgtcgcgctcgacatcatcgcgctcgcttccaacaccagcagctagcttgtctcgatcatggccggtctcgagagatctccattactggctctcccatatatgcatgcatccatctttggacgaagtgtgatctgctgatcgatggatcggatcttgacgccgatcgacgtacgccgtcgatcgtatgcgtgtagtctctactctctagt

SEQ ID NO: 29592 - DNA, 620 bp, Sorghum bicolor
  Clone ID: 9302450
gcgcctgatggtgttcacgaccaaccacccggagcgcctggaccgggcgctgctccgcccgggccgcatggacaaaaagattgagctcggctactgcacgccacccgcgctgcgcgtgctcgccaagaactacctcggcgtcggcgacgagggctgcgaggacgccgatgaggaccccgacaccgtgaacaccctcatggccgaggccgagggcctgctcgcccccgacgaggtacaaatcacgcccgccgacatcgccgaggtgttcatgggctgtgacggcgctggtgccgccgccgggctgaggaagcttgtgggcgagctgcaccggaggcgggatgctgccgcggccacggccgtagtagcaccgggtgaggagacgccggagtgaaagccagccagggatcctacgtggcgcgcaaccatgcatggctgcctagtcagcttccattactttgacgccttgacggtggtttgtttatgagtcgtgacggtgcccctctattgtagtacgcatggagtttgccttttttttttcgtttctgtattgtaactttgtaagtacgtatggagcccggagttattattattaggaaaataatggacgttgattaccccca

SEQ ID NO: 29593 - DNA, 722 bp, Sorghum bicolor
  unsure (1)..(722): unsure at all n locations
  Clone ID: 9302455
gcagaagatcgtgctgaaaacatacgcagagtaggggaagtagcanagctattcgcagatgctggcctgatctgcattgctagcttgatatcaccttacagaagtgatcgaagtgcatgtcgcagtttactaccaaagtcttcgtttatagaggtcttcctaaacgctccactggaagtatgcgaagcgagagatccaaaaggcctgtacaagcttgcacgtgctggcagaatcaaaggttttactggcattgatgatccttacgaagcaccatccgattgtgagattgtgatccattgtaaagttggggactgcccttcacctaaatcaatggctgatcaagttgtgtcatatcttgagacgaatggtttcctccatgactagacatggatgtatatgcaacgcaacacatcttgtatatagcagcaattggggtggcactgccaatgttacctatctgagtacccgacgaatgctaatgaattatctagtttcttaagtcagattgataatttggttcatcagttatcaagaacttgtttgtactgtggtcttagattgcacacatgtacagggtgatgtgttgctgacttgctgcttgtgatgcaatgcaaattgtggactgtggaggatgatttgtttccagctgctggcagtgtaatatgatggttgggtcgtgttgctttttaacacgaaacaagataggctatgttcaaagaaag

SEQ ID NO: 29594 - DNA, 703 bp, Sorghum bicolor
  unsure (1)..(703): unsure at all n locations
  Clone ID: 9302495
taccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagcccaagtccaaatccactaaatccaagaccaagtcatcatcatcatcaaagtcaaagaagagctcttcctcctccaagaaggagaagaaggagaagaagcctcaacagcttattgaatatcgcccccagagcaaggacggcaatgaacccaacgaaggccaagtggtgctttacaagccccgtgctgatgtcttcctcagcttcgttgacaagggccctgaaagcgagaagggtgtcagcttgaaccgtgttctcaagcgcttccaccgagagcgtgaggccaacggcagtgagctgggcaagggcaaggaagagaaggagctttggagatcactccgactccgacagaatgaccaaggcgagatcgtctgttntncgtcgagtaagcgccaaccgagccgggcaa

SEQ ID NO: 29595 - DNA, 110 bp, Sorghum bicolor
  Clone ID: 9302496
tataggtcatcaataaatcatcattatggaaataaacacattgaacatccagtttcattgggattttgtggataagcacgagagtccagatgtggtattagcagaagagt

SEQ ID NO: 29596 - DNA, 466 bp, Sorghum bicolor
  Clone ID: 9302515
ctaccgattttgcctcgttccgtagagccgtgggaaccatcagcgatgctccaggacaggacaacagcaactgcattcttttcgctggtggcaagaaagtcgcctcggacggcaacgaccccttcacaggctaccatccagcctggcgcaaagcctcctttggcattgttaccgtccgtgtcattccgcacaacatcactgacgcggaacgttctgccgttgagaaagacatgctttccaagacctcggctatggaagcttttgcccctggcacgggagcatacatgaatgaggctgatcgattggatccgaactacctagaaaatttctacggggctaactacggcgatcatttgaagactaagaagaagtatgacccagacaacttgttttactgcgggacttgtgtgggggccgaggagtgggttgagcgtaaagatgggcctctgtgtaagaaagcgtgaag

SEQ ID NO: 29597 - DNA, 669 bp, Sorghum bicolor
  Clone ID: 9302516
atccccaactccatcgagggcctcgtatcgctgcggggcgtcggacccaagatggcctatctctgcatgtctgtagcatggggtaaacatctggggattggtgttgatgtgcacgtacatcgtatcacaaatctttggggttggcacaaaacgaagaacccagaggagacacgaacaacacttcagtcatggctcccacaagatcgatggcatgagatcaatcatcttcttgtggggttgggacagtcggtatgtcttcctgtcggtcgcaagtgcggtgaatgtgatcttggccttgaaggactatgcaaagctgccgatcgagcaaaagtgtctgccggacgtcggctcaaagccgaaaaagttgaatcggaggctcagagcgatacactggtcaaaaaggaggtttcacagaacattgtaatcaaagaagagggtggtgcatgatgggttcccaggttctcacgacagacgattaaccccatcagcggccccgcccccggcaccaaccaccccataataatccccaggatcgagttgcctggagtcgctggcagaagtcgatttgaccacgtgtatgagcgcctatgaaggttggcgttgagaactgacagaaaagactgctccccagacgcattaatacccattgataccctattttacaaagac

SEQ ID NO: 29598 - DNA, 633 bp, Sorghum bicolor
  Clone ID: 9302523
ttttgctggagccgccgccgccgcgacgttaacgacaccggcggctttggctacccctgcgccgactgcatcgccggggccttcctcgaggtggagagagcgtgcccgtaccgcagggaaggcttcttttccaatcgaaactgcactcttgaacttgccgagatcagcatcttcgggactggtggcatgttcgggaacatactgaaacaagtcatggctccgggattggtacttcaagcaattggatttggttggcttttcttcttgctatttcaggaatggcgcagccggaaaagaggcacttcgatgaattccacccctcttttatctggagattaaaatgttggcaacacaattttgagctccagcctttactaaggcatatacaacagtaaatggatgcatgaagggatcggattttctctcaggggaatgaatacttcctctccacattgtaggacttcaatttgatcgtttcaaacccgctccaatgttcatttcacctacgctgatgttttccctatagaatttcatccccacttgtccttatatcaaaatatatatgtatgtgaatacaaaaccccaaacttgccacgattgagcaatactcatgaatcatcgtatgagtaagaa

SEQ ID NO: 29599 - DNA, 688 bp, Sorghum bicolor
  Clone ID: 9302525
catcacaaaagaagagttctgcagcaaccattggtcgattcaatcacaaagaatctctgtttaggtggacgggttttcatacaatcagatgtactggaagtagctgtagacatgagagaaaggtttgatgggtactctgatattttggcacatgttaattatgtcgatcaagatcttcagtgtgaccatgaaggatggcttctggacaacccaatgggaatccggacagagcgagaaatccatgcagagcttgaaggagcaaccatatacaggaggatgtaccaaaaaattagagatgcttcttactaactgttcatcagctgcagaagttgtccaggcagtaaggttttcaagaatgtgcattgcatgtatttcattaagagaagttgggaaaaaacaaagcgtccaagtacaaagcctgccaaaccaaaacaaagagaagtccaagcagtgacacctgatgtcttcctgcttgaatcatgcatcacaagttgccttcactacatagagctgcattacattttctgatagtgcactgtgcacatctcatcttttttttcacctgatgcaataagttagccaatgccttgatgaagatgactactgacaaggctgttcatttgttacgtcaaaccatacctatgatgtttagtgtctgctggggtattttattctgtccaggattcag

SEQ ID NO: 29600 - DNA, 621 bp, Sorghum bicolor
  Clone ID: 9302533
tgcgaaccaaaagttcgaggttggtgtcttctgcgggaaatacgtcactccggttgacgctggctacttcgagcatctcgagagaatacgtggggaaagccgcaaacagaaggtcatggagaaggcacgcgaagctgtcgtacatggcacagccaatccccagcaggtgcgcatggctgccaaaggtgttgaggttgaccaacatggcaacgttattccatcggatgggaatggtgaacccgattggcagccgaccaacggtgtcagccagacttccacgagtgacgccctggctaacggtaacggggaagagcgacgcgttaccagtagccaggacatcagcttacacaacatgaacgatttcaattgagcagccgctcaagggtatgagcgcatgcttatgccgctataagtacatacggaattttgttttgtgctatagacgatgatgatacacacgtaccattgaaaagttacgaaagacacgaccaggatacagcagaggattgctatggcgcaggggaggactttgtgatctcacaggattttccgatatagactttgagccggtggcctcaaagctggatctatgccgagatggagcatgcgctgttgcttatg

SEQ ID NO: 29601 - DNA, 653 bp, Sorghum bicolor
  unsure (1)..(653): unsure at all n locations
  Clone ID: 9302536
tcgcgcactgctcccgcttcaccaacaggctctacagctacggcggcaccagctcgcggacggacccgacgttcaaccccgactacgccggtcagctcaagggggcgtgccctgtcaatgtcggcccgaccatcgccgtcaacatggaccctgtcagccccatcaaattcgacaacatctacttcatcaacttgcagtacgggctggggctcttcacctccgaccaggtgctctacaccgacgagacgacgagacccatcgtcgacaagttcgccgccagccagaaggagttctttgatgctttcgtcgccgccatgatcaagctggggaggttaggggtgaagacagggaaggatggagagatcagaagagtctgcactgccttcaaccattagagggagggcatgcatgcagcagcgtttgtaattcagattatctcaatgctgtttggagttgatcgagatgcgtatactgagattgattcttttttctcttcttttgcatacagttgccaaagtttgaaggtgttcattttctctgtttgtttcttcctttttcttttctttttaaactttttttgtgcttattgattttttggtgcatttttgtacagactaaagagtgtaataccatgaacaacttgatntttttaa

SEQ ID NO: 29602 - DNA, 605 bp, Sorghum bicolor
  Clone ID: 9302543
ggggaagggcgtgaagctgcacgccatcgtggactcctgccacagcggcaccatcctcgacctcccctacctctgccgcatgtccagaactgggtactggcagtgggagaatcactcccggccttcgggcatgttggcgaagcgcaccaacggaggcctggccatctccatcagcggctgcagcgacgaccagaagtccgccgacgccagcggattttctgacgagtcgtcttcgatcggcgccatgacggacagcttcatcaaggccgtgaaggccgagccggggacgacgtacgggcggctgctgagcgcgatgaggacgaggatccgcgacggccaggggagccgccgcctccccggcaggctcggctccttcgtccgctggatgatcccgtccagcggcgtgcaggagcctcagctgtgctcttcggagatgtttgacatctacaggaagccattcctgctctgatttggtcgtcatctcgtcggctgctaattcgaagttgatccgaagaatgtcattgttgtctgctgtgtaccggtgtgtccgtgtgtaactctgtcagttcaagcctgtgcatatctggcatgatgtgagtactttt

SEQ ID NO: 29603 - DNA, 642 bp, Sorghum bicolor
  Clone ID: 9302567
tggggatgttccagttccagagccccgttggcgttgggtacgccggcgtgacggcgacggccaccaccggcacaggggggctgccgtggagcccactgcctccgcccctgctcctgtcgtcgtctccccacgacacgtttttcatcggcgacgacttccccgccacggccgcggacgagacgcgttcgcacgcgcacttgttcggcggcgacatcatggggctgggcagcatctcggagcacgagctgaaatgggacagcttcccaaatacattctcgagtggtgccgacacgtggaacacggcggcggtggcggcgagcccgacgatgctgtgccggcaggccagcgacggcatcgaggacctggcggccatcttcttcccggacgacaacaggatcgtcttctgatgtcaacggagcagtgctctgtctgcagcacctggttttcagttgcatgctcctgaagatgtgtggcatgcatgtgaagcgactgtgggaaataatcaaggctctcgatcagtgacctgctctctcttagaactggcggtatatttttcagccaacgaaggggagatactagcatatatatacatagtatatgtctacattctgagttttacaagctggtaattaaggttaagat

SEQ ID NO: 29604 - DNA, 600 bp, Sorghum bicolor
  Clone ID: 9302571
gaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgtgctgcttccacagtttccatggggttaattagctgaaatgcaagagtgattaggcgtaagtaagcttgcagatttctgctaatggtgatggatttggtctcgccgcgcgcgcgtgatctttgtatgcacgtcacatcaccaaccgctgctggctgccttttggttgtgtagtgtttttgcacggtttttt

SEQ ID NO: 29605 - DNA, 167 bp, Sorghum bicolor
  Clone ID: 9302580
gcggcggcgtccggcgcgagatggcccggaagacgctccgcgccatgcggggcgacctcgacgacgaggacggcggcggcgagtacaatgacttgacgggcaacaggtgccaaatatctgttcactaggaatgctatggtgcatgagctgtacaagatcttacaaca

SEQ ID NO: 29606 - DNA, 603 bp, Sorghum bicolor
  Clone ID: 9302581
gcggcggcggaggtgcccgacttccagcgcgcgttcgagcacttctgcatccactcgggcgggaaggcggtgatcgactcggtggcgcggctgatggggttcgggccgtacgtggtggagccggcgaggtcgacgctgcaccggttcggcaacacgtccagcagcctggtgttctacgagctggcctacttcgaggccaagcgccgggtgcgcgccggcgaccgcctgtggatgctggcgttcgggaccgggttcaaggcgtgcagcaacgtgtggcgcgcgctgcgcgacgccgcgcccgacgccgacaacccgtggaacggatgcgtccaccgctacccggtgccgccgccgccgccgtccaagacgcacaagcatgcttgatgtacgtattatattatttataacatcatcattagcgacgcatctcgtgcttgcgtctgcgtcagtcgtttgagaagcaaaacatttcagttgtttggtatgcttggatgcatgatgatcgcctgtctcattagctccatccaagacctatgtatgcattgtttgatgaggcatatctatttgtgtgtcaatgatatatatcatactataaaaggcaac

SEQ ID NO: 29607 - DNA, 497 bp, Sorghum bicolor
  unsure (1)..(497): unsure at all n locations
  Clone ID: 9302591
tccgcgcgcactgccgctgctggccggctgcggcgcgcgcgtgtcgcggagagggccgctagctagcgtagtacttagtggcggtgaccagtgccgccggccgccggggcgcgggttgtgttggaatggcggcggcgccgtggcgttcggcatcggcgtgggcggtgcttgtggcggtggcggtggcgggagtagtgacgacgatggcgaaggagtgcacgaacatcccgacggagctgtcgtcgcacacggtgcgggcgcggctgcaggcgtcgccgggagcggcggagtggcggtggcgcgagctgttccacgagcacctcaacccaaccgacgaggccgcgtggatggacctcatgccgccgccgccgcggggaggcctccagaccgccgccgccgccgacgcggggcaccaccaccaccaggaggaggaggagctcgactgggtgatgctctaccgctcgctcaagggccancaggtggtggtgggcggcgcc

SEQ ID NO: 29608 - DNA, 549 bp, Sorghum bicolor
  Clone ID: 9302596
gcacgagggcccattctgcaaaacgcctaattatgctgtggagtatcgtggtgtgaaaacaaaggaggaaaggagcatagaacagtttgaagaacagaaagtcatagaagcacagttgaggatgcgccaaaaagaactccaagatgaagaagctaaaatgaaaagaaaacagagcaggtgttcttctagcagaacagtaaccccaacaacggaagttgagtatcgagatatttgcagcacatccttttcagtgccatcatatcaatgtactgagcaaggaaatgaatgctgttcatctgaaccttcatgctctagccaggctaacatgcggcctttccattctaggcacaaccgtgatgataatgttgacgtgaatctggaggatatgatggttatggaagcaatttggcgttccattcaggaacaaggacatctagtaaatcctgtttgtggcagctactttcctgtaatcgagccaccatcacgtgaaaggcaggcgtttcttccagctgcgcctctagaaatgcctcatccaggtggatactcttg

SEQ ID NO: 29609 - DNA, 476 bp, Sorghum bicolor
  Clone ID: 9302602
ccgggccggagccgatcgagctcatcatctcgcctcaccacactcacacgacgacgacgatgatgccccggaccagcctcgacctcggcctcagcctgggcctcagcctcacctcccagggcagcctctcatcctccaccaccaccgccggatcctcctcgccctgggccgccgcgctcagctccgtcgtcgccgacgtcgccaaggcacgcgacgccggcgcgcacatgctgtaccacgcctccgcctccgccgcggcgctggaccgtgccgcgatgcgggcctccacgtcgcccgacagcgccgccgcgctctccagcggcggcagtggggacaacaccaccggcaccaagagggagagggagacggagctcgagcgcaccggctccggtggcgtccgtagtgatgaggaggacggcgtggacggcgccggcggacgcaagaagctcaggctctccaaggaccaggccgccgtc

SEQ ID NO: 29610 - DNA, 278 bp, Sorghum bicolor
  Clone ID: 9302605
tccgaagagtctgttaccactctggaagctgaccatagtgatgttcaacaaactgcagaagatcatgactcgtgtctcattgatgatgctcaaaatggtatccaaatcattgggtgcaaatcagtggacacttgcaaagaatttgatactatgaaagaaactgctcagagtgatacttctgcaaatgtcagtgctgatgctgaagaaactgtagaagatggtggttctgtttgtgtcactgatgatgctcaaaatggtttgaagttttccaagtgcaa

SEQ ID NO: 29611 - DNA, 585 bp, Sorghum bicolor
  Clone ID: 9302620
gaccgccaggctctctctccgtcgcacgctcacgccaagccccctgccaaaatacgcgccaagccccagctgctcgccgtcgcgtacaactccacgcacacgcgcatccaccggttctctacaaattgaagccatcgcaagtcgccgagatccaccggttctctacaaattgaagccatcgcaagtcgccgagatccaccggttctctacaaattgaagccaccgcaagtcgccgagaagcaagtctgcgccagcaagtcaccggttcctgctgcgacatcgaagacgctcacgtccaatcgaagacgctcacgtccataatccaacaacatcttcaagttcaagctctgaatcatgtcgtccacgccggttgtcacgtttctaggtgagcaatcaatctagatgtgataatagattcatatgaattttatgccaagagttccttgttctttcgatctacaatcatgagaaggccagcaacttgatgacatcggaaccctcgccgcgcgaggtcgttgtcaagttgttgatgaagtcgagcaatgaaaaatcaagacgcaatttcaactcgtcacgatggcggtg

SEQ ID NO: 29612 - DNA, 566 bp, Sorghum bicolor
  Clone ID: 9302651
gcacgagggagagagagagagaacttgctggtcatattacaggtcgagaagctcgaggcggagctccggcgcgtcggcgaggagaacaggcggctgagcgagatgctgcgggcggtggtggccaagtacacggagctgaagggccaggtcgacgacatggtggtggccaccgccaaccacactgggtcctccacgtcggagggcggctccgcggcctcgccgtccaggaagcggatccggagcgccggcgacaacagcctcgacaccgccgcccaacaccaccacagacgcaagccgtcgccgccgttggcggctgccgtcgcggcacacgaccagacggagtgcacgtcggccgccgtcagcgtcaccgccgccgccttccggcgcgccgtgcgggaggagtgccggcccaaggtgtcccggcgatacgtccacgccgaccccgctgacctcagcctcgtaagtaacgggatcggccgggatgccgtaattaaccatcgcttttttttttgcgcgccgaatttacggtcaattaactctcgtgctgcttttttaaacaaaaacaa

SEQ ID NO: 29613 - DNA, 658 bp, Sorghum bicolor
  unsure (1)..(658): unsure at all n locations
  Clone ID: 9302664
cttcgccctcctcgaaatgtcgccttcacgccacaacgtccctcccatcgtcccgcgctcgataacactcctggagggaaacccaagcattgcgctacacccgttataaaattccggattatacccaccgagagcgagatcactcctctctgtggaataaccggggcgtgtagagggcgacctggactcggaatctcgcagttctactggagttccggggcgacctggcagttctactggaggtcctgggcgcccgtcagcgagactcggtcaatctccctcgaggttgcgttgttggaagtgctgtgcaggtgagtcttgagttcgtctactaaccttgcgctatggcgtgcatcgccctcaacgaaacaacagctgtcgtcgagtggcagtgggagggtgtcacgcgtaacttagcgaccgccgatcccgatcacgacgcgatacgattcaccttgcgactcgactgtgagagtcaatccggcgcgcacttcgaactcagcatccctttcagattcaaggacaagccagctggggcaggcgtacgtctccggatcaatcccttcttcatcaagtccttctcttattctgacgtgccgagcccgcccgatgccgtanaaccgatattcaacacgactacatcccttgacttcactct

SEQ ID NO: 29614 - DNA, 465 bp, Sorghum bicolor
  Clone ID: 9302670
gcttggcgttggcggtgcgcgagacgaagcagcagctgtaccttgccgggccgctcgtcgtcgggttcctcctgcagaacctggtccagatggtctccgtcatgttcgtcggccacctcggcgagctcgcgctggccagcgcgtccctggccacctccttcgccggcgtcacgggcttcagcttgctggctggcatggcgtgcagccttgacacgctgtgcggccaagcgttcggagcgaagcagtactaccagctgagcgtgtacaagcagcgagccatggtggtgctcactctggtgagcataccggtgtcggtagtctgggcctacaccggcgagatcctcgcctggtgcgggcaggacccggagatcgcggcggcggcagggatctacatccggtggctgatcccggcgctgttcctgttcggggcgctgcagtgccacgtccggttcctgcagacgcaga

SEQ ID NO: 29615 - DNA, 590 bp, Sorghum bicolor
  Clone ID: 9302672
cacgaaacaaggctcgcgccggctgcttggctgcagacacaccacgccaccagtccatcgccggcactccggaagcacgcccttctttgttcctccgactcccactcggcggcggcgacgacgacgacgggaggagcggcggatcgagcgaatcgatctgtgcgtgcgtggctgtcgcgcgcgtcgatctctgccgggcagggcaggtcagggcgggcggcatggggaggtccccgtgctgcgagcaggcgcacaccaacaagggcgcgtggaccaaggaggaggaccagcgcctcatcgcctacatcaaggcccacggcgagggctgctggagatcgctcccaaaagccgcagggctgctgcggtgcgggaagagctgccggctgcggtggatcaactacctccgcccggacctcaagcgcggcaacttcaccgaggaggaagacgagctcatcatcaagttccacgagctcttcggcaacaagtggtcgctcatcgccgggagactgccgggcaggacggacaacgagatcaagaactactggaacacgcacatcaagcggaagctcctggctcggggcacggacccg

SEQ ID NO: 29616 - DNA, 292 bp, Sorghum bicolor
  Clone ID: 9302675
gcacgaggacgagctcaagcttcggtcagatgcgcgtgaaggcgcccagccaaaccatgaggaatgggtcgtcgacgaacagtgccgccgaacctactacgcagtctacatcttcttcggtctgctcactctgacctacaaccacacgcctgccatgggcttcaatgagttcgacaccctgaagctgccgtcctccgaatcgctctggactatggaggtctcggacgatgatgcctggcgtgaaagcctgagctcgtccaagattatcactttccgacaggcccacgacaat

SEQ ID NO: 29617 - DNA, 536 bp, Sorghum bicolor
  Clone ID: 9302676
cagccgcggtaattccagctccaatagcgtatatttaagttgttgcagttaaaaagctcgtagttggaccttgggccgggtcggccggtccgcctcacggcgagaaccgacctactcgacccttctgccggcgatgcgctcctggccttaattggccgggtcgtgcctccggcgccgttactttgaagaaattagagtgctcaaagcaagccatcactcctgtcgccaccccaggcatagcacacaacgctgcaacggggccggagccagcgccgggtccgccacggttccccgccatcgtcggtgcgagcacgaaccaaacgccgtcggcagcggccagtttcgcgccacccgccccggcgcccgcggaagcagacgcgccgccgccggactgcccatcctacttccggtggatccacgaggacctgcggccgtggcgcgccgcgggggtcacgcgcggcgcgttggagggcgcgcgccggctattcgcgcccaagttccgcgtcaccgtggtcgcgggccgcctgtacgtggcg

SEQ ID NO: 29618 - DNA, 354 bp, Sorghum bicolor
  Clone ID: 9302692
gcacgagggagcggcggaggcgcccgtgacatctgcgcccaggtgctcgagcgcctcgtcgccgacggccacgccgaggcgtccgaccccgacttccgcgacaggctcgccgcccatttcggccggctcccgcacagctatcagctggatatcaatgttgacaaagcagccgatgtcttggtccaccagaacgtcttagcggaagcaaaggatcctgataggcgccctgcattctatgtccgttgcttgaggattgaagatatggatccagcatatgactccgatgcatctgacgaaggggatgatgatggtgacgatctctctgtaaggcaggacacgccatatactcacatt

SEQ ID NO: 29619 - DNA, 591 bp, Sorghum bicolor
  Clone ID: 9302709
gcacgaggctgctttgctcaactaccattcacaaatgatgacttcggctgaaggagcaagcaacactatgaatccaacaccaacctcatccgatgcgcaacccgctccctggtatgatctcgtttgtgttggtttcggagctgcacaattagccacggctattgcgaacagcgaatctcggacaccatccaaagtcttgttcattgagaaaaagccatcgtttacgtggggctcgagctccaacctttcaaggacgcggatggagacaccgttcatgtacgacttggcaacactccggaatccgacgacagcctttagttatgtgaattacctactcaatcgcaagcgccttatcgagtttgcaaactcagatcgtctcaatcctctgagggaggaatttgcggactatatgagatggtgtgccgaacatttcaaggacgacgttcgttatggaaacgaagttattggggtagccccagagaccaaaggagatgttgtgcagggttggaagttggccatcaaggacaacactgggaaaacatgggtgttgcggacaagaagtctcgtggcaccgtcgccatcaagagccag

SEQ ID NO: 29620 - DNA, 581 bp, Sorghum bicolor
  unsure (1)..(581): unsure at all n locations
  Clone ID: 9302717
gcgaacgaggccagggacgcattccagcgcgtcatgagccagggaatgcggaggcccatccactccatccagggactggtgtccgtggtgcaggaggagggcctgacgtctgagcagaagctcgtcgtcgatactatggcacggaccgcaaccgtcgtctcaacgctcatcaacgatgtcatggagatgtccgccgccaaccaggagcgctttccgttggagacgaggccattccacctgcactccatgatcagggatgccgcctgcgttgcacggtgtctctgtgacttcagggggtttggattcgcggtgcatgtcgagaatgtgctgccggaccttgtcattggcgacgagcggaggattttccatgtcttgttgcacatggttggcaatctgattggtcgaatcgatgtgggaaatgtcacgttccgggttcgtgctgatgatgaggcgatggaggaccanaggtggaatccgtggaggccaagctactccggtgggcactcatcggtcaagtttgtgattggggtgaagaggcagcagaatgctgactcgccaagctcgcttgcacagttcttgcg

SEQ ID NO: 29621 - DNA, 612 bp, Sorghum bicolor
  Clone ID: 9302740
cacagatggttgtccttccgagtaaggaggttgatcctaggcgcttggttagaaaaactcacaaaggagagttccaagttgaattcgaagaaccagatggtttctcagtggaggttgaacttgggagtaatcttactaatattccttcaaaagctgttgaagatcagaccaagtctaatggaacagatcgtaaagaagatgttcaagaaaaagacaaagcatctgatagcacttcacaagatgaggatggcagaacatgcaacaatgatatgccaggtgatgtagaatatattgataatgagaaagctgatctcatgcaggaacttattttggatgacatgaaggacaccgtaaatctcccacctattccttcgttagatgaattcatgcagggcctagattctgagccaccttttgttgatctctcagttgagactcctcaagaagatgtcaatgactctgaggaacctgacaccaccatggagcctgaggatcttccagagacagaagataatgcatctgcaccagagaaaactgaatctgaatctgataagtcatctgcacaggttaacagtgagcccaagttagagtcaccagtacatacagcagttc

SEQ ID NO: 29622 - DNA, 451 bp, Sorghum bicolor
  Clone ID: 9302747
gcacgaggcatgattgggggctacacctctcctgccgctgtgaccaccgatctcatccagcagtacctggatgagaacaagcagctgatcctggccatcctcgacaaccagaacaatggaaaggtggaggagtgcgaacggcaccaagctaagctccagcacaacctcatgtacctggcggccatcgctgacagccagccaccacagactgcaccactatcacagtacccgtccaacctgatgatgcagccaggccctcggtacatgccaccgcagtccgggcagatgatgagcccgcagtcgctaatggcggcgcggtcctccatgatgtacgcgcacccgtccatgtcgccactccagcagcagcaggcagcgcacggccagctgggcatggcttcagggggcggcggtggcacgaccagtgggttcagcatcctccacggcgaggcca

SEQ ID NO: 29623 - DNA, 366 bp, Sorghum bicolor
  Clone ID: 9302755
accaccaccgccaccaccagcagcagcaccaggctccgcagcagcaggacgtcatctccaactcgccggaggccgcctgcacgagccgtagcagcgacgacgagccgcggtcctccacgccgacaccgccgccgccgccaaggcgccacctggacatcgacctcaacctgtccatcagtctgtctgcttaccagccgccggaggaggaaagcggcagcatcaagtcgccactgatgatgatgatgatgaagcaggaggaggagacagcggcggcatcggcggcgggcggcaccaatgcggcggcggcggtgtgcctgtgcctcaacagcctcgggtaccggccgggcgtcgagtgcgcatgcggcg

SEQ ID NO: 29624 - DNA, 667 bp, Sorghum bicolor
  Clone ID: 9302767
ggcgtgccggggcagatcgacgtgccgcgatggtcgaaggagatcggctccggcgtctcctcagtccggccgcggtgaaggacggtgtcggcgctcgggcgccggctcgacatccatcgccatggggccggcccagttagaaggaccggcaacgtccggcgcaggaggtgatgggagcgcgcgacgcggacagggaccgtggccatgttcgtcgcagtaaagcggcaaccatggcggacacggccccggtccgtgctcggggcactcattcgccggagggggcgcaggggccacagcagcatcgccggcgcgacgacgacgtccaccacgtccaccgacccgcatccggagcccccgacgccttccccggcgttcaccggcccggcgttcgccgagaaggtagcggaaagtgtcgaggagttcgtcgcggatgtagtggtggtcgtgcgggatccgcatgtcgacggcgcggtggagaatcatgtagacaagatcgacgaagagcatcgccggaggtatgtagcgaaacatcggcatggtaccttccgatgggagtttcttcgcgaactcgccggcgttctcgtcggcttcttcttccttgactccctctcgagagcacagggactcgagcaagtgctgataacgtgttcgcgttggaatgtaaatg

SEQ ID NO: 29625 - DNA, 667 bp, Sorghum bicolor
  unsure (1)..(667): unsure at all n locations
  Clone ID: 9302768
gaacgtagcagtggtcggttctggcgagaagacggtggaagtagtggacgacctgttatcgtgccctcgcntgggcaacatcacagtggtgacggaggatgattcgtttgcttcactgaagattctggacgatgcaaagctcccacaggctcaattgtgctcgatctggacgaagccaacaagctgccagataccacctgttatcgaagcaccagaagccatccagccgatttacatgcgagcatatgagaagcaagtccagtccaaaggcgagttcaggctgcatgtcattatcggaaaagatgcctctgctgcctgctcgcgttccgatttgatcatcagggacacggcaacaagtccttttccgaacagtgcactgttccagagcatagattcaatcatactaggatgccggcctaagggagaaagcctagaagaggtgcagtttaagcgtggcgctattgcaccgggatgccggctctggctggtgtcttcaaagtctgacggtggccggaccttggccaaggatgtttcattaatggctggagaaattgtgcgtcaggcgtccgcagggtccaaggaggtaggggatggagctgcatcacagatgcaggtgcaagcaaggatgtagagacggcatggatagcctcgtctaaaacggtgtagc

SEQ ID NO: 29626 - DNA, 116 bp, Sorghum bicolor
  Clone ID: 9302786
gactgcttcagagtcagccgctcggattttccggtcaatccatatggagaggaagcagaatgattcgtagctggttcgtgtcatttgatgacagcttgatgcagtttccagggctc

SEQ ID NO: 29627 - DNA, 173 bp, Sorghum bicolor
  Clone ID: 9302792
gagatcgagcggctacgccaagtgtcctagcagcagcagatcaaggtggccaccaccggcggcgccgacatcgccgcggccgcctccatgcaggccaggcaagagctgctcgcctgcgaaggcgccgccattcgatagcggaggcgttcatgggcagaaccagcgcccaattt

SEQ ID NO: 29628 - DNA, 180 bp, Sorghum bicolor
  Clone ID: 9302809
agctgtgttggaaggagggttcatcggagagtggccgcctacatatcttgcagactatcgatgcatatatttcagatgagagagtaggattagctgagcctgcagaaggaatagagctgtacctgtgcccttctcatgggaaaaccgtggaaatcctgtcacggtacttgccaaaggagc

SEQ ID NO: 29629 - DNA, 478 bp, Sorghum bicolor
  Clone ID: 9302815
tccagcagcagcaggcagcgcacggccagctgggcatggcttcagggggcggcggtggcacgaccagtgggttcagcatcctccacggcgaggccagcatgggcggtgctgctggcgcaggcaccggcaacagcatgatgaacgccggcatgttctcaggctttggccgcagcggcagtggcgccaaggagggatcgacctcgctgtctgttgacgtccgtggtggcaccagctccggcgcgcagagcggggacggcgagtacctgaaagcaggcaccgaggaagaaggcagttaagacgatgtcactagcactggcatcggctcgggaacggtatggcatagcagcaggattagcaggtagctttgaggaacgaggagggggtagtagcgtagtaatggtagcattagctagcagtatgtagtcggtaaggtagggttgttccatagaacatggaggtggtagtgaccagcaatgca

SEQ ID NO: 29630 - DNA, 529 bp, Sorghum bicolor
  Clone ID: 9302842
gcacgaggccatcttctccggagcaccctttgctttcatctctcactcgacacccaaccgtgttggccttttgacactcttgaacattccctcgactgtccgctccttcgaccacccatcatgaaccccgaatacgattacctcttcaagctcctcctcatcggagactccggtgttggaaagtcttgcttgttgctccgtttcgctgacgacacctacaccgagagctacatctccactatcggtgttgactttaaaattcgcaccatcgagctcgacggcaagactgtgaagcttcagatctgggacactgctggccaggaacgattccgtaccatcacctcgtcttactaccgtggtgcccacggcatctgcgtcgtctacgatgtcaccgacatggactccttcaacaacgtgaagcagtggcttcaggagatcgaccgctacgccaccgagggtgtgaacaagctgctcgttggcaacaagagtgatatggaggacaagaaggttgtggagtataccgtggcca

SEQ ID NO: 29631 - DNA, 434 bp, Sorghum bicolor
  Clone ID: 9302846
gcacgaggctttcttggcgcggcacgtcggtccgtggtgagcgactgagcatggcgccttcaccgccgcagcagctgagccttgcccttgcggacctcagggcactgtccgtgctcggccagggcgccaggggcgtggtcttccacgtcgtgcccgtcgccgcagcagccggggacagcaccgctgccgcaggcgctggcgagcccatggcgctcaaggccatgtcccgcgccgccgcgcggcacaagggcgcggggccaggaggtacgtgccatggcggtggcggtgacgggcaccggaggatctggttcgagcgcgacgtcctgctgtcgctccgccacccgctgctcccgtccctccgcggcgtcgtggccaccgacaccgtcgtcggcttcgccatcacccgctgccccggcggcgacctcaagtcgctc

SEQ ID NO: 29632 - DNA, 259 bp, Sorghum bicolor
  Clone ID: 9302849
gcacgaggaaaggccaattacagcgaaagcactggtcccgtcgcccccgttcctcttgacggcctcgccgtcgcctccctttcttcttcctcgacggctcctcctcacactctcactcacgcggagagcgctcgcgcgggcgcacacgcggaggtggaggttcacaggagggggagggaggggatgccggggagccagaacggggggccgaggcctcggccggtcaaagccgagaccatccacggtcttgcgcgcgccg

SEQ ID NO: 29633 - DNA, 555 bp, Sorghum bicolor
  Clone ID: 9302870
gcacgaggcaaccactcagatcagcacggagcagcagcagacatgcaaagccagtttggtcaaggttcacagcagcagcagcagcagcagcttcagcacaagaatatggctactagtttcaccccaaggactggcaagactcctgatccaaagacaatcagaaggcttgcgcagaaccgagaagctgcacgcaaaagccggctgcgaaagaaggcttacattcagcagcttgagagcagcaaactgaagcttgctcagatagaacaggatatgcagagagcacattcccagggcatctttctaggaggagctccaggtgcaaactctagctcaggcgccgcaatgttcgacgtggagtacgcccgttggctggatgaccacggccggcgcatggccgagctgcacggagctctgcatgcgcacttgccagatggtgacctcagagccatcgtggatgacaccctgacccaccacgatgagctgttccagctaaaggcgtcggcagccaagtctgacgtggtccacctcatcaccggggtgtggacgaccccggct

SEQ ID NO: 29634 - DNA, 384 bp, Sorghum bicolor
  Clone ID: 9302916
aaggagaacgtggtgatcaccgcttacgccaacagcaactaccaggccgtcaacaactcggtgctcgtcgccggcagctgcgccgtcaacgaccccggcgtgcacgtcgtcgtggtggagcacgtcgacgagatccgcgactacgatgaggacatcgacggccaggagttctaagcattgcattattaattactgcaagtgatggtttcaacgacagtattacgaacaactccgatcgatccctcagcacgtaaaatgatgttcgaaagttgttactagttgatgaggtgatcactatcactatatggatgataaaggacatatatatcatatatctatgcatgcatggcatatatatctatgtaatcccggctttcagtttcg

SEQ ID NO: 29635 - DNA, 662 bp, Sorghum bicolor
  Clone ID: 9302952
gtggtgatctacgagatggtgtacgggcgcacgccgttccgaggccggagccggcgggagacgtttcaccgcgtgctcaccgcaccgccggagctgcccggcgaagccacgccgttgcgtgacctcatcaccaggctcctcgagaaggaccctgggaagcgactaggcgcgcgcggcgtcaagcggcacgccttctttagaggcgtcgactgggatcgcgtcctcgacgtggcgcgcccgccgttcatcccgtcgcctgatggaaacgatgctaacgccggcgcggtggtggaggccgaagcgctggacgtggagaaggtcgtacatgaattgttcggctcgagtggcgccggcgagacgcggcttgtgaaggtctgcagccacggagggacagatgacgatttctccatatttttctgagttttggttagctatatttctgcaccagaggaaggtaggaaccgaggaaaacaagtttggtttatttgctaaagtgagctacccaaattggctatactcaaatggcaagattagacttgcctggctgagagagtacgtactagcattaaaccggccagaaatcacattgtgtgaaggattaaatcattgttgtatcataagttggaatcatttgaagcccatgaattgaactcacataatta

SEQ ID NO: 29636 - DNA, 321 bp, Sorghum bicolor
  Clone ID: 9302956
gagggaacggatattcacgagagacaatctcagcgatcgccagactggtccattctttgccttggcaatcactgccagcgagatttctttacctttgctccatcttcttcctaggaactgactctctagcaagaaaggcaaatggttgatcttgcttgtcgttgcaagtgacggtctggggcctacgcttccttctatccctgtttcttcattctcctcttttgctttagatggatctgcggtctgtcattgtttgcttgcttttgtgattaccgccggtgttgaacccttccttcttcccccatcccccctagtattcct

SEQ ID NO: 29637 - DNA, 289 bp, Sorghum bicolor
  Clone ID: 9302963
ttgtgatggatgcagtttgtcgcttgatatcattctattttgtttcgtgcatgagaattttgagatgctttactcctttcaaggatggcatagcaaagacggagctatgatgtaagagcagagacatctaggaaatttgacatcagaatttgtacatcaagtttttatatgagcttgatatgtgactagtcatgctgcctcagtgatttattttgaggccatgagtttttgcactttgcacaaggcaatgtggaccataaatctttggaaatttgtacagtaagttatc

SEQ ID NO: 29638 - DNA, 651 bp, Sorghum bicolor
  Clone ID: 9302966
aagatgcaaaaagaatactggtgccaggaacacatgctgatgatattggatatcaatgtggtgggtggacgatagcatggcatggagacagtggaaaaataactcctggtacgagcatattggaggccatacaagaatcagtgggagtgcaaactgaagttgtgtacgagaaatgcccaacagaaactattattgaaactggtggtttttcctatgcggttgttgttgttggagaggttccatatgctgaatggacaggagatagaactgaccttagtatcccgtttaatggctctgaccttatcacctgtgttgctagtaaaatccctaccctagtgattgttatatctggaaggccattgattatcgagtcacatgttttggaacagatagaagctctagttgctgcctggcttcctggaactgagggcatgggaattactgattgcctctttggagatcatgattttgtcggcacattgcctgtgacatggtatagatctgttgatcaattgcctataaatgctggagatgctaactatgacccgctattccctgttggatatgggctgaaaatgtttcgaagtgatgatgattcagcgtaactttattatagatttggtacatttgaatctctgtatgttaaatact

SEQ ID NO: 29639 - DNA, 187 bp, Sorghum bicolor
  Clone ID: 9302982
gcacgaggatcgtgtgggaggaaggaggggagagtcgcggccacccgccgcgggatgaagttcgggaaggatttccggaaccacctggaggatacgctgccggcgtggagggacaagtacctcgcctacaacgccctcaagaagctcatcaagaacctggtgccaccacatcccgcggcggcccctc

SEQ ID NO: 29640 - DNA, 512 bp, Sorghum bicolor
  Clone ID: 9302988
gcacgagggtgaagccggtggccaaacggttacacagcacactcaaagcagcaatgttggggatggcacgcatcaacgagtggaagccggtgatcgcgatgctagtcttcgacctcatctccgccgtgacaacagccctgatcaagaaggcgctgcaggaagggctcgaccgcctggtgctcatcacgctgcggcagcttgtggccacggtcttcctcgctccaattgcctacttcagagagcggaacacaaggcctaagctcacactagagatcctagtctacctcttcttcagtgcagcatttggcgccgcactctctcagtacaccttcttctacgggcttcagtacacgaccgcaacgttcgccataactttcaccaacgtggctcctgtgctcactttcctcattgcagtcttgctaagggtggagtcactgaacatgaagaacaaggcaggagcagcgaagatcgtcggaacgctcacgtcgttcgccggcgtcatgctcctgacc

SEQ ID NO: 29641 - DNA, 416 bp, Sorghum bicolor
  Clone ID: 9302997
gcacgaggaaggccaccaacaacaaacacaccacctagtgcgctgcactagtcgcttgcaagcaagcaatcaagcaactccgatcaaagaaacaccggccatcgccctctccgctactataccagtgatccatataatccactacaagcaagcaacgagccaaggagcaaggcagccgggtagatcgaggtcgagcgaggaccgaccagcaccaccacccgccgccgccgccgcatccaaaaatgtgcctgccgatcgactcgtggttctgctgcatgtccagcaccgtcaacgacgactaccaccatcccgctccggccccggcgaacaagcagcagcagcatggccccgcgccaccgccgccgacggccccggcggggggcaggacgacggcgcagcagctgcccgcgcacgca

SEQ ID NO: 29642 - DNA, 575 bp, Sorghum bicolor
  Clone ID: 9303005
gcacgaggctccagcgctcggcttacacaagcctctccaacatgaagctcctcggttggatgcaccggaagttacgacagaatagtaatgatgtcttcaaagagttcaacaacggtggaggtgggacctgcaactgcctcaccgggctggcctcgccggacccggccaccttcctcgcctccgccaacgaatacttcgccggcgaccacgacttcaccaacattcactcatctccgccggacaccgacctcttcacctttggtggcagcggcctcctcaccatcggcactctaggcatcaccgcggtcgcggtccctgcagacgctgacgacgacgattacgacgtcgacgtcgatgccgactccgactctgacgacaacgacgacaccgcggatgagggagacaaggtcgacagcgccgtcacgcccacattcacatacacagcgccgcctacggcactggcagaggccgccgaggtcgtcgagaaggctgcagtcgccgtggtcgaggccatcgccgagaaggacgacgacaccaccacggaggacgacctgatggtggtgagcgccgaactg

SEQ ID NO: 29643 - DNA, 617 bp, Sorghum bicolor
  Clone ID: 9303007
cgaaaaccccataccgttgtcccacaaaaacaactcctaaatcaaccaatgggcactcattggtattattggtactgcaggttggtggttgagggcgttgtgcatcaacagggccgaggagcaacagctcgatctggaggacatcaattctgtgcaccatgagcactactgctgctctccctgcagccgtcctcgctggtgaagaaatggcggctcctgcaccagctgcatctgcatcatcggacgaagcaacagcagctcactcgaggaggaagcagcagaggaacccggcgagcctgtacaccaataatgtacctgcagctgagactgagataatcgagtcgctccccctggagacgcggctcatggtgcgccgccggcagtacggaggcttctggcaagctgagttcatactcaagggcttggctgccgctggcgcatcgtcatggttccagccggagacatcagacatcttccttgccagcctacccaagtccggcaccacctggctcaaggcccttgccttcgcgacgctcaaccgtgccacccactcgccgtccgacggccaacacccgctcaaccaccggaacccgcacgactgtgtcggcttcctggag

SEQ ID NO: 29644 - DNA, 212 bp, Sorghum bicolor
  Clone ID: 9303010
actttgaccactccgtctccgactaggagagagcacagagccgcagaggcgcaaagcacaagaccgaggaccgacggggcgagcgagcatatatgaggcgcgtacggggacggtcgctgcttaattagctcatggtgatggggaggcaaagcaatagctacgggagcgggggcgacgaggagcggctgcccctccgcggcgtgcgggaaacg

SEQ ID NO: 29645 - DNA, 352 bp, Sorghum bicolor
  Clone ID: 9303021
gccaaagctgcgactgccacagctaggacagacgacgcgtccatgccggccgtggaagcaagctgaactcaccgcgaggaagcgagcgctgcagcaattaatcttcgttcatcaatggcggcggtgccctacggagctcaccctccccaccaggcgccggcgccgttggcggtggtgtcaccgctgttctgtgcgtcgtacgcggtgccgctgacggtgaccaagaaggccatcagccgctccggtcgagacttcgtcgtcaccgacggcaacggcgctgaaatgctccgtgtcaacggcgccgtcttcagcgtccacgaccaccgcgttctgctcgacgccggcggccagc

SEQ ID NO: 29646 - DNA, 168 bp, Sorghum bicolor
  Clone ID: 9303032
ctgcagctaggcgccatggaacacgccgctcttgcacgggtcactcatcgccaaccggcggcacacgggcaggcaagggccgccgccgccaggacatggccacggctgcagacggcgttacggcacctgaactcatggcggttgctgagcagcgccccggagacgacg

SEQ ID NO: 29647 - DNA, 292 bp, Sorghum bicolor
  Clone ID: 9303038
cctctcaccgctccgatccaatggcgccgacgtcgaagctgtcgatgggcatcaagcgcgcgtcgaggtcgcacgcgtaccaccgccgtgggctgtgggccatcaaggccaagcatggcggcgccttccccaaggcagagaagcccgccgccgccgcggaacccaagttctacccggccgacgacgtcaagccccgcgtccccagcacccgcaagcctaagcccaccaagctcatgtcgagcatcacgcccggtacggtgctgatcctcctcgcggggcgcttcatggggaa

SEQ ID NO: 29648 - DNA, 273 bp, Sorghum bicolor
  Clone ID: 9303045
gcggcgcccgctggacggcatcacgccgggcgagtggtgtggcgcagtgggtagcggcgtggacggcgcggcgggcgagtgctcggtcgggggcgacatcgatgctgtcaggcagggcgcggcggggaggaagctggcaagcttgatggccggcctcgtggggacggccgtgcgacggatgcaccagataggataggcgcgccggcagccgatggaggtggtttgggaaggagcaagccggctggcagctccaaccaacaattccattattca

SEQ ID NO: 29649 - DNA, 342 bp, Sorghum bicolor
  Clone ID: 9303059
agtactacttgcacaaagtgacaggtttgaattgacctgtgcaaggaaaaggaaggaagtggagagatcccttgtttcccgggcaatcttccttccatccccagaatgctgccttttgctgttctgtttttattttttttccatggcttccagaaaccctacttactgtacgggatctggcaagcaggcatgcgtgggaggtttcaggaaacatcaagttgtgagggagatcaaaggagacagacagagatgtgtatgtatgtgtcatctgtacctatgtctatgtgggtccaatagagtacaaactgtgaagttgatgtgcctgctcctgaagaaacaaga

SEQ ID NO: 29650 - DNA, 579 bp, Sorghum bicolor
  unsure (1)..(579): unsure at all n locations
  Clone ID: 9303061
aggctgaccaagaaatacccggcgctctactccagcacggcntacatgttcctcatcagctcgctgcagggcggggccctcacggcggccatccagaggcgagcttcggtgtgggttctgacaaggccgctggagatcgttacggtcttatatacagtaaggagtcatggggtccggagtgggctacgtgttgatgacgtggtgcgtggagaagagagggccggtgttcacgtcagccttcatccctgtcatccagatcatggttgccatgatcgatttcttctttctccatgagaatctctatcttggaagtgttctgggatccatactcttgattctgggcctctatattctgctgtggggaaagaagagggatgcctcagaagcatcatcatcagctgctgacaaggaagaggaggaggaggaggaggacaaagagaagcaagtcagatcatgaagaccagcagaccactctttcttttttttttccaaaacaaacaaattaaaccagaggatgaggaggaccaaaagatacagttctttggactgtgatggatacttgacatatatacttaatat

SEQ ID NO: 29651 - DNA, 148 bp, Sorghum bicolor
  Clone ID: 9303072
ccgcgcgcacacgcaggaggacaagacaacaattagctattataacaagcagagaagtgagtgtttttagctttgctactctttttttttttttttgtcagtccttccatgtcttgagactcagtagagctgtagaggcagctggagg

SEQ ID NO: 29652 - DNA, 613 bp, Sorghum bicolor
  Clone ID: 9303085
ttggtacagtgatcagattcagaagaagtacgatgagcaaccagctgttgatggcataactgtcaaagtgttccagccgagccacgaggagtaccagaggtcaaggaacaagaagcacaacatgaaggcacttgctgagatctatctactgagcatgagcgatgaactgataaccagtggcttttccacgtttgggtacgctgctcaggggctcgctggcctgaagccatggatcatgtttaagtcggagaaccacgtgatgccagacccaccgtgcggccgtgccatgtccattgagccgtgcttccatcaggctcccttctacgactgcaaagcgaagaaggacgctgatttgggcaaggtagtgccttatgtgaggcactgcgaggacgtgagctgggggctgaagattgtaaatcaaactcatttgtagctgtaattttttcaggactcacgacatacttgcttgctaactagggcagaattccttctctctttttttgtgcaaaagaaactatacaaaatgtattctttccctcctgtatttgatccaagtgtagatagttgataaacagatcgattaaactgttcatctgagtcaaaagcaagagaa

SEQ ID NO: 29653 - DNA, 450 bp, Sorghum bicolor
  Clone ID: 9303094
tggcaagtgttcagaggggacagcacaaacgcaagcgatttactctttacagccaagaaatcttcaatctttcaactgaagcccgaggtggatgtctttctggccggtaatcatagcgaacaagtatgtgatttcaagatcaggggtagctacatcgagagatcttgcggattctatctgggcaattcagacaccatggttgctcaaataaaccgcaagtacacggccaccaacgtacttctggaaaaggacacctttgttgttaccgtgttcccgcatgttgactatgtgttcatcacggctgttgttgtgattctagatgagattcatagggaacggttcgatggaaccacaatattcgatattgtcactgatatgtaaaacttttatttgtaatttgggcagtttattatcattgttcatccccaattgataaacaattgggcctta

SEQ ID NO: 29654 - DNA, 385 bp, Sorghum bicolor
  Clone ID: 9303102
tagggatgttccagagcccagaccactcgaaggtgacgcccaagttctgcaagcagtttggggacgtcggcgccgtcatcggcaaggcgctcgcggagtacagggagcaggtggaggctcgggctttcccggacgctgagcacacgccctacaagatatcatccgcggacgtcgatgtcttcgcggacgcgctgcgaaacatcggcttcgatggagctgcagcagctgccgccgccgctgccggaaaaaaggagaaaatagtaggcaatggaaagccacaggatggggataacatcaataatggcatcttgagcggtagcgcaggtgctgcagtttaatggcggggcatgtgtgctcccgtagttcttaaataaattaattaatt

SEQ ID NO: 29655 - DNA, 571 bp, Sorghum bicolor
  Clone ID: 9303113
catgtgtccgtgatacgaccttcctcagaagcttaacctgcacccatccccagactgcacctaccattttacttgaatcaccaggcgctgataattctgcagagctgtaactgaagttccactatttcactgcattgaacttgcttctgctggtatttcacctttagctgtaagtgggttggttcaaagggagctgatttgtgaggctgtggttgttctccccactccccagactggcatcaaaagaatgatgctcccgagtcactttctgtagctgtattccctggtagaattggggagagatgtttgtacaaaagctaacctgattcttctgaccaagacttgccacacagggttgatgtacttagtgggttactctcaagagccagcttctatatgcagtatgttggcctaatagtgcagtatggctcccccacaccactgctgtgtttaggacaaaaaaaactttccagatacctgatgaaggattgattctagttggtgagttgatgtagtgcttcatagttggaaacatgggaactgtaacacacagtgtaccatatgatctttc

SEQ ID NO: 29656 - DNA, 641 bp, Sorghum bicolor
  Clone ID: 9303127
gcacgaggggtgaacgagcccaacatcgagcccctcggcggctacgaccagggctacctcccgccgcgccgctgctccgccccattcggactcgccggcgtcccctgcacccacggcaactccacgacggagccgtacgtcgtcgcccaccacctcctgctcgcccacgcgtcggctgtctccctctacagacgcaagtaccagggtgagcaaggaggacggattgggctcacattgctggcctattggtatgagccggccacgcacaagcctgaggacgtacaagcagctgcaagagcaaatgacttcacacttggatggttcatgcatcccttggtgcacggcgactatccaccggtgatgaggaggaacgcggggtcaaggctgccggtgttgacggcgcaagagtcggccatggtgcgcgggtcgttcgacttcgtcgggatcaaccagtacggcgcactcttggttgaagcagacctcggccagctcaaacgggagctcagagactattacggcgacactgctgtcaacttcatcacactaccgttcgagagcacagtaaggaaccaggagcctcaacttgggctgcggaacaaagaagcgccatgggctctgaacaaagtgctggaacacctgca

SEQ ID NO: 29657 - DNA, 568 bp, Sorghum bicolor
  Clone ID: 9303128
gcacgaggcaacaacaagatggggaaacgtccgatcgctgatgttgtcgccgaagatggcgcgaccactacacccgagctctcaaggaagaagagcaagaaagacaagagcaagaagcttagcaagaccgctgaaatcgacgcgaccgagaccaacggcaatgtcgaagctgtagagggctctgaagatgacgagaagctttcaaaggccgagcgcaaggcggcaaagaaagcaaagaaggaggctaaagaggcgaaaaaagcgctgaaggctgcggcggaagacgagccagctggccagactgcggaagagagcgaggaagccatcaaggcagcagagaaggcagcgcggaaggcagagaagaagcgcttgaaggcattggcaaagggcgaagctaccgagtctgcgtcctcatcgaagccttcatcggtccaagccagcgccgagcctacagcaacgagcgcaaccgcgaccgaatcgggcgattatgaggagagcaaggagctgacgcagcttcctcaggccgaagtcgacgccttccttgccaaaaacaccatgactatccaag

SEQ ID NO: 29658 - DNA, 531 bp, Sorghum bicolor
  Clone ID: 9303132
cccgaccccgccggccgcccgccgccgggatcctccgcgccggctgcccccccaccaccgctgccaccgctggccagaggccgctgcaagtccaccccacccctgcgtggacgtgcgctccgcggctccgccggcaggtccgcccggcgtccggctccgggcgcgccgaagccgcgaagccgcttgccgggccagccggaggccgtccaagcgcccagtccctgtgcgccgcctggtacctgccccctggtggtctgttgacttgactaacatatgctgggtggggtggccgctcctggcccgtgctgaggctgactgctgtgagcctgtgactgggaggccggtagccgggtgccatctgctgtctgccgattcgagtagaggactaactggcaaccattaattcaaattgtctctcttaaatttcagtgtcacttagggactcctttccctgagaagaggcggaggctgggatatacaatgactgttggatcacgtgtggtggtgatagacaatgggggtggtcttctc

SEQ ID NO: 29659 - DNA, 634 bp, Sorghum bicolor
  unsure (1)..(634): unsure at all n locations
  Clone ID: 9303133
gttgtggtcaagatgctccttgataggggtaaagtcgacgttgatgcgagagacaagaatggccagacgccactatcgtgggccgccgagaatggacatgaggctgtggtcaagatgctccttgataggggtaaagtcgacgttgatgcgagagacacagagtatggccagacgccgctatcgtgggctgctgggaatggacatgaggtcgtggtcaagatgctcctcgatacgggcaaggttaacgttgatgcaagagacaagtatgaccggacgccgctatcgtgggccgccgagaatggacatgaggtcgtggtcaagatgctccttgataggggtaaagtcgacgttgatgcgagagacaagaatggccagacgccactatcgtgggccgccgagaatggacatgaggccgtggtgaagatgctcctcgacactggcaaggttaacgttgatgcaagagatacaaagtatggccggacgccgctgttgtgggcggctgagaatgggcatgaggcggtggtcaagatgctccttgacactggcaaggttgatatcgacgccnaagatttctatggtctaactgcgtaccagctatctgccttgaatcatcatgagcaagctgaacgtcaat

SEQ ID NO: 29660 - DNA, 613 bp, Sorghum bicolor
  Clone ID: 9303136
gcacgagggttcaagatgctgtcccatctcggcatgtcggtggcagctgctgccgctatgcttcagagagcatggacatttagctatggcataatcagcggattacttcctattcacgtgctgatgctaatggtcgtcctggtggccgggctggccatgttgtggcgccttcaccggccgcgggacgtgtacctcgtggactatggctgcttcctgggcgatccatgctacagggtcccgttcgcgatggccctggagcacggacgcctcatgaccgacctcatcgacgaggagagcctgagcttcatggtccggctgcacgagaagtccgccatcggcgaggagactagcctgccggactcgttccgctgcatccctcctgacagcagcatcgaggcgtcccgggaggaagccgagctggtcatcttctccgccgtcgacaaggcgttcgccaggagccaggtgaaccccgaggacatcgacgccgtcatcgtcgcgtgcagcttcaccacgctcacgccggtgttcgccgacgtcgtggtgaacaggtacaagctcggcgccgacgtgcagagcgtgaacctgtccgggatgggatgcagcggcgcgctca

SEQ ID NO: 29661 - DNA, 545 bp, Sorghum bicolor
  Clone ID: 9303137
gcacgaggcctgtcctcgcgtacagtcgtgccctcccagcgccgccgcgcccacccagcaccgccgccgccgtcctgcgccgccgtcgtcttcctgtgcctcgctgctccggcacgcgcccagcgccgcccctccctgacggtcccgcagctcggcctgctcgcccctccctgcgccgcccgaactcgccgcgcccccggggggcgcccggccgcgctgccacgaccgcgccggcaccggccccgctacggcagcgcctgccccggccagcgtccaccccggcctactcttccagttctgcgagtgttcggattttactatttgctgttgcaagcgagtcctcaaatttctgcccatctttaaggaagcagcaaagtcatttaagggaaagagaagaggccgtttaaggggtctcggagtacccggattgtcttcgtcggcgttgtgggtgtgcctggaccgcgtctgctccgctagcattactccaccgacaccctaggtgacagaaacaaacatggtggccaaccgttcaccgaggcaggtag

SEQ ID NO: 29662 - DNA, 505 bp, Sorghum bicolor
  Clone ID: 9303154
gcacgaggagcaagtcacggctcgtgcgttgcagccccagccagcccagggatcggacatcgatcgatctcgacccctctcgaccgcgcgacccgtgagcacgtcgtcgtcgtcgatggcggccatgcccacggacagcatgactcgccgcttcgccgtcgcgtgcggcgtgctcagccagtacgtcaggaacggcgcgcccgcgacgacgatgacgccgccgccgccgttcctgaagcaggcgccggcggccggacccgccgcggcgcaggagatgatcgtcgccagcgccagcgcgccgcagcagctgaccatcttctacggcgggagggtggtggtgctggacgcgtgcccgcccgagaaggcggccgagctgatccgcctcgccgccgcggccgcgcagggagggtcgacgcagccgccggagcaggcgctggtggacatgcccatcgccaggaaggcctcgctgcggcgctttctcgccaagcgcaaggacaggtcctct

SEQ ID NO: 29663 - DNA, 615 bp, Sorghum bicolor
  Clone ID: 9303162
gcacgaggctctctctcgctctgcctgcgacgactgggctacgccgtcgccgccgccgccgccgccgccctgcgtcaggagccggaggtcttcgttggacccttcgcccgcgacgagcgtccgccaggctgacggcgatggcggaggcgacggagaggaggaagcgcgcggcagtcgtggtactgggcgacatcggccgcagcccgcggatgcagtaccactccctctcgctcgctaaccaggccagtatggaagtggacattgttgcaaatggaggaagtgatcctcacttgtcattgagagagaacccgtcaattcacatccacgagatgaaaacagtgcagttaactggaatttcaaagatatctggtgccctggcacttctacttaaagctgttgtccagttcattttgctggtttggttcctttgttttaagattcctcgccctgatgtctttgttgttcagaatccaccctctgttccaacactggctgctgtaaaattggcaagctggctgagaggtgctaaatttattgttgattggcataactttggatatacattgctggggttatcgcatggtcgaagtcatattattgtcaaaatttatttct

SEQ ID NO: 29664 - DNA, 547 bp, Sorghum bicolor
  unsure (1)..(547): unsure at all n locations
  Clone ID: 9303163
gcacgaggggatgttgtgttgtcttctgtggggcacctaaattatgaactaggtgctgacaagtttgttactgggaaagaaagtcctgccaagcaagctttggacttgactgaagcccctggaaggtatgtatcctatctgcagtcttctacagctgtgacctcaagctcttctaagatttcaagctccagaagaaacacaaactcacaagaagcaaaggactctccagttaaatcagcctcttcatcgccaccgagaaattttaacattaaaatgatttccagtaccagaaaagatggaatagtggatggttccttgggcaacacacacaacttagtaaggtaccaaaacagtgaagtcattgcattaaataatggtcagaaaactgaaaactttgagggggttcaggttgcaggtgaacccaattttcatggtcctttgcaaggaatctccgatagcaatatcaaggaaatacctcagtcagctggtgctcaagtctccaatatcactggttcggagaggagtttggataatagtctgccganag

SEQ ID NO: 29665 - DNA, 628 bp, Sorghum bicolor
  Clone ID: 9303165
cgagcctgtccggtggccctcgatatgcgcattgctcggtgtggtcgaaatctcatcgggctcggttatcgccatgcatctatcggttaactgttggggatcgtggtggtgttgtggcgtcatgatggcaaaagggagcgcagtgacattcgcgatccccagcatcagcatcagctgcacaaggacatgctggaatggttagcgtcgaggtcagcaatagtcgcaaacagacgcacccaatggagaacaaagaaggcagtgccagtgccgctcccccccgtcagtctggaacagcggaagggaccagcgctttgagcgtcgatttcatcgttgtctgagcaagggtctgtccagcctgacaaggtgaaaatggaattgtcaatggttcgcgtgacgcagcgagtgacttgaggcctagacactgccaagtactgggtacctgcggagtgcggtgggttcaagccagctgactgctgctgttccccagacaggcaaatcttttaggtaccaccaaggtatccgtttgatgatgctaaaaagctccttgaaaagagtccatctaccagctgcgatacttgcaaagcccatcatctgcctcagatattcattagcagcgcatctgtttagc

SEQ ID NO: 29666 - DNA, 554 bp, Sorghum bicolor
  Clone ID: 9303167
gcacgaggcttaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatggccgtttaggccacggaagtttgaggcaataacaggtctgtgatgcccttagatgttctgggccgcacgcgcgctacactgatgtattcaacaaggctaacaagtccaagtccaagccgccccgccatggcggcggccacgggagggggctgttcgacgccaccgacgacgagatggtccgcaggatggcgctcgacggcgtcgcggccgcggtctcggtggtcggcgaggtgacggtggacccgagcggcgcggggaactacagcaccatcggcgaggccgtggcggcggcgccgaccaaccttggcgggagcaccggctacttcgtcatacgcgtgcccgcgggcgtgtacca

SEQ ID NO: 29667 - DNA, 532 bp, Sorghum bicolor
  Clone ID: 9303173
ttcatctcgagaacaaccaactgactggaaatgttccttcatactttggtagcttgccaaaactgagcgagctgtaccttcaaaacaacaagctgtctggatccattcccagggctctgctaagtcgaagcattattttcaactactctgggaacatatatcttggaatagggaagcaagagaagaagcatgtaatcatcattatatctgctctgcttggagcatccttgttacttgcagctgccctatgttgctacatgctgacacgcaaagccatgaacagggactcttcatccacaacagaaggaggtccacatgacgacgatgtcgttgcagagaaggtgctgcctgcagagcaggacaagaagttgcagaaatatccaagcacgcagttgcagtcgagcgcaagaatcgccaccgagacggctcatccctacagactgtgtgagcttgaagcagcgaccaagaagtttgcgagcaggatcggttcgggggggttcgggatagtgtactacgggaagctgagtgatgg

SEQ ID NO: 29668 - DNA, 603 bp, Sorghum bicolor
  Clone ID: 9303175
ttaacctcgagctctggttatactactaacaatcagtaacaaccgtccccgcaactcgtgccggttcgagtacacccgcgacgacaatggcggcctctgttgatcgtcacctggctccccacccatggccaggcaatgcgcctcccaagagcttcgacatgttccgctccggcggcccaggcggcggaggcaagcgccgcgccggctccgactccgactccgaggacgaagacaccatccccccggactggcggtcgctgtacctcccgcgcctcgaggtggagccgcccgtccacgacccgcgcgacgaggccacctcggacgcgtgggtgcgtcgccacccggcgctggtccggctcacgggcaagcaccctttcaactcggagcctccggtgccccggctgatggcgcacgggttcatcaccccggcgccgctccactacgtgcgcaaccacgggcccgttcccagggcggactggtcgacctggaccgtggaggtgacggggctcgtgaggcgccccgctaggctcaccatggagcagctggtgacggagttcgaggccgtggagctccccgtgacgctggtgtgcgcgggcaaccggc

SEQ ID NO: 29669 - DNA, 511 bp, Sorghum bicolor
  Clone ID: 9303178
caacaccacaccattgtagcaacaagaagaagaagaagacagccaacacgtacgccattgcttgtaggcagctcgatcgcgcgtcgtcgctgttgttgttggcgattaatagcaatggaggaggagccgcagccgcaggtggaggtggaggtgccctgctacttcctgtgccccatctcgctgtccatcatgcgggaccccgtcacgctccccaccggcatcacctacgaccgcgacggcatcgagcgctggctcctcaccgccgccacctgcccgctcaccaagcagcccgtgccggcggactgcgaccccacgcccaaccacacgctgcgccgcctcatccagtcctggtgcgcgctccacgccgccgacggcgtcgatcgagtccacacgcccaagccccgcgccgacgtcgcagcgctggtctcgcggctccacgacgctgccgccgccgggtcaacggcgccgcagccacagctcctcgccgcgctgcgcgagctcagggacgtgg

SEQ ID NO: 29670 - DNA, 587 bp, Sorghum bicolor
  Clone ID: 9303180
gcacgaggcaaggaacatcaaacctcttccttgtatcagggtgaagtgcagtatgctgcagatagagatgatgatgaaaattcttctgggtgcacgcatccaagcaccatagaaaataagggttgcaaaccacaatatctaggtaaccataggataaggaaattgcttgcctcgaaggtaaggaaggcagcacgtaataagatttgtggagggattccgtcaaaaaagatctatggagggttgtcaaacaaaggtagcaagctaaacttatgtgggaaaaagatatccaccacacgtcaaaaggtgcaaaggacgattttcaagaagaaaaagctagcacatcatacaacatcttttgctaaagagatgctaactgaagctagcaggacatcgtttgctactggaggtcaaaataaatcgtgtgaatctgagaactaccacgttaagctaagaatcaaatcattcaacatcccagaattgttcattaaggtcccagaaaatgcaactattggatcactgaagagaactgtcatggatgttgtcaatagtataatggaaggtggtctacgcgttggtgttcttcttca

SEQ ID NO: 29671 - DNA, 478 bp, Sorghum bicolor
  Clone ID: 9303182
ctctccttcgctgccgtcacgtgggcacgttgctccgcatccgcgattccgcgaggcaaccagccgcttgcggtgttctactgccgcgtagcagcggcagcggcaccgacggcatcccaaaaggcagcgacgtctggggtcggttggagccgccggggatcggtggcctgagctcccagtatacgcctctggagtccggatccgcggagccgacggccgaagctcccgtggtctcctctgcagtacgcggctcggccgggaccgggagcgaggactggcgtcctgcgtcggcgggatcggcgtgcgaggggagcgctgaaatctgcgcttccttctctcgcggatgccaggtcttgcttgggagaggtaaggtagcaaaggaaacatggagctgaggctgaggcggctgctgctgcttgcgctcatctgcctgcatgctccccgttgggcttcggctcagcagccggaggaggcgacg

SEQ ID NO: 29672 - DNA, 600 bp, Sorghum bicolor
  Clone ID: 9303192
gcacgaggcagcagtcgagcttcttcaactggttcaccttctgcctctccgtcggctccgtcgccggcctcatcctcatcgtgtggctcgagaacaccagaggctgggacgtcggatttggcctcagcgccctcctgatcctcatcgctttgctcgtttccgccgccggcctccctttgtaccgcaaccgtgttcctcagggcagcgccctaactcgagtcctgcaggtttttgttgtggcattcaaaaacaggaagcttggcctacctgacaagatggaggaaacacagcaaaatagccatgaagtggattctcaagaagtaccatgccctactactaatcacagtctaaaatttctggacaaagcctgctgtgcgaacaccaacactgggagagacgatggaccttggtcagtctgcagcgcggcaaaagtagaggagaccaagatcgttctacgcatgctgcctctcgtcttcagctcgacggtggcgcacgtatcgacgcctctgctggtcgcgttcaccatccagcagggcatgacgacgaacacgaagctggggaaggtgcacgtctacccggcgatgctcttcatcgtcccgt

SEQ ID NO: 29673 - DNA, 517 bp, Sorghum bicolor
  Clone ID: 9303204
gcacgaggcaacgcacccccacaaccagacgagcacggacggacctccgcaccccgcaccccacgacgagcgccaattccgaagcgccgccccctcgatccgcccggcccggccctccccaccgcgcccttgcgtccgccagccactaccgttccctccctaccgtttgccgtcgccctcttccttccggcgccggccacacccccgacgcggcggaccaaaaccaacgccatgagggtccacccggccccgcggaagcgcaccatcgcggtgcagcgctgcgccacggcggcggcggcggcgggcgcggtcggcgggaagaagctgcgccggctgccgcacatcttcgccaaggtgctggagctcccgttcgcggccgacgcggacgtgtccgtggaggaggacgccgccgcgctgcggttcgtcgccgccgccgtcgtcgacgtcgacgggttctccttctcccccgcgggtggcccccgcgcgcacgccgtcgagatccacccgggggtcacca

SEQ ID NO: 29674 - DNA, 538 bp, Sorghum bicolor
  Clone ID: 9303207
ccaccaccatcaagatggagatgattgagaactcgccctcgccccagcgctccgcctccaagtcatcggaaccctcacagacaccggctcccgagagcagtgcctcgaagccagtcaagaagcggaagtcatggggccaggtcctgcccgagcccaagaccagcctgcctccccgcaaacgcgcaaagaccgaggacgagaaggagcaaagacgtattgagcgcgtaaagcgcaaccgcctcgctgcccacaactcacgtgagcggaaacgccaggagtacgaggtactccaacacgagaaggacgagctcgaggccaacatgagggcctacaaggagaagatggcccagatggaggccgagctccgctactaccgcacaaagtaccctggcgaagcaccaacatccactaccttcgacctctctacaccatcacacgactcgttcagcaccatctgccctgcgcagattcccacatccttccccagtcccgaatccatggactcgatggactcacctcgtgactcctcgtgccagcc

SEQ ID NO: 29675 - DNA, 192 bp, Sorghum bicolor
  Clone ID: 9303216
gccacctacgcccagggcgagctcgtcgtcaccgtccccaagggcgccggccccgacgacggcgacggcgatgcggccgctggtgccctcggtggcacggaccgcgtcctcgtgcttgtatagtcctataatcccattcccatccatgactcttctcgacttcgcctgttttgctgattcgcctcctgttct

SEQ ID NO: 29676 - DNA, 635 bp, Sorghum bicolor
  Clone ID: 9303229
gcgccgttactttgaagaaattagagtgctcaaagcaagccatcgctctggatacattagcatgggataacatcataggattccggtcctattgtgttggccttcgggatcggagtaatgattaatagggacagtcgggggcattcgtatttcatagtcagaggtgaaattcttggatttatgaaagacgaacaacttcgacctcatccggacgagggacagtcaaggcgacgccaagtacctcgtcctcgacatcaactactgccccggctactccaaaatgcccggttttgagccggtcctcactgaattcttcttggagatgcttcgcagtagacctgttcttgagcggcctgccccgggcaatggctctgctgcctctgctggcctaggcgttgatgaggcacgcaaggcagaggccgagcccaccagcgtcattccggagccgaggcaggttcaggcctaaaaccgctaggtttcggtccaatttgatccggtactgtgggtgctgaacctcttgcaagttcaatttggggtcctttaccataccaagtttggagcaccaagaccacaccagtgaagtgtggagtttgctttaatttgtaaccttcgtccattgcaattgcaaaggaaaa

SEQ ID NO: 29677 - DNA, 646 bp, Sorghum bicolor
  Clone ID: 9303230
atctctcagcagctgactgagaagagcgacatgtacagcttcggcatcatcctgctggagctcatctccggccgccctcccatctccaccatcgccttcggagaccacttccgcaacatcgggccgtgggccaagttctactacgagagcggtgacatcgaggccatcatcgacccctccgtctccatggcaggcgagtaccaggacgtgcagtccgtctggaagatcgccgaggctgcagtgcggtgcatcgatgtggagccccggaagcggccctgcatgcctgaggtggtcaaagagatccaggacgccatggcgctagagcgggcggcggctgcagagacgaccaacagcaacagggggctcggctgccccttctcccccgcggcggcgagcgtcaggtccggcgggaccatgaggtcgcacgacatggtcatggacaacctgctgctcatggacgacgacgagtccacctccttctccggctccgccgtcagcaagctcaagtacccggagctgcgatagctaggtcgcattattatctggcttgtcttgtcgactttggagagcggcaaaggcgattgcaatttgaaattgttgattgactagctagtactctcctccgtgtaaaatgtaatacttacac

SEQ ID NO: 29678 - DNA, 688 bp, Sorghum bicolor
  Clone ID: 9303232
gctcggcgcgaccattgacatcaagggccctattgggcacatcgagtacgccggccgcggcggcttcgtggtgaacggcgagcgccggttcgcgcgcaggctcgccatgatcgccggcgggacgggcatcacgccggtgtaccaggtgatccaggctgtgctgagggaccagcccgacgacgacacggagatgcacctcgtgtatgcgaaccggacggaggacgacatgctcctgcgggaggagatcgaccgctgggccgccgcgcacccggcgcggctcaaggtgtggtacgtggtgagcaaggtggcgcgaccggaggacgggtgggcgtacggcgtggggagagtggacgagcaggtcttgagggagcacctgcctcttggagacagcgagacgcttgcgctcgtgtgcgggccgccggcgatgatcgagtgcacggtgcgcccgggcctggagaagatggggtacgacctcgacaaggcttgccttgtcttctgatcgagctgaagcctggcagctaacaacaacggatgtcgtgcaagatgaaactgtacatagaaatactgcgtcttgaaccctagtagcgtgtcagatctagctataacactctaccgagttcttgtaataatagcgagttaaagtagtttgtaactggccatgtcctaaagcgcaataaaaactcgaagg

SEQ ID NO: 29679 - DNA, 663 bp, Sorghum bicolor
  Clone ID: 9303235
ctccgcgacaggccggccgtctccaggcccgccaccaaggcggcgctgcacgtgctcgtgcgcacggcggcgtggggacgcaaccgcgtcaaggcggtggacgccggcgcggtgcccgtgctcgtcgacatgctcttcgacgacggggcggagcgccgcgcgtgcgagctcgtcctggcggcgctggaccgcctgtgcgggtgcgcggaggggcgcgccgacctggtggcgcacggcgcgggagtggcggccgtgggcaggaaggcgctgagggtgtcggaggtggccacggacaaggcggtgagggtgctgcggtcggtggcgaggcacgcggcgacggcggcggtggtgcaggagatggcgcatgccggcgtcgtggcgacgctgtgcgtggtggcgcagtcggagcagtacgccgagaggacgagggagcgggcgcgggagacgctccggctgcatgccagggcatggcggacctcgccgtgcttgcatcaccacctccaggccctgtacccttgctgatcgatctccatgcaatatatggggacatgcatgcatcctccattgctgcggtggtcttgcagaggaaactcttgctgtttgattcattcatctttttccgcttttgaaacaaggatgatgtagttgtacaaagagcaacag

SEQ ID NO: 29680 - DNA, 592 bp, Sorghum bicolor
  Clone ID: 9303240
gctgcaccgtcgccgccgcgcccgagctcgccgccaacacggcgttcgccgtcgccacctacctggggcggccatggaagctctactcccgcacggtgatcatgcagtcggaggtggacgcgctcgtcgaccccgccgggtggatgccgtgggacggcgactacgcgctcagcacgctcttctacgccgagtacaacaactccggccccggcgcggacaccagcaggagggtggcatggccgggcttccacgtgctgaacggcaccgcggacgccgccaacttcaccgtcggcaacatggtgctcggggacttctggctgccccaaaccggtgtgccgttcaccagcggtctcatcaactgatcgatgatggataattgttaattatctgctggagctagctaattattgggcagcaagtcggtacaaagtcgatcttatattagtggatatgctgctatatagagtattgtattcgttgcaagaggtagataggtaggcatatatacagaaaaaatttaagttgcgtatataattaacgacagaaataataagtgcggtgcaacaagatgacaccatgcatgatccgtagc

SEQ ID NO: 29681 - DNA, 556 bp, Sorghum bicolor
  Clone ID: 9303261
ggcgccctacgacgaccgtcaggacgacgacgagccgcccgcgcccaagaagggcaagatggcggcggcggcgacgcgcgaggagccttcctcctcttcttggctcgcgctcggcagcctgtgctccatgcacagccgttgagatcgccggccggctcgccgacggtacgtacgtgatgagagttcaaacaagaggtcgggcgcacccctccacttggcttacgagtacgtggttggcatcgacccccggccattggaggcgttgtagcagcaatttaccattttacctacggttgtgctacctaccacaacgaactgcgcatgttatagggtacatattattattattattactaattgctagtatatacggtatctatcgatcaatcaagccgggcggctatactgcattgcggccggcatgcgttctcacagagagcgacgacactattcgttcgtatccttcgttggtttggtggtgtatcatctaatctaacaagacgtgtgaacctgaacgacaagagatgttcagccactgtgaatcgtttgttgactt

SEQ ID NO: 29682 - DNA, 588 bp, Sorghum bicolor
  Clone ID: 9303262
agtattgggcgacgcaagacccttgtttcggccatgtcgttacagagaatatcgccgtgctcaggaagatgagtagcgaatacatcacgaactcgagattggcaggtcctcgggaatctttgccacctcggtgtcattttctcggccaagcatctcggtgatctcaactcgaacttcgttcttctggtttagcaccgcaatacggctgacattatccactctgatagagtacaggtcgtctcgtaggatccgggctcctggggccagttttgtttccgctacgcgtttcacaatctcatgctcgttctcgtccctgcaggtgatcctgacgcggtggggattttgggtccttagtcacggctcggcatcgccacgtgggattatccagttcggagcggacttcgttctccactgtcgctcggatcgtcccggctgagagcctagcttcatcttctcctagtcttgaagccgttatcgttggcggctatgaacgggcatgaggcgatcgtcaagctgctgacgtaagacgttgtactgagcagtgattggagtcacatatcttaatagccaatagtgcgtgtaaggctt

SEQ ID NO: 29683 - DNA, 600 bp, Sorghum bicolor
  Clone ID: 9303279
ccccgggcgtcgcggcggtggtcgagaggaagaggaaggacacggtggcggccggcggccagatctccatcttctggctggcgccgcagttcttcctgatcggcgtggccgacaccacctccttcgtggggttgctcgagttcttcaccggcgaggcgcccgacggcatgaagtccatcggcgtggccttcttctggtgccaggccgggatggcgtcgctgctgggcacgctgctggtgaggctggtgaacagggtcacccacagcggcagtgcccctgggtggctggaggggaagaacctcaacagcagccaccttgatctcttctactgtgttgtcacggctgtgtcgtttcttggatggctcaattacctctactgggctaagaggtacaagtacagacaggatccacggatttccaccaagtcccccgatgaggacgactctactatgccttgaacttgaaagcatggctatggtgaaccgtgaatatactgctcttccctctcaaagtgatctatatgtatcgcctatttagttcactgtctgtatagtactctgtaccatgagttccaaggcaagaccatcaataatgtgatgt

SEQ ID NO: 29684 - DNA, 307 bp, Sorghum bicolor
  Clone ID: 9303283
agaggccagaaaacccccttggcgtctccgttctcggttcttccatacaggtgattcaaggcgcgtttgtgatcatcaaaagcttgagcttggtatcaggaagctgcagtatgaatttgattttgctcggttggttggcgggtgggtggagggacgctcgggcgaaataggcgactccgggaacgctgactccggtgagcctcgccggtgattccagggccaatccgcgtcgcgaaggaggagatctgactcgggaggagacgctgcatcttctcatcggagtgcggccaagatgagaaagcctgct

SEQ ID NO: 29685 - DNA, 538 bp, Sorghum bicolor
  Clone ID: 9303290
gcacgagggtcacgactcccttcgttggagagattcaagcgaccatgaccaaggggaaagggagtgaggggtactatggtctttttgtgtaggtgccttttctttttttttaactatttaatctagtcattttagacggtgttacaaagcaggggtagatgggagctttgtttgaaaataagaaggttaaaatcacaaagttaaaaaaggaggggtaaaatcaccattggactatggaataagggtagaaacaccaaattccctactataatagtagaacccttttttacaaatgctttcagaaaacatagttaataaatattactccctctattcgtttatatctttcactaacaaacataataggaacagtggaagcagcagatattaatacaaagctagttgtgtctagtggtcagtgccatcagctctctttcaaattgtatttttagtatccaactaaggaaacagacttgcaaactttatatacataaccaaaactaaacctctttacttttacaacaggtttaagaaagtt

SEQ ID NO: 29686 - DNA, 487 bp, Sorghum bicolor
  Clone ID: 9303294
gcacgaggctcacacaatgtcatccagggttctacttttgcgctcatggcgagcaactcgcaacagcccccgggctgtggctccattactcacaagctctgctcgacgatggggcagctccctctcacaaagaccgggttcggatcgagtgcttttccccggtgctgtcaacagcaagtttacgactgaaatgtcgttcctcaaggcgtccgatctacccgcaatccctacatatcgagtaatcgactccgatggcgagttggtcgacaaatcacgaggtcctcccgatgtgtcagacgaggaagctctgacatggtataagaatatgttgacggtgagcatcatggatgtggtcatgttcgaggcacaacgccaggggcgcctgagcttctacatggtctcagctggcgaggaaggtatcgctgttggctccgccgccgcccttacccccgatgacgtggtatttgctcaataccgtgaagctggt

SEQ ID NO: 29687 - DNA, 544 bp, Sorghum bicolor
  Clone ID: 9303305
gcacgaggatcaaagcaatcacaggctaagaaccagaacacaccagctcccaattcatctcggaagtctctgtctgcatcggttgatagttcccctggggattttgaaattaggttttctgcaaatggctcggagtctgggctggagaaaaccaaaacggcaataacagagaataaaacaaagatacaaactactgccttcaactccttcgtggcagactttgataatatcaaaatgaactcacaaaacagtactgacaatgtaaacatgactagcaaattgaaagaacatcaattggaagcagaagtaactttgctgaaggaacaattaaagatagcaaacctggagaaggaagaaatttcattgaagtttgataagttgtctgccatttgctcctctcagaggcgagagatacaagagcttaagcaagccttagctgcagcttctgctacaccaccagctaaacagttcagagaaaattcaaaagttgaactcaccccacccagcaaaagcctcgatactccgccgagggagaagattgaag

SEQ ID NO: 29688 - DNA, 567 bp, Sorghum bicolor
  Clone ID: 9303318
gcacgaggcgtcatctcaacactcacacttccatactcatcatgtctgttcccgacaagttccagggctttcagtcccccagcgccgagcactggaccgacttccagaagaactcatttgagccccgtccctttggcgagtacgatgtcgacatcaaggtcgagtgctgtggtgtctgcgccagtgaccgtcacaccatcagcggcgactggggcggttgcccttatcctctcgccgtaggccacgaggttgttggcaaggttctccgtgttggtgacaaggtcactctcgctaaggtcggcgaccgtgtcggtgctggtgcccaggtctggtcgtgtcttgagtgccatcagtgcaagaatgacaatgagacctactgtaagcaccagatcgacgcctatggcgctgattacctcgatactggtttcaagacccagggtggttactcttctcacagccgagtgcatgagtactgggtctaccccattcccgaagccctctccagcacccaagctgctcccatgctctgcgccggtatcaccgtctacagcccactgaaacgtctcg

SEQ ID NO: 29689 - DNA, 260 bp, Sorghum bicolor
  Clone ID: 9303325
gcacgaggcagagcgagtgaccggccgataatggcgcgcgagctcgtggccatggcgctgcgcttcctccacgagtacgtgcgggcgtcggacctggccgtggccgccgcggtgctcttcgtctgcagcgcggtgaggagccggctgtcgtcccgtcctggcgagcccatgctgtggccggtggtgggcatcatcccgacgctgtccgcgcacatcgcgctcggcgacgtctacgactggggcgcggcgacgctgtcccg

SEQ ID NO: 29690 - DNA, 445 bp, Sorghum bicolor
  Clone ID: 9303346
ccaaggctgaacccaaatccgactccaatgccgccgacggagaggagaagtgggagctcaacaagaagtcgaacgacaagagcgctcagcgcaatgatcgcgaagaccgcaacggtagcgctggtcgcaacagccatggtggtcgcagcggccgcggcaactttcgcgacaatcgcaagaagaggccaaatcgcgagtttgaagacctccccgaaaccgatgatccaagcgagatccgagctcaaatggagttttacttttctgcgcaaaacttggcgaccgatgagcacatgttcatggagctcgagggccccaaaaacaagcctgtctcaatccatcacatctgctccttcaagcgcatgcgccgcttcaagccctactctgctgttgtagaggccattcgtcacagcaacgacctcgtcctcgtcaacgatggcgaatacag

SEQ ID NO: 29691 - DNA, 354 bp, Sorghum bicolor
  Clone ID: 9303356
gcacgaggcgggcaacgccgacaccggcctggactacgagccggcgccggacctcgaccacctgaacgacgtcgtccggagcgacctcacggggtggctcgagtggctgaagagcgacgccgtcggcttcgacggctggcgcctcgacttcgccaacggctactccccggccgtcgccggcgggtacatcaacagcacggcgcccgacgtcgcggtggcggagatatggacggacttggcgtacgagcaggacgggaggccgcgcgccgaccaggacgcgcaccggcaggtcctcgcggactgggtggacgccgtcggcggccccgccgcggcgttcgactacaccaccagggg

SEQ ID NO: 29692 - DNA, 521 bp, Sorghum bicolor
  Clone ID: 9303358
gcacgagggccaaatcgcgtaatctggttgactttttttgaggcaattccgggagtgcctaaaataagggatggctataatccagctgcatggatgttggaagttacaagcactcagatggaacagattcttggagtggatttcgctgaatactatcggcaatcaaaattatttcagcagaccagagaaattgttgaggccctgagcagaccgagcagcgaatcgaaagaacttactttcgccacaaagtatgctcaaccattttgttctcagtatattgcttgcttgtggaagcaaaacttatcgtactggaggaaccctcagtacaccgcagttagattcttctacacagttattatttccttgatgtttgggaccatttgctggaaattcggttctagaagggagacccaacatgatatatttaatgccatgggtgccatgtatgcagcggtgctgttcataggaatcaccaacgctacttctgttcagcctgtgatctccattgaaagatttgtatc

SEQ ID NO: 29693 - DNA, 280 bp, Sorghum bicolor
  Clone ID: 9303365
gatatatctatatggtggatattttaaagaagtttcttctgacaaagaaaaaggaacagttcatgcagatatgtggtctcttgatcctcgtacttgggagtggaataaggttaacaaggctgggatgccacctggtcctagagctggcttttcaatgtgtgtgcacaagaaaagggctgttctttttggtggtgtggtagatatggaagttgaaggtgacgtcattatgagcatgttcatgaatgagctgtatggttttcacttggataaccaccgttgg

SEQ ID NO: 29694 - DNA, 585 bp, Sorghum bicolor
  Clone ID: 9303369
aaggactccagtgcctggagaatcattgagagatttctacaagaggacaaatatgtactggcaaatggctgcctacgagcacactcaacacactggaaaggagcttcgcaaagatggttttgatcttgctgaaactcgatacaaggaactgaagccgatacttgacgagctggctgtgctggaggctgagcagaaggctgaggaagaggccagtgcttcaactagttccaagaaggacaccaagaaacccaagcagaagagcgcaggaaggtagttatggttctgaacgagtgtgtatgcggaagccagctttaaacgagtgttgcagaagatgctactattctagtgcgtcagcggaagccagctttaaacgagtgttgcaggaagaggccagtgcgccagctagttccaagagcaagaggtgaagactgatgagggacatgaagaaacccaagcagaagagctcaggaagatagtttttgctctgaacgagtgtttaagtgtaagacaggtttaaacgatcgttccaaattctcaagttcttttgattaatagtatgtatactcacgttgaaagttgaattcg

SEQ ID NO: 29695 - DNA, 484 bp, Sorghum bicolor
  Clone ID: 9303374
ctgctgtacttcactttttatggcatgatgaccacagcgatcactccaaatcatacggttgctcctattattgctgctccattctacacgctgtggaatctcttctctggattcatgatcccaagaaagcgcatcccagtgtggtggaggtggtactactgggccaacccggtgtcttggacgctctacgggctcctgacctctcagttcggcgacctggaccagcccctgctgctggccgacggcgtcacctcgaccaccgtggtggcgttcctggaggagcacttcgggttccgccacgacttcctctgcaccgttgcggccatggtggccggcttctgcgtcctcttcgccgtcgtcttcgccctggccatcaagtacctcaacttccagcggcgataagagagggaagaggttcacccgccaccgacagaccacccaacgaagcaaagcaatgcatcgcagcccagcatatgtccatcca

SEQ ID NO: 29696 - DNA, 461 bp, Sorghum bicolor
  Clone ID: 9303376
tgctgttgtaggtcgcctgcggcagtccggccacggaggagatgcccgacggggagacgctggcgctaccggagtgggtgtgggagctctacgaccgcggcgccgtgctggaggccgccgacggtaggctggacggtcagttcgacgtgtgggagatggagcgcatgctggtagtagggctttggtgctcgcatccggtgcccagggagcgcccgtccatcgtgcacgctctgaacgtgctgcagtcccgggacgccaccctgccggctctcccgacgaacgtgcatcgtggcgccgcggcgccaacagctgggttcagtgcgtacgttcactctatgtcgtccgtcggtagcgttggagaaccatgctgatatgatactagtgccacccaggatctaaaagtatatagggtctgttttggttgcctggctccttctagtcgtactaggaatattaagact

SEQ ID NO: 29697 - DNA, 595 bp, Sorghum bicolor
  Clone ID: 9303412
gttcacgagccaaggaggccgacgctcgcaagatgggtgccgatggcttcctggccactggtgagaaggactggaccaagggccacgagatgtccttcgacatcatcatcaatactgccacttctttcgagggctttgctctcagcgagtacctcagcctgctcgatgtgcacggccactggaactccgttggtcttcccggcggtgatggtatctccatccgcaaccaggacttcatcaccaacggctgctacatcggaacatcgcacttgggtagccgacgtgagatgcttgagatgttgcagctcgctgctgacaagggcctcaagtcgtggatcgaggaaattcctatctccaaggagggtcttcagaaggccatggaggctctgaagacaagctctgttcgctaccgatcttgcatgaccaactacgaggaggcttttggtgcttgagcgtgtggaaatatgaaaaaataaaaagaaggagtttgttgggagcagcattgggagttatgaatgagttaatggtggagctgaatgctcttgttggcgtgcatcaaagacaccttgatgggtcgaaatgacgaataagtata

SEQ ID NO: 29698 - DNA, 664 bp, Sorghum bicolor
  Clone ID: 9303417
ccgatcgttcaagtcaacaagactgattttcgaatagccagactgttcgagggactgaccattcaatccaatgacatagcgggcacagtgggatatatgtctcccgaatatatcttggaaggaactttgtcgacaatgtatgatgtgtatagctttggtgtcaccctccttgagaccattagcagtatgtgtaaaactaaccctgttcgtcaccatgcttcagttccatgggcttggaatgtgcgtgaaaatcaacaaatgggtcagttatttgattcatccttgtttgaggaatctcagctaacagagataaaaaggtgctttgagataggactactatgcactcagtttgagagagcaaagcggcctaccatggcatctgttcttgagatgcttaatggcaagaaagagttaacaaccccatggcaaccggaatataccaaagaaagggtcatagatgccaaaagggccagccaaaatgtcaggagtcggatgtagcaaaacatccaagtattggagctgtttgagtgatgaataacaatttgctgttgtaaatatagttggcttgcttgtatgcaatctgtaagtgtgctacttacgtggtggcaatcaactggaatttcttcttttgaacaatttgtaaatgctttacttgtaataaatc

SEQ ID NO: 29699 - DNA, 150 bp, Sorghum bicolor
  Clone ID: 9303424
gcttgcgtgctagtgtaatgctactagctagagctaggagtacgtgctccaataaagtctatagctactgtgtaccagttgcctgcagcgcgctgatgcagtgctgtaccccagtaaaatctgttttgtgtttaccatgccgaaaagtac

SEQ ID NO: 29700 - DNA, 575 bp, Sorghum bicolor
  Clone ID: 9303443
aacaatggcttcgccatctccaccccaacgcttgagcaatatcgtggcgatggaattgccagccgtggtgtgggttacggcattgataccattcgagtcgacggtaatgacgtgttcgccgtcaatgaggccatgaaggaagcccggcggcgtgccctgagtgatggtggacgaccagtcctcattgaggcgatgagctatcgtgtttcccaccacagcacgagtgacgacagctttgcatgccgtgctcgagtggaagttgaggattggaagcgccgcgacaacccgatcattcgtctgcgcaagtggctcgagaacaaggggttgtggaacgaggatctggagcaggaaactcgggattctttgcgaaaggccgtcttgaaggagttcagtgaggccgagcaggagaagaagcctcctgttcgggaagcttttacagacgtctacgaggagctgacagaggaggctcgggagcagatgaaagagctctaagcgcattctggagacataccctgatgagtacgatctacggccatacaaagatggagcgaagggactggattagactttagatg

SEQ ID NO: 29701 - DNA, 515 bp, Sorghum bicolor
  Clone ID: 9303461
gcacgaggctcgtgtctctcttcccaggcgttcccgccgatgagcaagctggacccggccgtgtacggcccgccggagtcggccatcacggaggagcacatcatcgggcagctggacggcatgtcggtgcggcaggcgctgcaggacaaccggctgtacatgctggactaccacgacatcttcctgccgttcctggaccggatcaacgcgcaggacgggcggaaggcctacggcacgcgcacgctcttcttcctgacggcggcgggcacgctcaagcccatcgccatcgagctgtgcctgccgcccatgaccgacgggtgcgcgcgcgccaagcgggtgttcacgccggccgccgacgccaccagcaactggctgtggcagctcgccaaggcgcacgtctgctccaacgacgccggcgtccaccagctcatcaaccactggctgaggacgcacgcgtgcatggagccgttcatcatctcggcgcaccggcagctgagcgcgatgcaccccatctt

SEQ ID NO: 29702 - DNA, 578 bp, Sorghum bicolor
  Clone ID: 9303464
gacgaggtgcacttcagccgagcacgcacaggaggaagccaagtagagcgaggcaccgttgaccgaccaaggagatggcgctgggatcggagtcacaggcggcgacgaccgcggacccgtcgtgtccgccgttccctctcctggaggacgacggaggccacatccacgagcaggagcaggaggtcccaagtggagccgagctggagctcccgaccgtggacctggatgctccgggggaggcgctggcagcagcgtgccggggactcggcgtgttccgcctcgccaaccacggcgtccccgcgtcgctctccgcgcggctcttcgcgacggcgcgggccgcgctggccggggcgccgttccacgacaagcgcgcgcagccgggctacttctggggcacgccggcgctctcgctccgcgtccgggacgtcaactgggtcgagggcttccacgtcgccctggggggccaccagcagcccgcccccgggccgccgctcggcgacctacttgacctcgcggcggagtacggcgcgcacatggcgcgggtggcgcgggcgctcttcgacgcgctcgccgcgccg

SEQ ID NO: 29703 - DNA, 552 bp, Sorghum bicolor
  unsure (1)..(552): unsure at all n locations
  Clone ID: 9303494
ctgatttgctggacaatgagtggccaggtcacaattcacaagtttgcttggactacagcggtcagtgagagttcagttgcacttgtgatcgatggttcccatgttcttgttactcctcttatcctgggcctgatgccacctcccatgtctctgttccaccttgcatttccttgtgcagtgaatgaggtttcttttgtgaccaatagctcaaagagccacttggctgcttatctgtcaaatggcagcttgtctattgtggaacttccagcaccagatacatgggaagaatttgaaggcaatgggataagtgttgacctttgctgttctgactttactttgaataactgtatgcacctcacttggatagatacacgcaccttgattggtatctgttgctatagtgaaaactactctttaacaacaatcgggtccagtgaaaccagaaaccttgtaggtaaacatgattcgatgtttttcatcaatgagattgaacttatatgttcagaggattctgtgccaggttcagtgagttcatctggatggcaggctana

SEQ ID NO: 29704 - DNA, 127 bp, Sorghum bicolor
  Clone ID: 9303499
atgttctcgttgttgtcacacgcatcgactgttggtcgacgacaattctcgaccgccgacaagccatatgatgtcgccgtcattggaggaggtcccggtggttatgttgccgccattaaggccggcc

SEQ ID NO: 29705 - DNA, 582 bp, Sorghum bicolor
  Clone ID: 9303500
cccaacctcacgaatgttctcgttgttgtcacgcgcatcgactgttggtcgacgacaattctcgaccgccgccaagccatatgatgtcgtcgtcattggaggaggtcccggtggttatgttgccgccattaaggccggtcaattgggccttcgcgttgcctgtgtcgaatcgcgcggtacactcggcggtacttgtctcaatgttggatgtattccttcaaaggcattgttgaatgcatcacaccattatcacgatgcaaagcacaacttctccaagtacggtatcgagttgaacggtacactcaacatgaacatcaaggagatgatggccgctaaggagaaggctgttaagggcttgactggtggtattgaaatgttgtttaagaagaacaaggtcgactacttcaaggcacatggtacgatcactggtaagaacgatgtcgctcttaccccaattgatggcagtgcgaagcaaactatcaacgctaccaacatcatcattgccactggttccgttgcagccacccttccaggtatcgatgttgacgagaagtctgttgtcacttcgactggtgccctcga

SEQ ID NO: 29706 - DNA, 264 bp, Sorghum bicolor
  Clone ID: 9303506
ggtagcaggccaaacacactacgaaccctgaccgactacaccacccacaactagctcttctagggacgattccacacactctctccctccctctcttgcccctccgttctttcacttacagctgggtgaaacgctagcttcaaaattactcacgacacacctctcgacgccgcgaaccgcatctttgccccgccatgccctgtttcaagggtctcgccgtgagtatacacactccggacggacctatctccgaatactccattc

SEQ ID NO: 29707 - DNA, 614 bp, Sorghum bicolor
  Clone ID: 9303528
acattaagggtgttgtcagggaaattatccacgatcccggtcgtggtgctcccttggcacgtgtcgttttcagagacccactgagatacaagctcaacaaagagctcttcgttgccgctgagggcatgtacaccggacaattcgtttactgcggcaagaaggctcaactcagcattggcaacgtcctcccacttggtgccatgcctgagggagctattgtctgcaacgttgaaggcagagttggcgaccgtggtatgttcgcaagatgctctggcaactacgctaccatcgtttcccacaaccccgacgataacgtcaccagaatcaagctcccatctggtaccaagaagttggtcccatcagatgctcgtgctatggttggtgttgtagcaggtggtggcagaatggataagcctctcctgaaagctggcagagcttacttcaagtacaaggcaaagaggaagtgctggcctaaagttcgtggtgtggctatgaatccagttgaccatcctcacggtggtggtaatcaccagcacattggtaaggcagctaccgtcagaagagatgctccaccaggtcgtaaggtcggtattattgctgccagaagaaatggt

SEQ ID NO: 29708 - DNA, 520 bp, Sorghum bicolor
  Clone ID: 9303540
ctaagtggtaaaggggggcgaggctctgccgcaagcagctggtaagaggcgaccttatcagaccactcatgcaactctggtcgtcgcctcagagttgaagcggcctttctttggagtgccggagagcgactggatcccgtcgttcgtgctcaccaccgagaatcccaacatccccttcaactccgcttccgccatcaggaagctgaacgaaacgcacaacatctacaaagtcttctcccgtaaggagttgtccgacaaactgttggaccgcctgtttggtgggcgtgcggctacttatcgcaacgagtgggcggcgtacccagtgctcacgccctacccgttcagcgaatggccacgcatcaagcttcacgataaagtgtactacgcgaacgcatttgaaagcgctgtatcgtgcttggaaacacaaatcgcctctggtcacaacgtggctaacctgctcttacgcaaactacgtgcctgatcgtaagaggctctcgccgctcagattatccattttccc

SEQ ID NO: 29709 - DNA, 662 bp, Sorghum bicolor
  Clone ID: 9303544
gcgacatggcgcgggccatcagcggcgacgcgtactgcagcgtgcgccacagggtggcggcgagccaggcggcggagaggctctcgctctgctacttcgcgttcccgcaggacgacgccgtcatcagctgcgctggcggcaggtacaggcccttcacctacgccgagttccgggagcaggtgcaggccgacatcaaggccactgggtccaaggtcggcctcgagcgcttccttcttcgctaatggagaccgatccgacaagtagataaccattatatatatatatattttttttaaaaaaaacctgcaacgcagaagcctgtaggagcacctctcgctggtcctcatggcactgtaactgtgtccattgccggagccaatgcattcaacatggtactcagctggacaggtactgaacctgccattgctgtttaaggtgcatcttgtgcatgcacaggtaggaggatggttatggagtgcattggattgatgctgaattttctgccagtctgaatcgcagtaccgtgctggatacaagactgaatcaaaaaaggtgcacctgaaacaggctgttgtagtgggttctggtacagaggtggatcagagtatgctaatgatctttcgttgggtgtgaaattggaagagagcttgtgaaatatacct

SEQ ID NO: 29710 - DNA, 642 bp, Sorghum bicolor
  Clone ID: 9303555
gttctaccgcaccaaggctaagggtgagcaggtagctcgttctatctacccagagaccactattgttcgacctgcgcccatgttcggttttgaggatcgtcttctccaccgcctcgcttctcccacgaacatcatcaccgccaacaacctgcaggagcgtatccgcccggtccacgtcatcgatgttggcatggctcttgagcgcatgctccacgacgacaccaccgctgctgagacgtttgaactctacggccctaccgagtactctatggccgaaatcaacgagcttgtggagaaggaggtcatgaagccccgccgccacgttaatgttcccaagcgtattctcaagcccattgctcactatgcgaacaagctcctctggtggcctatccactcggctgatgaagttgagcgggaattcattgaccaggttattgacaggaacgccaagacgttcaaggacttggaaatcgagcctgttgagctgaagagcatgactttcgagtacctcaagggataccgaagctcgagttactacgatctgccgccgatgagcgagaaggaaaagagggaagagaagaagtatctgcacgtcattgatgaccaatagacaagcgagctttgtaaatatttaagccccat

SEQ ID NO: 29711 - DNA, 636 bp, Sorghum bicolor
  Clone ID: 9303556
ggctcttggcattaagatgaaccgtggtatggtcgagactgactcacactttcgcactaacattccaaacatctatgccattggtgatgttattgccggcccaatgttggctcacaaggctgaggaggaaggtatcgccgctgttgagatcattgccggcaaggccggtcacgtcaactacggtgctattccgggtgtcatctacactcatccagaagttgccactgttggtcaaagcgaagaggatcttaagaagaacaacatcaagtacaaggcaaacaagttcccattcatggccaactcccgtgctcgtactaacaatgatgccgaaggtttagtcaaggttctcactgatgccgagactgatcgtttgctcggtgtccacatcattggcccaatggctggcgagttgattggtgaggccgttcttggtcttgagtatggcgcatcagccgaggatcttgctcgtacttgccatgctcacccaacattgtcggaagcagtcaaggaggcttgtatggccaagccaatccacttctaagcgaaatataatgggacaccataataaactcacccactaaaaacaacctgaacacgttcgcatcggtggatcttccccattttttcttgttcagt

SEQ ID NO: 29712 - DNA, 502 bp, Sorghum bicolor
  Clone ID: 9303581
agcaatgtcagcaaatcacgaggggcaaggcgggcaaaaaaaggtggcaaaatacgagctggaagtccaggggaggaaatggcccttgtggagcatctcaaggggatggcgctcacaggtggtgcccaaaatgagctgaagagcctgcttgtggttctaatacagctgggaaaagaagagcgagcccgtcaggtgcaggaggctgcaggtaattttgaagtgtctcatactgctgcggtgaagttggccgaggacacagtatgcagcgacaaggtagacgagagcacacacacccttgagcattacgtaaagatgctgaaggctcatgggtcgggtgacagtgagccgggttcatggcgaatcaaagcattgtctcccccgtgacagggtgagtggtttaaccgattagcaatttagcattgtttaattcgggatgaagtgttgtgttctttgtgactggcgaaaaaaagggtcaggcttgatcttatcgatgaactgttct

SEQ ID NO: 29713 - DNA, 687 bp, Sorghum bicolor
  Clone ID: 9303600
tctcgaaggggcccttcgcaatgctgcatccctcgcgacagcagcagccaaggcagcccagtccggctcttcttccaagttcgctgagtatttcaagaccaccagcagttccacgcgctcggtcgtagcggctcgtctgcaggcagtggcccgggaggcccagtcgactacctcggggggcaccacatactattgtaccgatgtgctggggtactgtgagaccaacgtcctggcctacaccctgccatctcagaacatcatcgccaactgcgacatttactactccgacctgccggcgttggcgagcagctgccacgctcaggaccaggctaccactagcttgcacgagttcactcatgccccggccgtttacagtcccggaaccgatgacctgggatatgggtactcggctgccacatccctcagcgccaatgacgccctcaacaacgcggacacttatgccctgtatgccaacgcgatctaccttggctgctagactgggttcgaaagcgagacgttgaatgtctgagtgattgtgtggggggccgttgtagtaaccgggaagaggtccagagcggcagagggtggaagaattttaggtcaactgagagtcatgattatagtttattgagcatctcgtcccttcagtccaagtatatgaacgcgtcatttgcgctacgtcaatag

SEQ ID NO: 29714 - DNA, 588 bp, Sorghum bicolor
  Clone ID: 9303604
ttcctcgaccccgacatgaacccgcgcctcgggagcttcgcgctcgccgagttcctgtcgaggaacgagcacggcgggcaccacgtcgtggtcaccgccagctcggcaaagggcatcttcggctacatgtcgcccgagtacatggacaccggcgaggccaccaccatggccgacgtctacagcttcggcgtggtggtgctggaggtggtgaccggcacgatggccgtggacgggaggttgccggaggttcttctcgtccggaaagtccagctctttgagcagctgaaccggccggtggaggcgatggcggaccagcggctggacggcaggtttgaccgtcgggagctcgtgcggatggctcggcttggcatggcgtgcacccggtcagaccccgcggcgcggccgagcatgaggaagatagtgagcattctggatggcaacgacgaagtgctggacaagttcgagcagaggaaggagagcacggaggactggcagaggaggaacgcgactaatcttgcactagtcaggagattccaggctcttggaatacactgatgaaaaagtttgaaacaggggaaattattagcg

SEQ ID NO: 29715 - DNA, 545 bp, Sorghum bicolor
  Clone ID: 9303607
gcacgaggatggttttgtaagttgcccatgttgcgtcgaggccgattatcatcaccagctgcaataccctaagggagggggcccgatggcatggaaatgtctccactgaagcgtccaagcgaagatgcggaccacgaggatggacgtcggcctgctccgcgcacgccgcggattagagcttgtgcggaatgcaagaggcacaagatcaaatgtgagccagttgagaatgaagcaaaatgcgcaaaatgtttgagaagcggcaccgagtgtgtgccctataacatgaaccagcgcattctggacgaagatgctgcttggaaagcaaaagcatctgctgaaattggacagctgcgttcggcggtgcagcgcctcctcatgcacaacaaactcccaggccttgacagccctcaggaagaatcgcctcaaccgccatcaggccagacagtgacagtgactccaactaatgtcatatctgagagcggtcacactactctggtagttccgccaccgatggacatgacgcgcgacaattctgtcgaacgcga

SEQ ID NO: 29716 - DNA, 469 bp, Sorghum bicolor
  Clone ID: 9303616
caccgccgcgtcgcccgtgatactccgcgggccgcggccgagcgcgcgccggcaggatgagctccacggcggccgacgtccacccggcgctgccgccgatcaagaccacgccgccggcgccggcgccggagcccgccgcctgctcctcggcggcatcgtcgtcgacggcaacggcgccggacgccgagtcggtggcgaccttgccgtcggcggcggagaatcagcagcagcagcagcaccagggggaggcggagttggaggcccaggagacggagcccacgacgccgacgtcagaggggagccagctgcgggcgccggccgagtgcccgccggcgccgcggaagccggcgtgggcgcctccgtcgtcaacgcccggcaagcgcaagttcccgtcttccgccgcgccgtcggcgcgccgggccttcttccctgtcgcgcgcgacctcaccagcgtgttccgcgccctgcc

SEQ ID NO: 29717 - DNA, 542 bp, Sorghum bicolor
  Clone ID: 9303625
gcacgaggctctttcccctctatccacccgtgggcctctccggaccagagctagtggctacacaaccttaacccagcccaggtcgcattgctgcccccgtgaacctttttttgggcttcctctctctctctctcgctcgcgcgctctctctctctctctctccttgtcggttcaggtcactcttttcacctcgcagaattgttccagagctgtcccaacagggtgctcaggtagcaacgggtcagtgcgaggttcacccgcccaaagatcgcgacagttgcgcatcgtgtgtacggtggctcacgacattccttcgacaatctgttggcctctcgtcactgaaccatcacgcttctttgtctcaccagccatcgatcggcctgctcgcaagttcctcgaaaaccaagttctcgctccgcttcggtcttccgcgtttcggagcatttcatactcaacccgtcgcttttccctccttgcgtgccgtctggactgcctgcattacccccgttgcctcgttgcatccactgtctcggcgtggcatg

SEQ ID NO: 29718 - DNA, 536 bp, Sorghum bicolor
  Clone ID: 9303662
cttggcttcgctcacgatggtgttgcctttttgaccacccccgacgtggccgcgctcccctggttcttctttggcgtcatccccgccatcatcttcttcatctccctggtgcaggtcctgtactacattggcttcatccagtggttcatcaagaaggtggccatcttcgtcttctgggctctcaatgcctctggtgccgaggccgtcgtcgctgccgccacccccttcatcggtcagggagagtctgccatgttggtccgtcccttcgtcccccacatgaccaatgccgagcttcaccaggtcttgacctgtggtttcgccaccatttccggctccgtcctggttggttacattggtcttggtcttaatgctgaggcgctcgtctcctcttgcatcatgtccatccccgcctccctcgccatctccaagcttcgctatcccgagactgaggagactcttaccgctggccgtgtcgtcatccccgacgacgacgagcacaaggctgaaaacgccctgcacgcctttgccaacggtgc

SEQ ID NO: 29719 - DNA, 542 bp, Sorghum bicolor
  Clone ID: 9303671
gcacgagggcgccgcgggaaggttctggaagcttcggagatgaggaggagtatatgccacgaaggaggtggggctgccgccgccgctgccttctctgcgctgctgctgggctgcgtcgttatggccctcgtcggcggcgccgccgcgcatggcccccggctcccctccgactacaaaaccctcagcggtaatgcaccggccttccttccttctctacagcttcctcgacgtgtgccgtcctgtatgcactcctctgctttcaccccgtgcgtttgtttgaaggggtcggtggctgctggcaaacccaattggggcattcttggggatgatttcatagcttctccgacgactgtagaggggagttctgctctctatctatctaagacattcgtaccaactggttgttgcttctgggaactccacaattcagtttcggttcttctctgacaagtggagtgagtgccgctggcgctgagttgctatacttcagttgtctgaattctaagatgacttcagacaagagtctaatacatccaacttgt

SEQ ID NO: 29720 - DNA, 690 bp, Sorghum bicolor
  Clone ID: 9303679
acaacatccgagtcgctatcgtacgatcggcgtgaagccgccaacatcgccattgccgccgcaacaagcaccctaacgctcatcttcgaggagccagacttacgccgcgccatgaccgccgtacccatcttcacccacaccatggtagccttcagcgcgacctttcttctcaaaatggcaaagacatggggcggcgtcgcgcaagcacaatcacccgaatgggccacagaaccccttggtctcggcctcaacttcaatatcaatcaggtcgtctcgctgtcgcggcgctcagcatcttttctggcaaaggtggcggacaatctgaacaaaaaacatatcacgagacatatcgtgcaaggaatcaacgacctcttgaaacgcattgatgcggtcgcgggtacaccgtctgcctccacgactcagaatctcacggccccttcgccaaccacgtcgcccatctttgatcccgtcaaggctgcgacggcaagtcaggaagtgagtgtggatcccgcaaatgagtacaacatgtacgatctaatcggctcttatgggtttggatttgacgagacgttcttgggacagatggcaccgacggatatggggttttggcaaactgacccttttgattgttggatcatgtactccgtagagtctatatatataatttttaaagtataaggtgctggtaca

SEQ ID NO: 29721 - DNA, 455 bp, Sorghum bicolor
  Clone ID: 9303686
gatctcctcagggttgccaagctcattgccgagaaggtcatcaccaacgagtacaatgccttcaacgccatggccaccgacccatactacgccgacatgtctcctcgctcccagctcattgccacctatgctctctgcggattcggcaacattggctccctgggtatccagattggtattctcagccagctggccccgtcccgtggtggtgacgtctcccgacttgccctttctgcccttatctctggtgttttctcgaccttgacctcggcctccgtcgctggtctcgtcgttaccacccagctctctcactttaccagacctccggcgtctggttaagtggagttttgtacgtgtttcatgtgaaagatttgtgccatgtcaggagattatgagtgtgttttgttaaaacagagacgaacgagaggatgagtaacatgaaaagatgaagaaga

SEQ ID NO: 29722 - DNA, 130 bp, Sorghum bicolor
  Clone ID: 9303690
tcaccgacccaaacccggaggatccgctggtcctggagatcgcacacatgagcaacaccgcccgactcaggtaggagtcctccgccagcggatgaacgcacaagtacgccatgggatgataatgcatcca

SEQ ID NO: 29723 - DNA, 598 bp, Sorghum bicolor
  Clone ID: 9303693
tggacccctatgccaataaggagcccctcgtcgtccctggcggcgcgttcccgcgcctgacggagtgtaggttccgggactcggacctggggcccgtgttccagcgtggtgctgcgccgcggctacggaggctcgagttctgcttccgggtgaggaacaccatcgatcttgggaacgacggcttcgacttcgggctgggaaacctcgagtcgctcgaggaagccgtcgtttacgtcggctgccaggagtcaacggagcccgaggctgaagcggcggaggcggcgttgaggggcgccgcagatgcccatcccaaccgtgccaacttcgacgtgatcacgttcggcgaagagctcatgtgtttcgacgacgataattgacgaccacaactgtcagaaccaaaaacatgcggaaaatcgtaacatccaagttttctctgatccagtcagtccgagctacgaattgtagatgagtttgaggtaggtttcaaacatgtgctttgtgatgtaatgtaattcagcacagggcaacaagtcaaataactcatgcaacaaatatcacttaaagtgctgattaacagaaaagtcgtacatacagattt

SEQ ID NO: 29724 - DNA, 560 bp, Sorghum bicolor
  Clone ID: 9303737
cggaagccggcgtgggcgcctccgtcgtcaacgcccgccaagcgcaagttcccgtcttccgccgcgccgtcggcgcgccgggccttcttccctgtcgcgcgcgacctcaccaccgtgttccgcgccctgccgccgcccaagaagcggatccgcgcgggctgaccggctggcgggaccgatccgcgccgccgtggctcagctggccgccaactctgttgtccctggcgtgcaggacaggaggagggcagcggccgcgacctcaccggcgtcgactcgtgcggggcggtcggcggcggcggcggcggctcatggatcgatctgggtgtccgccattggccgcgacgacgccttaataggtgcgcggtcatggcatggtacagagctctctcgtacaattataagttgttggtttattaaaattttcctctgttttttttgggggggaaattgtagaattgagaaaatggtgttatttatattataggggggatgtattggaaaaatgaaagcttgtaaagagatttgtttcaaaaagaaagctgtaaagagaattcccagag

SEQ ID NO: 29725 - DNA, 176 bp, Sorghum bicolor
  Clone ID: 9303746
agttgagcctgatgattcaacagatggcggtgtccttgtgaatgggaatgatggtgaggaacactgggtgctggctcctgatcaatagtagagatattacgaagcaccagcagattagttgtttttgtgtaaagaaggtcgccacatgttcaactcgatagtcatgtaaaagttcc

SEQ ID NO: 29726 - DNA, 659 bp, Sorghum bicolor
  Clone ID: 9303747
acccctggcacagcgacgaacacgagcgcaaagtggccagctggtataatctggcaatctcggaaagcgtcgaaacgctgagtcttgctccgttcagccgagtgtacaactggcccctcgagaagatcaagcgtcttgcgacggatgtcaagactgaagccttcaacaaagatctgcactgttacaacattttgcatatttatcaggctcgcaaaccaagcgctgcttagctcatgatttatgtgtctcaggctcccatgcaaatgatcggtgggctcaacaaccagcctcttcacacgacttgatgttgatcggtgcggaaaacttctcttttttttcgaattgacgacgacgacctcatttgcttctttttacctttttcccattctggatgcatattatacacgagcatggtttggcaatcaggggactggatccgaatgttgccaacttgcctgatttattttttttgctcttcttttgacccctggtctatcctccccctccccctttctcgccctctctttcttcctttcttaattctgcttctgtatgataaataccctcgtgcttcccgcctctcttgagatgagatttgctatgttttgggacggagacggcactcttttttttaatatgagcaaacgcgctatcaacct

SEQ ID NO: 29727 - DNA, 307 bp, Sorghum bicolor
  Clone ID: 9303762
gcacgaggggaccacggtgtgtactactgtcttgtagctcttcttcctcttgcgtacttccttctcaagtcgttgtccaagaaagctccctgccatggacttgagctccctccaggcccatggcagctccccgtcgtcggcagcatccaccatctccgcggctccctcctgcaccgcgctctgcgggatctgtcgctccgccacggacctctcatgttcctcaagttcggcgagcttccggtcgtcgtagcgtccacgccggacgccgcgaaagaggtgatgaagacccacgacgccatcttctcga

SEQ ID NO: 29728 - DNA, 602 bp, Sorghum bicolor
  Clone ID: 9303771
cgaaaaattgatgggaaatcaatcgggaagaagcaaatggccattgaaggttataaagcgcagagtgaaatggtaattgatagtttggatcggttaattactgcttgggaagataggaaagaatcagttgttgttgagggtgttcacttaagccttaattttgtggtatgtgcttcgataaaactattcatttgcacttctttcctttcattccagctattgattttttttagatcgtatcagacccactatgttgcatatcttctgctaacaaaggtggagttgtaactttcatggttaacatgcgcactttattccacattcccttttaattatttcagatgggtctaatgaggaaacatccttcgataatacctttcatgatctacatatctaatgagggtaagcacacagagaggtttgctgtacgtgcaaagtacatgacacttgatccaacgaaaaataagtatgttaaatacatcagcaacattagaactatccaggagtacctctgcagcagagctgacaagtacctagttgccaaggtcaacaacactaatgttgatcggagtgtggcttcgatccatgccactgtctttagc

SEQ ID NO: 29729 - DNA, 343 bp, Sorghum bicolor
  Clone ID: 9303775
tgcacgaggcatggaacgtcgcctgtcaaagccccaaaggccaagactaaactttcgtcccgccttggaattgtacggcgctggagaatgaagctgaggcctgaggtcgatctcgagcctccagctccggcaccagttcccgcaacagcgaggtcatccacgccgacatctactaccctcggcgacgcctctcaagttgcacgaagcacgtgaagtgaacctcatgtccagttcttgctcctgtttaactagtaactacatcatttgtaatgatggaagctgtaaagaagctccatgctcatctcgttgtttctggcctgcacaactgtcaatatgcaatgtt

SEQ ID NO: 29730 - DNA, 290 bp, Sorghum bicolor
  Clone ID: 9303788
ctggatcatctccaccaccaagctgcagaacctcacgcagtaccaggccgtggagcgcgtgaaccccacgctcgtgcccaccaacctcgacgtcggcaccatggtcacgttccccatcttctgccagtgcccggccaaagacgacaacgccaccgcgctcgtcacctacgtgatgcaggccggggacacctactcgtacattgccgccgacttctccgtcgacacccagtcgctcgtctccctgaacgggcccgagcccaggacgcagcagttcgacgagatactcgtgc

SEQ ID NO: 29731 - DNA, 651 bp, Sorghum bicolor
  Clone ID: 9303794
gcacgaggtcgagactcaagatgggtgaaaaacaagccgaagctgcgccccatatggcgagcgccgatcgacatgatcaagctgtggtgtatctcgagggtcatagtgatgtgcatcccaacgtggatctggtcgccctgcgccgcaagatcgatcggcggttgctgccctacatgttctgcttctacgtgctccaattcctggacaaggtcatgctgaattacgctgcggtgatgggaatcaagaaggaccttaagcttgctggcaatgagttctccaacacggcgacgtggttcttcatcgcgtacctgattgctgaggttcccaatgtctactgcctccagaaagtccccgcagccaaatggctcggaggtaatgtctttctctggggcgtcgctgcggctgcctctggcggcgccaccgactaccgcagtctgctggtcgcacgggtcttcctcggtatcttcgaggcgaccgtgggtccttctctgatgctgatgagtagccagtactatacgcgcagtgaacaggcaccccggtttaccttctggtacatgggtctgggcgttgctcagattatcggcggtatcatctcgttcgctttccagcatgttcaccatgcctcgctggcgggatggcgcatcatgttca

SEQ ID NO: 29732 - DNA, 525 bp, Sorghum bicolor
  Clone ID: 9303804
gcacgaggctacgtgatgctgtaaacacaaaggctagttcttctaatttgacgagttctgaactgaagtcgtgaaacaaatccttacaagtttcaatgctaatctttttcgatttgttggctcaaatgttaacatttggagctcacgtgtctttgtctctttggcctaggattggggtgacacacctcggaacaaaagttctatgccaacgtggttggcaaaatctgagagcactttgagcttagcctctagtaccactgttatttgacgttcttttgttctttcttccttgattaacttcttctgaaatgagttgactttaaagttcttcgaaattgatgttattaaagaccaagagactgtagaagttggtcaatttgacatcttcgatgctattacaatgatatgtgataggctggcacatttagtgttgtcaatcaagattatagggcatcgaacatgcctgatgaaaggatccaacatatgctaagcacattaaaggtgctaacaatctaacatttgtgt

SEQ ID NO: 29733 - DNA, 541 bp, Sorghum bicolor
  Clone ID: 9303808
gcacgagggttcctcggtcgaagcggattgagatcctcggctccgtgcaacaataatggaagctatccgccttgcctacgtgctcgtcttcctcctgcccttcttcctcctcctcctccgtctccgtaagcgcccagcaacaacgacggcccactccccgcaccccaacccggtcctgggcaacaccctcgccttcatccgcaaccgccgccgcttcttcgactggtacacggacctgctccgcgccgcgccgtcgggcgccgccgtcgaggcgtgggggccgtttggcgcgggccacgccgtcaccaccgcgagccccgccgacgtcgaccacctcctgcgcgccggcttcgacggctacgccaggggcgcgctcttccgcgacgccaccgccgacctcatcggcgacgggctcttcgccgccgacggccgcctctggagcctccagcggaagctcgcctcgcacgccttctcgtcccgctcgctccgccgcttcaccggcgacgtcctcgccgtgcacctgcgccgccgcttcctgccg

SEQ ID NO: 29734 - DNA, 525 bp, Sorghum bicolor
  Clone ID: 9303812
gcacgaggaaacaatcccgactatgaagcgcgcttcttaacggaagacgacggcgatgattacatccgcaagacgtttgcagattcccgcccagatatcgtcgacacctacctcgcattacccatacccatttacaaagccgactttctgcgctatgtcctgctttggaacgaaggcggagtctggtccgacctagacgtctcgtgcgaagaaaatgtgcgaatcgatgagtgggtgccggaaatttataaggacaaggctgcgctcgtggtaggatgggagtttgaccagggttggccgggcagatatgagcggcaattcgagagctggactataatggccaaaccgcgctcgccacacatgatgcaagtcatcgacgatatcctccagacactgcaggagaagactgcggaatttgacgtctcggtcaataacatcacaatggatatgatgggcgatacggtcgacttcactggtccgcggcgtctgacgcgcagtgtgtatacgagtttgggaagcgtgctc

SEQ ID NO: 29735 - DNA, 584 bp, Sorghum bicolor
  Clone ID: 9303821
gcacgagggtccggcacgttcatcgggtacgtggccgtgtcgaccgacgaggagacggcgcggctcggccgccgggacatcgccgtggcgtggcgcggcacgatcacccgcctcgagtgggtggccgacctgacgtccgaccagatccctctgcgcgagacgggcgtcccgtgcccggacccggacgtgaaggtggagagagggttcgcggcgctgtacacggacaaggacgccggctgccggttctgcaggtactcggcgcgggagcaggcgctggccgaggtgcgcaagctggtggagctctaccacgggcggggcgagcaggtgagcgtgacggtcacgggccacagcctgggcagcgggctggcgatgctgtgcgcgttcgacgtcgcggagacgcgcgcgaacgcgtcgccggacgacggcagggtcagggtggcgccggtgtgcgtgttctccttcgccggcccgcgcgtgggcaacgtcggcttcaggcggcggttcgagcgggagctcggcgtgcgtgcgctgcgcgtggtgaacgtgcacgacagggtgcccaaggtgcccggcgtgttcttcaa

SEQ ID NO: 29736 - DNA, 170 bp, Sorghum bicolor
  Clone ID: 9303835
ggaatttccagcagcatatgttcccagctattggacatttgttaaggatgagatccaaccaattcgcgtgagcgcattgtcgtctcaagtttgtccggagacaattttccggaaaagcgttggcaccccatgggagagtgcgtgtcatgtaccagatgcacacgctagcc

SEQ ID NO: 29737 - DNA, 392 bp, Sorghum bicolor
  Clone ID: 9303841
gcttcggcatccgcaagacctccaaccgctgggcctggaacgtcctctgcacaatccccggcatcatcggcggcgccctgctttccttcctgcccaagagcaacaaagccggcgtcttgatcggcatttacctcgtcaactcaatcgtcgccaccctccccatcctctaccagtggacaatggccaactgcgccggccacactaagcgtgcctttgccagcgccctcgtcgccggctccttctccgttggcaatatcatcggtcctcagaccttccaggcccgcgatgcgccgcagtacaagcctgcgaagatcgcggttctcgcgacccaggctggtgcagctctacgtgtcggtatgtgctctttttgtactataagtggcagaatagta

SEQ ID NO: 29738 - DNA, 350 bp, Sorghum bicolor
  Clone ID: 9303846
gacgacgacgacggcgacgtgaaggggatgcactacctgcacgccgccatcaccgaggcgatgcggctgtacccgccggtgccgttcaacggccgtgtcgcggtgcgcgacgacgtgctgccgggcggcgcggcggtgcgagcgggctggtacgccaactactcggcgtacgcgatggggcggatggagaagctgtggggcaaggactgcttggagttcgtgccggagcggtggctcggcgagcgcggcgagttcgtgccggtcgacgccgcgcggttcccggtgttccacgctggcccgcgggtgtgcctcgggaaggagatggcgtacgtgcagatgaagacggtcgc

SEQ ID NO: 29739 - DNA, 130 bp, Sorghum bicolor
  Clone ID: 9303863
ctgcatgtcccggggccattgctcgtgccaagggaatgccaggagcagtgccggatattgggctacgacgtgcccaagggagccatggtgctcgtgaacgcctgggccatcgctaggagcccagattgct

SEQ ID NO: 29740 - DNA, 449 bp, Sorghum bicolor
  Clone ID: 9303886
tcccggagctggtgctgcgggcggtgggcaggctgggcgtcggcggcgtgtacacgcacctgggcgtggcgctggagctggaccacagggcgtcgccgttcctcaaggagaccctggacatctcgtgctaccacaacctggaggcgcacctgcacctgctggacggcttccgcggctccggcgaggggttcgagctccgaggcagggaccccgcgctggtgaacaagtcgagcgacttcctccgggaggaccacatggtgccgcccgtgtggtaccaggcggagaacaagggcatggtgaggacggaggacgggcggtgggtgctgccgccgcggcagcgggagctcgaccaacacccggaggacactgaccatcacctccagcggctcggcctcaccctcaccgcgtgaaggtgaagctaaacgatgcgaggcctgcacgctacggag

SEQ ID NO: 29741 - DNA, 628 bp, Sorghum bicolor
  Clone ID: 9303895
gcacgaggattgtggcttagtacactgccattcatgcagttcaaaaaaagctctaagagcagcattgtctccaaatccgggaaagccataccgtgtatgtgattcatgctatgtgaaattaagtaaagttttggactctggtgtcagttatagcagaaatactattcctcggatacctggtgatacaaaggctgagagaatagacacaaaggcaaacaaagttgcaccatctagtagttcagatatgattaggaatttagatgtgaaggcagctaagcagacgaagaagtctgactactcgtctcaagttccagcaatgttacagctgaaagacatccctttcatcagtgcacctgacctgcagaactcgtctacagtggctaatcaattcccttatgactccagatctactttaccatttctgaggatgccatatctgaactattccagctctctgtcctcggaaagctcagagagtcttagggatgcaaatgaacttctgaagcaagaggttcaaaaactacaagcagaggttaatagtttgagacaagaacgtgaacagcaagatactgagctgaagaaatcagaggcaaaagcccatgaagcaatgaaccttgctactgaggaa

SEQ ID NO: 29742 - DNA, 155 bp, Sorghum bicolor
  Clone ID: 9303916
gcacgagggaacaacaacttcaccgcaaccatctatgctgctgatgtgggtgacccaatcgaccgcaatttgtacggtagtcatcccttctacctaaaaacccgctacttcgagaagggcgggaatggcagcaagactcccttgaagcagactga

SEQ ID NO: 29743 - DNA, 524 bp, Sorghum bicolor
  Clone ID: 9303941
gcacgaggagttcattagcctttttggttgtccgagtttgaccaagcttcccagtagcattggactgctacatgacttgaggtatctctgtcttcacagaacaaatataagtgttgtaccaagggatttttgtggtctaacttctttgaggaaattatatggatttccagcccacatggactgtgaccgttgtagtttggaggaacaagtgaaaggcatgcctatcttggagttgcttaaactgaaaatgtgcaagttgaggcgtgtgccaccaggcctggccttccacgcaagggctttgaagaagttatgtatatatggtgtgaagcatctaagctctttggagaactttgcttctgtggtccacctggacgtgtttacaaacactcacctggagaggatcagtaatctaccaaaactgcagaagctcgtcatcgtcatgtgcccaaagctgaaggtagtggatggcatgcctgcactccagagactcaatctggaggattatgacatggaaacagtgccca

SEQ ID NO: 29744 - DNA, 410 bp, Sorghum bicolor
  Clone ID: 9303944
ggatatggccggagccgaggactacgacaccgcggccgcggtggccgtgttccatgagtcccgagccggcgtctgcgggctcgtccagtccggcgtcaaggccataccaccaattttcctcatgcccacctcgccatcgccgcggtcacccacgacgaccaccgcgttcgccatcccatccgtcgacctctccctcccgcgccgggacactgtagcgctcgtccgcgccgcggcatgttcgtgcggcttcttccacgtcaccaaccacggcgtcccggccggcgtcgtcgactccgcagtgtccgcggtgagggcgttccacgacgagcagccccgcgccgcccgctcggcgttctactcaatcgagcccgccgtcggcggtgccggtgctgtcacctactcgaccatcc

SEQ ID NO: 29745 - DNA, 476 bp, Sorghum bicolor
  Clone ID: 9303947
gcacgaggctccggttccgcccgccgagcccctggcgttcccgaggtcggtgtcgccgtacgtgtcgcgcaggaagtcggacacggcgggcgcgctcaggcaccacccgagcctgctcttcttccggacgccgcaggtcgggcccgcctacggcggcggcgctggcggcgcgttggaggaaggcgacatagcctacgagtacgagaagcggcgcgcgcgcaagttctccgtgctcgccacgctcttcggccaccaccaccaccaccaccaccacagatcggaagagaagcatcaccatcagcaggaaggcgcccccaaggagcgcaagaagcgttcttggacttggttcgccgggatcataccgcgccgccgcaagaagcagtcagcggcggcggcggcggcggtctcggccacctcgccacagtcagccccgccgaggcgctcctcctgccgcgcggacaacaaccggggcctct

SEQ ID NO: 29746 - DNA, 185 bp, Sorghum bicolor
  Clone ID: 9303983
gcttttggtaacttgtatgttgatgacggcgagtctttagagccagaatcgtgcctggacgttacgtttgctgctatgactggacagctgaaggtcaatgttgagggcgagttcaaggacacggacgcgcttgctaatgtgaccattctgggtgctccagcagttggacaggtcaagttgaacgg

SEQ ID NO: 29747 - DNA, 444 bp, Sorghum bicolor
  Clone ID: 9303984
ttgttgagcacgatttcatcatggccacgtaccttgctgaccgtgtcattgtcttcgacggacagcctggtattgacgctcatgccaacaagccagaatctctccttaccggctgtaacaccttcttgaagaacctcgacgtcactttccgtcgtgatcccaccaactaccgcccccgtatcaacaagagcggatctcagctcgaccaagagcagaagatgagtggcaacttcttcttcttggaggagacccctgacaagagctaaaggcgtccataatgagaatttcccttctctcgatggtgcatctcacggcgtttggggcgttcaaaatgggaatgggcaaaagcagcgagtcttgggaatagatgatgaccgcagcgtcagcgaggatgacgacccagatgaataacgacggcgacggcagagtgtctcctcttgtctg

SEQ ID NO: 29748 - DNA, 415 bp, Sorghum bicolor
  Clone ID: 9303988
ggataagcgcgcatatggctccatgatcatggcctatatcagggctgacatgttgcaggaagcagaaggtttaatcaaagaaatggaggaccagcagatgttcgcaggaaaggaagtttataaggcgttgctgagagcctattcatacagaggtgattcagatggtgcacagcggattttcgacgccatacagtttgcagggatagtgcctgacacgaaattgtgtgcgcttctggtgaatgcttactgcctttccaatcgaatcgatgaagctgtttgtgtaatccgtaatatgagatgcgcaggagtcaaaccttgtgacaaatgtattgccttggtattgggtgcttatgagaaggtgaacatgttagaaacagcactggaatttttgacagagctcgaagaaaaaggtgtt

SEQ ID NO: 29749 - DNA, 350 bp, Sorghum bicolor
  Clone ID: 9303996
tattgcccaagctcacggacgccgcatatggctttgcttactcggaaacatgtcccattgaagatgagtggcccacaggaggacacacgtatgtagaaaaacgtatgcccctctgcgtacgcttcaggtaaaaaagttggctacacgttgattgcttccctctgtttcagtaattgtgcatgcttacacctccttgacacgtgattaattgaacatggcaagttctttaccatttcatttcgtccgtgcaacgtatttttgcaacatgtgcaggtgcaacgcctatcgccacttgaatggctggtttgatgaagcgtgcctgcactgccatgaagccgacaacatcgctt

SEQ ID NO: 29750 - DNA, 466 bp, Sorghum bicolor
  Clone ID: 9303999
cggagcgggtggtcggcagcctcgagcacaccgaccccagcttgttcacggtgctggcacaggacggagttggtgggctgcaggtccgccgcgacgacggagatgagtgggtcgacgtggtgccggtcaccggcgcgtttctggtcaacatcggcgacgtgctcaaggtggtgtccaatgatgaattcaagagcatagagcacagggtggtcatcaaattccacacaaaatgcccgggtgtcaattgccctcttcttcaatcctggtaaacgtgagaattccgaccgttttgggcctctcccggagctggtgacagcagaaaagcctgcacggtaccggagtttcacggtgccagagttcatgagttcaaggaaagaatatggccataacagatcgtccattgatctattcaaggtaagctccagctaataataatctggagggatgattagttgatgatatagca

SEQ ID NO: 29751 - DNA, 445 bp, Sorghum bicolor
  Clone ID: 9304029
gttcgagagcaagggcttagtggatgcaaaccaggtcttggcctactttgctgtatcaaagcttggagaaccaccagtcgatgggattactgataccaacccagaggggttgactgctgcatttggcagttgggctcctgcagtggctgcccgcctgcaaaacggcggacttacctgcaaggtgcttcaaaaggaagcctttcagaagcagatgctagagaagttgatatggatttcagctttcatgcttgttggtgctcgacatccaggggctactgttggtgtggtggaaaaagattaccgatctgaggttgcgagcctgatagctgaattagcatcggctgctgctgcagagagagggctcacattcgacgaaggcatagaggagcggctttgtgcttactccagggctgtggcacacttccatacagctgtaaaagagttc

SEQ ID NO: 29752 - DNA, 212 bp, Sorghum bicolor
  Clone ID: 9304033
gcacgaggcatgggcaaaccacacctaccgtcatgaccgcccagatgcgtcatgtgttggtctttggccttgtccttggcgtcttctgcttcttcacgggggtcttggcccacgaggagatcgtaaccggcgtccccaagcccaaggatttcgtcttcaccgacgccaacaccgacgacgtgcaggccatcaagctgctgctcaagtactgc

SEQ ID NO: 29753 - DNA, 551 bp, Sorghum bicolor
  Clone ID: 9304035
gcacgaggccacctgactgcacggaccattattgagatcgatcctttgagttgagcagagcagctagccagccagcacttgtacatacgttgttcctgtgccacgcgaagcgcggaagatggccgccgccggcattgttgtcgtcctctgcatcggcctgttgtcgtcgtgcgttggccttggccttgcgcgcggagacttctccatcgtgggctactcggaggaggacctgtcgtcgcacgagagcctagcggagctgttcgagcggtggctgtcccgccaccgcaagggggcgtacgcgagcctggaagagaagctccggcggttcgaggtgttcaaggacaacctgcaccacatcgacgagaccaaccgcaaggtgagcagctactggctggggctcaacgagttcgccgacctcacgcacgacgagttcaaggccacctacctcggcctaagccccagcggcggcggcggcgatgtcgtccatatgcatcatgatgatgatgacgaggagccggaggaggagggctcgtcgtcgtcgtcgtccttcc

SEQ ID NO: 29754 - DNA, 598 bp, Sorghum bicolor
  Clone ID: 9304047
gcacgaggccgcagccccgccatcccgctgttcgataggcacccgaagcgcctattcgagcccaccagaagcgcgtgcgataagcccagagctgattgagaaacctagagctatttcatcatgagcggctggggtatgggttggtttggcggtggccaggcgaagaaggaggcgcccaagaaggccatcctccagcttcgcggccaactcgagatgctgaacaagagggagaagcacctgcaaaatcaaatggacgagcaggatgccttggcgcgaaaatatgtgtctagcaacaagcaagctgccaaaaacgcgttacggcgaaagaagcagtttgagcactccctcgagcagactagctcccaaatcatgagcctggaacagcaaatctactcgatcgagtcggcgaatatcaacaaggagacactggatgctatgaagaatgccggtgcggccatgaagcagatacatgctggcctgaccattgacaaggtcgacaacgtcatggacgacctccgcgaacaacacgccattggtgaagaaatcagcgaagccattacctcgagcgtcgccaacaacgccatcgacgatggcgaac

SEQ ID NO: 29755 - DNA, 580 bp, Sorghum bicolor
  Clone ID: 9304068
gcacgaggattcctctcgccttggtgggatgacatttccaagtctgctcaagaccttgtttcccacctgcttaccgtcgaccctgaaaagcgctacgacatcaagcaattccttgatcacccttggatccgccagtccgacgagcagactaccgctgctgcagatgcacctcctcttgccaccccactcgccacccgtggtggttctctgtctgcgggcgaagaacctctgaagcagaacttcgagtacctcgaggatgcacccggtggtgctggcaagaagcaggatttcagatcgcccggtgcagtcaatcttcgcgaggtgttcgacgtcagctatgccgtgcacagacaagaggaagaaggcaagcgtcgcaagaatttcacacaaggctaccgtggaggtggacccatggactcattgaaccctctcaacgaggactacgaagaagagtacgaagaaagtgcatacgccaaccctcctgcgaaacttcccaagtcgggtgctcctgatgtcagcggtgtggagaagcagatgcgcaacacatcgctatcttccgcagcacaagcgagacaagcgg

SEQ ID NO: 29756 - DNA, 280 bp, Sorghum bicolor
  Clone ID: 9304080
gcacgaggaagaaaggaaaagcagctaggcggcaggcagctgcaccacgcacggtcgcacgcacgtcgcccggctgccggccatggggttcccgtcggtgtgctactgcgtgatcctgccgcagccgctgatcctggtgctgcagctgctggacttcctccggcacgccgtgctgctgtgcctgtcctcgctgggcctcgcggcgtcgccggccgacgacgaccacccggcctactacgcggccccgccggcgccggccgacctctgggcgctgcagccg

SEQ ID NO: 29757 - DNA, 641 bp, Sorghum bicolor
  Clone ID: 9304082
tcatcacagagctcacgcaccaccagagccgagaggaaaggcgactatagcaggcatggcgacgcgggcggacgtggagaagggcggcgtggtgaggaaggagcccggcaaggtgccgtcgccgctgtacccgcagcacgagggggagagggagtgggtgccatggatcgtccccgtcttcttcgtcgccaacatcacagtcttcgtcatcaccatgtacgtcaacaactgccccacgcacaccaccacgccgcgcgacgccaagtgcgtcgcacgattcctcggccgcttctccttccagccgctgcgacagaacccgctcctcggaccatcctccgccacgctcaccaagatgggggcccttgtttgggagaaggtggtgcaccaccaccagggctggcgcctcctctccagcatgtggctccacgccggcgtcctccagctggtcgccaacatgctctgcctcctcttcgtcggcatgcgcctcgaacagcagttcggatacgtgaggatcggtgcgatctacatcctgtccggcctaggcggcgccgtgctgtcgtcgctcttcatccgtaaccacatctccgtgggtgcctcaggcgcgctcttcggcctgctgggcgccatgctctccgagctca

SEQ ID NO: 29758 - DNA, 540 bp, Sorghum bicolor
  Clone ID: 9304094
gcacgaggtgtcgtttggcagacgggctccggcactcagtccaacatgaacgcaaacgaagtcatttccaaccgagccatcgagatcctcggcggaactatgggtagcaagaagcctgtccatcccaacgaccacgttaaccgcagtgcctcttccaacgacaccttccctactgttatgcacattgctgctgtccttgatattgagggcgagctcttgcctgccctccacagcctccgtgctgccctgcagaagaaggttgatgagtttgaagccaagaagattatcaagatcggtcgtacccatctccaggacgctacacctttgactctcgcccaagagttctctggttacgtcgctcaactcgactttggcatcaagcgtgtagagagctctctccctgacttgcgtctgctcgcccagggcggcaccgccgttggcaccggcatcaacactttccagggcttcgctgaggctattgccgaagaggtcaccaaaatgactggcaccgagttcaagactgcccctaacaagtttgag

SEQ ID NO: 29759 - DNA, 283 bp, Sorghum bicolor
  Clone ID: 9304100
cggcgtcttcgatgggccctgcggcacgcagctggaccacggcgtggcggccgtcggctacgggacggcgggcaaggacaatggccatgtggtggcggactacatcatcgtcaagaactcgtggggacccagctggggtgagaaggggtacatccgcatgaggagaggcaccggcaagcgccaaggactctgcggcatcaacaagatgccctcctacccaaccaagaactaactgatatatatatatatatatatatatatatatgatgatccaactcgatca

SEQ ID NO: 29760 - DNA, 336 bp, Sorghum bicolor
  Clone ID: 9304106
gccttatttttatcagcaaaagaaagagctacagccatcgccagaagcaagctgctattgttcgcaatatgagattgagaaggctggatcctagagccaacccacaacaaacaagcggagctaggaaggcataggcaacttagtgttactcatagaggattcttggacttgtgtgtctacttttgtggatctatataatcaatcaactatgaacaatagattgtagtctgtgtccccctcggtgattagatacaccagatacgacctccttgtcagccttatatagaagaagagttatataagttgtcactgagtattcatggaatgcagaactta

SEQ ID NO: 29761 - DNA, 418 bp, Sorghum bicolor
  unsure (1)..(418): unsure at all n locations
  Clone ID: 9304113
gctcatgcgcccgcacttcgggtggatggagcgatacagcatgcccgccggcgcaccctgcaccgccaggaagtacctcgcttaccagtggatcctcntcgccgtcgccctgctcctcctcgtcgtcggattcgcggtcggcatggcgatggtcttccgcggctccaacgccaacgacagctgccactggtgtcactacctcagctgcgtgcccaccgccagatggaactgcaccaactgatcatccagcagcagcacgagttgccaccttttttaattcctctctctccttcgtatatcctacccagcttgtcatgcatacacatactacacacagttgtaattcctttcggccggggtactgttactgtagatagcttctttgatgggggttgtgaactgtagagtcccgttgaga

SEQ ID NO: 29762 - DNA, 355 bp, Sorghum bicolor
  Clone ID: 9304126
gcttcttccgcagcacaagcgagacaagcggcggctcttaggcagcaacctgctgcgagaggctatggccagcacagccccgaggtcgctgcggcagcgaagaagcaagttcgtaacaagggccccttcgagcttaacatggagggcgccaccttgctgggtcgccgtggcaagaagggtcccagcaatctgcgcgaacagatggttcagtaatccactcgccaccaggcgaagattctgtgtcgtcacattcgatgcaggcgggaccactgttgcgaggaactctggtcgcattcttgctatctagaagcagctacttgagccaataatgcgggagaaaaggcaagaaaaagtg

SEQ ID NO: 29763 - DNA, 444 bp, Sorghum bicolor
  Clone ID: 9304148
aaaactcccccaagcacccaatgcgaaccccaaggctccgcagcgggtcgaggaagacgacgaggaagaggagctgcggaagctacaggctgagatggccatgtaagaagctcggcgctgtgtgtgtggaaatccatccagagagacatagacatcgctagcttgggcgcgaatgagatatacagtcttcaggcgtacggcgatatatggtcagaagcggggacattttgaggctttgaagccgcctcctcttttttcttacttatccatccattttgttctccttataatcacggcatctgacttgttttttcttttttctttttcctaccctgtgtgttacgggatcactccgcatcagatggtacccaccaccaccaccacgagcccccagatttacgaagtgcttattttttggtgggaaggtttaccgcagcgaaagga

SEQ ID NO: 29764 - DNA, 373 bp, Sorghum bicolor
  Clone ID: 9304153
aacctcctgcacagctcccgccttctgacagatggcatgcgctctttcgagaagaacctagttgctggtcttgctgctaacgaggagaagattgccagcatcatgaaggagtcgctcatgctcgtcacttgcctgaaccccaaaatcggttacgacatggccagcaaggtcgccaagaatgctcacaagaagggtctgaccctcaagcagagtgctctcgagctccaggctttgactgaagaggagtttgatactcttgtcaagcccgagcttatggttggccccagcccctacaagggttgaaaattgctctaaaacaaaatcgtgatgccatgtatcaaaattataaaagcgctcgctcatagatcttttt

SEQ ID NO: 29765 - DNA, 564 bp, Sorghum bicolor
  Clone ID: 9304168
cgctgcctctccggtcccgagctaccgcttcccgttcgccgtgctgcgagacgcgaccaacgacttcgacgagcggctggtcatcggagccggcggcttcggcaaggtgtaccgcgcgacgctcccggacggcaccagcgtggccgtgaagcgcgcgagcccggagtcgcggcagggcgcgcgggagttccgcacggagatcgagctgctgtccggcctgcgccaccgccacctcgtgtccctcgtcggctactgcgacgagggcgacgagatgatcctgctgtacgagtacatggagcacgtctctctcaggagccgcctgtacggcgccggcgccgccacggcggagcgggcgctcggctgggcgcagcggctggaggcctgcgccggcgcggctagggggctcctctacctgcacacggccctggccaagccggtgatccaccgcgacgtcaagtcgtccaacatcctcctggacggcggcctcgccgccagggtcgccgacttcggcctgtccagggccgggccggagctggaggagacgcacgtcagcacggcggtgaa

SEQ ID NO: 29766 - DNA, 551 bp, Sorghum bicolor
  Clone ID: 9304204
gcacgaggctcttcttgaacaagactcattagcaatttctcctttttcattttacagcatggcagccgcagcagttcagacttacactcccgcgtcctacgaccaccgcgccgtcgatgccatgacggacgttgacgtggccgcccagcgactccaggaactcaatggcttggatcacatgaagtcctgcatcagagatgtcttcatgaagcacggagtcgacaaggtattcggtattggtctcctccaccgccattacgacgttgcacccaatgagaagatcatcgagcttggccctgtctcctcgccctgggttgtaggtgatgacgaagccatcactggtggctcagtcctccctcacacctggcgcgtctttgatggcgagctcaagcccacagagttcaagttcgtgccgcagcgcgagctctccaacgtcgatcgacctgtcttcccagctgcctttgttaaagagctcatcggcgtgctgcaagagacaggcctcgatgaggttctgggcgtgagcctgtatgaggctggcgacccagataacg

SEQ ID NO: 29767 - DNA, 522 bp, Sorghum bicolor
  Clone ID: 9304217
gcacgagggtagactgctcaggattttgtcaagaagatcatacgagcaaagtcagtagatatccagatgttcacattcatgccattgtaggcgcttgatgtgtgaaagcaaattttggtagacacacatggatgccaggcaacacaacaaaaataggtgacaaggactgcaacttccccttctgttgcttctgtagacattaggtaactgctaatgtcatctatttgcttttgtttctattttgcatttgaagctaagagataaaatgggattgtccaagggtaattcgcctgaatttaaaagataggttcattaatatgtcatcctaaactcgacacagtatatgtacaattttataataaatggtctacccaaaatattatcttagacaaaatattacatgctctcttttatttttctaggtctaaaacttgatccacaatgctcatgatgttgaacttaggcaaaagaactcatggctggcaaaatgattgcaaatctaagactctggctgcagagctc

SEQ ID NO: 29768 - DNA, 471 bp, Sorghum bicolor
  Clone ID: 9304232
caacatagaattattaggaagaaaaaatgacggcctgccgtgaacgtggaggcgactctaaaataagctccagaggtccttgagtaaccatttcttgtgcgatgagccgatgaaccggagcgagcgaacgctaaagccgcatttggagtccctgacctcgcgtcagatctgcatatgcaggtcacaacgcagttgtagttgccagtggcagctgtgttagcaagcaagaaggctagctagctagctaggtacaagcacggcgccggcggagagggagatcatggagtcggtgaagatgagggcggcaatggcgacgaagcgggagtacaggaggatggaggtgggcgaggagggggaggagctggacgaggcggagtgggcgcaccgtgccgaggcgcagatgcagcggcgcaggcggggccagcgctacgccttcagctgcgcgctcttcgcgtacctcaacgccatcct

SEQ ID NO: 29769 - DNA, 726 bp, Sorghum bicolor
  Clone ID: 9304242
tgcgcagcaaaggcgagtgaaggtgtaaactctcgtcatggtatctgtgctgctagatctgctgatgatggcttgaaggcccagcacggtatttgcgctgtaaaggctgctgacggtggtctcaaagctcaccatggcatctgcgccgtaaaagccagttctgacggagttacctctcgtcacggtatctgtgctgccaaagtggctgatgacggaatgacagctcgtcacggcatctgcgcggcaaaagccgacgacggtttcacagcacggcatggtatctgtgctgccaaagctcctgaggaaggcttaaaggctcgccatgggatttgcgccgccaaggccgctgacgaaggaatcacggctcgtcatggcatttgcgctgtaaaggctgctgaaggcctcaagacctaccacggaatctgtgctgccaggtctacggaagacggtgtcaaggctcatcacggtatttgcgctgtccgcactgcggaggatggcatcaaggccaagcatggaatttgcgttgccaaggttgccgatgagggtatgacagctcgccatggtatttgcgccgcacgttttgctaatggggctggaatcaaggtttagaatggtagttttcatcatcttttcctattgtcctattgtcatagcgtatactggggaggagtgagccgagtatatacgattactgcctgtttaagaagacacgtgtagagagaatag

SEQ ID NO: 29770 - DNA, 532 bp, Sorghum bicolor
  Clone ID: 9304262
ggcgcccgccaacgcctaccgcgtggccgccggcgacgagtccggcagcggcggcgacgacgacgacgacagccggagcgagtgctcctcgctcgacgacccaaagtacgtgccgttccaggccaacaacatcagcttccagaagaggcaggcgctggtgacgtacctggagaacaaccgggcggggatcacggtgtacggcttcgtggtggaccgggcgtggctgcacgcgctcttcatgatcgagttctcgctcgtcatgtggctgctcggcaagaccgtcggcatctcctgaaccccatctttttgcctgctcctgctgtcagatgcagagttttcactggaggaatgtacaaattgagtgcagatagaagatattctgatgcctgatggagaacaaaacaactgctttactttgtaggttcattcgttactttgttagctgtcgatagtgagcatgtgagaagttgtccaggttttttttttttttgacgagtccatagccccccatgaatgactcgaaccactgtct

SEQ ID NO: 29771 - DNA, 446 bp, Sorghum bicolor
  Clone ID: 9304263
aatgaatatcgtgtatactaatctctgtgaatagtgatgctttcatatgcacaaaaatatgtacaagtacacactaacactcatgagatctacattactttcaagcaaaggtcatcaggccctttctggtcgcgcgcaggggcgcgcgtttcctactagtggcaaaaccatagcggaaagcatgtgcaccgtcagagacatcgttctacatgccctcgataaaccaaatctacacgctcagaagccttgatacggaccaatatgtgttagagaggggattccggatgtggcagatccaacagccataactgacgagattccagcgaagggtggcctagcaaagggaagttccgcaccggcttcacctccacctggatccagcgagagttttgcgcaaggaaggcagacgtggaaatcaagcaaaatcatggtcggttaaaatagag

SEQ ID NO: 29772 - DNA, 422 bp, Sorghum bicolor
  Clone ID: 9304278
tggcagggcaggggcgagctggacaagatcgtcgaccgccggatcgccgccgcggtgaggccccaggcgctgaggaagtacggcgagacggcagccaggtgcctcgcggcgcgcggcgcggacaggccggcgatggaggacgtcgtgtggagcctgcagttcgtgacgcggctgcaggacgacgacggcctcgagttctccgacgtcaacagcctgagcctggtgcgcgagctgatgccgcctttggattctcgtcggacaagctcgcatcagaacgaagccgggtgcgaggagggagagggtgccactgacgccagcttcaccgatgtcgatgtgtccgtgtccatgcgaggtgtcttctggcagatggtcaatgtgggcggcagatgaagcatagaacatgctagaaggccaaaataagg

SEQ ID NO: 29773 - DNA, 483 bp, Sorghum bicolor
  Clone ID: 9304304
gcacgaggcttcaactaccgggcggccgtgctcgccgacacgcgcgccgccgccgccgccgcgggtgaccccgcgctggcggggctggtggagtccggcgcgctcgtgcgcgtcccgcgtcggcggttcggcccggtcccggcgtggcgcccgccggacttcgtggagcccgacgaggtgtggatcctcggcacctcgcacctctccccggactccgtcgccgacgtcgagcgcgtcctccgcgccgtccaacccgacaacgtcgtcgtcgagctctgccggagcagagctggaatcatgtacgtgtccagtgattcttccgacgagccgctcttgaagtctaacatgttctctctcggtggctccaagttcttcggtgcagtcaacagaagcatcaacctgtgtgggcagagcgcctttgctctgcgtctgctcctcgctgttttttcttctaaaatttcttccagtgcgaaccggccgttt

SEQ ID NO: 29774 - DNA, 578 bp, Sorghum bicolor
  Clone ID: 9304311
ctaatagcaccatccaagaggaacagaaacctcttgctatttgggacttgggagctgggaagaaagcgagggaagatggagcagagcatgatgcttccgagcgccgagctgtcggcgtccaacggcggcggcggcgccagtggcctgccgaccctgccggacttcttgggcaggaagagcaagtacgtgcgcatggacgacgtgctccctctggagcaggaaggcgaggacggcggcggcgtctgtgtccgtgagcgccagagcagcaggagatatgtcttcgcctgctccgtgttcgcctccctcaactccgttctgctcggctacgagggatcttcacatcaacgaggtgcagcaggaggtcctggtgggttgcctcagcttcatctccctcctcggcagccttgccggcgggaggacatcggacgcattgggccggaagtggaccatcggcctcgccgccgtcgtcttccaggccggcgcggccgtcatgacgctggccccgtcattcggtgtcctcatggtgggccgcctgctggccggcatcggcatcgggttcggcatcatgatcgcgccgg

SEQ ID NO: 29775 - DNA, 516 bp, Sorghum bicolor
  Clone ID: 9304316
ggcaaattggaaagcactgcggttctcaaagcgatctgtgctgggttcaaggagtccactgaacctcatgtctgcctgacgcccggcatggaaactgacgagtgcctcaacaacaacggcggctgctggcgcgacgagaagaccaacgtcaccgcctgcaaggacacttacagagggaggatctgccagtgccctgtggtggatggcgttcagtaccaaggcgacgggtacaccgactgcaaagccgtcgggctggggcggtgcgccatggacaatggagggtgctggaaggagacgagacaagggaaaactttctctgcctgctcggatccagagttgagcggatgcaagtgcccgccggggttcgagggcgacggcttccattgccaagacgtcgacgagtgcagggacaagttggcgtgctcctgcccgcactgctcgtgcaagaatatgtggggcggcttcgactgcaagtgcaacagtggcatgatctacatcaagaacgaagacacctgc

SEQ ID NO: 29776 - DNA, 485 bp, Sorghum bicolor
  Clone ID: 9304324
gcacgagggtttgtagagcttgcttgcttgtgcagaggtcgatgggtgccgcgccgggaggaggccgtgtccctgcccgggccatggcggacgccctggaagacgtgcgctccatcctgctgaaaccgtcggagcgcctcgacgacaagcgcttcacgaggatcgccggcgccgacttcgacgacgcgagcctcggcctcgcggagctgctcgcctcgctcgcgtccacggggttccaggcctctaacctcggcgacgccatcgacgtcgtcaaccagatgttggactggaggttatcccacgagaagccaagcgatgattgtgctgaagctgaacttgatcctgcatatagagagtccgtcaagtgcaagatctttctgggcttcacatctaaccttgtgtcttctggtgttcgggagattatacggtttcttgctcagcatgccatggtggatgttattgttacaactgctgggggtatagag

SEQ ID NO: 29777 - DNA, 572 bp, Sorghum bicolor
  Clone ID: 9304331
cttcagcggacatttatgaaagccgttgagaaccttctgaagcgtccgcgacgtctcatcaagaaagcggatgatacccgctggttcttcatattgcttgccaaccctctgttatcatctcctggtgcttattcgccccatcgacctgcacaaggagtgaatcgggatgctcgacgcccatcccatccgaatgaaggaccacgcccgactacgagggacagcaagtcttcccacaaagaccagaaccgccatggaggcgctcataaccatcatggaatcgtgaagcgaatcctggggttgatgtcgaatgcttctcatgaatgccatcaccatttcatctcttggttttctcggtattctccgagtcaattcgaacggattgtggagttgataaatggtttcgtcacttatcggttacttcgtcagcatggccgtaagcggagcgaggccacccacgatggagatgatcttgtcccaagtttcgccagcgctgcgggtaccacccctgcagaactacatgcagctatcaacaatcgtcgcagccccaacaaaaaacctgcgaagaaaaagga

SEQ ID NO: 29778 - DNA, 286 bp, Sorghum bicolor
  Clone ID: 9304340
gcacgaggggagtatataattgcgtattccatctccacccggagtccaagatctgataatgctgtctgcctgcctagctttcatgcaccatgattcatggaaggcgtgatccaacgcacatgacgaatacgccagtatataccagcgtttccccccatagtacatgttctttgggattatattacgtacagtatagctgtcaaattcaaatatattcatggagcagtacgctccacatctcagccttgagaaatacatgcacggatggatctatctaccgaaattg

SEQ ID NO: 29779 - DNA, 543 bp, Sorghum bicolor
  Clone ID: 9304341
ctctttcggcgttcttgttctgcctctagcacttggtgtgctctacgacaaacaccgcgggattgacgcaaggcccgagctcaatggagctacggcaccactccccattttctccttcatcaccaattacatcgaccctcagaacttttactatcccattgttgagcagcttgtccaaatggtccaccgagttttccccttttctcgtggtctctttgaggacaaggtcgccaacttctggtgtgccctcaacactgtcatcaagctgcgtaactaccccgtcgagcttctccagaaggctgctctgggcgcaactcttttgtccatcatccctcctaatctcatcctattcttacgcccacgcaaatcagctcttccggttgcctttgccgccactgcctggggctttttcctcttcagctggcaggtccacgagaagagcgttcttcttccactgatgcccatgacgctgctcctggccgggaaacaaggtatgagcggcgaggtccgtgcctgggtgggctttgccaatctcttgggcgc

SEQ ID NO: 29780 - DNA, 133 bp, Sorghum bicolor
  Clone ID: 9304360
cttgatggtggattgaaccagcaaagaatggggatatgtgatgccgttgcagcttgcaaagattcttaatgctactcttgtgatccctcatcttgaagtaaaccctgtttggaaggattcaagctcattcgaa

SEQ ID NO: 29781 - DNA, 314 bp, Sorghum bicolor
  Clone ID: 9304372
cgattccgacagactgtccgcactgttcctggccaaggaggccccgccggtctccagaaccagcagggtgtgcccgttcctctgcctcagggcaacagccaatggacagcgcaggacccccgaccacaggagtatcagggccatggaaacacgggactcgagcaggatctccagggaggactggatgcctccaggagatgagcaagcatatttgtttatgacaagagtcggatagtgtcttagaggaggttcagaaacgtcgtttcaagttcaaaatgagagagatactttaggacaaggaaacaagaatacag

SEQ ID NO: 29782 - DNA, 398 bp, Sorghum bicolor
  Clone ID: 9304374
cgcgccccgtgctcctcaaggtcaccgacaccgaggacgaggctaaggagaggctcgccgagatcgaggctgctgcggcaggcaccaccacgggcgccgctggcaagtacggtgacaggacggtgtggcaggagctctcgaggccatccccggtgatcgcccggatgctcgtcaccggagtaggcatccagtgcttccagcagatcacgggcatcgacgcgctggtgtactacagcccgaccatcttccgggacgccgggatctccaccgagcgccagctcctcgccgccaccgtcgccgtcgggttcttcaagacggcgttcatcgcgctggccatcgtgctgatcgatcgcgtcggccggaagccgctgctgtacgtcagcacggtcggcatgacc

SEQ ID NO: 29783 - DNA, 593 bp, Sorghum bicolor
  Clone ID: 9304378
ccctggtcctgtcgtgcgtcgccggcatcggcatcgcgggatacctgttctacaagttcaggctcagggtaggggccgaacaatctcttcccaaacccaggcagaaacattaggttctctctttcttccagaccgtggattcgcccggtgtcttgtgttgcagcgatacatggactcggagatcatggcgatcatggcgcagtacatgcccctggacagtcagcacaacgagaaccagccgctgaggacggaggaggcccagcaagcgtagctaggcatgtgacatcttcaatttcacgtgtctatatctcacacgatgagaaaacagcataactaaccttctttccacacttggtgaagttatccaaagccatcatccacggagttttgagatttgtaaatgttgccccacaatggcacaatgtacatgacagcggttcacacagatcttgcacgttctgcatctgttacagagaggtatacacaggtatagagaaagaaacatagattagatgatgagacgtgatcagttaagtggtgtataaaatttgagatggtgctgtatgtagagttataaactgcagaccgacagg

SEQ ID NO: 29784 - DNA, 441 bp, Sorghum bicolor
  Clone ID: 9304384
gtctccgacatccccagaggcttactcgccaacgagtccaagcttctccaaaagtcctgggtcgcagcaatctccaactagccctagctattcgcccacttcaccgtcattttctcctcggactcctggtccgggagcttcaggcaaccaatactcacctaattccccagctaacgattgatttatcttataatgcatacagggcacattttttgcccttggttttatcgatttacccctttctttatttgcgcgtgtttctctctctctcttattgttctcatggtggaaggcttgtgaggacttcagcatgatagacgttttatgcaggctgtagcaaaagccaaaagtggataaaaaagaaatacctgcacaaaaaaatacaaatggttttgtcaatttgcgatcctctcagcggagatattagaaacggatgatggt

SEQ ID NO: 29785 - DNA, 584 bp, Sorghum bicolor
  Clone ID: 9304401
agcctcctggaacgcgcctttccaagaaggacagtccaagctcgtccaatggggcaccgctctgctacaaagcactttctatgtaaccatggcggcgtggcacgttgtcgaggcctttgtcgtgccgccaccaggcaaacctgatttgtgggttgtcgccaacgtcggtgtaggtgcggctggcttctctatctgctatctgtggtgcctctggaggcttttgcgggagacggaattcttggcaagcactcccaagactaaagcgaagacgcagtagaagatggttataggcgtgtgccgtgatagttggagatgaaacaagccgaccccctcataagctctacacatcccgtcgacttcagatgacgttggtctagagcagctgcctagggagagatgcgttgtgcatcaaagatgttcgccactagagatagaatatgcatgttggactttatgcttcgttcaactccggcaacacacaggcagcagcggttaggtattggtggaagcaacagattccattagaagagagggaccgaagatcaaaggattggtcgatgaaagcctcaatacccagaatagat

SEQ ID NO: 29786 - DNA, 559 bp, Sorghum bicolor
  Clone ID: 9304590
gcacgaggagaagatcaaggtgtcgctagcgttcaaggatccggttgaccctgtagccctcaacatcccaacttactatgacgttgtcaagcaccccatggatttgaccaccatggaagccaagctgaaggagaaaaagtacacatatgtgagggatttcatggcagatcttgatcagatgattaccaacagcgaactattcaacaacaagcagcatcctgtcacacaggcaggatacaatctacgagcttacttcttaaagggcatgggtaagatgccccgcggcgctgcggctgaagagcctcccaagccggcaaaggccaagaagccgacggtgaatacggcacagaaggcgaggcgtgagtcacgcgtcgcaccgcccaatgtcaagtctccagccgcccccacgccagcggcgacatcaccacaggctgcttggccgctgcagcaggatggcactccgctcattcgccgcgattcatctactgctgacggccggcccaagcgggaaatccacaggccgtccaaggacttgccctatgcgaatgctaagcccaga

SEQ ID NO: 29787 - DNA, 499 bp, Sorghum bicolor
  Clone ID: 9304605
gcgaaagggacgcgcaagcttcatccacaagaccctccctacaccacacacccaccctcgatctcctacataattgctaaccacgctgctgcaattcactcctcatcagtggctcaaagacctgcaccaagcagctgaggcaaagctatagtttgtccccagcaccttagccttaggactctcggcgttgataccgtctccggagctgctggcaatggcgcgatgccaggggaccgtcgagagcctctgccaggggctgctcgacctcgacgacgacaggttcagcgcaatgtgcagcgccttcggctacctccaggagtggccggacctgggcgccatgtgcggcgcgaatctcgccgtgcctgccgtggcggcggcggcggcaccgagcgccggcgacggcaacgactcctcctcttgcagcggcagcggcgggatcaggaagaggagaccggacgcgtacctcgatgccaagggtggtgcaaacgacatgagcaag

SEQ ID NO: 29788 - DNA, 529 bp, Sorghum bicolor
  Clone ID: 9304642
gcacgagggtcgctgcatgcatgccgctgatcaggccatgcatgcaggcagcaaccatgcaagtcctccagttgctgctcccattgttgttggctctggcgccggtgtccatcctgctcgtcgtccggcgtgcaacgccgccgccgatcaaagcacgcctggccaccctcaaatctgccatagcacgtgcacgtaagccaattatcttcgtcaccgacttcgccacggcgcatcacctgctcgtgcggggcagcagatcaacaaccgccgccgccgccggcggcggctctttctccaaccgcccgccgtctatggcacccagcgccgtcctctcgggccgccgctaccacaacatcaactcggcaccctacggccagctctggcgcgccctccgctacaacctcacctcgggtgtcctccacccgacgcacctgcaccgctacgcggccgcaaggcgccacgcgctacgcggcctcgtggcggacctcagcgagcagcagcaggtcgccgccggcgtggtgctcgccgc

SEQ ID NO: 29789 - DNA, 618 bp, Sorghum bicolor
  Clone ID: 9304677
aagaacaagcccatgggcaagtcggagcaggaagacaacatgcgcaagatccaagagaagttgcagtcgttccagggcggtgcatcgggatccagccagtctccacctgtgcacgatgcatctagcgacgacgacgagtcgagcggctctgaaagcgaggaagagtaaaacctctttggcaacaccgtcttgtttccgcgtgacctgcttcgtctgccatgccctgttctgccctgctctatccctgcgtgttttgatgattggtccagttttcattcatcacttctcttccctgcatgacatgaacagtcttgagcttcttggtccggccgatccggcatcgttgccgatttaccaaagggctaaagctgaatgttagtgcgtgcctaatacctgcgcgcccccggcccactcaccattgcacctcatccatctcatgcccgcatacacatcgattgtatagtattctcttcccccgccgacttgcctctagaggtgccttgataacggtaccaatgccgacaatggattacgagtgatgacgaggtttgtcttttctggtggtggtccgtttagtcgacgacatggggtgctccttgtaaccagcatttggcgcgc

SEQ ID NO: 29790 - DNA, 610 bp, Sorghum bicolor
  Clone ID: 9304691
gagctggtgcccgggtgcagcaaggtcacgggcaaggccggcatgctcgacgagatcatcaactacgtccagtcccttcagaagcaagtcgagttcctgtccatgaagatcgctgcttccaacccggtggtgagcttcgacatcgtcgaggacctcttcggccggcagctgaagcaggcggcagccctgcccgcgatggctctgccggccgggcagctggagccgtcctgccttcagatgagccccatgcagcaggtgcacccatctgcagccgcaggcggctccactggctttgggcttgagatggtcgtcaacaacctgtacgcgcccgccgccgcgagctgccctgtgtccgctgcgccgtcggtatcggcggctgccggaccgtcgacgatcgagccgtgcctcaacgtgaatggaactgctgctgctgggatattggcgcccagaatttgttcagcggttttgatgcacaatttcagtcagtagaaagtgactgtttgctagacaacctcaaaatggaaatgtaagaagaattaatcctcattgctggagttttaaccacggcaaaatttgtggctgaagattctttattcatagcaactgtaat

SEQ ID NO: 29791 - DNA, 469 bp, Sorghum bicolor
  Clone ID: 9304725
tcatcttggaggcgctcaggctgcatcccaccaccaagttggcatttaggcaggtgacggaagaagaccaagtggttcatgatggccaccgtattcctgcgggcaccaagatggtcttccccttggaggctttagcgagggacaagacagtttgggatgaccctgatgagttcatgccagaacgtttccatggatgtggaggtggagaaagcacgaaaaagctgctgtccatggcagcagagatgaagatgatgccttttggtggcggccggaggatgtgccctgctataagcgtctcgttgctccacatcagctacttcatggcaaaccttctgagggagtttgagtggagggaagcagacggtgagcacaccattcaactccacaccgatcctgccatcgagatgttcaatttcatgaagcgtccaatgcgtgctcaccttgtgattcgccgacagaaaggcacaaa

SEQ ID NO: 29792 - DNA, 382 bp, Sorghum bicolor
  Clone ID: 9304727
tcatagatgcgtataacaaaaggttaacttcatctgatcctattgttcaggttgaagctgctaagcgctggacgatgtgggagatgatgactgcccatcttatccaaaacaatgataacattaaaagaggagaagatgacaagttttcactggcatttgcaaggattgaaaatcactattttgtgaataagggttttttaccctccgactcattcctattggacaatgttgacaagatccgacatattaaagcttttattgtacagggccgttatgatgtttgttgccctatgatgtcggcttgggatcttcataaggcttggcctgaagctgaattcaaggtggtaccggatgcagggcactcggccaatgaagtaggcat

SEQ ID NO: 29793 - DNA, 592 bp, Sorghum bicolor
  Clone ID: 9304761
gcacgaggctccttcgagaagtggtttgaactgaaagctcatggtgggcatgccacttcccctcctgttagtcttcgtgttgcagcttctgctactgtcccaagcagctttcagaaggtgttcagcatggtcatgatggagcctttctctctgaagtcgtgtcttctgccacattccatcaaggatcaaaacatgagtagctggactcgtttcgtatatgattgtggtaccgagcttatccgtcttcagataagagagcaaaaggcaaagaatggcatggctgctgttcgggaattggtcggagtattgaagtcaccaaaaaagcaatttcagcttgcagaattcaaggaaaataagtggaccctaaaagactccatgctgtcaataactcatggcactgatggcagtctactcgatctcaaaggtgacaaccaactgatcaagctctatcagggaaggaaactagaatacgagcgcaaatgctgcagcgctcattctgaggatgtttcagctgttactgctgtaaagttctgtgctgaacatccatatggcaaagctgttgccttgctagacactgaatctcagcttatca

SEQ ID NO: 29794 - DNA, 149 bp, Sorghum bicolor
  Clone ID: 9304765
ggcgcttcctccggtccccacccggcggtcgcgctgcccgattcggacgacggcgtccaatgggaggaggccacccggtgctcggagccaagcgtgaccgcgcgctgccgacgcggccgggggttccctgagctcggcgcccgacggga

SEQ ID NO: 29795 - DNA, 590 bp, Sorghum bicolor
  Clone ID: 9304802
caaaccgggcagcagcacggcagcaatggcgtcgagttcgaccctggatttggcgatgggccccggcgtcctcgtcccccgcagcgcggtcccatacgcctccttcgctcgaggaaggggaaggagcgcgagcgggaggaggagcaggaatctggtgctctccgcttccttctccaacggtgcagcagtgccatccctgacaacagactcagagaagaagggcccagtgataatggaaattccactggaccaaatccggaggccactgatgcgaacgcgtgccaatgatccagtcaaggtgcaagaactcatggacagtatccgtgtcattggcctccaagtacctattgatgtgctggaggtcgatggggtctactatggcttctctggatgccaccgctatgaggctcaccagcgccttggtctgccaaccatccgctgcaaagttcgtcgtgggacaaaagaaacactgaggcaccatatgcgatgagttggatgttattgatggccacatcagctacaaagtgatctgtgtatctagagcttaaacagaaccttctatgggttttttttttaccatcgtactgtaa

SEQ ID NO: 29796 - DNA, 640 bp, Sorghum bicolor
  Clone ID: 9304835
tcgccgaggccgacgtgtggtacacggccgccggcggcggcggcgacccggggagcccctgccccgcggcgtcccgccaggtggaggtggagggcaggagcgccggcgggcagcgcggggccccgcggcgcggcgtgcagggagggctgagccaggcgttcggggacgggcctggcgggcggcaagtggcggcgtcggcgcccgtcgaggttcccgcgtggcccgcccgcttcgccgtcccggacgcggagccggcgctgctgttcgagatggagatgggggacgacgacgacgagggcgacggcaagcggggcgccggcgggtgggtgccgccgcacgtgtacctggcgcggcggcaggagcgggcgtccgtggtggagggcgccgggcggacgctcaagggccgcgacatgtcgcgggtgcgcgacgccgtctggagccggacgggcttcgacggataacgatgaatgagcaagcgagcctggtggacagattttgatctgcttttgcttcctcctcctcctcctcctcttcgttttcattgcctctcagatttctctccttgttttattatttttttctctggatgaaatgaaaattttgtaacatggccggtgtgcttgttttggccaccgatcca

SEQ ID NO: 29797 - DNA, 619 bp, Sorghum bicolor
  Clone ID: 9304849
ggcaacgcgaccaccacgacgtcgtcgtcgccgacggcgtacgagatgctggagcggtacgacttcccgcgggggatcctgccggcgggggtgtccgggtacgagctccgcggggacggcagcttcgaggtgtacttcccgcgccgctgcgagttcctgctggcggggacgtggctggtccggtacgagccccgcgtgcggggctccgtcgcggccggctccctcacggcgctggacgggatcagcgtcaaggtgctcttcctgtggctcggcgtcggcgaggtggaccgcgccggcgacacgctcagcttctacatcggccccgtcgccacctccttccctctcgacgacttcgccgagagcccgcgctgccgcggctatgactatgatggcgatggtgatggcgctgctgccggcgacgacttattcccggcggcggcggtggcggcctcgtcgtgacccggcgcgatgattagtatttgtacaattgtatgtatgtacctgccgccttgatgatttagctggctatatacacgtgtgcatcgatcgagaattcgagacgagccggcgattagctacttcatcttcatttttgtttacagggaaattggaaattgga

SEQ ID NO: 29798 - DNA, 547 bp, Sorghum bicolor
  Clone ID: 9304857
cgacgcaagacgcgcctcgccggcctggccgaccgctgctgggtcatctacgacggcgacgccgacgccgacaagagtgccgccgccacgcccacgccgctgctctccgtccgccgccacgccaccagcggcggctgcaagacgctcgcccgcgtcgacgccgcgcgcctcgccctaccgctaccggccgccgcggcaccgtcgtacgtggtggagggctcctacgggcagcgcgcctgcgcggtgcgcgacgccgcgcgcgggggcgccgtcgtggccgaggtgcagaggaaggaggccgtgggcgacgacgtcttccgcctcgtcgtgccggggccacgcctcgccgcgccgctggccatggcgctcgtcatcgccctcgacgacatgttccgcggcggatccggcgccggcggctggtcggcgcggtcgctgctgggcaggaccttgtcggcgtagtactttcactagtactgctagtatttcgttacaagtattgtatgggtactgttacagcgaccccgggcccagttgtcagctcagcaga

SEQ ID NO: 29799 - DNA, 113 bp, Sorghum bicolor
  Clone ID: 9304870
tagcgcactgcgcgcccattctctggcgctcttggctcggcaattctcaaaccagcgtccctattgaaaacaaaatgccaacattggcaacaaaactgctgcagtcagtcatt

SEQ ID NO: 29800 - DNA, 201 bp, Sorghum bicolor
  Clone ID: 9304888
tcctcgtggccgtcgccatcgtcgcagtgtcgttccttgtcgccgccggggacgcgtccagcgtcgggttcgacctccaccaccgcttctctccggtggtccggcagtgggcggaggctcggggacaccccttcgccgcgcaggactggccagcccgaggctcgccggagtactactccgcgctgtcccgccacgaccgcg

SEQ ID NO: 29801 - DNA, 215 bp, Sorghum bicolor
  Clone ID: 9304897
acactgatggcttctgtatagcgatagtaaagaagcttggtgaattgtggtatcttggatataggagcctctgattagataagataaaaacccttcaaaaaaataagatgagataaaatagcaatcagattctgaaatccagagtcacgtaggatgcataaggagcaagttcttcaaggaacagagctcaccaactggctggctaaattctaaca

SEQ ID NO: 29802 - DNA, 483 bp, Sorghum bicolor
  Clone ID: 9304909
cccaagctttgcttgactgcgatcgatggagaccgccaccgtcgtcgtcgcgccggctccggtgtccatcacccagccgccacagcacaagcttatggaattgaagccagccttcgccgccgtggcgaaaccgtcgccggcgaggaaggccaagccggccaagaagaagctcgccggcggctgcggcgggtatgtccttgaggacgtcccgcacctcaccgactaccttcccgagctcaagagctacccgaatcccctgcaagaccaccctgcctactctgtcgtcaagcagtacttcgtgaaccctgacgacacggtggcgaagaagatcgtggtgcacaagagcagcgcgcgcgggacgcacttccgtcgcgccggcccgcggcagcgcgtctacttccagcccgacgaggtgacggcggcgatcgtcacctgcggcgggctgtgcccgggcctcaacacggtgatccgcgagctggtgtg

SEQ ID NO: 29803 - DNA, 423 bp, Sorghum bicolor
  Clone ID: 9304915
agcatccctatagaaaacaaaatgccaacattgccaacaaaactcctgcagtcagtcattcgttcgttcacgggtctgtcgagctcgacctgtgcggtgctgatgagtgtgctcacgtcttcttcgagccctgcaacgtgagaacacgcacgcaccggaagtagcgcagcagcggagtggattacgcatcacgcagggacaagggctgggggccgcatcacgcaggggcctgctggacgcatgccatggaggacgagcatccttttgctgcgtagcacgagtatcgccaattcgccattattcaatgcttcggttaccgacttgcactgtactatacctttgacaataaattcaatgcggtttatcaaacaaaccaaaaatcgatgcaaggctcgcagaggcaaccaccacctcccctcccca

SEQ ID NO: 29804 - DNA, 584 bp, Sorghum bicolor
  Clone ID: 9304935
acggacggacggacggatggatgaatggatggttgtggcagtcggtgacgctgcacacgaacctgggcgacatcaagtgcgaggtgttctgcgaccaggtgccccgcacggcggagaacttcctggcgctctgcgccagcggctactacgacggcaccgtcttccaccgcaacatcaagggcttcatgatccagggcggcgaccccaccggcacaggcaagggcggcacctccatctggggcaccaagttcgccgacgagttcagggagtcgctcaagcacaacgcgagagggatcatgtcgatggccaacagcgggcccaacaccaacggcagccagttcttcatcacctacgccaagcagccgcacctcaacggccactacaccgtcttcgccaaggtcatccatggcttcgaggtgctggacctcatggagaaagcgcagacaggacccggggacaggccgctcgccgagatcaggctcaaccgcgtcaccatccacgccaacccgctcgcactatgaactcaactcctgtcctggctgcctcatccagaaggatctgttcatggttagacctgcctgaat

SEQ ID NO: 29805 - DNA, 532 bp, Sorghum bicolor
  Clone ID: 9304940
gtcaccaccatggtaggcccctatcctaccatcgaaagttgcctcgtgccgaattcggcacgagggcgagggtccacgggccagcggcctccccttcttctcctgatctgttcatcgatctgttcgttgggggagagcacgcgcgaccgccctgccttcttctccgcttgatcgaaggcgctgccgctgcctgctgaggtgatccgtaacccaaagccagacctcctcgtcatgacccgaagccccaagatctagtaaccagtttgttactgcccacatccagaaagtgatccacaccgctagaaaccacaagcaaggcaaaggtaaacatcaggagcataggcgcaggcagccagcgcaagctagggcggtatgtctatcttcctcacagcaacatccactgctacgaggggctgtactttgtcgttggatgatccaacagtcctaggcaattgcatgcctttgattgtttggttattggaacaggaatgggaaagggatcagacatcagaccagcaagagtactttgtaa

SEQ ID NO: 29806 - DNA, 503 bp, Sorghum bicolor
  Clone ID: 9304966
ccgtggtcggttactgcctggcgatcatgaagaatgacctcggcgtcaatttcaacatcatcggccagaacttcatgacggggctcaaagtcgtcttcgaccgggagaaatccgtcctgggctgggagaagttcgactgctacaagaacgccagggtggcggacgcgccggacgggagcccaagcccagccccggcggcggacccgaccaagatcacgccgcggcagaacgacggcagcagcaacgggttccccgccgcggcgcccctgccgaggtcggccggctcgcgcaacgccgctgccagcgcgctgggggcgggaggcctctcgctgctgatgctggtagctgcaacgctcgtctgacgccggtgactgggattgttcacgccggccacggcggcttcctgctgtgcttgtgtacagactacagagtacagactatacagctcgattttggttcagagttcagacttctgatacatagatgattcattgtagttatat

SEQ ID NO: 29807 - DNA, 493 bp, Sorghum bicolor
  Clone ID: 9305025
cgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgagtgcccgagtcgtccaaggggagggaggagatcgcggccacggtgcgggaggtgatgcagggggaagggaagggcgccgcggtcagggcgaaggtggccgagctgcagaaggccgccgctgagggcctccgcgacgggggcgccgccgccaccgcgctggccgaggtggtggaagggtggacgacgacaggtggacaagaggaggaggactaggtggtgatggtgatgctgacgcgattggcgcctagcgatgctcctcgtcatcctcctacttgggccgggcccaccgtttattttggcccttgtgtatgtcttgt

SEQ ID NO: 29808 - DNA, 348 bp, Sorghum bicolor
  Clone ID: 9305092
accaatagcagcgtgttcttcctcctcatcattcttgcagtgttcttggagttcccgccgttcttggtggtgttgtgccagactggcagtcagtgcagcatgcatggcaacaggagcagcagccttcggcatcgtacaaagtgaccgtgcacttgttctggatcgacacgtgcaaaactggctcgtgtggattggattattgtactgctacgccattgtcttgagcatggaccacgccggccggccggcagctgctgcttggtatggagtaggtttttcaatttctttttgtgtcctgtgggagagcagcaaatgctgaaacttaagttttttttttgaaaaattaaa

SEQ ID NO: 29809 - DNA, 212 bp, Sorghum bicolor
  Clone ID: 9305186
acggcacgaggagcacatcattcatcatgggtaaagttcacggatctcttgcccgtgccggcaaggtcaagtctcagactcctaaggttgagaagcaggagaagaccaagacccctaagggtcgtgctctcaagcgcctcaagtacacccgtcgctttgtcaacgttaccctcactggtggcaagagaaagatgaaccccaaccccggctca

SEQ ID NO: 29810 - DNA, 218 bp, Sorghum bicolor
  Clone ID: 9305212
ccagcagcaacaggccacgactacggccagccgcggcggcgacggattctggaaaggatgctgcgccgccatctgctgctgctgcctcctcgacatgtgcttctgaagatcgatcgcgattatagacaacgacatccaccccagctgctcatcgatgattagtggcgcaatttctctcctttattattttccgtgagatagaaagtgtgatcatcata

SEQ ID NO: 29811 - DNA, 424 bp, Sorghum bicolor
  Clone ID: 9305245
gcgcaggcggatgacacctcagtagtcatagctgggtgagctactaatgttgaggcaaacgatgatccagagccatgtcttacttacacactggcgtggttaacagctagcatcttcttactgcttctggctgtggtggttctaatatcttgtgtctccggcgatgtgttgtagcaagaatgtgagatgaatggttggttggaacctattcagctgtgtgaaggacttccctggatgataagttgttgcctcttattgtatgctatgttaaatggcgagtttcccaaagacataaggatctatttttgtgtgtaattcgggaccgatgctttttgcaatgttgttgttgaagagtgtactatttctgttgtagcctttgtagggtgatgataaaccagtctttgttacgactgtcctttgatca

SEQ ID NO: 29812 - DNA, 170 bp, Sorghum bicolor
  Clone ID: 9305267
ccgccacgtgcctgagtacaaagctcctgactacaagagcaaagcaaccaccaaggttaaatctaagaagagcgagagcaagagcaagggcaataagagaaaggtgaaggcataggagtggtgaacaaatactccctttttggccttgaatttcatggtcagaaaatgaa

SEQ ID NO: 29813 - DNA, 643 bp, Sorghum bicolor
  Clone ID: 9305292
ctaactcgtgggggaaatatggcatcatccgtgaggtcgatatgtggaacaagcgaccagagttcactgcatggctatcagaagtcaagcaggttaatttggaggcattatcaaattgggaagagaagcaaatgttcaaggaattcatggaggatcacaatacagcgactttcccgtcaaaaaaatattataatttagatgcttatcatcgcaaagcgatggagaaagagaaaaagaagggtttaaaggtgtctgtgacagaacgtacagtatttaatgatgaggaacagcgaagattagaattgttgaaggagcgtgaacgacgaaaggaggaagaagtggaagctttaaaacgctctatgcaagctggactggctcaagacatgaaggagcaggcccgtctacgcgaagaaatgaactaccaatacaggttgggcaattttcaggctgcagctgcaatccagaaaagattggatcctgatgctcctttgcagtagtaggcttgtggatatcccaattccctgcagttgttccttggctttcctcaacactgtaggacaacgagcataccttagcatgttgaactgctgtcagctgctacaaagtttttaacatagtgtgtcagatgctactattgtattgt

SEQ ID NO: 29814 - DNA, 677 bp, Sorghum bicolor
  Clone ID: 9305357
atcaaagaatgcaaggtgggtgcatcagtgaccactgatcaggcatgtgcaacctgcatcaggctctcctcgtttggctgggtgtgcgtgcaaaagagaggtggtgatgttggtggtgggttttcagttgcaaattgcagtgtttggtgacagtcgtgcgtgctgttgcaagtgtcatgctcagaatgggagctttcagtaagtccaggctcctcctttggtgcttccagtcccaggcagacgtgtcccagcagcggtcatctcctccctgctcatgtctccatccgcccgctgatcatccccaccaaacccgacgcctccgccggcccacggtctcgccgcgcggccgagatagggacggatgtgtgctgtgtgttgtcgccggcgtggagcatgtggccgaactgatagagcacttggctggcttgccattggccgccggtggccatgggtgcatgcctgggtttctttaacctccctagcatcatcggttctcgctcacggcttttcttgccttgctgagttcatcacctgcataatgcaggacacatacatggccgctgtatgtagcttgcttagttccctccctccccaattatcattctaatgtcaaacctttcttatcctgcggctggataattgagtgtgcatcactggataatattgtaattagctgt

SEQ ID NO: 29815 - DNA, 594 bp, Sorghum bicolor
  Clone ID: 9305363
ctggtttcaaaacgggccggtggcaatccacacggattgagcagcgaaacgggccattccggccgaaacgaacgaggccttaataagtataaacttcaattttgtatttgtgatatactggatgcaggccgcatagaggagccccagcagggagaatttcacacatgctgtcttcacgcgttttcagcagaaagaaggcatcgcaaagttccagagtagtgtttctgttttggaccagaaacacacgtcaggcacgacgcagcccgacgcgacgaccatcagcatctggcgttcccagctgcacgccgccgccggtgccaggacgcacgctgttttggtcaaacccagcggtcgtccccctgtcagtgtcagcagcccgagcccagagctccagctgaaaatccacggaacgcggcggcaggtgaagtgaacatcgccgtgccatcgcttcttcacacgtgccatcgccgtccatcgtgctggcggccgattttgggcttgtgctacacggctacttggcattcgtttctgattctttctattcaacatgcatgtaaatatatctatatctatacctactaataattgtgaaaa

SEQ ID NO: 29816 - DNA, 540 bp, Sorghum bicolor
  Clone ID: 9305370
gcgccggcggcgacaccacgtacgccatcaccttctgccccagcacaaccagcgtgaaggcggccggcggggcgcaaggaggaggcctgccgctgatgaacgccaccatgatatacctcggcggcgaccaggtggtcgtcggatccgccacagccgcggcgcgggtgccgccgtccgtcctccatgaggtcctcatcgccgtcgtgtccctcgcgctggcaggtgctctgtactgatcatcacatgcccccactgcaatacgacgcgacgaccccggccggacgcgagacaatcgtgctcctgcacactgaaaattgcaggacagaaacgagaaatggacgcaccacctgctgcctgccggccggtggtggtgctcacacggtccggaccatattgcgagccccagcaacgacagtgtgattcacccgtgccgaaagagacagctgcgatgcaaaattgattcaagacattattgtggatttttttcttacatatatatttagtacacgattatacgcataatatggtagcagttgatag

SEQ ID NO: 29817 - DNA, 561 bp, Sorghum bicolor
  Clone ID: 9305423
gcacgagggcacacgtagtttattccatgagcattttggtaatctttccatcagtttttctatgtctccatttatattgacctcttcaaagttcaatatctgtaaatcacagagactcgccaagtttctgggtatgtttcctgacaatatatggttctggcttaagtctatgacttggagagaggacatattgcctaatgcatcaggaataggcccagaccattcagaatttgacagatgaagctccttaaggctggtgagaccccagaaccagttgtggtggactgaaaagttaaatgagtttcttgacagatcaaggacctcaatatgggtgaggttggaatgggtcagggttttttcaactccgccgctaaacctgcagtctgacaatcgaacaactcgaagagcaggaagcatgttgagccactgaacccagtcccttgcagaactgaggtctactccgctcatatcaagattccttagcagagaaagatgatgcaaccacgagagatcttgtgtgttcagatcgttattgctaatgtcaaaacatcgcaactcgga

SEQ ID NO: 29818 - DNA, 433 bp, Sorghum bicolor
  unsure (1)..(433): unsure at all n locations
  Clone ID: 9305428
gcacgaggtctgctttagggcttgtaggtacagtagaaaacagagtcgtcgtcgtccctgtatagctgctccatcgctggttcgtgctcctctggctcgttttgcctttgtggtttggtcatgactacacaaccttcttgtcatcttgtgccacgaatgaaattcgaccagcaagttatacggctattgtttatttctggtaccttctgatagaaagacaaataaatttgttttcatcccttttcttttgttgtttctgtcgtgcttgtgcatccaccatccgatccaaatttccaatggtgacatataatatatgctccccttcnaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaacctggggg

SEQ ID NO: 29819 - DNA, 530 bp, Sorghum bicolor
  Clone ID: 9305431
gcacgagggtctgattcttccaatcagggcgtcaaggagttccttgcagaggctcagaccttgacacggattcatcacaagaatctcgtgtctatgatcggttactgcaaggatggggactacatggcacttgtctacgagtacatgccagaaggcactctacaagagcacattgcaggaaatggtcgcagcagaggattcttgagctggagacagaggctcagaatcgctgtggagtcagcccaagggctggagtatctacacaaagggtgcaacccgtccctcattcacagggatgtgaaggctgccaacatcctactcaacgccaaactggaagccaagatcgccgattttggcctcaccaaggctttcaatcttgacaacaacactcatgtatctacgaatacacttgttggtacacccggatacgttgatccagagtatcaggctacgatgcagccaacgacaaagagcgacgtctacagcttcggcgtcgtgctgctggagctcatcacggggcggccggccgt

SEQ ID NO: 29820 - DNA, 517 bp, Sorghum bicolor
  Clone ID: 9305460
gcacgaggcctcgtgccgaattcggcacgaggctttatggctgcatacttgttatcacttaaagggaccaaggacctgtctcctgatcaacttcagaaagcgcttaggaagacgttttcagctgaaaagaagaaaagtaaaatccggaaggcatgggatggaactaaagtcatttataatgttgcttcatggggcgccactgctgttggggtctacaataatcgagcattacttacggtcgcaactacagcatttcggacttcctgccgcgtgatatccaagttcctttgaataaatatatattgtgtcaacaactaggctatgttagaattgcttgcgtgggttttttttttcaattgttcagctaaaaaggtagcataaagcctgaaaccatttgtttagtctattctgatgctgtgaatctgcgtctgctagtgagatcatgatttcccgattgagttcgactgctaatttagcattggtgctattccacaacttcatcaacagcagcgcctct

SEQ ID NO: 29821 - DNA, 486 bp, Sorghum bicolor
  unsure (1)..(486): unsure at all n locations
  Clone ID: 9305470
gcacgaggaatcaccatccataaccaacactactaagccgtaccgaggcagcccttcctcctcgctctcccacatatccccccttttcacaaacacccccccacccccacagaacaaaatgccattcttcggaggcggccgccgcgagccctcacctgagcccgtccgcgaaccgaccccaccgcccccggaaccccgccgccacggcctcttcggctcccgccgcgacccttctcccacgcccacgacccgcacatccgcgacctcccgctcgtccctgtcgtcgacgacctaccacacctcccccgacggcggccatcacaacggcaccgggggaggaggggtgggcggtgtgttccgccggtccacggacgcgtcgtccggccgccgcggcatcctgcacaagttcggcggcgccggcggcgcggtggagatggatcccancatcgtccaggcccgcgagcgcgtcatgagcgccgaggccgc

SEQ ID NO: 29822 - DNA, 533 bp, Sorghum bicolor
  Clone ID: 9305474
gcacgaggccgccctccacggcctccagcgccgtgctcaccagcggcggacgcaacgtcagctcctccccctacggcgccacgtggcgcgcgctgcgacggaacctcgcctccggggtgctcaacccgtcgcggctccgggccttctcccccgcgcgccgatgggtgctcgacgtcctcgcctcccgcgtccgcgccgacggccgccacggggagacccccgtcgccgtcatggagccgttccagtacgccatgttctgcctcctcgtctacatgtgcttcggcggcgaccgcctcggtgacgacgcgcgcgtccgggacatcgaggccacgcagcgggagctcctcgcaaacttcctcagcttccaggtcttctccttcctcccgtcggtcaccaagctcgtgttccggcgacgctgggagaagctcgtgtcgctgcgacgtcggcaggaggagctcttcttcccgctgatacgagccaggagggaggccggcgccgacggggactgctacgtcgactccatggtgaagctg

SEQ ID NO: 29823 - DNA, 141 bp, Sorghum bicolor
  Clone ID: 9305493
gctgcccgaaaaaatggatgtttcccaataatagttcaggcccccaaattttaaaagtttttgttgccaaaatttttcattttgctcagggaattaatgccagctgcagcaaggttcatgggcaatttattttttattttt

SEQ ID NO: 29824 - DNA, 488 bp, Sorghum bicolor
  Clone ID: 9305531
attgccagggcaaagtacaagcagatcatcgcagaggcacaggcatccacagctcgtgtgtgcaaggtaactatccctgagatgacaaaatctgtggagacccctattgatggtctgtgcacccgttataatatctcaatgtcagtttagttaccaagtacaagttctattcactacacttttgaatagccttcttcccatcaatcggacagttgaatcctcatgtcgtgatggtgtggtcgttgtttcgtacgtccgtagataatcagtagagtacagatacatagaaacatcgaatagttcatgagcataggaacagtgtgtaatatcaagagagtttatcggtatcccattttttttccctgacttatcaaagcaggccatcgaatgctaaactgctgttccttctgagagatctcaattctcaatctgacagtcaacaccagcgtaatgtaatatactacctattactctagagttattttccc

SEQ ID NO: 29825 - DNA, 525 bp, Sorghum bicolor
  Clone ID: 9305582
gcacgaggaacaacttgcaactcttgccattgatcatgcttgttcttctagtttctaaggcggttggtgacttctttaacgaagggttatatgaagagcaagcccgattaaggggcatccctctactggactccaggcctaagcaagttatgagaaatatgactgcaaaggatgcgtgcaagaatcaaaaggttgtctgcctaccacgtgtttcaaggattgttgatatcgtttccgttttgcgtaccaacaagcataatggtttccctgttgttgaccgtgggcagaatggtgagccacttgtcataggtctcatacttcgtagccacttattggtacttctacaagcgaaagtagatttccagaacagtcctttcccacgtggaccaggcgtactgaacaggcacaattttagtgactttgttaaaccagcatcaagtaaaggaaagtcaattgatgatattcatttgacagaggatgaactggggctgtatttggatcttgccccatttttaaatccttcac

SEQ ID NO: 29826 - DNA, 317 bp, Sorghum bicolor
  Clone ID: 9305583
gcacgaggattttgttctaggattcttcttttttgtgggccatttgtggcatgcaggaagagcccgagctgctgcagcaggctttgaaaagggaattgatcgtgatttggaacctgttctttacatgacccctcttaactaagattttttatttatacctgttctagtttttttctgttctggctcggttattccatctagccgagccattcatgcttttttatgaaagaatgatataagggggctgaacagagaaaaacatagatagaaagaaacaaatgtattcaatatacaaaaggagagagagggattccaac

SEQ ID NO: 29827 - DNA, 473 bp, Sorghum bicolor
  Clone ID: 9305612
gcacgaggcttcatcacaccgctatcttgaccacctccaccaccctagagctccttctaggtttgttggagataaagtggccccgggctacaaactatgtctggagctcttgctggagtcgactctaccttccttctcgtcgctgatcctggagtcgactctgccttccttctcgtggctgatcctggagtacctggggcggtagatttactcctatatgccttcttcctgccaaggaaaaagttcttattcaaggcattctgggaagtgcaacatgtaaggagcaaatgaaaaggtaaaataaggatttgggagccagcattggtcaaacctctttggttcaacagagccttgtggtgcaacgttattggagcatgaaagattaattactcttttcttcttcctgcatattagtgagcaatgtaacaaatcaaaaacatgtgagcagtataaccaattgttgcagtaagggg

SEQ ID NO: 29828 - DNA, 101 bp, Sorghum bicolor
  Clone ID: 9305627
gacgaggggaacttgctaaagcattaagttcttgtcctggagtttaccgggttgatctattgacaagacaaatcttagccccaaattttgatcgtggctat

SEQ ID NO: 29829 - DNA, 594 bp, Sorghum bicolor
  Clone ID: 9305644
ggagaagcacgctgctgaggttgccaagctcaaccaggcgcatgatgctgccgtcacctggctcaaggaggagcattcggtagatgttgcccgtgtgcagcaagctgcagaggatgtggtgcaggatgtaaagaaggacatagcgctcgccctattccctgacctggatgcttcattgctgtgatcagatcatgaaccactctgctggaggagctccttattttgatgatcgccagccttcgtctagagactgagttcccgaagtttagtaggagaaatgcagtcagttttgaagcaatatatatagaaggaccttgctacctggtcaagatgattttggcatggccatggcagggctctagaatgtatgcttgtcatcagtttggtatttgctcttgtctggtatatgtatgtatctgatgagattgacgagtgaatactgttggtgtagacccagtggtcttttgctttctaaatgtataactgttttaacctggaatgctccctaaaccttccccctgatctagctcagtgaaacaaaaacactgtactgtgccattactgatgataatggaaatgatgcggaagattggg

SEQ ID NO: 29830 - DNA, 174 bp, Sorghum bicolor
  Clone ID: 9305661
gacaccctcaaaaggtccccctttgtcaaggaagggttggccaacgggcccctcaggttggtggggggccactacaattttgtgtcaggggagttcgacacatgggaaattaaaagttaagttgcccggccggccgtttaacaactcctcccatcttcataaatatatatacta

SEQ ID NO: 29831 - DNA, 137 bp, Sorghum bicolor
  Clone ID: 9305666
ttgaggtgatttcctggtcccgtgtgtttaaattaggtgacttgtaactcaaagtgttcaaacacgtcattcatgtatcccccggtaaatttccaaggctttgttttggcggttgtaagtaaaaatctatcatctgt

SEQ ID NO: 29832 - DNA, 110 bp, Sorghum bicolor
  Clone ID: 9305739
gcacgagggcagcaggaagtgggcagcggcgtttctgctgacgttggcgttggcgtggcggcgcctacgcggaccgaacgcgtcggcgtcggcggtggtgccgaagagga

SEQ ID NO: 29833 - DNA, 488 bp, Sorghum bicolor
  Clone ID: 9305760
gcacgagggtggtttcttgatcctaaatgaacttgtgttagcttgttctacggcttcatgtcattttttggaattgagtcaagggtcaagaaatttcaattgacctgcatagcaatccgctagtctctatgttggaagtgtctcatttcgcattcaaacttcaaattggttgcatcataatacttgggatttttggatttagttattcttatatactctatgtgcagtcaatattgttgattgtaccttgtcactatctactgtattgtatctccatatgaaacataatcactgcctcatgcatcatgtgctactgagagactgaaaaaatatcttgttcctcctgtgctacagaacaagtattggcaggcattcactttcagtcacaaatcattattgattcggtcggactgataactaaagtttcttaatcagggctctgttatattattttgctcttatcttatcttgggtggtttggcaaagaa

SEQ ID NO: 29834 - DNA, 327 bp, Sorghum bicolor
  Clone ID: 9305772
gcacgaggatggagttgtacttcttgaactcatttcagacaaaaaggcactggatccttctttctctccttacgggaatggattcaacatagttgcctgggcttgcatgcttctacaaaagggtcgatctcgtgaattctttatagaagggctgtgggatgtggccccacatgacgaccttgttgagattctacacctgggcatcaagtgtacggttgaatctctttcttctagacccacaatgaagcaagttgttcggcgacttaaggaactcagaccaccgtcttactaggaatagcaagcagagattggcttacttcagcaaat

SEQ ID NO: 29835 - DNA, 213 bp, Sorghum bicolor
  Clone ID: 9305777
gcacgagggttgggttgaagaaggacctccgcgaagatcccgtcgccattgaggaaatgcgcaagaagtcgatgcgcttcgtcaacccccaggagggcgatgcagccgccaaggagatcggcgcccgcaaatacctcgagtgctcgagtctcagcggcgagggagtcgacgatgtcttcgaagctgccacacgcgccgctttgctgacctttg

SEQ ID NO: 29836 - DNA, 564 bp, Sorghum bicolor
  Clone ID: 9305813
ttcaccatgaattgcattgcatccaaattacatacctctcaaaataagtactagtaagtatcctcgtgccgaattcggcacgaggcaagaataccaaagctcagaagactagaccagaggaccgagttcttagggccacagaagggcgctttaagaatggtatactggacgtcaagcatcttctgtcgccaccaaaaccatcaggcagggatgcgccagaacccaagatgaaaatgggcaagcacaaggggaagggtaaacaaaaggggggcagaaggaagagacgttgaagaagaaaacacatttttttagtaaccaggttttgtaacccaagatgaaaatgggcaagcacaaggggaagggtaaacaaaaggggggcagaaggaagagacgttgaagaagaaaacacatttttttagtaaccattgtttgtaacgttggaatgacaccatgtggtcgttctgaaattaagacatttccttacgctggtggaaactttgaagtaatccttgaaatgatgtaatcttctaggacgcaattcataaaaaaaaggtattcagtttt

SEQ ID NO: 29837 - DNA, 135 bp, Sorghum bicolor
  Clone ID: 9305828
gacggcgagggttgggtttgtatgcaaaaaaatgggtttggcccttcagggccattgtgtggttgcttcgggcacccttttgggcaaaagtttcaggccatgttcaaaaccccccggggggtttgcaagaaaatc

SEQ ID NO: 29838 - DNA, 168 bp, Sorghum bicolor
  Clone ID: 9305834
aaacaacttggttcagttttccatgtttcaaaagggctccctttaagctttttagaaaagttgtttcacgtcctgttttgcccctatgtattccccagtgtttattttttgcgatgtgatgtaaaaaagccccggttaggcttttggatcctagtcaatcagggcact

SEQ ID NO: 29839 - DNA, 215 bp, Sorghum bicolor
  Clone ID: 9306432
cctaaacgagtttttggtttctgttggcgctgtcaaaaaacccgtttttggacggaagaggtgacctggaaagaaaccggtggatgcgaatggttttatatgaaggggtagctgctccagtgcatgcttgaagttgaagcatggtttcccctgttaaattgttatgtggttagtgcccaaaaatggtccattaggctataatttaggagagtaca

SEQ ID NO: 29840 - DNA, 214 bp, Sorghum bicolor
  Clone ID: 9306435
tcatgtcatatgagcgagaacaagcttcagcccatatggcatccccggtgcaaacttgcatgaaacagtacggggtcccagttgaggaagcccttgagaagctcaagtttatatgtgaggaagcatggatggacattgtccaaggatgttttgaccaaaaatatcccatggcccttttgcccaaggtggtcagcgttggacgatccctagattt

SEQ ID NO: 29841 - DNA, 673 bp, Sorghum bicolor
  Clone ID: 9306499
catcatccagtgatggctattttgacgagccctgtgaatttggttctgcagaactaactacatttaatttgtgcaaaatgagtaatcgaagtcattcttccattggtaattggatccaatgccgtgagatcttgaatccaggagactcggacaagcaagttgtctgtggaaaatggagaagggcacccctatatgttgtacagtcagatgattgggattgtttttgttgtcttctttgggatccagcccatgctgattgtgctgttccacaggagttgaagactagtgaagttttaaagcagctgaagtttgtaaacatgctaaagaatcagccggtggaccaaaaccagaagcctgcttaaagcccagtaccagagtgggtgattccttaagagaaggatacccattatggttgtatgaatgagttgctgtatgtggcgctatcctgtagctccatctgtagtctatagaacatgtgggaattatgttgttgttgcctgttaaacggaatgatcgttgacgcctccccctctgtaccgccgtcttctatagggttttggtacacaagagttgtacaacatagatctgtctgcgcagttcagggagcagcgtctcgctactgttgtaatccctgccaaacgatgcagtgatcctgctcaagttttgtttttgc

SEQ ID NO: 29842 - DNA, 156 bp, Sorghum bicolor
  Clone ID: 9306509
gttatgctcctatcatacaacactttgcagaatcaatagcagggtcaagtactattacaagcttcggcaaggaaaatcactttgtgacaactaacagtcgtctaacagatgcctactgtcgggccaaattctacaacgctggaacaagggagtggc

SEQ ID NO: 29843 - DNA, 588 bp, Sorghum bicolor
  Clone ID: 9306520
gcacgaggcaaaccatcgccctccctggattcaacctcatcccagtcaacaccaggccttgatggttcgttctccaaccgttcaagaacagccagtggttctgtaatcttccaaaagtccttgaaatccatcacgaaatcttacatgccatcccacagaaaactgctcaaattctgcaattgcccagtggaaatggccaagaaatcctacaaagatgcttgctttcgatgcccacggccacaagcatatgccaatgaaatggattcttcagaagaggatgaattggatgacaaattgaatgatatttttggccttaatgatgatgatgttacttcgtctgcttctgcctccagggaccagctaaagtataacctcatatcttgcaaacaaatggttggtatttttgtcacagtctgggcaaagaaagaactagtgcagcatataggacatgtgagaacatcctgtgttggtcgcggaataatgggatatcttggaaacaagggatgtatatcagtaagcatgacattgtaccagacaagcttttgtttcatctgcagccatttggcttcaggtgaaaaggaaggcgat

SEQ ID NO: 29844 - DNA, 596 bp, Sorghum bicolor
  Clone ID: 9306535
gcacgagggtttttcctggcttcaaggacatcagagtagtgcacaaggaacccagacgtgtaagtgctggccttttcaatgcatcatctcttctcacttggaaaaactgtttagttcttctttgctagaatgctgcttgcccattctcttgcaaatctaagcatttgcatcaaattcatgtttttgaacttgccttatgttaaagatatggtttatatagtgctcattttgaaagcaaaagagccacgtttgttagattaagaggggcgcacagattatgaagacaaaaacaagaaactgcacaatccacaaggggtcctcagatacagatctgagtttcttagcacccatttctacccccttgacttggcaaatgagttctgtcacaaccttttccatttgttgaaagattagagatccttgaattgctctctttccatattatgcagatggttgtccttattacttcatggccacttgacatagatccattttgtcatatccatcaaatttagagtgtttctactttccagtaggggggcattcttagagagttgatttcgtgcttcatggccactgaacatacatccatgaca

SEQ ID NO: 29845 - DNA, 603 bp, Sorghum bicolor
  Clone ID: 9306540
gcacgagggagacttagatgccctgttggattttctcaacaaaatgcaagaccaaaacccttgtttcttttacagtttagatatgaatgagcaagggcagctaaggaatgtcttttgggctgatgctaaatcacgcagttcatacaattactttggtgatgttgttgctattaatgtcacaaactttagtgatcagtatgacatgcagtttgtgtcattcatgggcactaaccaccatgcacagccagtgttactaggttgtggcctgcttgctggtagatctcttggagcttatgtgtggctttttggtacatggttaagatgtatgaatgccaagccaccacattcaataattacaaactactgtcatgatgtagcgatagctattaaaaaggttttccctaatgcaaggcaccgtttttgccttgcaaacatcttaaatgttcttcctgaaaagttagaagaaatggagaacaaggatgaaattatttccacattcaccacactggcctatgattatgttactgtgcctgactttgacagagagtggcaagataccatccaacatttccgtttagagggaaatgaatggctgtccaaact

SEQ ID NO: 29846 - DNA, 338 bp, Sorghum bicolor
  Clone ID: 9306544
gcacgaggccaagctccactagcgcggggccaacccgagcacgacgcgcgtggtgggcaccctgggttacctggcccccgagctcacgcggacggggaaggccacggcggccgcctacgtgttcgcgttcggcgccctggtgctggaggtggtggccgggcggcgccccatcgagccccgcgcggagcccgatgagctggtgctgtccgagtgggcgtgggagcggtacgcggccggggaggtggagaaagtggtggacgcccggctcgccggcacgtacgacttcgcggaggcggcggctgccgtgaatgtggggctgtggtgctcgcacccggtgg

SEQ ID NO: 29847 - DNA, 459 bp, Sorghum bicolor
  Clone ID: 9306551
ttcgacgacttcgtgcactcgtacccgtcgtcgtcgttcgagcgcgccgccgcggccggcggcgggtgggacggtgggacccagacgtcggtggccacgttccccttctcgccgctgtccatgcggtcgtcgcacgtcagcatgtgatgcgtcgacattcctgggcccgcttgccagtaagatgacgacttcgtcaaacctagtgggaccctggagcctgtttatagctgagctgtctatttttttttctttactgcactcagtaccggcaaatgacagagtggcagttggtagcatcttatttaatcttttttgtttgtcttttttagaaaagtcgtttgatttttgggctaaagagtcaaacacacatgtggtctccttggatggaaattaaaatatttccttcagtggaatgcaccttattagcgtgcaaaatttgggaatcaaggaatttttcac

SEQ ID NO: 29848 - DNA, 496 bp, Sorghum bicolor
  Clone ID: 9306575
gcacgaggctcctcttcgtctctggtcagcagcggcggcggctcgcctagcgcgggcgtgcggcctatcgaccagcacgtgaagacggcgccggatctcccgttccactccactcctcccccatcgtctccccttccattcctctcctcccctacaggcatatcccaaatccccaatcctccattgctgctgtagttcttcattcagtggtgtcatcgaaaccaaatcactgagctctggtggtgctcatggagatccggcgcggggtgggtagcagtagcagcagcatcacctaaatgagggcctgtgcaagcgttggccttggtggtgctacagatggccatccaagggctgcagcaccactgccgccgccacctgcacgaccagcagtagcagcagcttgtcaagaccataatgatggagacattaacaatgtgtggatgcatggctcaaagcttgctggtcagggtttcaaatgtgggtactgtgggactac

SEQ ID NO: 29849 - DNA, 131 bp, Sorghum bicolor
  Clone ID: 9306582
gcacgaggcggaacagaagcatacatacgcggtgcccaagcccagctatagccagcttccagcagtggtgcactgaaaatggacagcgccagcagcctcgtggacgacaccaacagcggcagcggaggcgg

SEQ ID NO: 29850 - DNA, 616 bp, Sorghum bicolor
  Clone ID: 9306595
gcacgagggtacttgacatcgaacaagctggaagcaaatgacagggaggggtgggaattcatcactcagctagcgaactgctgccagcttcagcaactgattcttcgcgataactccttcactggaaaacttcctagctcaatcgcaaacctgtcgacaaccctccagtaccttgatttaggcgacaacaggatttctgggtttattccatccagtatcggttatttggttggtctgcaagtccttgcgatggccaatacttccatatccggagtgattccagagagtattggtcacctacaaaacttggccgtgttagcactttacatcactaacttgtcaggcctagtacctttgtcactaggaaatcttacgcagttaaacgtacttcttctatataatggcgacttggaggggccaattccagcaaccttagggaacttaaagaatgtctatagccttgatctgtcaaacaatagactcaatggttcaatccccagagaggccttaaagcttcctgcactttctgagtaccttgatttatcatacaatatgttgtctgggccacttcctactgaagttggtagcttggcaaaccttaataacttgtatctgt

SEQ ID NO: 29851 - DNA, 410 bp, Sorghum bicolor
  Clone ID: 9306621
gcacgaggctttctctcctctctctaccttatgtcttttcccctaccgacagctacttacttccccaccatccgctgctccacgccacggggactcggcggagctgcctcctcggagcttgcgaacaaggatctcccgtcccggcatccctccgctcctccttgtgcagcaacacggcggctcgccggcggtgctcatctctgcgcgggcgtggcgacccgatgtcgctccactactcctcgggcgtcgccactgtcgctctccaccggtcatgcctcccaatgagccggtgaggtattcaagatgctagaggctgtaaatatgccttactaccagaagacttcaatttcaaagtctctgcaatgatggtttgtggtataccgacaatggaggagtttctgtgttttaag

SEQ ID NO: 29852 - DNA, 624 bp, Sorghum bicolor
  Clone ID: 9306628
gcacgaggtcaatattggtttcttcaaccgcatgtttgaagggcttacagaagctggccggattgatgatgccttgaaggtgtacgggaggatgcctgacaaggagatcaaaccaaacatgaccacttttgaaatccttgtcaaagccttatgcaaagaagaaggggacttggatcaagcaaggggcctagtgatggacatggcgagaggtagtattgtgcctcctccagagttccgtgagtctgttgttaactttttcaagaaggctggtcgacaggaagaaattgagaaagcttttgaagaaaaacctatgctaacaactcagcctaggacagagtatctgtcgaggactgaatatcactctcgcaatgcagttggtgctgctcaagtaaaacaacctggctttagctcagctccagcagcggaacctgaatttgtttactctcagccacaacagtcaacacttagtaacactccaaatcagcagcctgagtttggctcatctcgttcatggaattcaagttttggtgctcctcaagcgcagcctggatatggtgcacctcagcctgtacaggctgtagctggttcatctcagcgaccccggacacagtttggtgcttctca

SEQ ID NO: 29853 - DNA, 611 bp, Sorghum bicolor
  Clone ID: 9306632
gcacgaggcttgatcgtcacattgacccattcgtcattatcatggccgacccaaacctcatctccgctggcgaaacaggcgggccgcctccgggggtgagtctgcccgttaggcttctatggtcaaagagacacccgccagaggaccccgccgtaagctttcagggcaagacggtgctcgtgacaggggccaacacgggattaggattcgaggcggcggtgaaatatacgatcctcggcgcagataaggttatcctcggggtgcggtccgccagcaaaggcgaagaggccaaaaggcgcatcatggacatctctggctgcagtcctgatgtcatcatcattttgcaagtcgacttggccgactttggatctgttaagacttttgttcgtgacctggaaatggtcacgcccaagcttgacgtggccctgctcaacgccggcttgggcaacccgacgtacgaaaagtcgggaaggtgggaactgtccgtgaaggtcaacgtcctctccacagctctcatggctatcttgattctaccccttctccggtcatcggcggccgccggggaatcgacgccgcatttgagctttgtcaacagccacgggcatagcatg

SEQ ID NO: 29854 - DNA, 307 bp, Sorghum bicolor
  Clone ID: 9306647
gcacgagggcgccactatggcctcctccctcgcggtgtccctccgcgccctcgctgccgcctccctccccaagcccagccccgcccccgccccttcctctcccttcctcgacctcctcgcgccggcgctgccccgacgcctgctccgcctccgctccgcacgccgcctgccgctcgccccactagccgcctccgcctccgactccgtcggggttgactacgcggagccggccgactcggagcaggaggaggaggaggcgttcaccacggaggaggatgagggggcggaggacgatgccgaaaaggcc

SEQ ID NO: 29855 - DNA, 188 bp, Sorghum bicolor
  Clone ID: 9306651
gcacgaggggagttcctccccgatcctcactcgagaccctaaccctcgcccttctcgatgtcggccgacccaaccggaccagaccctccggtggccactgcgatggcgccccctccgtgctacccggcctcctccacgatctccgcctccgtagccgagtccgtagaggaggaggacgacctctatgg

SEQ ID NO: 29856 - DNA, 547 bp, Sorghum bicolor
  Clone ID: 9306663
cggaacggcagtggcggtgggtacttcaagcagaggaacaacaaacagagttaccaggacgaggggcagcaccagcagcacaggaccggcggctggcagcaggaccaaagaggaaggaacaggcagtggcgtccagtgtacaacagagctccctaaaatggtccggactcttgatcccatggcgagaattgcaggtgtcttttcttgtgcagtcagtgttgagctgctgctagcaaagtggtgcttgtaaatagatgtttgtttgtttgagttttatgctgcagctgctgaacttccgcagctgcagcgatgagatcctccattggagggttgtgtttcgatatttcagagcttgggaagagttttagtgatttttgtgtggagtgggttcgtagagaagcgaattcagtggctcatatctgtgcccatatgatctcagccactgaacgttgcttattttggttagattggataccggactggctaatcgacttagctgccggagcattgtaattcttcccatgatataatgaagctctgaattctc

SEQ ID NO: 29857 - DNA, 405 bp, Sorghum bicolor
  Clone ID: 9306666
gctgttgggtatgtccgtcatgcagaccgttgcgcgcatggcggccggcgaggaacaacacccgcagatcatggtaaacgctgtgtgccccgacctttgcaagaccgatttgggccgtaagtggacaggcttcatgtccaacatcggcaagaccattttttacgttctgtttgcccgcaccgccgagcagggtgcgcgatccttggtcagtgcaacagctttggggccggagagccatggccgcttttggcatcacgatattctatacccattcggtgattttgcccaggacgaggttttgatgcacaagacatggaatgagattgtagaggcaattgcccaagaagagcccgacatactgccaggcagcagttagatagcccgaaatgaagtttgttgtccttc

SEQ ID NO: 29858 - DNA, 516 bp, Sorghum bicolor
  Clone ID: 9306804
gcacgagggttgcttgcttgcctagctagccactacggagtactactaagggccgggcttgagcatgcttatataggacgtgtgtaccggtaaagatacggtagctagcagccatggcatcatcaagtgctaccctcgctttcctgacgctcagctgggcggcggttctcgccggcgcgtcgctggacacgtcgccggtgacgttccacgccggctacatgccgctgttcggcgggggcaacctcgtgccgtcgcccggcggccgctccgtccgcctcaaacttgaccgccacaccggctccgggttcgtatcaaagtcggcttaccaccatggattcttcagtgcttccatcaagctgcccgacgatgacaccgccggtgtcgtcgtcgccttctatctgtcgaacgccgacgtgttccccggcaaccacgacgaggtggacttcgagctactgggcaaccgccgtggccacgagtggcgcgtgcagaccaacatctacggcaacggcagcacct

SEQ ID NO: 29859 - DNA, 417 bp, Sorghum bicolor
  Clone ID: 9306808
gcacgaggtaatgcattaaaagagcagctgcaagcaaatccactgcttggagatccaagcaaagttttgttgctcacttgtcatagctctatggccagttcagagcacaaattaatatttgataagcctgagcctggagtaaggaaaatagttctcgccacgaatttggctgaaactagtattactatcaacgatgtactttttgttgttgactgtggcaaggcaaaagagacatcttacgatgcactgaataatactccctgtttgcttccaacctgtatctccaaggcttctgccagacaaagacgaggacgagctggtcgagtccaaccaggggagtgctaccatctttatccacgatctgtatatgatgcatttgctgactaccagttaccacaacttctgagaacccctctt

SEQ ID NO: 29860 - DNA, 496 bp, Sorghum bicolor
  Clone ID: 9306834
gcacgaggccatctgcagcgtcggcgcgaacctggtggtgttgagccggatgctctgctcccaccagtagaacttggcgttgctgccgttcctgtagaacacgtcggggtcggccatcaccgggtggtccttgccgtacctctcgtacagcgtgctctcctcggcggcgatgctgtaggcgacgtgccggagccccatgtgcgccgccggggcgccgaagaacccttccccgtagggctccatcttcccccacgggatcacctgcaccaccacggcgcccgcgcgcaggaacaccatgttggtcagcccggcgccgtgcgcgcccacgagcacgtcgcacgcgtccacctcgcgcgccaccgcgcccacgcttccccaggacgccgtctcatccatgcgcgccacctcgaagcccgcgcgctcgatcgcgtccacgatcgcgccctcgttcacgaaccgccgcgtgcgtccccgggagacgagcatgagccgcggc

SEQ ID NO: 29861 - DNA, 491 bp, Sorghum bicolor
  Clone ID: 9306840
gcacgaggaaaacttggtcacatcccctacatctccaggtcatgtgggtttagaaggtggacaatccaccaccaaggaaacttcttccaatgatgtagaactgcccactagtggcatactccagtcaaactctactaatgcaaagagtggtactggacaagatgcaccggtggactcgactccaacagccatgtctgtagagcataataaacctgacaagctatttgctagtagcaaaaggggtctggaggatagtattgtttcagttagctcgagtatcaaagagtctgagccatttgcatctggtaggttacatttggagaaggatgctgaaactttgaatcatcttgcagctgtaacccgtgatttgcaagatctgtccgaggaaagtacaggcaaagaagatgaacctacatcttcatctagtacagatgatatggacatgagcagtgactatatattgcaaagatgtatgtcaagcttaagggact

SEQ ID NO: 29862 - DNA, 526 bp, Sorghum bicolor
  Clone ID: 9306846
gcacgaggcctcactagattcctagtgggccagcctcgtcgtaggccgatagccagtccagccacacccacacaacacgcggacgccccacttcaccacggcaccaccggccggccaccgggcgccaaaaggaacggaacggcgcagccgcggcggcggcggcggctgtaagctcccgcaccagcgaccggcggacacgtacacggtatatcgatctcccctcgcacagtcccacgcaacccgtcctcggcctcgttccgtccgccagcaatgccgctggcgctcgcgcagctgcaggacctgcgggaccgcatctccgaccacctccgcccatggagccgctccgcgcagttctgggtccgcgccgcggacatctacaccagctataaggtgtgccagctgcgggcggggtttgtgaaggatgaggacgagcgggaggccatgtgggagcagcagcacgagctcggcgcccagaagatgtactccctctgctccgagctcggcggtcttttcctcaaggctgctc

SEQ ID NO: 29863 - DNA, 457 bp, Sorghum bicolor
  Clone ID: 9306861
gcacgaggcggcgccgctcttcgtgctcttcaacatcctcctattgtggggcgtttacctcttcgtgatccggagagaaacttcttctctgctggacatgctaataaatgcagaatgtgcactgcttttgtggggactctacaggattttatctggtgatccaggtattgttgcttgtgattcttcatatttggaagaagctggctgcaaggattttgtggaagctatatgctcgagtgagaaactcccaatgctctcaagggttaggcagtgtacctggtgcaaagcaaacattaggggctatgaccatcattgccctgcatttggtacttgcataggacagaaaaatcatcggctatttatggcccttttgacaggatttgttgttgctgaatcaacttatacaatgtgctcaacaaaatatattaccagatgcatcagttcaggaactataaga

SEQ ID NO: 29864 - DNA, 487 bp, Sorghum bicolor
  Clone ID: 9306862
gcacgaggccgcgaacaatggcaccggcagtactgtcgtcgtcggggctgctgcttctctaccttgccgccgtcgcgtccgtcgccggcgtcctccaagctcgcgcacagcctgacagcattggtttcatcagcatagactgtggcctgtccgggacggcgagctacgtggacgacaccaccaagctgtcgtacgtcccggatgccgggttcatcgacggcgacgccgggtccaaccacaacatctcggccgagtacatgtcgccgatgctctcgaagcgctaccacaacgtgcgcagcttcgccgccggcggcagcgcgcgcaactgctacacgctccgctccatcgtggcggggctcaagtacctcctccgcgccaccttcaagtacggcaactacgacgggctgcgccggctgcccgtcttcgacctccacgtcggcgtcaactactggacgacggtgaacatcacggacgccgacgcggccgt

SEQ ID NO: 29865 - DNA, 466 bp, Sorghum bicolor
  Clone ID: 9306877
gcacgaggactagatcaacgcatcgttgggtcaagagaagttccgattgaagttcaatatgaatcttttgggacttatcatgagatttatgcccactatctagtagtgggaaatagaaaaaaagaaatccgttctatatacattcgaaccactcttggtcatatttctttttatagagaaatagaggaagccatacaaggatttagtcgggcctattcatacactatctaaacaaggaagtgaaattcggcgatgcccctttcggggggcattccgatttcgctagtaccatcttttttgccgcgcaaatccagattgagattgaggaaagggagtaaataaagttttcgaatcactgactcaggcccattgtcgaatcctactcagcaattgtcgaatcctactcagccaaaaaagggggtacttatgtatggcagaacgggccaacctggtctttcataataaa

SEQ ID NO: 29866 - DNA, 136 bp, Sorghum bicolor
  Clone ID: 9306930
tttccccaagtttggtcgattgggttaagtcccttaggtgcaacccagaatttgttgtagtgtaaaaaggggatcccaccctttttttcccctttaaagaataagcccaggaaatgagatgccccagttatcaaag

SEQ ID NO: 29867 - DNA, 553 bp, Sorghum bicolor
  Clone ID: 9306941
gtcgccgccgccgacgacgacgacgacgccgagtgccaggtcgccgcgatgacggcggactgcgccgtcatgacccccgccaagcgcgccgccatgcggcgcttccgccggcggtacctcctctacacggtgtgccacgacatgtaccgctacaacggcaccgtcttccccgagtgcgacgccgacgactcggaacgccacgacttccacaggtggggcgagtccaagcgcgtgtcgcccagcagccgcgggtacaagcagccgcgcgcggacaaggccgccgccgtcgacgtcgccgtcgccgcgcctggacggcccgacacgtggccggtcattggaacgttacgtgtcgactaataattgggtttatactacacgagtagagatacgtccaggatacaaatctcatatagctaggtacagttacatggtgctactccatggacacacatagggcctgtttggatcgtaggatttgtaaaggaaaagtacaggaatcaagattcctctattttatgcactgttcatgcgtttggaacacaggattgagtat

SEQ ID NO: 29868 - DNA, 595 bp, Sorghum bicolor
  Clone ID: 9306954
agggtcgaccacgtcgtaccgcgagagcgcgcggaggacgcggtcgtacttgccgaggaaccaggcctggccaccggcgccggtggcgaggaggtcgacgtcgcccccgaaggcccgcgccgtcgtgaagagcggcaccagcacgtcgctgaaggcgtgccagtagttggacgtgaggccgccgagcgcgaacaccacggccggcacgtcccggcgcaccgtgcagccgggcgcctcgtggaggctggacgcgtccagggaccggacgatcacctcacggacgccgacgatcttgcgggactgagagcggatgctccaggtggccgccgccgcggtagcgagctgctgcggcggcgggatgaagtagaccaccgacttgtcggcgccactcgccgtgcgcgcgtcgccccacatctcgcagccgtcgtagcgccggtcggagaggtcgcagatcggctccagaggaggatgcacaggcgcaacagaggtcgccgtcgccgtcgctgtcgccggtgcaatttcttcacctgcaaacggagaatacagaaagctgagaaatttagctgtaataatgcctaggaatctgaacttccag

SEQ ID NO: 29869 - DNA, 583 bp, Sorghum bicolor
  unsure (1)..(583): unsure at all n locations
  Clone ID: 9306988
tctgccctgttgccagattgcattcttgatgtggcacatatattgcatctgcttcaacatcaagacagatgagtgggtaatttcaaatttcccatgctttggagtctttcttcatcaattgcaggtcgtcttctcgttagctgtttcttgtagctaaaagttaccctagtggtttatagcatggcacgtgtaaatccattccctcccgcaaatgcagattctgaagtcaaatttgtgaacccatatgacaaaggcatgctgtgtaacataagagaatttctgaagccggaatgatagatagccaattttgagtacgaagacctgacatctgatggaactagaaacatgggaaatctgtagtgcgtcataactggagacatggaagcttgtttcccttgttgctgctgtagcatttattgagactcattgtgaggatcattggactccgctgtctagtttaatgtgcaagtagcattcttttatatggttactttcacttgaccgggaattgtaggcccttatagctgtagagaacttttctgcatagggagttcacatcgtgctcctgcatttttcncccgtt

SEQ ID NO: 29870 - DNA, 570 bp, Sorghum bicolor
  Clone ID: 9307138
agatgttcttattgacatcgcggaagattttgttgagtctgtcacaacatttgcttgttctttagcaaagcataggaagtcaagcacattagaagcaaaagatgtacttctccatgcagagagaagctggaatatcaccttgccaggcttcagtggtgatgaaatcaaactatacaagaaacagcacataaatgatattcacagggagaggcttgctctgatcaagaagtccatggcgactgacacaagaatctttgctgcccaagcagcagctaaccagaaaaaccagactccgaaaccacctgccccagcttccccgtgaaagatgtccatgggccctgcaaaagccagtatcacgcatcacatctttggtgttcggacagttgtgggattgttgtttgttgaaccgctggtggcagtagatgtgttgcaacgggtagatgtacaaatgattttgtcattacgagtatctggttagaatgttattttgttaatacaaggcatggttccatattattgtacattactttcgttctaaactgtacatataagcaaataacttgaccctct

SEQ ID NO: 29871 - DNA, 302 bp, Sorghum bicolor
  Clone ID: 9307149
gtatggtttgcaaagtttcctcaattttgcggtagttttgaccctgcatgctcccatatgggagtaggaggttaagggcaattttgccattggagcatcggttggtgagtaaaacccccctcaatttttcagggcccaggttgagtaaatgaaaccctaggcaaaaaaaaagctggcgaaaaaggttgtcgcccctaaacagactggtgccatttttttttgaacccccaactatcaatatagaagggccagttattaaaagattttcaacatgtatattgaagggatttgagttgctgtcc

SEQ ID NO: 29872 - DNA, 595 bp, Sorghum bicolor
  Clone ID: 9307152
accggaagtccagaaaaggagtcgtgtgccaaaacataaggagatttcgacaccaggcagcaaatctaatgaaggcagtgagaaagccaaacggaaggcatcagctttgtcatatcaaggcctgagatcgagcaaatctggtgttgtgaagaaggtgaaagtgaaccagcaacccagcagcaaagggaagcagagcaaaactaatgaaactggagcgagtgctcgcaaagataagcgacccgctgtggctgcaagaaaagcaaagcagctagccaagaaacgcaaggtggatgcctcaactcttgagaatacacacaggagcaagaaaccaaggaagtagttatttattgtgttgttgtttgcccttgccacattgtagcaggagtttcactgaatcgaatttttgacaagcttgtcacctggtcagatgatcttgcatagaggcaatgtgcggccttaagtgaggttagggcaatacaggagcgattctggaaatgtaagcatgatatgagttcaaggtagtaactcggtactcgccactataacccttgtaaccttatttgatatttgttttgttttttgtagtttttcctcc

SEQ ID NO: 29873 - DNA, 542 bp, Sorghum bicolor
  Clone ID: 9307154
gagtatgggttaaagcatggagcggagtttatgggcagatggaccaagtagacttgattggtaactgctgcctttcatctgttgacttgacgcgacaaacgaaggaaacacatacaggatcttttgagattaatggcggcaaagcccccgagcacggagagagagagaaggacgagaaaacagaatcagggatgtcaggagataccacagaaccgccgtccaaacaaacaacatattttctcttccaatgcttccacaggcaggcacagtatctatgccagcgggcaaggtggaagcatttggttcctccaatgtaaaaggtcggaagcatcttcccgttgcatgtcgcttgatccgccgagcattttggacctcgtggaaccccaaaggaagggcgtgagggagaactgagatggggaaggggaagtagggaccatggtcaaccatgacaggcgggcattttgggagctagcttccttggcgggtcggccttacaggtttgtttgcagtcttcgtatagaaaagttagattttcggctttg

SEQ ID NO: 29874 - DNA, 579 bp, Sorghum bicolor
  Clone ID: 9307172
gagagagtgggtggatcagttggagattctaaaccatatcagcgtacaagggttcttgagccattgcgggtggaactcggtactcgagactgtgacagccggtgtgccattagcggtttggcctatgcatgctgatcaaccattcaattcgaggttcttagtcgatgagctgaagattgctgtaagggttcatacaagtgataggacaattagaggtttggtcacaagcgaggagatttcggaagtggtgagggctctcatgctaggcgaggagggggtggaggcaggaaagagggtggtggagctgtcagctagtgctagggaggctatggtagaaggaggacaatcatggaaatctctaaaagagatgataagtgagttgagcatgatgaagttgaatgggaatgaagaggtaagcctagaggagcaagtggatgcttaattagtgtttgttctaagttgtccattgtttattttcttcacaaatgactaggtggaggcaggaagaaagaccatgtgttggctttgaactgtaaagggaaaatttctctgtgaatgatagatcttccatccattttg

SEQ ID NO: 29875 - DNA, 526 bp, Sorghum bicolor
  Clone ID: 9307178
catggcggcggccgaggcgctgttcggactccgcgtcgtcgcgcagcggcggaaggacggcggcaggctcgcgccgggcgtcgctggcgaggccttctcgatcgcttacatccatgcgatttgcgtcgtgctggagatcatcgtcagctgcatgttttacaggagctgcaagaggagtgaagccgacgagctcagagagctcgagccagaggagaagggagatctccaggcttgatcagtgatcccctctcaacttcagcttcagtttggtgcatgaacaaggaaaaaaacatacaaatagtagaatcatagtttgtttgtctttctgatgagaagcaagaggatcagatcatagggtacagagctgatccagagaaatatagtggtaagccaagatagattttctgcaaaaatgtttcttttttatgaaaagaaaatggtaaaaaattgagttcaaataaatggttatcttgtacataaggagatactctcttcaactgaaataagaaagcagggaattggagtt

SEQ ID NO: 29876 - DNA, 500 bp, Sorghum bicolor
  Clone ID: 9307391
gcacgagggtttggagcttgatttagagaagtatgtagttccaacaccaaacatgggctcaggtgttgtttatgcagctaacttgactgaaaatccacgctcattattgcaaactgggagttcctcaaacaatgataccacaaaggacattttgcacagctcaactaaaggagactcatcctcgaatcactatgttaacactatgaagagtgcaattggagggcatgcgccatcactggaagaacaaagggcaatgtttgttgatagaggtgttggctcaccaaactttgcaagaccaacaaaggaaaccttttcgatgagcaactttaagttggattctgactcaaagggtatgccagcagcagaaggcgctgttgcagcagctgcagtagctgatcagatgtatgggccaaaagaggaccgcaagttggccatcgtgttggttgggctaccagctcgtggtaagacctttacagcagctaaacttacaagatatctca

SEQ ID NO: 29877 - DNA, 541 bp, Sorghum bicolor
  Clone ID: 9307395
gcacgaggagaagatgagagagagagatcagtagtacagtagtcgtttgttcaatcgtctgccggggtcccaaatctcacttcagccagcagagcgcagctgtacagctggtgggatcaatggttgccaagacgaggcgacaactcgccaagctgacgctgcttctactcgccctgctcctcctcctcgccgccatcttgctgtgcgtcttcctgatcccgcgccaccacaggaggccgctgccccctgcctcgccgccgccggggaacgcgtcgaaccccgacgacagcatcgtggcgttcgacttctccccgtacctcatcatgtacaagagcggccgcgtgcaccggctggacggcaccgcccggtgctcggccggcgtcgacgaggccacgggggtgacctccaaggacgtggtgctcgacagccggaccgggctcgcggcacggatgtacctgccccccaaggaccccggcagcagcggcaggcggcacccggtgctggtgttctaccacggcggcgcgttcgtgatcgagtcggc

SEQ ID NO: 29878 - DNA, 472 bp, Sorghum bicolor
  Clone ID: 9307407
gcacgaggtaaagagaaaatatgatttgttaattaaagaacatgactccactcatcttcagcaaaagaaggcacttgatggtttttatgagaaagttcaacgcaaccaatcactggctgaggattttcgggccaaatttatatcaccgtccgcagcacaaggtgcggcaaaagcccatacccctccagttcgtcgcacacctcaggctacgccacaagtgatgaggcctccattgttggactcagcatcatcaattgccctgtcatcagcttgtcgaccaccagtgccgaggcctagggtccaagcaccacaggtggaccaagcatcatcgtcattgttgcagttgtcccgtccgtcattgccgtctttgcaagtggtccaacctccaaacttggaacaaggcaatcttttcagaacaacggcaacgactcttagtcacatgccacctccacgtgggagctatggagttcag

SEQ ID NO: 29879 - DNA, 438 bp, Sorghum bicolor
  Clone ID: 9307408
gcacgagggcctcctccaccagtaccagcaccagccgacccccgccacaaccttcttcatgcccatcccctccttccccaaccacaatcagcagtcgccactcgttcaaccaccgcccaaacgtcatcaatccataggggatgacctctatctcgcccgaaatcggcttctgtctccgccggcggggcaaggtcacgcctttccaccactaaatggtcctgctccgttccagctccagccttcgccaccaccgccccacggggcgatgaagacgacggctgcggaggcagcgcagcagcagttgctggacgagcttgcggcggcggcaaaggccgctgaagccggcaattccattggcgcgcgagagatattggcgcggctcaatcaccagcttcccccgctcgggaagccgttcctccgctccgcctcctacctcaa

SEQ ID NO: 29880 - DNA, 595 bp, Sorghum bicolor
  unsure (1)..(595): unsure at all n locations
  Clone ID: 9307411
gcacgaggggaaaaaggcttatggaaatgatgatgaaattgccagagacttttgtagcaaggttgaccacatcctngaaaaaacactcgggcattggtgtcaagaaacttgtgattgacatgtgtggatgttatgctgccaatgattcttgttatatcaacagttggcttctgactgctgttacaccaggaattgaagaacttttacttgcactgccagtgggggcaacatacaaattcccatgctcacttttgtctaatgggagagactcaatccggtatctcctactttctggttgctccttgcaacccacagctgaacttccttggttaaaaagattgacaaaagtggagcttcatgctctctgttttacgaaggatgagttagggtgccttctatgcaattcttttgctttggagcggttggtaatcaggcactgtgatgagatagattgcttgaagatcccttgcgtgctgcagcagctcaggtacctagacgttatttgctgtgacgatctgcaagtgatagacaacaaagctccaaatatatccagcttcttctactgcggaggttgcattcaactgtcacttggaga

SEQ ID NO: 29881 - DNA, 519 bp, Sorghum bicolor
  unsure (1)..(519): unsure at all n locations
  Clone ID: 9307414
gcacgagggtccactgtccgggagcatttatctctctagagactattggtcgccacgcactcgccgctatcttcatgattgcgtctgtatcgctctcgttgctccgttcctgttcttccgctgcctctcccaaccttttatcatcgaattcttattcttcctcgtcactcgtcagagttattgttcgtgaccacttttctatgacactctgagtgcttggttactggttctgtaactcgtcggccatcatcagttcaccactcgccaatcgtcatgtcagggcagagctcaagctcctatggtgacactgaccatggcacggacagcgcatccagcagcatcggatgggcaccacacggccgcggcatgacggcctgcctcatcgtcgtcaacgtcgtgctcgtcgccctcgtctacctctacttctggaggctgttctcccgcaaacgcgccggcgcgtcctcctcagccactaacaaccccgtggaccacgacgacgatgacgacgcatcgtncacc

SEQ ID NO: 29882 - DNA, 592 bp, Sorghum bicolor
  Clone ID: 9307423
gcacgaggaaaatatttttataccactttttgataaatatttttttataaaagtaacaagttaaaggtagactttgaagaccgtgccattgtctaaaacgacttattttataggtatgaagagagtatgtaatattatatttatatttaattatcacagttgcaatatagttcttatattatagataatcgaagttgatgttttagtttcgtatttaaagttagagttaactatctatcgtacgggttttaccagagaaagagagacagggactgacggacgggcgtgcgatgtactagtgtggtaggattaggccggactggaggaggaagcggccgtctccgtctccgcccgggtcacgtcgtcgaggagaggtggccccaggctgacgatggaccaccactgtcccacccactgcgtctgcatgtacgtcgcgtgtcgcgctgcccgatcttatccgcttcgcctggggcccagccgtttgccaccgtatacctgggcctccgacccaccccctgtcgcactcgtcactcgtgtgccggccggcgacggcgatggcgactggccgatcgctcgccgcggtatactccgc

SEQ ID NO: 29883 - DNA, 460 bp, Sorghum bicolor
  Clone ID: 9307434
gcacgaggtatcactctgcgcaggaaggaatctccacgcctcgtgctcttgacttgtcaagcgactctgctgtttcttggttgcaaggaaaggaatggaacaggacgcggcgaatctgagcgccggcgccggcgaggaggaagaggaagctgcggtgcgcgcctccggcggcgggttcgacttcgacccgacggaggacgagctggtgctgcacttcctgcgcccgcagctgcgcgggttcccgccgcgcgtggcgggcgccgtactggaggaggacccctgcggcgcggcgccgtgggagctgctggcgcggtacggcctgcgggagcggggccacttcttcgtggcgcgcgggcgggggcggtccgccgtgcgccgcgccgtgagtggcgccggcgcctggatgcgcagcgccaccaggctcgggcagtccgtgacggacctcggcgtggtggtgcgg

SEQ ID NO: 29884 - DNA, 492 bp, Sorghum bicolor
  Clone ID: 9307450
gcacgagggcaccccggaacgagagaacccaggccaggagagaggtgaggcagagagagagagagagaacagagaagggggcggaggaaacccttttcttcgccctcgccgccgccttctcctttcccggtcgcgtcttcttgggggttctcccgtaccctcttgaatccgccggcgagttcttgcgtccgggcgtggcaatccacacatatcttttgttttttttttctctctcaaccctgttcctgaacccgtgtaactgaagaaacaagaacccaatcaatcgaatcgaatttgaaaggaacgtaaatttaatctgctactaggggagggagaagtgcgtgcgttcgtccgggcgggcggtcttggcaaggcgggccggccggccggccgattgatcggcgatggcgccgccgtcgagggactactggctcggcttcttccgcggcgcgggggacaacatcttcgacgccatcgacgcggccatcaccg

SEQ ID NO: 29885 - DNA, 545 bp, Sorghum bicolor
  Clone ID: 9307458
gcacgagggaagagctttatggagcatttgggttttctagtgaaggaataaagttgtggaaatgtgtccttcgctgtttgatccatccaattgtctgaccaaaggagaactgagcttcctttattgggtgagcaaatggagatattttggaaaattgggaagagtttcattatgtctttccaccagggggagccgacagggcttcttgcatgtggaggaatggactcatttgcatacagtttgctccatgttagcttgacctagggcagatctgctctgttataaaatttatctaagaattttagtaacagggcttcattttgtttctgaatgtcaatgatacccaggcccccctcatctttgggtctacaggcagtctcccaagctactagacattttcctttcctatttatatctcctttgtcccaaaggcaatgctttctgtagatatcgatttgcttgataactgctgggggcagctttatggtgcacatgtaaaatgttggtaaggcagagaagacagagttcactaatataagtctgcc

SEQ ID NO: 29886 - DNA, 605 bp, Sorghum bicolor
  Clone ID: 9307470
gcacgaggtgccatttttccccttcatgagcctatgatgaagattccatactcattactcaagaatatgatatgatgttaaatatttctaggttctattgtgtactctgattgacacattctatttctataataattcaataatatatgttcacaaggtctatttgaccttttcaatacaaaatggttgtttaagatactaaaatgggcatcctatcttattggcttatctgaaaatcattgttgccttctttgccagatcaattgttcttcttcgactaatatgatctctccttcaattgggaatgcgtccatgaacaatcagcgtggacacgttagtaaaaaatggtggtatatgggttgtgaattatgcaagaaaaggctacataatgaaggtggctcatattactgtcagccttgcgattgccgaagcgccataccaatgtataaattttcacttattgcagccgatgaaactgctgaagcaagatttttctgccatgatatagttgctcatcacctcatatgtcgcaactacaattcgctgctcaaacctattagctatccaccaggcttacctgcacaaatgctagctattatccctag

SEQ ID NO: 29887 - DNA, 488 bp, Sorghum bicolor
  Clone ID: 9307480
gcgccgggtgggtgctggaggagtaccagatcacggacccgcggtgctaccgccgcgccgacgaggaggaagaggaccagtactggatcctctgccgtgtcaggaggagcggagatcatgggcggcggacagagtctgaggctggagctgggatgccgccgacgagctggaacaaggttatggagtgagtgatgaaggccaccgccgccgcgcacggaaagcagaaagcacgaggtgaagatgttgtttttaattatttgtttgattgatagaaaagaagttaaccaaaagtgagtcgcctccatgaatcggcggtaaaaattggttggcagatgtttgtactgtactgtactgtacgatgatcatccgtcgaaagttgcaactgccaccaaattgaacgcctgcctgcatctgtaatggcctcagcagcagtcagcaagggagggcctcgatccgtttataaatttggctcgacagcactgctctgc

SEQ ID NO: 29888 - DNA, 429 bp, Sorghum bicolor
  Clone ID: 9307496
tcggtgtccgcggcggcgcgtgggcgtggcggcctcgaccaccgcggcaggagaggcggcggcaacggcaacggcaacggcaagcagcagctggacgataagcagcagtacttcatgctttagttccagcagtatatgtcagtccgatcgagtttttgtgtttttctttttagccgattgcgttggatgagagtactgtatgttagtatatatatatgtacatgcatgcatacatgcagctggggaaaatgcatggcgaatgagaactggttcggttcacccatgcaagcaaaaatatgtgtatacattttcaacagcataggcttagcatgccactgctaaggtttaattttacaaacttgcaacatatatagtctgtgactctgtacatattagtgttgctgaagtatctatatacatgtttttttt

SEQ ID NO: 29889 - DNA, 195 bp, Sorghum bicolor
  Clone ID: 9307519
aaaccccattggctttccattaaattcgtcgttttgttagggtagggaaactgaggaggttttaggttcccttggtatgatgtaaaaaaaccaccaggtagccccgtcaaatttggagtgtattgtacatgtagtttttggatgagtttttgaccaattggctattgacttatttgggggtgttatttgcggccc

SEQ ID NO: 29890 - DNA, 582 bp, Sorghum bicolor
  Clone ID: 9307727
gcacgaggaagaaagccccgcctggtctgtccgatactggagcgttaaggcaatgtatggagaacctagaagttttcccagcggagcaagatgagattacccggaaagaagcactccagctactgcggcgaattatttcggagtcggaaccaacaaattcagatcaaacacggggtcgtcccaccgttatattagtccctgtagggtcgtatggcctcggcacctggtctaggacatccgatattgattgcctttgcattggatccattagcccccgaatcttcttcaccctcgcccgtcaaaggctgagaaagtcgggggagccgggcatccgattgttgaggaaagtaaaggccaagactggcaccatgctcgaggtcgaggtgatgggcataaagtgcgaccttcaatattgccaagcgcccagcgtagcagaccagtggcctgacatgttgaagcggccttcatcggacccggcctttactttgccaatgcagacactcctgaagctgaagcctgcaagggatctattctatttgcagcgctctatacctgatctggcacagttccgcgtgtgtttcc

SEQ ID NO: 29891 - DNA, 556 bp, Sorghum bicolor
  Clone ID: 9307735
gcacgaggcagaaaccttctaacaatatttaatgtgaatgagcaatacctacaatttgagaagggttggttctcggatttgcggaaaattgcagttctccaactaggaaggtggcacaacttacgtcgacaccatattgaggttgacagtactgaatttttagaaggactgcagttatccaatcaattgaaatatctttgtctgagaggcatctctagaatcattgaacttcctgcttccattggtggactctcaaatctcagaatcttggaccttcatgcctgtcacaaccttgagatactgagtgctagcatcacgtctcttcagatgctcacccaccttgatgtgtcagagtgttacttgctggaaggcatgccaaggggtattggcttgcttactgaactccaagtgctgaaagggtttgtcattggtggttcaactggcaactacaattgtcgggtagcagagttggctaggctggacaaattgaagaagctgaccatatatattggaagcaaagttacagtgacagaagatgaactgaatgaacttgaga

SEQ ID NO: 29892 - DNA, 471 bp, Sorghum bicolor
  Clone ID: 9307749
gcacgaggaaagcatccgaagctactgcttcctcagggaactggagatagtaaactgttgggaattttctgctctaccggattggcttggagaactgacgtcgctacagaagctgacagtgcacgctgccaaactggaggttttaccccaatcgatccgatacctgactactttggacacgttagttctcaagaagagcaatttcagaatccttgagggttgcacactgggaaaggactttgacaatattaaacacatcaaacatatacgttataaacctcagagacctgttctttccttctgcagaagtggccctcatattgttgagctacaaattgaggatcttcatcttgtcaaccgagcagaggaagcagaggatttgaatttgattgggaaaaagaatctgcgttcactgagtttggactggagttcttattataaagaaagcttacctaataagcttgttttaga

SEQ ID NO: 29893 - DNA, 557 bp, Sorghum bicolor
  Clone ID: 9307751
gcacgagggatatatgtgccttataggcaatagtatgcatgagcagctttctgtgaagggttttcaaaatggtccaattgtggaggattcagaactctcaacacttttatctcttccggactatgatagctttgttagataaagattggtcaataacaaaactagaaaagggaatattgatgacacttcatacttctctactattgttgaacagttgagcaaccaagctgaatactcttcaagttttttaaaagatttgtcaacctacatgaatagcaatattattgtggtgcttcgttcactgcaactagtgagcaacacctttgttcatactctagaagagcatgacatgttgaagattgaattggggaacaatgatgctcataacagagctcaagaatctgaagtgctttctctacaaaaagagctgagagcaatgtcatcaaaatgtatttattgcatccaacaaattgaaattgtttttgatgatatggttggacttggatatgcaatagacttggctacaggcatctcaagcatagggtctgaactataat

SEQ ID NO: 29894 - DNA, 258 bp, Sorghum bicolor
  Clone ID: 9307785
ctcgccgtgtccggctcgccgaggttccgcgtctacgacctggacttcggattcgtccgaccggcgaaggtggaggtcgtgcccgtgacgaggaccggcgtagtggcggtggcggagagccgggttggggacggcgggatagaggtgggggtctctctccagccggctgccatggggagctacaagaagtgcttggcggatgctatcgcgtggctccaccagagaagacatgagagcggcgactcgttctaaatctgc

SEQ ID NO: 29895 - DNA, 574 bp, Sorghum bicolor
  Clone ID: 9307789
ttagatgatcgcgaatggggcgtttacgtcgatgaagactacgagtcagatatggaggacgaagaagagaatgaagacgaagagatccaggagtggctcgtggagaagacaagaaaaggtaaattgataaagcaacgctcggcgaccgcccggaaacccgagggtgcgggtaaattccgcacagcactcgatgtgctgaataggctgcgatgggacccggatatggacaccaacgacttcatcatcgggtacgaggaccgtttcctagggccacaggaaaaggctctttccgcctggaaaagcgaacagacacacgaagaattcatcccccagcaccgcatcttgtggttcaagcgccgaagtgacaatgtcatagtgtggcataggtctgagcgtatcgaccttctcttcaaaaagacataaggcaacgattcgaacacaacacaatagaaacgaggtcaacgggaattggttccacgtcaagagcctcggaacggcttggcaccgtcgagatgagctctgacaaaggcgtctgcaagacggtcttgtgcgaggaggatgggattattctagc

SEQ ID NO: 29896 - DNA, 196 bp, Sorghum bicolor
  Clone ID: 9307818
cttgtaggctcattttctgtcaagcctgtgttagacagagtgaagttccccttggtgggtctggcaggctccctgatcctttgcattcttctttacgttaccaccgaaaacccaaaggagccatatgttaataccggtggaaggagctatccctggagtgtacagtgacactcccgcaaggtcatttgagcgtgat

SEQ ID NO: 29897 - DNA, 562 bp, Sorghum bicolor
  Clone ID: 9307820
gacgctgctcctcgccgacgaacacgtcgccgggctgcagtttgtgagggacggcaactggtaccgcgtcccgcccgtgcatggccgggcggccttgctggtcaacgtcggcgtctcgttggaggcaatagccgtctctctgaacttgtgtgatatttgcagtcatgtatgcagattatgactttctgatttcttggctgttttcgtcggacacttgtgaccgagatgtgcagataatgtcgaacgggatcttcaaggggccggtgcacagggtggtgacgaactctgagaaggagaggatgtccctggccatgttctacgctacggattttgagaaagagatcgagccgatcgctgaactggtagatgagaagcggccagcacggtataagaagatcaagttcagggatcttgtggctgctcactatgagtacttctcaagaagggagagagtcatcgagtcgctaaagatctagttaaagatttaaagtcatgttcctcgtagacttaagggttggacatagttataaactcttaaaatggtacatagttaacccccaat

SEQ ID NO: 29898 - DNA, 591 bp, Sorghum bicolor
  Clone ID: 9307826
aactttacctgcatgcatccaacggctcactggattgcaggctttgaccctgtcaaaatgcggatcagtgcttgtggaaagatacaagttcggggaggacaaggataagatagtacacattccaaatttacatatagagcggagaaaatggaccttctcttcttcaacatccgcgctgtaaacataggatcaatcttctccagcatcacagaaggtgagaagggatcacgcgctgttcagcatcaggacaccatccaccgaaatcaatatccatgtccgaagcagcctacagagatactgagcatggcatcatttgaggctaagtcaaaggatagcaaagagccaaagatcaatgatgaagctggctagagaactagagtagttgatgggacaacactagctgttacttatatgtgatgaagacaaaatcatcttcttaattaggtactactaagtttggataaacaatagagttatcagtatcacatcaattcgtgctccagcaaatcccagaataccatgttacataaatattgaaattcttgtgataaattttaatacattaatttgctttactctaatcaccagccg

SEQ ID NO: 29899 - DNA, 432 bp, Sorghum bicolor
  unsure (1)..(432): unsure at all n locations
  Clone ID: 9307892
atctgncattagnaagccatgatggtnncttctgtnctgttgatgtaaagaaaatgnaagtttctcnctggagcaagaaagttcatcttggttccccagtcacctccattgnattttgtcctactnaaagggttataatctccacatcacatcaatgggaagcagagttgacaaaactgaatgtgccggctgactggaaagaatggcaggtctggctcgtactcctggcgctcttcctagcgtccgccatcctgttctatgtgttctatgagcgctcggacacattctggaacttccccatggggcgacaccagccagcgaagccatggaacatgctcaaggagtctcctccggtccccgaggaccagaatccatggtgatgttatgcttcattgcgtcattcgtgaagagtgatactagcccaattcccaa

SEQ ID NO: 29900 - DNA, 623 bp, Sorghum bicolor
  Clone ID: 9307938
cgcgttccagggctggagcgagggcgccatcaccttctccccgacctacaagtactaccccaactccgacgcctactacggctgcgccaccgccggccaaggccacaggagcaacaagcggcgcgcgccggcgtggtgcgaccgcatcctgtggcgcggcgcggggctgaggcagacccgctacggccgctgcgagtcccggctgtcggaccaccgccccgtccgcgccgtcttcacggtggaggtggacgctcccaggaacctcaactcgctcaggagcttcttcatgtccgagaggttcgacagggctggcagcaggagccccggcgccgccgaccagctgctccgcaaggacgacgtcgttaacagcgccagattcggagacactctttgagacgtgcatgcatgagatcagggtggaatcgtcagcccagttcttctcccgattaagattgtacacaacacaggcaaaagctaagagagatgcagatcagtatatatatgattgttcttcatttctgagtcagtgttcgtaagatcgtatctactacaggtagctaggatacagagaggctttttttttgtttccaccctgttcctacgttctgtatgtaattgtaata

SEQ ID NO: 29901 - DNA, 712 bp, Sorghum bicolor
  Clone ID: 9307939
tggttcacagtttgattgctgctggccaggatgtaccaaatgaactcatggatctggctatgaaggatggaagattcagagcaaaacgggactccaggaaaggtgggaagaaaggtggcaaaggaaaaggtggtggtggaggtgctgggcgcggtcgtggtgtgcgtggagttgattttggcctcggcataggttacaatgctgaatctggttcgcaagtgcctcctccaagatctgctgctgtaaattcgttgaagacagggatgatgcagcaatttaagagcagctttgtctctggatcttcaaatacaccaagcagcagtgcgccttcctttgtaagaccagcactccgtggctttgtgtctggcggcaccattggaggagatgcacggcctgcacagtcggcccccacttttgtccctgcatcccggccagcgcagcctgccccctctgtccctgcaccgcggcctgcaggaaacatcaatgaaaatgggaactcaaatccagaaagttcacgggatcggtccagggagagaaaacgaccatcaggttgggatcgctagtccctgctaactggtgtgccgagttgtgattcctttccccctttgttatattgatgtagtctcctgggagacatcctataaaaaaaggcatattgatgtacactgtagattacatgagtcacggttgtgaatgataagtgtgttttttt

SEQ ID NO: 29902 - DNA, 600 bp, Sorghum bicolor
  Clone ID: 9307982
aaaatcaagcatctgtcagctgttctacacaagaaggataaacattctaggaaggggcttcaggagatggtccaaaggaggaagaaatacctgaaatacttgcgcagaaccgactgggattcgtactgtcttgttctgtcaaagatggggcttcgcgatgtgccagagtacaaagctcttgactacaagagcaaagcaaccaccaaggccaaatctaagaagaagagcaagggcaagggcaagaagagaaaggtgaaggcatagaggtggtgaacaaatctgcccttcttttggccaaatctaattataagaagaagagcaagggcaagaagagaaacgctcaggcccgagatggctcgatccagtattgcaatgctgtatttgaagctgtttgtaataaccatttctctggagtctagatgcctatgtttttccttgtcttgctaggagctgcagccttctctaacaactgatttcttcttgcccttaggtcttgtttacttccaccccaaaacttaattttttttaagattccccatcatcaaatctttagacgtatgtatgaagtattaaatatagacgaaaataaaaattaattga

SEQ ID NO: 29903 - DNA, 637 bp, Sorghum bicolor
  Clone ID: 9307984
tggtgtttacgcaaatactgcaggggagatccccacagtgaaattgtgtattaaaatttaaaggatgcttcagattttggtgttttttccttgtgtaggctatctacaattcaaacagctgacagaattattgtcatggaaaatggtaatatcgtggaggatggtaaacacattgatcttattgagaagggtggtttatattcaagattagccaggcgacaaaatgacaaccttaagtagccctgaaatcacagaatgtggtttactccacgcgtttttttttcagtggaatggcagaagtgagagtcgtctgtcattggtgtattctttgcaaggactgacctggacccaggagctcgaataagctggcattgtttttgccatcaagcagaaacgatttacgactaatcaaactaaaccaagatggtttccccccacgaggacgagcacagtaagtatcgagtattgagagcagactttgaagaacccagtagtttgtaaagatagcttccaccgcatcccgtcagatccagcatgcatgtaactagaagtatataggcatttgttatcttgttacatctgaaacttattttacacacggagttacctttaaaaaaaatacacacggagaaaatgc

SEQ ID NO: 29904 - DNA, 627 bp, Sorghum bicolor
  Clone ID: 9307989
tcccatcaacagcgccatacagcctcgccgagtgcgttcatgacctcctccacctcgctgcaaggatggtagtcatggggggcaggctcgtcttcttctaccctgtattgcgaggtgaagatggcgctgccagcccgcagttccctgagcacccatgcttcaagctgatcacctcctctgagcagatcctgagctttcggtacagccgggttctgctgaccatggtgaaggtcgcaccctacaccgaggagattgagaagatggccgcagagaggcaccaggagttcagggagaaccaccacaagtggatggaggagggcaatctccactctgccgtgtttgagccagcggatgggaagcctgatagagactccaagcccaaatacagaggcaagtacgtgtagcagcgcagatactaactcgttgaatttagtggaaagacatttttaatggtgtcctgttctgcatcctgagctagaagagtgttggcaggcgctgcgagatgtaccactgtcccagaatgtaattgtatctctattttgtctgaacttaaattttttgttaacctgcctttaacacggcagtcgaaattggtgctgcttctgctgaattatgcggaacacatgc

SEQ ID NO: 29905 - DNA, 712 bp, Sorghum bicolor
  Clone ID: 9308031
taccttcatgaggagtgtgaaaaagtcatcatacatcgcgacattaaagcaagcaatgtgctcatcgacaatgagatcaatgggcggataggtgattttggtcttgcaaaattgtatgatcatggcactgacccagaagcaacacatgtagttggcaccataggatacctagctccagagctagcacgcactagcagggcaaatcctttaacagatgtatttgcttttggtatattcattcttgaggtcacatgtgggcaaaggcctatcaagcaaaatactgaaggcatacaggtaatgttagttgactgggttttggaacattggcataaagggtcacttactgatgcggtggacatcaaaattcaaggtgaatatgatattgatgaggcatgtctagcactgaagctaggattgttatgctcccacccattcactagagcaaggccaaatatgaggcaagtcatgcagtaccttaacaaagaaatgccaataccagagttaacaccaaacataaatttctccatgctagccttgatgcagaatgatgagctcataatgcactgtccatcggaaattggctttggcacaatatctacaatctcaggaggtagatgactagatgacatgaggcttgacagtgcacatggccttcaatgtttgcatgcatacatagccaatgttgtgtaaagatgaagtaaactctataaat

SEQ ID NO: 29906 - DNA, 688 bp, Sorghum bicolor
  Clone ID: 9308046
cacgcaacatgtatcaggctctgtttgtttgttagacccatccttgcattggataatttggtcagtattagtgttgctctttgctcgtttttactgtgtatttgagctctttttccgtttgtaattctgtctgtgaaggtctgagtatttgtgttagctactgtctatgattctattttctgttagctcacctgatctttagctacgttgccagtatttgtttttttttttggtcttttgcttcaagaagagtgatgtcctaaagaattcattgttcagtttggtttgatgtccagtcttgttaatcaaaacaagaatgatgcaatagcttcttgctactctgctgtgcaaagttaatttctgttggcgtgaattgctatgggagtttcaaagggcggatgtactaactgctgttgatactctgctctaactcagaagacaatgttttgcgctagtgcggaggataattctgttcacaaactgaatactctattgtaaaacagtgtgagtttgatgcagttgcattgcattggtgatcagtattggttttctagttacatccgttatcaatgttggtttagagcgagcattgaagataagactttttatagcagacgatgagcttttctttcttgcatgtttgtttttcattgcaacccgatattataatacatcatgactatttcag

SEQ ID NO: 29907 - DNA, 359 bp, Sorghum bicolor
  unsure (1)..(359): unsure at all n locations
  Clone ID: 9308063
caaacgtatctttgatcaaacatgctgagttgattggagttcgttgaccaagccggcaatcctggatttggctttgtaatgaatattattactaaaaacatcctgaaaaagagggcagtcatttctgaaatttatcttttgctgaatgtccaagtcatccagaaggaagcagtccaaatcgtgccacttggaagctagcattttctgtccgggttggttgttgattggtgtttgtgaccaaactaaattatactactcagtatacactctggtgatcctcgttggctgcagcatctctagcatttcgtttttccagncccagtcgttaaaaaatttgagcttgctccccgaagtttaaa

SEQ ID NO: 29908 - DNA, 562 bp, Sorghum bicolor
  Clone ID: 9308064
acaacctgtggaccccggccacggtcgccgcggacatgtcgatgtcgtcgccaacgcaggcgcagactcccggcggcgccgcggcgggtggagtcagcgccgtgctcagcctgtcgtcccgcgaggcagcgccgccgccggtcacggtggccgcggtggccggccccggctgcaccgacgaggcgggcaagtaccacctgggcgtgtcggccacgtcgcaggggcagatggtgatgagctccaagtacctcaaggctgcgcaggagctgctcgacgaggtggtcagcgtcagcaagggcgtcgaggacgccaacaagacgacgaccaagagcctggcggcggtgaagaagaaggaggactcggagggggtgtccggtggcggcaccgaggacggttccggcgcaaagagcggcggcagcggcgcggcggagatgtccaccgcggagcggcaggagctgcagatgaagaagagcaagcttatcaacatgcttgacgaggtcagtagtataccagtatacataatagcacagtgtatatattgcttcaattcatactagttaag

SEQ ID NO: 29909 - DNA, 559 bp, Sorghum bicolor
  Clone ID: 9308108
caagtgaatttgtaagagaaagtatgagctcaggacaggactttgcaattacaaatttgccctgggaaaggtatgctaaagcttaaaaatgataaaatgacttgtttatattgaatcctttattctgctaaagttcacatcaatggagatatactgtaggattatatgatcaaactgaaactttagtctatctactactgctaatggtttagcactaggtgtcctttgttagagcttgttttgggtgtcaatgttatgcaattgcacttcaattgtgagctggaaaccccagccaagttgatcatttattaaaaactgaggcatgcctaaatgcctttgctctggtattgatcatttattgtgtttataggaggtttaacgagtaatgatttcatccttgctgcgaagatcaatgatctcacattagaaggcattataaggaagaagaaaactacatagctaatgtctcagaagtaactcagatcggtcgatccaagcagtcctgttttatgtactccactcaaaatatgtaactcgatttgcttgggaaaatgtaaca

SEQ ID NO: 29910 - DNA, 609 bp, Sorghum bicolor
  Clone ID: 9308126
gattaagtacaagaatactccattcaaattctgagttgaagggtcttgaaattttctcctcaattgctggagcaaactaaaggatctaacacagtttagtccaaagtattcaacataaaagatactttggaatcacaataagctgacaaatacatcaattttttttcgagaattgtaagactgctccattagtccatatcaatttgaccatctgaatttcataactttgtttttattctgttattcacatggctttttttaatattgttattatcaaagcagttgttgatgcaccttttgtatcctctctaacatgcttccattgctgttttgatgctgttacctgcttttcatgctaacatggcttcaatactataattgtttttgagccctttgagaattgtagccaccagcatgcctctccaaagacgtgggtcaaggttcaaaccggtagtggttgctgtcaaaagcagccagatttcttaacaactcgtgtgatgttgcattgctctctagattaccaatttgagcttgtaaataacactgtaggcatggaaggaaccaaatgtacaaaaatataattaactgctcatgaaatatcatatggag

SEQ ID NO: 29911 - DNA, 330 bp, Sorghum bicolor
  Clone ID: 9308153
gaattacttgagctcagctatcatcaccctcatcgcaggggtgaccagggtatggcatagtcctggatggatgccggatgatctgaacaagggacaccttgattactactactggtgtctcacagccctgtcgttggtgaattttgttgtgtatctgtattctgctagtaaatacaaattgaagaaagttgttatctggtaatactacttgtgaaatatcaccgagtgtcacatatgaaatgtttatttttattcttaacatgtatagcagtataggccatggaagcaccttatttccccaacatatcgtcccttgtttttctcgtagca

SEQ ID NO: 29912 - DNA, 288 bp, Sorghum bicolor
  Clone ID: 9308172
gagagagagagagagagagagtggggtagtaacgaatctgtataaattccccacctgcttagttaagtggcaaccgctattacttctagctagtacttagtagtattttgctgtgatcactgtgttacgtgtagctttctacattcgatttagttgagaaaaaaggaaagggggctgggttgattcagaggtcactgctctggggttttgtttttctgtcgccacttattggatgtctgattaggatgctacttgttcatagtggtttgttgataactggaataaata

SEQ ID NO: 29913 - DNA, 494 bp, Sorghum bicolor
  Clone ID: 9308175
cggcgcccgagagccagcagtggttccccacgctggcgtggaccaagtacgagaccggcgagctcgtggacctcgtcgcgtccagcagcggcgaggaggctggcgatgcggccgccgcgccgcgtgacgacgagcaagagcatgagccgcgtcgcgatgaagagatagtggagaggatgtgcaaggtcgcgttctggtgcgtgcagcagcagccggaagcgaggccgcccatgggtgcggtgttgaagatgctagagggcgagatgagcgtcgctgctcctgtgaacccgttccagcatctaatggcgacgccggtgacagccagacccgtggacgacgacgatgacaggtagcgcggacgcggtgtcagcaactgcaatttctgagactagcaacgagatcgtctccctttgacaattgcctgcacctgaaaatgggcaagacatagtcaaagctttgagcatctagtccatcgacctgtttcaaattgaaaa

SEQ ID NO: 29914 - DNA, 130 bp, Sorghum bicolor
  unsure (1)..(130): unsure at all n locations
  Clone ID: 9308183
ctnntgccacttagntgacaactgtagcttatgtttacttctgcttgtagtacatcgcctagatcgtgggagtccctcttttcagacgaatgtcatgaaacattggtttttgaaaatgatctggaagaca

SEQ ID NO: 29915 - DNA, 383 bp, Sorghum bicolor
  Clone ID: 9308209
cggtgtcgagcagagctatgtcggccaccgccggggacagctgcgacggcgacggcgacgaggccgagggcggcggcaggtcggagagctacggctgggagatgcagcagcagcagcagcagcagcatgggacaaaggcatggtcgtcgtcttgatgaaatgatgatccttgttcttccttggactggatcacgaattcacgattcacagcagtatagacgaggacactgcggatgaggcattttttgtacagccgttgagaggaattttttccccccttcgatccattttcttgcagcagagggaggaggatgtgatgaactgatccgagtgagtgttttcgctgggtggtgttgttgtaggggttgatcgagagtgtgaca

SEQ ID NO: 29916 - DNA, 564 bp, Sorghum bicolor
  Clone ID: 9308300
cgcctctcatcatggctggactcggtaccggcctggcgcctttccgcgccttcgtccagtaccgcgctctgcagaagtctcgcggcgaagagattggctccatcctgctctacctcggctcccgacaccagcgcgaggagtacctgtacggcgaggagtgggaggcctacgttgacgctggtgtcatcacccacctcggcgccgccttttcccgtgaccagccccgaaagatctacatccaggaccgcatgcgcgagtccatgcgcgacgtcgtgcagtcgtacatccgtgacgaaggcagcttttacctgtgcggccccacctggccggtgcccgacgtcaccgacgtgctgatggaggccatcaacaccgaggccaagatgagcggcaggaaggtcaacgcccgtaacgagattgagaagctcaaggaggatggccgctatgtcctcgaggtgtattagactgttgaaccctccttttgttaggaatcttacaggggtggttgtaatcgctacattgtgtatatatcgtctacggctgtcagtcgaaaaagttttttttgcg

SEQ ID NO: 29917 - DNA, 494 bp, Sorghum bicolor
  Clone ID: 9308301
tgctggcagaaagaagagtttacaactagcagaagctcttcggatgcaaatggaggttcagaaacaacttcatgaacaattagaggtgcaaaggcagctacaggtacgcatagaagaacatgcaaagtatttgcagaagatattagaacaacagaaggcaagtaattcattaccagctatgacaagttcaatagaaagagagctttttgaatttaaagaggaaaagaaacccaagacgcaagcggacactttttcagctccattgccaaattaaaaaaaaacagatactgacatggaatgactcacaagtcataagtgaataaccaaaaagaaaaaagcaaagcctcaggttgattttgagaaggagcaactatgtttatagccgttatgaacaattgaatatgttgactcgcctactttcaaaaaaataatgttgacttgccaagcactttccttttttaaccttgtagaatattagcacttttgcctaaaag

SEQ ID NO: 29918 - DNA, 223 bp, Sorghum bicolor
  Clone ID: 9308309
ttactctgtgtgaacaataagtgtagattttaaaaatgtcagacttgagacgctgactatatttgacctgcatagtcatgttccgttgaaaggtgctgtgggaaaaaagttgtattgctttcaagcagagaaggctttgtatcccccccagcaaagctccttgcttttaaatagtagcagggtagtttttgtatgatttgcagttataatttttattggggtt

SEQ ID NO: 29919 - DNA, 358 bp, Sorghum bicolor
  Clone ID: 9308327
gcacgaggctaccaacacgcgcgcgctggcttcttctagctcggttgctagcaacaagacacggatcatcagagatagagagagagagctctgctgatctgacggtcccgctcttgttcttgtacggcgccggtggctagcagctgtagcctttttgtgtgttgttgttgcctaccaccaccaccaccaccaccccgcagctcactaacatcaatcacacacgagcaagctagcaataaccttgccgcaagctaaggggaaggtgaaaaaagggccagttgtttttgctcacggagatcgatcgaaagaggtccttgatcgacaccaccatggtgaggccgccgtgctgcgacaagga

SEQ ID NO: 29920 - DNA, 345 bp, Sorghum bicolor
  Clone ID: 9308331
gcacgaggatattgtaactgcttgttctgatggcactacgaggatatggacagcagattctagcaggttctgcagtgatgaggaacttgcagcttatacagatcttatttctcaatacacactcagcagaaagactgttggtgggcttaagttgatggatctaccaggagtggaggcactgcaagttccagggaactctgatggacaaacactaattgttagagaaggggacaatggtgtagcatattcttggaattcagcacagttaaaatgggacaaaattggtgaagtagtggatgggcctggtgatgctgctcaaggccaggctcatgatggtgttcggta

SEQ ID NO: 29921 - DNA, 280 bp, Sorghum bicolor
  Clone ID: 9308342
gcacgagggaagatgtgggcaacagtatgttaccacctggtgattgtgtcaaagctggaacaggaagaacatccaagagagtgctagcaccagaaaataaagaagatacaatgagatgcactaggcaaagggctgcaagagaacaaatgtcgaccactagcctgattgaagccacagagggtggactggaacctgaattctctgcaaaccagaatcagggcgggaccaacaatattgaacaagggaagaaatttttttgatgtcatctagttggatgttg

SEQ ID NO: 29922 - DNA, 315 bp, Sorghum bicolor
  Clone ID: 9308355
gcacgaggctttaagcaagacatgtatgtcggcttctcggcagcaaccgggaagttggcgagctcacattacatcctcgcatggagcttccgtaccggcggagaagctcaagctatcgatctctcccggctccctaatgtcccaaagcctccagctcccccaccttccatgtccacggtcataaagatcgtggctgtatcttgcgtggccacgctcaccacgatcgttttggccattgcgtgtgcactttggctgcaacggagggccatcctcgcggagacgctcgaggagtgggagcgcaaccaccctgacagg

SEQ ID NO: 29923 - DNA, 479 bp, Sorghum bicolor
  Clone ID: 9308366
gcacgaggcctccttgctttttcagcgcgcctgattccggctgccccccctccggcctccgctcaggctcaggcctcagtcagtcctcggatcgatcgaatacagcagagctgttcccttccagccccaaattcaatccccctatgcttatgcttatgctggaccacgaccctccctcctggtagtggtggacactctagatttccatcaccgatttcgtatcttcttcctccgccagcgccgccgccgacgccccgcccacaaggttagctgctatccccaaatcgattcatgcgtgtccttcctcccacctcctgctggcttcacttcattccatttcgtccccatgctgatgctgcagcgggggtgcttccagtcggtcgccgcagcagagcatatgcattcccttcgcacatcaaactaaccaggttgggactgtatactactttcctttgctcgattaccagcctcagcacccc

SEQ ID NO: 29924 - DNA, 194 bp, Sorghum bicolor
  unsure (1)..(194): unsure at all n locations
  Clone ID: 9308368
gcacgaggggaagaggtgtgtgcggacaggacaggcaccgcgcgcgcttggcttgtccgcgcggcgggagtcgggagagagagaagcgcgcgccgccttagcttgcaatccaatcatagagcatgatggcgcaaccggcgggcggcggcggccagcatcagcatggtagtagtggtaggaacggcggcnangca

SEQ ID NO: 29925 - DNA, 492 bp, Sorghum bicolor
  Clone ID: 9308410
tcatcttggttcaatcctcacaaatctcacgtgcctgttgcccaaggccacattgatcaacctcagccgccacttagtccaaccaataattatgttctggagcataatgttgtggcggcgatgccagtacatacaagatggagtttggagagcactggagtttttgttgctacctgcctagttgtcattattcttgcatggttggttgctccacatgttggcaagaaagctgctgtaatctgtcttcatatgcttcttggaggtttatgcgtattgactgtagtaatatccctgagatttgttttcccaagaatccagtatgggtctatgcaatattgggcaatcttgttcgtgtcctggttccttgtgtttggtgtttgggcttcacgaacacgcagcgcacgctcctcatgagcatatagtgtagcatgagtcattgtagcagacccaattgcttcactacggcagttttaggtactgcatccttgtata

SEQ ID NO: 29926 - DNA, 108 bp, Sorghum bicolor
  Clone ID: 9308459
agtaccccatcctcatcaaggcgatggcgacggggctgcagctggtgagcgcctactggttcctgcggatcctcaggatggtcaggtacaagctcggcaagaagaagc

SEQ ID NO: 29927 - DNA, 410 bp, Sorghum bicolor
  unsure (1)..(410): unsure at all n locations
  Clone ID: 9308468
gcacgaggacatgatgtgaaacatccaagtttaactaaagcatgccaagttattgatgatgtccagatgggtctggacggaggattggtttattcaaagataattataatttagtaaatagtgatatgttgaaataaaagaaggatttgatataatatatctatttctttcatgtgattatgttgcacagtgacgacttcgtttgcatatggactgtaatttccaatagatacaatgaattgcatctttgtaacaactgcgaggcatacaattaaccttaactagtgaactaactttggttccaccagcttacccatttgctgatgttttacctgcgaggcatacagttaatcttagcttgtgattttttgacatgcttagttgtatttgacagtttgtctgggtgntct

SEQ ID NO: 29928 - DNA, 518 bp, Sorghum bicolor
  Clone ID: 9308470
gcacgaggccgcaatctattcagcagtggcaccgagaatgagttccacatgtcctcttttcgtattcttcactgctatttactgctttggccttgtgacatacggtattgctgttccatctggtctctttatccctgttatacttgctggggctacatacgggcgcatagtggggacccttcttggcccgatatcagaccttgatcctggactatttgcacttcttggtgcggcatctttcctcggtggcacaatgaggatgactgtatcagtctgtgtgatacttctggagctcaccaatgacctccttatgctcccgttagtcatgctcgttcttctgatatcgaagactatagccgacagctttaacaaaggggtttatgatcagattgtagtgatgaaaggtttgccattcctggaagctcatgccgaaccacacatgaggcacttggttgctggcgatgttgtgtctgggccactgatctccttttcaggcgtcgagagagtggggaatatcg

SEQ ID NO: 29929 - DNA, 500 bp, Sorghum bicolor
  Clone ID: 9308479
gcacgaggggagctcgacgaggccaccgacggcttcagcgacgaacgcgagctcggcgtcggcggcttcggcacagtgtacaaaggcacgaaaattaaagggtcttcagtactttcagcttgtcctgtccgatgcatggtttgatttcatcatcagaggttcaagctcagaaaaaaaatggcgtgcatgttgacggctgtgcagggactctgctggacggcagcgtggtggcggtgaagcggctgtacaagaacagctacaagagcgtggagcagttccagaacgaggtggagatcctgtcgcggctgcgccaccccaacctggtgacgctctacggctgcacctcgccgggcagcagccgcgacctgctcctcgtctacgagtacgtccccaacggcacgctggccgaccacctccacggcgcgcgcgccgaggtcgacgcctcctcccggtcgtcgacgtccccgccgccgctgacgccgacgctgtcgtggcccgtc

SEQ ID NO: 29930 - DNA, 392 bp, Sorghum bicolor
  Clone ID: 9308492
gcacgagggatctgcgctcgccattgctctatgctttgtaatgtggactaaattccatcttaccaaatgtgatattctataaatgatgtgacttgtctaagttttatattaggtactccctctgtttccatttataggccgttttggcttttctagatacacaacttttattatgtatctagacatatcgtatatgtaggtgcgtagcaaaagctatgtacatagaaaagcaaaaacaatctataatttgggacagagggtggtaagtgttttctttttgtttgtttcaatcccaaatcaatctaatgggtgaactgattttccatcccttgctcagtaactatttttcatgcatcaaacaactgatcgtctgatcctataattgaatgttc

SEQ ID NO: 29931 - DNA, 482 bp, Sorghum bicolor
  Clone ID: 9308505
gcacgaggtcagattggacaaaggatagggggaggaacaggcggtattctgatatccagagttatgatgatgaggatgaagatggggctcctgggttcaaaagggagcgccgaagcggtggtgggattgacgaggttggtagtagcgtgtcgggggtggctggggaggggccatcatcgaaggtggaggcgatgggagagtcggagctggaggatactgggtcaaaggctagttctaacagcaatgcccagcagaaagctgatgctttgcaagaggtggaggatgaaaatgaggcaaacaaaatgcaggagaacagtgtggtgtctaattcagacgtagtcgagcaagggttgaatggtgaggataatagcaataatggttcttctgatggtgttcaaggggcagagacaaaacatttgccagtatcctcaggtgaaaaggtctcagatgggaggcctgaagatattggtgttctgaatgac

SEQ ID NO: 29932 - DNA, 539 bp, Sorghum bicolor
  Clone ID: 9308529
gcacgaggtatttattgatcaggatgaagtaatcccacatttggagcctggaatggtgccttcaaccgtggaccctgatgctgctggatatgctgaaagagcaaacaaagctaagaaggcagtcaaaatcagtgctcgcagcctcgcaaagcttgataagaatgaggtcatgaaagctgctgcaaaagctcgggcatcatcctcggttctgcgacctatagatgcccgccgtggtcatgaagctgatgtcatctccagcggcaatgccagtgtcaggagtagcatgagtgttgactacagtggcacaaaggaatcaaacagcgagatgaaactttctccacttcagaactcatacccgcaaagccttgcaagccaggatgattatgataccggcacaccaaccgcaagcagtttaagcagtccagtccacatccacaagcttgcttctcactctcagttcagtgtaacacctcagcctacacctcctgaaagacctgtgccagcgatgctgcggccacctgttcccaccacacaaataa

SEQ ID NO: 29933 - DNA, 591 bp, Sorghum bicolor
  unsure (1)..(591): unsure at all n locations
  Clone ID: 9308582
acgtgcactcagctgtggcactagcagagcaggtagcagcactggcagcccatgctgcgtcctgctgcatntgcgctcgtactccccccactcactcactccggccaccattttcctgcagcatcatttcggtggcgccactttcttctcctgttggatgatctcatcagccattcaatttttttttctctatccgtgcgccggcgatcgagtcttttttgctccatcaccgtcactagctgcagtgttgtttccactttccacccgctcgctcgatcggtctgtagctttcaggtcagctcggcaggcatgctgatggcccgtgctgtgcagtgcgcggcgtggcgctagctatggtttttgcacacgaccggctggagcagaggcatgcagcagagagctgacgacagtgatcacgtgtgacgcgcaaccggcgccctatacgatacgacagggattcatggcgtgcatcaatctttttttttttaataaaaggtaaaatataaggaagaattttgctagggccttgtttagttccgaaaaagtgaaaagatttcgagtactgtagcacttcgtttgtttgtgacaaaa

SEQ ID NO: 29934 - DNA, 465 bp, Sorghum bicolor
  Clone ID: 9308629
acttctgtccatcaaagcaattccagatgaggacaaagacttggcaaaactgctcacaggatatcaagatatggttggttttttgcatgtccacaaggtggcacaaactaatagtcaggtccctgtgatcttagaggcatccacactttctctgaagctacgaaagaggaggttgctggtgctggaacggttgaaccaggctccagttgatgggtcaaccgggccttcatctgctgcatcaagtagttgctcatcacaaggttcacagcttgatttctaattcagagtcagatggtatggctagttttccttgagaggagcctggcagtgttgtgtactagttacttctggcagcagaatgcaacttttgggggtttaggttttagatagggaggcagtttgatggttcaccgttaaccatcctccctcatgtataaatcagtttgttgtacaccactttcaata

SEQ ID NO: 29935 - DNA, 133 bp, Sorghum bicolor
  Clone ID: 9308652
gcacgaggcgcgtcttcggcgtcgagctcgacaccatccggagcaccgagttcaaggaccccgacgacaaccacgtcggcatcgatatcaacaggctcacgtacgtgaacgccaccaacgccggttactacga

SEQ ID NO: 29936 - DNA, 167 bp, Sorghum bicolor
  Clone ID: 9308689
gcacgagggaaaggaggaaaaactcgcgaaccgactagtcccctgcttcctctctgttactcctcctcccctgattgctctcaatctgccagcgcgcggcgcgatggccgacaaggcggagtccccggagaagaagtagtgggccgacctcgaggaggaggaggagg

SEQ ID NO: 29937 - DNA, 507 bp, Sorghum bicolor
  Clone ID: 9308699
gcacgagggccaggtttacggggaggatcaaggccgtgctcgtcggggagaggaaggcggaggtcgtccggcggctcttcgccggtggggagatgcccgacgtcgggcttggggaccgcgagagtgaccatgacttcatggccatctgcaaggaagcttacatggtgcctccggacaagcgcgcggcgcgtgcggccgccgacacgctgctgtcccgctgcgtcttccacgacggccgcctcgtccagcgcccggacccggcgcaggcgctgttcgcgctggcctacctcccgctgggcttcctgctggcgctgttccgcgtcttcttcaacctcatgatgccgctacgcctggtccgccacacgtaccgcctgacggggatccgcctccgcgtccggggcacgccgccgccgcccccggcgccgggcgccccgggttcgctgctggtctgcaaccaccgcacggcgctggacccgatcatcctgtccgtggcgctgggtcgccccg

SEQ ID NO: 29938 - DNA, 450 bp, Sorghum bicolor
  Clone ID: 9308711
gcacgaggccggcgtggacaaggacaacaacaacaacaagctgatgccgctggagctggcgatcgccgagagcgtgtctcgagggaagctggtggcggggagcggcgggacgggcggcgggagcgcggtgacggtgccgacgttcgcgaacccgccgtggacggaggtgtgggtgctgatcaagcgctccttcaccaacacggggcggatgccggagctcttcgtgatgcggctcggcaccatcatggtgacggggttcatcctggccaccatcttctggcggctggacgacacgcccaagggcgtgcaggagcggctagggttcttcgccatgggcatgtccaccatgttctacgtgtgcgccgacgcgctcccggtgttcgtgcaggagcggcacatctacctgcgcgagacggcgcacaacgcgtaccgccgcatctcgtacgtgct

SEQ ID NO: 29939 - DNA, 504 bp, Sorghum bicolor
  Clone ID: 9308721
gcacgaggattaaactaaaaataaataaatataaaatatgattcctctgcctttatatgagattgttatattataaatatacataatttagctatgtgtttgtagaaaatgtcgagtttcttatttatcttgctgttacatgcttccttgtgttggaaatttctctttttcatggaaattgctatacttatccaaatggcatgaaatttatacagtagactttggagatcatatatgagctgttgtagttttctcagaatttactatgtactttgatatatggttattactttgtctatttacctaaataaattaataaaggcatgaaaggaatttatttggggatgatcatgatgttttctagtatctctttgatgtattttaactgttggtaagctgggttttgcccagtttcaagtttggaacataaatgaaatgttatttctctataattcaaatgttagtggtttctcgacaatttctggggcattatgaattgctcta

SEQ ID NO: 29940 - DNA, 247 bp, Sorghum bicolor
  Clone ID: 9308729
cggcacgaggcctgtccctccctctcctcgcctcccaaaaaaaggcaccgcaccaaaaggagggggtgagaggcacggggaccgcccgcctcgctcgctcgctcgcctgcacaccggattcgggcgccgaggcggtggttgcagcggcggcggcctggcggggagatgtcttcgcgctcggggtccacgagcggcggcagtagtcaggggggaggcgccgcggtgccgatggccgtgcttcttaggc

SEQ ID NO: 29941 - DNA, 224 bp, Sorghum bicolor
  Clone ID: 9308731
gcacgaggataagttctagaaacatgaaatgttgcattcatgctggtgcatattattttgtttgattgtaggactaggttgtttgaatttgaaaatcaatttggttgaaattttatccaaaatttacagccctaaaaatttaaaagagttttctcttttgtatccacccctacacccagatctggcccagcacaaaccctaccacagctctccccccccccacc

SEQ ID NO: 29942 - DNA, 105 bp, Sorghum bicolor
  Clone ID: 9308744
ccatagaagattacattgtttgctgcattttgtgaacttacagttaggagttcagattgtagaagcccacagctgtgtcaaagaagaaaacatagctttagaaac

SEQ ID NO: 29943 - DNA, 425 bp, Sorghum bicolor
  Clone ID: 9308817
gcacgagggggaaccccaaccccggcgtgcgcgacccggacaccggcctcatgtattacagcgtcctggacgcgcagcgcgacgccacgttctctgccatggataagcttgggttcaccagtcttcaagcaattccaggggagaccgggtcagcgtctgccggccgaccgaaacctggtcctcgacacaacaaaccactacaccagccttcttgggagctggccgtcggggacgacggggatggagttagagtagacccgccggcggcctcaaaggccaacgcgcaggcgtacaacaacaacgtcatcaaccgcgtgctggccggcaggacgggcaccccgctccgccccgacgccgacatggacgtgtacatcttcgccctgttcaacgagaaccagaagggttccgggccggacgacatcgag

SEQ ID NO: 29944 - DNA, 427 bp, Sorghum bicolor
  unsure (1)..(427): unsure at all n locations
  Clone ID: 9308833
gcacgaggctgagctctcagttctctcagtagttttgttgcaagtagggatggagctcatagacctgcacttacagaagtgcgcccttgagaaagaagtggagagtggagaagcagagtctctttctttgcaaaacaaaaaccaacaaatgttggaacagaatgaacaactaaggaatggattgcaggaaagcagtgaaagggaggaggtgctgaaaactgaagtattcatcatacaagagaaactatcttgcttgagggagtcctaccagacctcacaagatgaaatttccaacctgactgaaaaaaatgagtccttgtctaaggaatatcagtccttgagtgggaagtacaattccttggaagatgagaatgatactgttcttgaagaatgcatgatgctcgagaacttgtgcctgttctttang

SEQ ID NO: 29945 - DNA, 500 bp, Sorghum bicolor
  Clone ID: 9308849
gcacgaggaaagagagaggagagaatatgcgccaccgcggccaaccgtcgtgacctcgccggcggtcacaggtccatggactccgccgccgccgtcctcgccatacttagcaagctgcagtccctgggcttctgtgctgatctccggatccccgacgccgccgcggcctccgacccctcggaggcgttcgacgccgtcctcgccacattcctccgcgaggcctacaccggcggtcgcgatgcgcggcctatcccggtggcgcttggagatggccggtgcgtcgacctcctccgcctcttcctcgccgtccgcgccgcggggggctacgccggcgtgcccaactcaccaggcgggtgggccgccgccgccgagtctgccggcgttgactccgccctcgcggcgcctgtcaagctggtctacgccaagtaccttggcgtcctagaccgctggatccatgagcttgtggaagcgcacgggcccttcttggatgtcgacatgat

SEQ ID NO: 29946 - DNA, 366 bp, Sorghum bicolor
  Clone ID: 9308852
gcacgaggcccaagcccaagtcagttgcgcggtacggtgctctcgtggggtgggtgggcaggagcagccagcaggcggccggagaggatgcagggaggaacaagtatcctccggcaggccggcggttagttggagttggttatggccccgatgcgccagcgcgaggcctccgctcctcggcaggctgcgaacgcaggtcgtacgaatctgacgggcgccgcggccgctcgtttaggtccgaggaatcattcggccgccgccgccgcgaccggccgacgaccgcacgctaggaatcggcgttcggtgggcgacatcggcaaccacggggaggccaatcgccgccaccgccgcctcaacaggtacctc

SEQ ID NO: 29947 - DNA, 500 bp, Sorghum bicolor
  Clone ID: 9308869
gcacgaggagagaactagttctttggccactgaagaaaaacatcccactggatttccatcactggaggtgctgaatatatgcgagatgtatgatttgcagttctgggtcagcatgagagagggggattttccacgactcttccgtctttctatcagtagatgcccaaaactcaccaacttgcctcgccttatttccctagtgcatgtgtcattttattatggtgttgaactgccgaccttctcagaacttccatcactggagtcactaaagattgaaggattccagaagattagatctattaatttcccacatcatttgacaaccttgaagaagttggaaattattgactgtaaagagctattatcagtatatgctcattccttgtctgtttcagatttaaaagttgtcaggtgcctgaaacttgatttggttggaagctcaacagaagaccatatcggccagaaagtggttaatggaacgaatagcctgacaaagaggc

SEQ ID NO: 29948 - DNA, 112 bp, Sorghum bicolor
  Clone ID: 9308879
atggccatatgcctggagacaagaccggtgggggaagtgatgatgctttcaacaccttcttgagtgagactggagctgggaatcatgtcccccgtgctgggtttgttgacct

SEQ ID NO: 29949 - DNA, 206 bp, Sorghum bicolor
  Clone ID: 9308882
gcacgagggccttgcagaatctgctgtgtccctcctcgaggccactaccgctgccgcggtggcgccggcggcgacccagccgctgcaaggcctctcccgccgacgcgctgccttcaccgaacaacagccgaatccgtccgaggcgggagcgaccaccagcctcgccggcgccctcgcgcgcgagcggatcaggcgccgcggcacgg

SEQ ID NO: 29950 - DNA, 157 bp, Sorghum bicolor
  Clone ID: 9308890
ttgacaataaggaggcacagcttcaggccatgagtgagcagtgcaagttcatggcgctgaatcacaactagcaggcgaagagcctgaggcagctttcctcgccctaacgatgcagtgatgaaccttacaaattactgttacattcaaggttcatatg

SEQ ID NO: 29951 - DNA, 665 bp, Sorghum bicolor
  unsure (1)..(665): unsure at all n locations
  Clone ID: 9308895
aaatgtcttggatgatgatagcaagtgggaaaagtttggagaaaagaatatatttggctacatatttgcaaggtcttactacagatgcatttggagaaacttgacaggatgcagtgcaacaaagattttgcagccggacaacaatgatgccaacacattgtttgtcatgtacatctctgagcacaatcatggattctccaatgaaccacaccttgaactgcagagtcaacttggaacaggtcgtaaacgaaaggaatatgatgtgtccagtgatgaaaacacatctagaaaacaactgcatgactcttctgtcagcgctgcttctagtgtgccacgtccggcaacgggggaggcgacgccatcaagcgctgaagagctcaaggcaaagaagatgggccggcccaggaagccgaacccacgtgtcttcggcccggaatggagcatcgcgtgatccatcaaggagcgatgccgtctgaagcccagcctacggctggctgtccacgttatatagtcgtattttttttttttgaaaaagttctatttttcctccttcaactttcacaaaactccaaaaccgggcaaattacctactttaactttttaaaccatatattttacctttctggaatgatttcgaggctgtnttttaatacagtgaatagggt

SEQ ID NO: 29952 - DNA, 102 bp, Sorghum bicolor
  Clone ID: 9308899
tgatccagatgacacacctacaaaggatcctggcaccgaggtcacctgcagaggcacccaatgctcgcagacatttatttaaagatgtcggtgcagtggacg

SEQ ID NO: 29953 - DNA, 625 bp, Sorghum bicolor
  Clone ID: 9308908
tcctgaccattttgaagctcctccagccccaatgcactatgggcgaccatcagatcctccaccagggccttgtgcaggctggtctaggccacctaggatatctaataactattctcccacaagacattctatggagcctccagtttcacatgcagctggagggcatggtggatggagacctagataaccttttgtaatactgaagtggtgctgatgcttttcttagtcttgggggggtttaacctgggagagtctggtgtctctgcttcagattgaaggcacaaacggaacactccaggaaagtgggagctggtacctgcctccttgtacatatgtatctcaaggattctttggcagtcggtctgcctgaagtgctgttgtatcctaggggtagactgcgcgaccacacgcagagctgagttgtagggataggatgtcttttatcaaccgattgtagtcttagattgtatttgatttcattgctgatgtccattcctgaattcctcctggcctcagacgacagccagctgctctgatgacttgctgaaactgtttgagtacagcgtacatataagcccaaaaagagtgaaatacaaatcattttgcacctgctggtgacctgttc

SEQ ID NO: 29954 - DNA, 453 bp, Sorghum bicolor
  Clone ID: 9308926
gtggctgcacaatgaaggaggttgcttgtttccaaccctccaagccaaggagagtacattacctacaagcaagccttgtttaccgtcagaaataagccatccaacaactaatgaagtgggccctttagtgcaagctactttttggatggatgctggggcgtgcattgagcagcaagaaacccctccttgggtggataccggggcctcaggttaccagccttttctggacgtgattgatgaaatgtgcggacttgagtgcaggctgcagaggctgaaggagaacatgttttcatttggcatggacggcagaacccccggtgtgagtgacatgggaaaccaggctgtggtgcttgtgccgactgctgagctcaaggaaaaagccccgcatggcggtttatttggccattattgcccatagattttatatatagcagatagctgtacagggaaccc

SEQ ID NO: 29955 - DNA, 431 bp, Sorghum bicolor
  Clone ID: 9308954
atcagctgtaactgaaaattgtaacttttgatcattttacttcttgtgtggtgatatacattctaaagtccattgataaaattgattgtagtttcaaaaaaataaataaatgattgtaccaaaatgaagtagaacaaaggtacaatatcaattggaatgcgccttatctcaatgctgctagactgctatactgtttacttcattcagttgcgtacaacatccactaagtgaaatctatctatttgctcatttttcattttcttgaggtttaccttgcaaaaaaattatgttcagtctgcaagaatgcagtgtgatctgcaaactctgtgtgttttgcctatacttatctcttactgccatttcctatgcttgtgttctttgtggcttaagacctttttttagttcaaaataaactcatttggttacactgc

SEQ ID NO: 29956 - DNA, 110 bp, Sorghum bicolor
  Clone ID: 9308964
ccggagcgcgccgctcgtagtgccgcaccgtttgatgcagcatggtcgttgcttggcttgagcaagttaaggctagctgatgattcagaacacttgcattgattcgtgca

SEQ ID NO: 29957 - DNA, 530 bp, Sorghum bicolor
  Clone ID: 9309026
gcacgaggaaataatgctcttgcatccagtgcttcttcagatcatgacttcttattccagaggtggttcatcagccttagatcatcatttcttgaggtcctaacaaatgttcttgatatccttagtgcacactcttcttatgaagcaagaggagaccatttaactttatctggagagtttatcaaagaccaagcacttgctttggatcattgctctctaagattaagtgacttggcaaagagttatgatcttcttgccgcatcccatatggacctggatcgacatagctcaagtagtatatccaggcttgctttcatgtgctcacttttggcattttgtaccacatattctgtttatttcccaaaggcatgtaactacgtagagtcctgcaagcttccaaaaaggttttctcatgcttcaatcctacaagatctgcatggaagagtagatgggtctgactggcaggttgtttcccagctgcgacagttcatgcccacttcttttgatgaacttgacagcttacagtccag

SEQ ID NO: 29958 - DNA, 524 bp, Sorghum bicolor
  Clone ID: 9309028
gcacgagggtctaggactccgcttatctcccctacgcgcgtggacaccgagggtggccgcaccagactggcgacgtcctgcgactccgcttatctcacgcgccgccgcgggccttgtccgtggccgccggcctcgtgcgccgtccccgcgaccccactgaccgcgctgccacgggcatcgtctccagcctcccgcgaccccaccggcctcccgtgcgctgcaggcctccttgcgtgtccccaacagcctgtggtgttgtcgcgccgccgtgggagacaaatcctctgccgaccaaaaagctcaaactagttgatgtctggttttgcgaattgcgaaagttcagaatctgagttgtggaagtttgaaatctgagttgtgtggaagtttgaaatctgagttgtgtaagagaatgacagaatctgataagaagatacctgaaattggtttgaggttcaaaaatccggatgaggcttggcaattctgggtggcctatggtggcagtacaggctttgatgtgagaaaaa

SEQ ID NO: 29959 - DNA, 517 bp, Sorghum bicolor
  Clone ID: 9309029
gcacgaggcccaaggcgaaatcggcagttgcccagtcggaacggaagctgaaacatgtgtcttcagatggacagctcaacagagacaggagcgctgattgctcgtcgcaagagtcatcggtgaagcagaaccggaaggggctcgtcggcctgaacttggacattccacagctgcatgtggttcggccatccaaggacagtccagacccgctggatttctcttttcactcggaagagcacagccagacgcttcagagagtgtgttctagcccggctcctttctttatgaaggatgcaacggcacgagctgatgattccagagtgcgtagtgcatctatgaaggtcaccggagaagtgtccaagccgatggcgaagccgaaacgaagagccaagtcccctatccccaagcgcgccatctcggatgtgttcaaggaggcgaaagctgccaccaagaggttctccagcccgcaacggcagaggaagcccacatccccacggtcaccagatgacagccctcc

SEQ ID NO: 29960 - DNA, 523 bp, Sorghum bicolor
  Clone ID: 9309032
gcacgaggctccttgctcatgtactgtacatgactacgaaactccttcagacattatccaccaccttgggagcaaatttcttcacagcgtcgccaaccgagaggaatatcttgtcttcaccaatcatgtccatgaatttagctgagcggagcttctggatcacggctggcccgggattggcaagaaccagctccagccatgtaattaactgctgaccgtgagaaagaacctacaatgaacgacttctgtcagaattaagtgttacctgtggctatgattttttttatttctgaattgattgttacctgtggctatgtagcaagaagtcaatgaaccaacaatgttcatggttcctagagccaccatttctttattcccatctatctggtaatccttgagggcagcaaatgttcttccaattgcaattgcttcctgataagtttgcatcaaaaaaaaaaaaaaaaaactcgagactagttctctccagaagcagagatcgatggccgccctcgccgcctcctcc

SEQ ID NO: 29961 - DNA, 550 bp, Sorghum bicolor
  Clone ID: 9309098
acacaatcacttgcttcacttgccggaaactcgacatttgatggcatcacaaagaaaaatttcagaattgcaagcttttgaaattgagacagctgatgattttggaattaggccaaaagctgcacatgagttggctattcgccaagttggtggaccccttaaccttagctacaagagtacactgtcattgacagttttactcagctcataacagttccaactttggcaaatttggagcttcaagatctgttctagcttttattagttggttacttagtattttggacaggctaactatagtattttgtgggctaactatagtattttgcggcctaagtatagtattttgtgaagaatatcgcaatgccacttaattggacttctctgaatttgtaagcactgctattgaaaagttgttgatggaagctttgtaagcactagactgagttccacttaattgataagctgatgcacttgattagctgctggattagctaatttgtaagccctgaattagctttgaaaatacagtgacctactattttttgtg

SEQ ID NO: 29962 - DNA, 495 bp, Sorghum bicolor
  Clone ID: 9309101
cctcaagagaagtaatgctgttactgctgaaggaatgagagcctttgcaaatttagtgaacttactaagtctcgaccttgaaggttgcctaaagattcatggtggccttattcatttactagatctgacaaagctcgagtcattgaatatgagatattgcaattatattgcggattcagatatcaaatatttaacagatcttacaaatttgaaggaccttcgattgtcatgttgtaagatcacagatctgggggtgtcgtatatcagaggcttgcagaagctcactcacttgaacctagagggctgcccagtgaccgcttcttgtttggaagctatttcaggtcttgcatcgtatcctgatagtatcttgtgttgttctgagtcttgatattatgtgacctcagtcaaagtttcatatctgtttctgttgttttcttggttcatcagcgttcggagttctacctctgttgcacttgtatggaatgataatgtact

SEQ ID NO: 29963 - DNA, 371 bp, Sorghum bicolor
  unsure (1)..(371): unsure at all n locations
  Clone ID: 9309149
gcacgaggcctcgtgccgaattcggcacgaggtggatatgtaaggctgcatcattttgattccgaatacttcagcatcaagatgtagataagaacaccagactaatccaaggctgtttgaggcccaactggttcaatttcttgattcagatgctgctggttggccataacgcatgcagagcaggctcatatcctaggtagtggcagtctggtgcttgttagatgaagctgctctggagaagcagctttttgttctgcttgaggaatttgtacacacttggcaatgaaaagatccttgaacttgctnannaaaaaaaaaaaaaaaaaaaaaaaaaaaaaaaaaaaaaaaaaaaaaaagggggggaaaaaaaa

SEQ ID NO: 29964 - DNA, 377 bp, Sorghum bicolor
  Clone ID: 9309166
gcacgaggattggactgttgtgtgtccaggaagacccacttgacaggccaactatatcttctatcagcatcatgttcgacggcaacacggtcccctcccaagctccagcccggccagcattctatgtagaaatgagcggtttcattggatcagggacatactcccaccaatacccagggtttattaatgactctactcaaaggtcgacagtaatgtcaccgaatgagctatcgataacagatcctgaaccaagataagtttggaaaataatttaccagagcaagtcatgtatgtaggtatgtaaggaaaggaccatgcattgttgtatatatgtatgagtgcatttgtacatttttataaaaaaaaaaaaaaaaaaa

SEQ ID NO: 29965 - DNA, 208 bp, Sorghum bicolor
  Clone ID: 9309222
ccccacggaacgttcagaccacccttgacctggttttttcacaggagggaatcctgtttattgaaaatatcccccccgatcgtcacgtgtcggcatgggatcaaagcactaatttgcttgctggtactgaacgaaaattgttcatgtgggggccgcccccatgatcagggatattttccccagcagttagcaagccaaagtttttgtg

SEQ ID NO: 29966 - DNA, 161 bp, Sorghum bicolor
  Clone ID: 9309243
tcaaatgtttttgctgcccctttgatttattgttttgcccgtttctgtcaaaaattggattcccacccaggtgtttccagtaggtaaaagtaaaacattggcttgttaaataatgaaaaaagcgaacttcgattttcagcaaaaaaatgttactgtggatt

SEQ ID NO: 29967 - DNA, 108 bp, Sorghum bicolor
  Clone ID: 9847159
gcacgaggctgacattcactatggaactgctccaatagctggttttttcagtgaggatagtgctacattaagtgatctggttgtgaaggatcaagaatttattgatgc

SEQ ID NO: 29968 - DNA, 590 bp, Sorghum bicolor
  Clone ID: 9847166
gcacgaggccactgcttatatccaaatcaacagatggaacttatgtgattgctgttgataggagcaatgtgcctcctgcatatgtcaatgaatctagcaggcagcaacgtttatcatgtgatgatcgacagctgctgctgcaggtagaagctcaagacagcaagatgccttcatccaagcacatggagcttcctaggctgtccttggacagtaggaatgagtctgtcaagtcaagtttgcatcagaagaactttggttatgcaagaaccgatgacagtctcattgataatttgaaataccaagaatccccgagccatcggcgggccagtgctgtcgttgcaaagctcatgggattggaagagactctcgatgcccctgggtctgcaagatcacacagaccagaccgtcacactcgaaataattacctgccacacacctccaggagtatctgccatgacctcagtacattgcagccgaagattcagcctacaatactgaaaaccaaaccttctccgagaattgtccctgaagctgcagcttggaagcagcagaagataaatacagctagatattattctaaagaagggcca

SEQ ID NO: 29969 - DNA, 161 bp, Sorghum bicolor
  Clone ID: 9847177
gcacgaggaagacaacaaaaggactttgaatgagggcatccgtcttctaaaaagctctaagatcaaccagacattgtttgccttgtacaatgtattttcagctttaaacaacaatgaacaccgaattccctacagagagagtaaactgacccgaatacttc

SEQ ID NO: 29970 - DNA, 611 bp, Sorghum bicolor
  Clone ID: 9847195
cacgaggaacaccgtcacctttggcgggcagcacgctctggacccactaaccgtcttgaaggcccgcatcaacaactctggcaaggccagcgccctcatccagcacgagtggaggccaaagtctctggtcaccatctcggccgaggtcgacaccaagaccatcgagaagagctcgaaggtcgggatcgccgtggccctcaagccctgattggttataagaccattttttttccttctaagctcctagcatgactgtttgggtcagatcaggtcagctggggaaaacaaaaactgttggggttcccggcatcctttggtcgttgcagtctgttgatttcatgaactgcgtaatgcttcgttgaggaaatttttcggtcatctgtgtagcgctctgttaaatgagcaaccttcacaataattcaagctttagaattctgaacttgtttacaatggttgattgtgactttgtgtcaactgaggtaggggcgattctgttttctgcaaccatttttctgtcttggtgtcggcgacttgacccaatcgattgatgtgttttttattggtgctgtcttaattaatgtcatataatccgatcagtttctgctgaattc

SEQ ID NO: 29971 - DNA, 561 bp, Sorghum bicolor
  Clone ID: 9847198
gcacgagggccaagtacgatttcaagttcaaggactacgctccttgggtcttccgccgcctccgagctctcttccgcctggaccctgctgattatctgatgtcgctcacgggcaagtatatcctatctgagctgggatcaccgggcaagagtggaagtttcttttacttctcccgggattataagtatatcatcaagaccatccaccatgctgaacataaatttctccgcaagattcttaaggaatattaccagcacgtcaaagacaaccccaatatgcttctttcgcagttttacggccttcaccgagtcaagatgccatatggaaagaagattcactttgttgtgatgaacaacctcttccccccacaccgggatattcataccactttcgatctgaagggctctaccatcggtcgagactatagggaagaagatttggagaaaaacccaagggcgaccctgaaggatctcaactggctgaggcgacagcggagcctcgagttgggtattcagaagaagcgcatgtttcttgagcaactacaacgggatgttgctctcc

SEQ ID NO: 29972 - DNA, 511 bp, Sorghum bicolor
  Clone ID: 9847218
tcgcctgttgggcccagaagccgaacctgttgtatgcaaaaccctccaggaaccgtccgcataccgtgaccgggagctcgccacggttcgacgtgtacggtaatgactttggatggggccggccgttggccgtccggagcggcgctgggaacaaggtggatgggaaggtgaccgtgtacgagggacgcgacggcggaggcagcatggccttggaggtgtgcctgtctcctgaggcactcagcaggctaatcgccgatgaggagttcatggaggccgtgagcaccgtgtgaaggcgtggtgcctcgtcgtcgacggatgatgcctgctggtggtagtgcgcaccatatgcactcttctactgcttagtgcttcttaaataattgttgtattcattgattcgataactaatttatcttttttcatgcatgctttgttgaaagaactcgatgcttacttagctgtaatatacgaagtcaggtgctgttgttctaactatttttgtaaaaaaaaa

SEQ ID NO: 29973 - DNA, 564 bp, Sorghum bicolor
  Clone ID: 9847233
gatgtctacagcttcagctgcctactcgctggcacaactcctcttgattgcacacaaggccgtgaagaaatcccccattgttccttctagacgccacgcatggctgctttttgccggggatcaggtgttttcgcttgcaatgatgagcgctggatccgctgcggcggcggtggccaatctgaaccgcaccggcatccggcacacggccctccccaacttctgcaagcccctgccacgtttctgcgacctctcggcggtctccatcgcgtgtgccttcctcagctgcgtcttcctcgcggcttccgccgtcatcgatgtcatctggttgtcaagtccgtgaggaggtgtgatccgatgcacctctgtgtgtactcgtactgtgtattcaactgaacccataccctcctggatgctgatgcgccgcgtcacctcaatgttgtctgggttcacaatcctgcgagagtgctgtacgtgtacctgtaagatagctatcgactgagctcaaaaacatgtttaaggcgatgtaatattactacgcgctgattgtttgtacagattagaatg

SEQ ID NO: 29974 - DNA, 587 bp, Sorghum bicolor
  Clone ID: 9847238
ccgcgcgcccccgcagcccggggcgtacctcgtcactccggaggaggctgctgctgaggacgacgatgacgatgctgacgtggttcctgaggaggatgagggagcggagggggaggagagcgattaggtctgcctcggcacggactcactaggaatgaatggcggcttttggtgctgggtgtctgtatcctcctgtgcctgggggacctagatggacgagttctctgttagggtttgtttgcggatagcctaatctgtcattcggcaatcattaagagttgtgtctgtgaccatgatttgcggcatcagtagggtgtgtgtgtgcgcgcgcgctcaagagaacacgtgtttagttctaactatgtagtaagggttaagatttggtaaacggttatgctgtgatcatgattgaacagttaaccggtttgcctctgtggttccagccttgcagcttccagcagctgttgaccgtatgcttttgctggcaccgtgctgcggttcccgtgagccttgttcctccttggtatgcttctcttatccggctgctgtcttgggctaggtcttgcagattttggagaactgggaat

SEQ ID NO: 29975 - DNA, 702 bp, Sorghum bicolor
  unsure (1)..(702): unsure at all n locations
  Clone ID: 9847292
ttaagattcagaatattgttggctcttgtgatgtcaagtttccaattaggcttgagggccttgcatattctcatggtgccttctcaagttacgaaccagaactctntcctggccttatctatcggatgaaacaaccaaagattgttcttttaatttttgtttcaggcaagattgttttgactggagcaaaggtgagagaggagacctacactgccttcgaaaacatctatcctgtactgacagagtttagaaaagttcagcaatgatgacccaagtgaaggtcacgttcttctaattacaagcatccttgaggttttttgtgtgaccataaattctaactgtacataaaaagtctggcggaacttatagcatcctgtaatttctgtgagcctcggtgtgtcatggttgggtgggtttgttgtggtagctggtggacttgtcaaattacttcagtttgagtagtttgtgtcccatgtggttaacttgagtgctaacaagagtagataaattttgccctactttgtctttgagacacgagtctattaaagtcttttctgagtatctttcagtgctgtgcgatgatgaaaagactggcactgtaggtaactggggcaatgtactgactactgacgggattgtgtgagtgtgactggttgtaagttatntgttgtatttgagatgctgtatcgtagaggaccaccg

SEQ ID NO: 29976 - DNA, 410 bp, Sorghum bicolor
  Clone ID: 9847307
agttattccccatactatccatcaccatttcagccaccacatccaccaccaccgggtagtgttaatccctctcagagtattgcaactgcaccttgggcaacccacagtgcagtgccgccaccactgccacctttgtcttccacaaccgaccagcgtactgcttcttatggtgctgatgcagagtatgacaagtttatgtcagagatgaagtgatgagcgaaactgggcgattcttccaatgaagggaaaaaaggcttgatctttcttggagcttataccaacctgatttatttcttgttggaagtttgggactcacatcttaaccttgctgtgtgctgttgtgaccattgcagaggttgcatgcttaagaagcatcaagtattaatggatcagatggcattggaatattt

SEQ ID NO: 29977 - DNA, 178 bp, Sorghum bicolor
  Clone ID: 9847353
cctgaggctcatccgtcaggcagcttcgaaagatgacaaaaagaaactagaccaacattctttttcggtacaatgtaggttgttgatgacaacacacaaagataatgctgaacaacatgtcaggaacttgatcgtctggttacctgattggggactacataaatttcaagaaatcgct

SEQ ID NO: 29978 - DNA, 475 bp, Sorghum bicolor
  Clone ID: 9847358
gatggtcttgcatgcatatcaagatgcggatgtctaacatacctcaatttgacttggtgtgtacgtgttactgacgctggcattgtagctattgcgcaaggttgtcggtccctcgaactgttaagtttgtttggaatagttggggtgactgatgcatgcctcgaggctttgtcaaaatcttgctcgtccagcctcacaactctcgacgtaaatggctgcataggtattaagaggaggagccgggatgacctgctgaagctgttcccatcactgagttgcttcaaagtgcacagctagcagccaccatggttttcggcggctttgcattctacatctaggaaggggaagggaggtattccggtgtgtgttttgacgtcaagttcatgtgttcaccttttttacacgactatgtatgtatttattttattaagagcaagaggagttctacagcagtccatgtatggaagcggctaac

SEQ ID NO: 29979 - DNA, 485 bp, Sorghum bicolor
  Clone ID: 9847382
cccacggcggcgaacccggtgtccgtgaacgccacgctcaccgccgacatctccatcaagaaccccaacgtggcgtccttcgcgttcgaccggagcgagacggacttctactacggcgggcagacggtgggcgtggcgtacgcgccggagggcgaggtgggcgccgaccgcaccgcgcgcatgaacgtcacgctcgacgtgctcgccgaccgcgtctcgcccaacgccaacaccacggcgatcatcttcggccaggtgtacaacatcaccagctacacggagatcaacggcagggtcgacgtgctcggcatctacaagagggacctggacatcaagatgaactgcaccatcatgctggaggtcggggccttcagcagcgtgcagagcaaagccactaactgcgttgcaaacgtcagctgattccggttagctggtcaaaatgaaatgaatatttgttgcttttagtagttgtgctttccgcctct

SEQ ID NO: 29980 - DNA, 370 bp, Sorghum bicolor
  unsure (1)..(370): unsure at all n locations
  Clone ID: 9847436
tgagggggtcacagatcagccttcatcctcgcagggaaccaagcgaaagagagatgatgatctgtcaggcagtggtgatgacagtgaggatgatggtattgaggacttgaggcccttcaagcacaagtaacggagcagccaatgtacatggatccctccctcccccttcgtcagctagaagtaagcagagcaggatcagcagcagcaggaggcagcaggaacagaaatatggtgggtttccncctgtcttctttttttatcgttttttcccttgtaaagactttgaattgagagagcttcagcctctcttggaatagcagattttaggaggtaatggagaaacacttgtgtagctagaggccagtagcta

SEQ ID NO: 29981 - DNA, 619 bp, Sorghum bicolor
  Clone ID: 9847439
ccgcgcacgggtcgctgccagtgaagatcccggactggtccaagatcttgggcagcgagtatcggcctggctaccactacggcgcaggcggcgttggggagtggtcggagctcgacgacgacgaggacttcgtggactgggtgccgccccacgagctggtggcggggcgccgccgcgccgcgtcgctgtcgctgaacggagtcgtcggcaggacgctcaaggtccgagacgcggtgtggaagcagaccaccgggtttcaggactgatgaccggggacgaggacgacgacgacttgatgatggcggactccattttgcactcctagatgtcctagctgtgtgcttcgctttcaaagaggaatttcgtttagctttttcgatgatcgggactagctagcaaattactttgttgcttgaggtagtactggtgcaggtagttgatgggtgttgtcttttagtgactgtttgcagcagcgttttagtcaccccttttgctgtggggtaattcgatttagttgtgtgtttctcgcctcggtaagccttggcaatgcattgaggaggagatgaggacgtctaggtttaggtttgtatgattgttcatcgttgctgcatttgctagt

SEQ ID NO: 29982 - DNA, 449 bp, Sorghum bicolor
  Clone ID: 9847440
aaaagccgcgtgatcgaccgatcgagctgcctggctggccgggggatatgcatgcaacttgcaatgccaagggagagaggatcagatcaacaagtaggtgtatggccggaggaatggaatatgcatgcaatatggccggcgcgggcggggtaagtggcagcgacgatttttggtgcaaacatttgcatttcttggccctttaatttccacgtggatatctttttttttcctgaaatgatcttcttttgttcatttcttggaggatctacttcatcgctggattagagagagagagagagagagagagctagttaggtagctgctgctaggagcttgctactactaccttttcttccctttgcatgtctaatggtttctgctgctcacatctttaatttttgttcatcaagtgtcaactaattaatcacttgtgcaaactaattaagcca

SEQ ID NO: 29983 - DNA, 553 bp, Sorghum bicolor
  Clone ID: 9847454
tcgtggcgtcgttgtccagcgctggcgagctgcggaaacaagacgcacacgcgggtgatgaagatgaactaccgcggcgacgttgcggtggtttcagcgatggtggacgaaggattcagaggacggattcgggaagacgaacgaacctggtgatggcgcggtggtcaaggtcatgtgggaaggcgtggtactgcgcgtgcacggccatgggaaggacgtacagcaccgcacgaggcgcaggggaggatggcgtttggcagtgtcgtcgtcgtacgcatgcacagccgcaaccacggcgcggcggatgggattgggaccggatcgtcggcggtgggagtgggacgacaagccgggctcagggcgatggaatttagcggtcagcagatgagaagacacgtcggcggagggaccatgaacacgcctactctacgtcggatgatgggtcgatcacacgggcagcgggatgctccattgtcgctgatggctgctgatgcctttttctgttccctttctatgtccgtgctgcttaactttgtgacgcagcaaggttaag

SEQ ID NO: 29984 - DNA, 552 bp, Sorghum bicolor
  unsure (1)..(552): unsure at all n locations
  Clone ID: 9847465
cgtcgccgccgccgttgccggctgcgtcgctcgcggacgcgtgcctgccggacctcacgtccgccttcccgttcctcagcgacggcagcttcttcccgcagttcgacgtcggcagcggtgttgcacttgcacctgcggccttctcctcctcgtggcagtcggtggtcccggacttttatgacgggctcgcgccgtgggacgacggagcagcggctggcaccgccgcggggggcttcgtgggcgcgtggggcgacatcgccggcctcgacctcagctggacaccgccggggaactgagtgccagcgggtcgccgtcttgaggggctccggttttagcagtgcggcctcatcaggttcaggtagtgcttcgttccaagttcctagcatgcagtgtgtcccgttttgatgagctatccagctaggaatgtgagcagctgagaattctcatatgccttcactgtttcttctcgtccttactgcgaaatgaaatggtggcggctagttagatcagtgaatcttgatctgtagtagctggagcgaggatgtaagatnt

SEQ ID NO: 29985 - DNA, 419 bp, Sorghum bicolor
  Clone ID: 9847509
gcagcgtccatcctcctccgcgtcgcgctctccagctccgccccgtccacgggtccgccaccgccgccgacggcgccgtcggaagccgccggaaaagggtagggagaggaagcggcggaagccaagggcgccgacgttgacgctgaagcggggaaggaggaagatgaggacgacggcggcgtgcacgtgaacaaggccaccggcgagatcggcggcccgcgggggcccgagcccacgaggtacggcgactgggagcgcggcggccgctgctccgatttctgaaccgcgccgccgctagccggcgaggtgaggccgtgagcggtcaccaggaaacctggacgtggttgcgtatcatcacactgttggatttgccatctgtgcaagggcggcgttagaattgcgttttgctttgctttgct

SEQ ID NO: 29986 - DNA, 314 bp, Sorghum bicolor
  Clone ID: 9847525
gcacgagggccgatccggttccggccatggcgaagccggcgcgggcgccgaggccgaagccgccgccggcgcgggcgtccgcccgtcggctcctgggccttggcgggctcggcgtcgcggcggcggcgtacgtgggcgtggactacctgcggtacctctcgccggcgtggcacggccggctgcagccggcgctgtgggcggcgctggcgctcgcggccgccgcgcgcgccccgttctaccgccactggtccgcggagctgcgcgccgcgctgcccttcctgggatccatcggcttcatgctcgccgccttcctg

SEQ ID NO: 29987 - DNA, 176 bp, Sorghum bicolor
  Clone ID: 9847530
gcacgaggcatcgattggaagagatgcatggggtgctagatgagatggaatgttttaagattgatcgaacaaagaagacattttggatcatgtacaaggcatatgttagttgtgggcggagggctgaggccaacactatacttggcatgatgtggaagcatgggtttggacttgct

SEQ ID NO: 29988 - DNA, 313 bp, Sorghum bicolor
  Clone ID: 9847542
gcacgagggctcaccgtcctaaaaccctagctcaacccccctctcccccctcacccccccgcgcgatggccaccgccgacggcgagccccagcccgtggccaccgaccccgcccaggccccggctccggcaccctccccctccccggcgaagcgcaagcccgaggcggatgcgggagccgacgccgacctcgcgcccctcaaggccgcgcgtcccgacgtcgacgaggaggctgccgccgtggctgaggcggccagggccagggttagcgcggctgacaagggtaagggcaagatggtagtcgaggaggagga

SEQ ID NO: 29989 - DNA, 515 bp, Sorghum bicolor
  Clone ID: 9847578
gcacgaggctctccctcgtccacgccgtcctcggcaggggcatccacgtcaccaagcgtgacctcttctacaccgacgtcaagctcttcggcgaccagtcccagtctgacgccgtcctcgacgacgtctcctgcatgctcggatgcacccggtcgtcgctccacgtcgtcgcctccgagaagggcgtcgtcgtgggccgcctcgtcttcgccgacgatggggaccggatcgactgcacgcgcatgggcgtcggcgggaaggccataccgcccaacgtcgacagggtctcgggcatcgagagcgacgcgctcttcatcctcctggtggagaaggacgctgcattcatgcgacttgccgaggacaggttctacaaccgcttcccctgcatcattctgacggccaaggggcagccagatgtcgccacccggctgttcctgcggcggctcaaggtggagctgaagctgccagtgctcgcgctggtggactccgatccatacgggctcaagatcttgtca

SEQ ID NO: 29990 - DNA, 278 bp, Sorghum bicolor
  Clone ID: 9847590
gcacgaggatacacagccacctgccagctttggcgatcgagcaacgacgacggacggccggccggacggacggtggacatggagcgcggcgacgactgccagttcatggtggtgcaccagtacgacgaggcggcacagctcatgcaccagctgatggtggcggccgcgggggaccagcaggaccccaacgcgggcgcggcggggcggggagccggcggcggcggcggggagaggaagcggcggttcacggaggagcaggtgcgttcgctggagacgac

SEQ ID NO: 29991 - DNA, 464 bp, Sorghum bicolor
  Clone ID: 9847593
gacgagggaggggcggaaatcggaaccggcggcgttcggtttcccggcgccggtgcagccgggggcgacgcgcgtggggtggatcggcatcggcgtcatgggcggcgccatggccaagcgcctcctcgcggctggctacacagtcaccgcgtacgctcgcacgccgtccaaggcggagggtttcgtcgccgctggcgcgagcctcgcggactcgccgcgtgccgtggccgccgcgtccgacgtggtgttcaccatggtcgggaacccaggcgacgtccgcgcggtggtcctggacccggccacgggggcgctcgcgggcctcccccgcggcggcgtgctggtggactgcacgagctcgtccccttccctcgcgcgcgaggtcgccgcggctgcggccgcggcgggctgccacgccatcgacgcgccggtctccggaggcgacgtcggcgcccgggacggcacgc

SEQ ID NO: 29992 - DNA, 330 bp, Sorghum bicolor
  Clone ID: 9847599
gaggccgtgcgcaagggccggcagacgaggcagcagcagcagctggagtgcccgcgctgccgctccaccaacaccaagttctgctactacaacaactacagcacggcgcagccgcggcacttctgccgcgcgtgccgccgctactggacgcacggcggcacgctgcgcgacgtccccgtcggcggcgcatcgcgccgctccagcggcgggggcggcaagcggcgcagggtctccgccgagccctcgtgcgcggcgtcgtcgtcgccgccggcgttgccggctgcgtcgctcgcggacgcgtgcctgccggacctcacgtgcggcttcccg

SEQ ID NO: 29993 - DNA, 226 bp, Sorghum bicolor
  Clone ID: 9847672
ttttgcatgaaacttttgatcccattatccaggtttcaactgggcgggacctcattccagccatggtttatgggaggagtgcaagggatcaagattacacaggaatgtattgtgctgtgttaactgtgaacaatactgtagtttccgcgggtcttttccgcatcatgggtaatgaaattgctgagcttccgttggttgctacaagtaaggatagccaaggtttggg

SEQ ID NO: 29994 - DNA, 191 bp, Sorghum bicolor
  unsure (1)..(191): unsure at all n locations
  Clone ID: 9847675
gcacgagggagaaatggagcgacggagcaggagagcggctgccgcagctcgccctcctgctccagcgtgcactcgggcaatggagaagaaaggagaagattgagacatgggagttgcaagaggaaaagagagggtcggcgagcacggaggcagcaagatgaaagagatgagattaatggggaggagaggan

SEQ ID NO: 29995 - DNA, 254 bp, Sorghum bicolor
  Clone ID: 9847686
gcacgagggcaagacgaacgaacgagctcccggtcgagatcgagcagcagtacatacgtacacaccatcgtcgcagtgcttttcataacttaattcttactccgattccgccaatggcaacagccaacaaagcgtcgattctcctcctcgccgttgcggtggccaccgcggcgtgctcgacgaccgcctccgcgcagaccagcaggctcggcaagctcgtcgtgaccggcgtcgtgccgtgcaacaccgggacg

SEQ ID NO: 29996 - DNA, 205 bp, Sorghum bicolor
  Clone ID: 9847709
gcacgaggggcggggggggcagcgcgtacctgctcctcccggtacgcgtagttctcgatgacctcgtagtcgaggctctcgatggcggcggcggataagagctcatagtccgccgccgcggaagtggaggggcctgcctcctccccgtcagcggtggggaggcgcgtccacgcgagccgcgccatcccgatgccgtgggggacgt

SEQ ID NO: 29997 - DNA, 493 bp, Sorghum bicolor
  Clone ID: 9847720
gcacgagggttgttggctgtgtcatcatgccccacaatgtgtttcttcattcagcactcgtgcaatcacggaaaatagatcaaaataaggaatatcaagtccgtgaagcattgagatactattcaatagagtcaactatagcattagttgtctctttcatgataaacctctttgtcacaacagtttttgcaaaaggattttatggaagcaaggaagctggtaatattggccttgaaaatgctggacagtatctacaagagaagtttggtggaggattttttcctatactgtacatctgggggattgggcttttagcggctgggcagagtagtacgataacaggaacttatgctggacagtttataatgggtggatttctgaatttaaggttaaaaaaatgggtcagggcattgatcaccagaagctttgcaattgtgcctactataattgttgctttgttcttcgacacatctgattctgcactggatgtttt

SEQ ID NO: 29998 - DNA, 496 bp, Sorghum bicolor
  Clone ID: 9847723
gcacgaggctcccaccctcgtggcgacggccaggcgaccgcagccgccgccgaggtcatcgccagcgaccaccgctccaccgggtacaacagatttatgcttggaacttctgcagaaaagcacacaacagtaatggggcacgaccatatttctcgtataaagatgcatatggcagaaggttcttttggtgacaggaaccggtgccagcaacccgggtgcaatgaggttgtcgatggaagggtagtgtactgcaaaactcacagtggggagttttcatgccaacagttcagtcacctgcacagcggaatggagagctcaggtttatcggtgccccatgttaatgacaaccagttcaagggatctatttgcattgcagtgccatgcactgagcaagagttacatgtgaagcatgaagggaatgatcgaggtaaactaaaggatagttctgggtacactttggatcagactgcacaatttgtcttctctggggcaggct

SEQ ID NO: 29999 - DNA, 345 bp, Sorghum bicolor
  Clone ID: 9847735
gcacgaggaaggaatggggaagggcaaggtgcatccctcgccgtcgccggcagcggcggcagcggcgggcggcggagccggaggagagatgacggcggaggcggtgctgatgcggctgctgcccgcggcggtgctcgcggccgcggcgccactcggcgccgaggggaaggaggtgctggcgtacctggtgctggcgtcgctgcggtcctcggcgcctccgacgccggtgcagacgccggcgcgcggcggggacgggatcgggaaggcggcgggggagcaccaccggccggagctcgggtgcggctgcttcgcgtgctacacggcgtactggtcccgctgggacgg

SEQ ID NO: 30000 - DNA, 326 bp, Sorghum bicolor
  unsure (1)..(326): unsure at all n locations
  Clone ID: 9847762
ctgcaatggcataaggggctgctatggaaaatgcaggataagctcaatcaggcggagacagctcttgggatttgttcagacgacgactaatgggagcgctgctgcagcctacgagtttctttggtggcttgaataatggcggcttggttggttacttggtttacgtcggcgccctgcttttttttttctttggttgctttttatcttgggttctgatgtgaaggaatgttgtaacactgggtagacagaaagcgcaccaggcgtccgaatccaggaacgtcgagctgctcgagagatagctgcatcntggagtattctactcaata

SEQ ID NO: 30001 - DNA, 289 bp, Sorghum bicolor
  Clone ID: 9847803
gtggtggaagttcatatgggcaagattcctgcctaatccataacctgtgttgcagctgaccgccttactgttttcggttgcatgatcctcttggcctcaccttccgtccagccggttttcaaagatctggttttgtgtctgtttctgtagttggtctctgtttagcatgtcactagcatcttaggcctgttgagaattcgtggattctgaaatatttgtcctgttccttgtggggtttcatatgtagtgtagtgctatatatccactgtgcacattaagcaaatgacac

SEQ ID NO: 30002 - DNA, 534 bp, Sorghum bicolor
  Clone ID: 9847818
gcgcagaccagcaggctcggcaagctcgtcgtcaccggcgtcgtgccgtgcaacaccggcacgctgatcgacgccgccacttctccggcattcccagacgccaacgtggagctgcggtgcggcggcaacgtggtggcgggcgggacgacgagccgcaacgggtcgttcgcgatcgaggcggacctgaccaacgcgctggcggcgctcgtgggcacctgccagctggtggtggatacgccgctggccaagtgcaacgccagcctgccggcggcgggggcactcgcctcctacctgcagggctcgctcgccgggatgctcggcggcgtcttccgcctcgccccggccggtttctccttccgcatgaactgacgacgacgaccgtgcataattcactgggttgcaatatatgcatcagtcagtattatatctatctaaaagaacaaaactaaaaacttccatgtttatgctggcgacggaccacagttacaaaatacagtaccgtacctcaaaataaatgagcatggataagtataa

SEQ ID NO: 30003 - DNA, 446 bp, Sorghum bicolor
  Clone ID: 9847832
cccggccacgctcgtgggatccgtcgtcaacgcggccgtcctgctggcgatctactggaaccagcttgacggtggctgcaagcccgcgggagcggaggaggtcgtcgccgtgcctaccgaggttgtggaggaggaggacgtaacgtcgcaccggttctcgccagccaccatgtcgcacctcctccgaagaggctccaggcagcagggggagacggtgccggtgcatcaggaccccgtcaaaccgccggccaaggacgtgcgtgtcaatcccattcccttggtcgtacaagaagacgtcgacggccactttgacgactggaacagcaaggtgtggaagacgtgcgtgtacgccatcactctgggcatgctggtggcgctgctgctgggtctcaacatgtcgtggagcgccagcaccgccgcgctggcgctcatcgtgctcgacttca

SEQ ID NO: 30004 - DNA, 350 bp, Sorghum bicolor
  Clone ID: 9847839
gcacgaggggcacttctgggaagaagatggatgatgaataccagaacttcctggctgagcttggtggtgggagtgcaccggagtccatgaacaaatctggtggtccaatgttggctcttacaggaagtggtggtagtggtggtgcttctgctggaactgggagtaacccaccttggtcaaccaatggtggtgctgctgccactgggctcaatggtatcaagaaagattatgacgaaacaaatctgtatatcggctacttgccacctacaatggatgatgctggattagtcagactgttttcgcaatttggggatattgtcatggctaacgtgatcaaggatcaaaacact

SEQ ID NO: 30005 - DNA, 145 bp, Sorghum bicolor
  Clone ID: 9847879
gcacaggggaaacacctgaacattctttgctggaacaaattttgcacttcaaaaccactggcaggtaaatatcttccgtgggtttactttgccacaagctccaacttttaggcaagtttttggcagacaattcattggacaggca

SEQ ID NO: 30006 - DNA, 469 bp, Sorghum bicolor
  unsure (1)..(469): unsure at all n locations
  Clone ID: 9847916
gcacgaggtcgagacccagctcaggcagctagtcagctcagggaaaggacgcgagagatggcgggggagacggtgctggtcaccggcgccagcggcttcatcggctccaccctcgtccgcctcctcctcggccgtggctacaacgtccacgccggcgttctcaaccccgatgacaaggcggagacggagcacctgctcgccctggccgccggcgccggcgagggcgagggccgcctccgcatcttccgcggcgacctcctcgacggcgccgcgctgatcgacgccgcgcggggctgctcgggtgtcttccacctcgcctcgccctgcatcgtcgacgccgtcagcgacccccagaagcaactgatagtgccggcggtggaagggacgctgaacgtgctgcgcgccgccaaggaggccgggagcgtgcggcgggtggtggtcacctcgtncagctgcgccatcatgccca

SEQ ID NO: 30007 - DNA, 504 bp, Sorghum bicolor
  Clone ID: 9847919
gcacgaggcatggaatcacttggatatgtactcatgtacttcttaagaggaagtcttccttggcaaggtctaaaagctgggaccaagaaacagaagtatgagaaaatcagtgaaaggaagatcgctacttcagttgaggttctctgtcgtggataccctcctgaatttcaacgctacttccatcactgccgtgcgttacgctttgatgatgcgcctgactatcaatacctgaagaaaatgttcagagacctttttattcgagagggatttcagtttgattatgtttttgactggaccattcttaagtaccagcaatcgcaaatgaccattccaccgcgtgctatggctgcagcaacggatcaaagctccaggatggcttcaatggcaaataataatggactgtcagccactgaagagggaaagagaagtgggtggtcagatgatcccttgcgacgccaggttccacctgcaggaataaatgcaggcagcttggcaaagcagaaa

SEQ ID NO: 30008 - DNA, 279 bp, Sorghum bicolor
  Clone ID: 9847973
gcacgaggcagcatctatagtagctcgctagctttttgccaacgccccggccggctctgctgctcctcgtcctctatcacgtttgcagcgtgatcgtcgagcgcctccccttgcaacaaggtacggtagaagaagaggtagctcacgggcggccggccggcggcggcggcggcgcgcgggaacgcatatatatatatatatatgggcaacgcgctggggtgcacggggctgggcgagcggctggcggccgccgcgagggacggcgacgcggcggaggtg

SEQ ID NO: 30009 - DNA, 520 bp, Sorghum bicolor
  Clone ID: 9847979
cacgagggtcgcgcgcaccgtcttctcccgcgacctcaccggcctcgacgacgacggcgggtccagggagttccaggaggtggtgacggacatcatggaggccgtgggcagccccaacgtctccgactacttcccggcgctcgcgcccgccgacctgcagggatggcgccggcggttggcacggctgttcgcgcggctgcaccggatcttcgacgaggagatcgacgggaggctgcgtggccgcgaggctggcgagcccaagaagaacgacttcctcgacctgctgctggacgccgccgacgacgatgacaacacggcgggcctggatcgcgacacactccgttcactcttcacgagggaactgaagaattttgaaacttgctgcattgagtgaaggggatgttttcagacagctctatcgaaacagagaaggatttgttttctgctgggagtgacacaagctccagcacagtggaatgggcaatgacggagttgcttcgaagcccaacttcaatggcta

SEQ ID NO: 30010 - DNA, 583 bp, Sorghum bicolor
  Clone ID: 9848004
ctttgtttacgcgtacatgagagaggctcccgggggcaattgtttgtgtgttcctgacctcgtcgtgtcgtcgccgccacagtgctcgccttgacctggtggtgccgagaggatccgtcgccgtcgccggccgtgatggggttcgccgagaaaggatcgccgcccgtcactggtggagggttcagtggacagagctatctgtgttaacagaatgaaggcgtggccatatgagggccaatcttttttatcatagtaaatctaccagatttcttcgctgtggcactggcgaattactgctgaattgtgattaggctgcataacattaacgcgtccatttgattggtgaaccctggtgatctccagtgcatctttatttcacacaaatgcagtgaaaacggcaagttcagctatgggtatgcaagctctcctgggaaaagatcctccatggaggacttccatgaaacaagagttgacggtgttgatggagagacagttggactgttcggcgtctttgacggtcatggtggagctcgagcagccgagtttgtgaaacaaaaccttttcacgaatttaatcaagcacc

SEQ ID NO: 30011 - DNA, 514 bp, Sorghum bicolor
  Clone ID: 9848019
gcacgagggtggtggtggtgaccgtggttttgatgatcatcgtggtggcagaggtggcagctatgggggacgagatcaggaaaaccaaaggggtagtgaaggtggctacaatgccggtggctatggacaagctcctccgcaaggtcctccttcctatggtggtcctgcgggtgactatgcagcgcctccgagctcctatggaggcaacaatgcttatggttcagattctgcagtgccacctcctaatagctacagtggtggcccaggctcatacccaccaagctatggtgccccgcctccacaccaatatggtggtgccccaggggggcaagggggtctgcctcctacatacgatggtggatatggtggtcggtccatgcctgggggtggaggatctggaggtgcaccgccaccttatcatggtggtggcggtggcagcggttatactggtagtgctgaccctgaaccagctgcaaaagttaagcagtgcgatgagaattgtgacgagacatgt

SEQ ID NO: 30012 - DNA, 495 bp, Sorghum bicolor
  unsure (1)..(495): unsure at all n locations
  Clone ID: 9848022
gcacgaggcttatccccttcctttcctctcccttccttccttccttccttccttcgccatggcaaccatgtccctccgctccctcgccatggccatggccgacacggccctcccgccggcccacaagctcctccccacggtctccctcccgctcctctcctcatccacgcacgccgcgccgctcctcctccgcgccagccgccgcctgccgctcgcgcccctcgtggcctcctccgacgccgtcgaggcgggcgtcgagtgggccgacgaggaggaagaggaggaggaggaggctggagaggccttcgacgaggaggctggggaggttgaggaggaggtgctggcctcangcgacgagggtgagggggagtacgccgcggtcgagccgcccgaagaggccaaggtctacgttgggaacctcccctacgacatcgacagcgagggactcgcgcagctcttcgaccaggccggcgtcgtcgaggtcgccgaagttat

SEQ ID NO: 30013 - DNA, 426 bp, Sorghum bicolor
  Clone ID: 9848037
gcacgagggatccaagaaaccggccaccggagcgaaccccgagaaacgaccttgatccgtgaggaagccaatcagccaggtgatacagagcagcgggcgccagcgatccagctgatcacccaggcgaggcgatacagcaaagccagcagccatgaacagcttgttctcgagctcatggaagcgcggcgggggagacgacggggacatcgagtccggcagcgtggagatgtctgcgccgccgggtgccgcggcgggtgcgagcctggaccggttcttcgaggacgtggagtcgatcaaggacgagctccgtgacctggagcggatccatcgctcgctccacgacggcaacgaggcgggcaagtctctccacgacgcgtgcgcggtgcgcgacctccgcgcgcggatggacgcggacgtctccggggg

SEQ ID NO: 30014 - DNA, 563 bp, Sorghum bicolor
  Clone ID: 9848048
gcacgaggccttgttcagataaaggccggctggtcccaggtggtgtggcgatcagatcagcatcctccagttctctcgcccacgcttcagtaagcttgaacgcagagccaaaggagcaatcaatcgaccaccccagacgacgacgcgtccaccgtgtcgggcggcacagtgaggtcgcgaccggacagcagcgacggcaagaagactactccggtcaggaaggcggacggcaagacgccgcccagacaagcaggatctcagcagaaggtgaaaccggtgagcgcggtgaagcctccgccggcgacgaggaaaacggtgggcgtgaagccggagcttccggcgcgccggccgacgtccgggcacacctctgactaggaggctgccgcacttgtagctggtggactgctggaaaccggcgccggagctgtcatgtttgcgcgagcgtggaaatagaaatggtgtgcgttctagcaggtcgcttttggtgaacaaggtttttgcagtggttgattcgttcgataggttcttggttagagtcttcggtcttgcatttgcgtagatcc

SEQ ID NO: 30015 - DNA, 153 bp, Sorghum bicolor
  Clone ID: 9848064
cagaaccatcaggagcttgaaattgttggtgcgcctaatttgtctcggagagggatcgatgaggctcgtaatcacaatcatggagagccaatgactcgtttctctgccattgggtcatctgtcactgccatttctctacactcagggcctact

SEQ ID NO: 30016 - DNA, 389 bp, Sorghum bicolor
  Clone ID: 9848069
gcacgaggctcgaatccatcgctccactactcgaacccgactcaccggcgcctactcccgcttggctcccgggcccattcgtcgacccgtcgccggcgaaagcgcgcctccaagctcctcccgctgaagcgaaggcgccacatcggaggaattgtagtttgtctgtcctcctcttctcgacagcgcggagcggagatccgaacggacttgggatcgattccttcccttttctcgattcagggcgctagcagttcccgagggaagctcctggggacatggacatggcattgcccgttgtgaatgccacagcggcagtgctcgcccgtgtctcggctgcattcaatgccccccttgcccgtgcagtcgtgtttggggtccatattgatggg

SEQ ID NO: 30017 - DNA, 221 bp, Sorghum bicolor
  Clone ID: 9848117
gcacgaggctcccatttgctcagccttcttctgcagacgagtttgaaattcatcttgttcaatcaaatcgtcctcctcctttctctctcgccaagcacaaagcttctctgcgttcgtgttgcagttgcagccctgtgttgttgattgtctggtcagttcctctccgatccagaggcaaagcaaaagccggcatggctctcacgctgcgttcctcgacgtcg

SEQ ID NO: 30018 - DNA, 200 bp, Sorghum bicolor
  Clone ID: 9848123
gcacgaggcttcatctctccccgacgcatgcccggaccgaccggtccagctctacccaccggaggaggaggaggcagatcgaccggcagccgccggcccgtcgccggaggcgtacgcgcagtactactactcggcgcgcgccgaccacgacgcctccgtcgtggcctccgggctagcccacgtcatccgcgcctcgcccg

SEQ ID NO: 30019 - DNA, 515 bp, Sorghum bicolor
  Clone ID: 9848151
gctggcgccggccgccagcgcgaggctgaatcagaagcatcatgcagccgccgacgtgcgcgccgtgaagcagcaggcggcggaccaggcccgcatggcgtccgccgagcgcgcctacgcggagcgcgtccgggagctggcgcggcgggagctggagctggcggagcgggagttcgcgcgcgccagggccatctgggagcgcgcccgcgaggaggtggagcgggtggagcgcatgaagcagatcgcggcgaggcggctcgtcggctcggccgcgtcgtccgcggcggcgctggagatcacctgccacgcctgcatgcagcgcttccacccctagtgtcctgaagctacttactctccagatcctagctagctatagtactagctcctcctacacacttcttgatgaagtgtaaaggtgcctgcctctccgcgacgccggccgcagtttcgatcgtgttgtgatgggtggatagatcgatatggctagcttccttccaccattgctgtaactctct

SEQ ID NO: 30020 - DNA, 549 bp, Sorghum bicolor
  unsure (1)..(549): unsure at all n locations
  Clone ID: 9848170
ttcccctgggcagagccgttcaacgcggtgtccggccagctcgcggcgctcgaaggcgccggcgaggtgggcgccgtcgacgaggccgtccggagtctcgcgtcggcgctggacgccgggaccgacaacgaggcggcggtgcgccccgcggcacaggagttggagaggcgcaccgaggagctcgcgccgcggctagaccgcctgtcggacgccgtcggcggcgtgttccgcgccgcgctgggcctccgcaacgccgagctcggctgcttcatggtgggacccgcggggaagccgtgtagtaaatacccgtagtcgtagctgtatatgtatacttacaatactgtactgggatactgctacagctgtaagtggagtgaagttgatgagtcgtgcagtacagggcgagttgggtgtgggatcatgtgtgtcagtgtcaaaggacgaggaggccactagttgcattttgcataattttggatatgtggcatccactgctgtatctgtatgggaaaggggaaaaaatgttgcaatttggtggtgtaattncgc

SEQ ID NO: 30021 - DNA, 417 bp, Sorghum bicolor
  Clone ID: 9848208
gcttctctcagcaaggacccatccacatttgcccctcaaattaatcctccatgtcctactctctttgttgcgaaccttggtccagcttgttcggagcaagagctgatagatgttttctcaagttgtgcgggatttgtgaagctcaagatgcaaaacaagcttggagctccagttgcatttgttgatttcaaggattcaatcagttcaactgaagccataaatcgtctccaaggagttatcctgtactcatcacttggtgagggaatgcgtttggaatatgcaaaatcacggatgggcctttggaagcgtgataagcacccctaagtgcagctgaaagacgatacagcagttgttctccattcagcacaagcggcagctgagcatactcaaggatgtttgatgttcgcaggcgacttg

SEQ ID NO: 30022 - DNA, 683 bp, Sorghum bicolor
  unsure (1)..(683): unsure at all n locations
  Clone ID: 9848307
tttgcatcagagaacaagcacagaggattcagagattacagcatgagtgatataggtagcgcctctgtgaaggtattgtgacaagttggttgattgattggcagtggtggccatggcgcctaaatgagagggaggaggaatgcaggtaaaatgaaggtgataccggtacatggtattgctgaaggatgtggtgtctgacatgctcactggtcaactgtacatgtgagtgagtgatgagttgatgacaatatgtagtaggaacatgcaggatcatcattcgtttggagtctcgagaagatttgaccttgtcccagaaaagggacgttgcgctttagcatttgtttttgcaacgtactctagtctagcaaaagcagaagatggatgttgacgctgcaactgtgtttcatgtaatcctcccctcccaatacaatcataagccttttggcagctgcttgttggcaggaaacagatccttgtccttgaaaaaggcaaggatgatacgaaaccggaagctgcattgcaggtgtctgtaagtctgtgttcatgccaaacgacaacagcggctggatgtcctgagctatttgttgcttggaagaatcagactttgtatcgtatatgttatgtgctcggcatgggttgtgattgacttgtttgaagaggtgancaaacctctgtatgtttgc

SEQ ID NO: 30023 - DNA, 579 bp, Sorghum bicolor
  unsure (1)..(579): unsure at all n locations
  Clone ID: 9848309
tgatgagcacataagtcaagaagacaacagggagatcgatgggcagatgcaaggatctgtcgacgaggactgcaacaggtctgatgaggaatacgacgacctggccatgcgggacagtctggagaacggctatttaactgacgatggtgtctttcattctggtttaagcaaatcttcaagcggcaagttctttggtagcaatcagggaagccacagtacgccaaagaaacaccaagaaagtgttggtgttcctgagacagcacgctcttcttctgccgcagtcccggctggtacaagcagcaagcggtatgccgctagaaagtggaagcgctcgctgagtgactcattccgttcacggccacgcagtgccccggaattggtgtcagtatgcaagggatcaccgcccgtgcctgtggctccagatgagaggtagccgatgagctgcacaagacgtgttgtgtcatgttttttttaacataagcataaattgcaaagggaaatacgaatatcatcatctgaggcatcatggatatgaaaaaggtactatgctagtgtttggtttnctgtaatgaagtactc

SEQ ID NO: 30024 - DNA, 522 bp, Sorghum bicolor
  Clone ID: 9848339
cgcattcggcgtcgacgacgacggtggcgatggtgcgtgcggggtcggtggcgtcggagccggtgctggcgctggcggcgtggatggcgtgggcggagggcggggtgcacgcgcggccggccgccacgctgctcccctacgccgcgcagctgggcgcggccctggcgtgggcgccgctcgtgctgggccagggccacgccgcggcgccgcgcgccggactcgcctgctgcgccgccatggccgcggccgccgtggcgtgcgcgcgcgggttcggcgccgttaaccccgtcgctggcgacctcgccaagcccgccgtcgcatgggccgtcatcctcgccgtcgtcaactacaagatgctctgagctctccccacctttgtgcatgcagcagggcctccgtaccacactcttcttcttcttcttcttcttcttcttcttctttctcgcgagtgcgcagtgttttggtgtgatacgttctgtataccgtatgacgctttgtagcgacttgctccctactacacat

SEQ ID NO: 30025 - DNA, 546 bp, Sorghum bicolor
  Clone ID: 9848399
aaggcggcgcgcgtgtggctcggcaccttcgacaccgccgaggacgccgcgcgcgcctacgacgccgccgcgctccgcttcaagggcgccaaggccaagctcaacttccccttccagcagccggccaccacggccacggcttcgacgtcggcgacgctggcaccgactccgcggcaggggacgcgccacgccgcagctgcgcctgctggtgcccatcagcaggagttcccggacctcagccggtacgcgcacatcctccagagcggcggcgacctcgacctgcaggccttctccggcgctggcgggctgacgccagggcggtcctcgactaccacggcatcggcgtcgtcatcgtcgccgccggcgccgtcggtggattggtttccatggcgaggtcctgcctaactagatgcatacagcagtactgatgaactgatgatcagcagcaaacatgagacatgtagttaagttagcgtctctttagtccttcaattcgaatccatgaaatcctgtagctataacaattagttattactccctccatta

SEQ ID NO: 30026 - DNA, 433 bp, Sorghum bicolor
  Clone ID: 9848433
ggtgcacgcgcccaacccgaccaacaggtacttccgccacgtcgtgcactgcaagggctgcagggcgaccgtcaagaagtacacctcgttgaagaacgcgttcgccgcactcgcagcggcggccgtggcggcggccgtcctggcggcgaccaggcagtggaaggccgtcttgctggctgcatcggccgtgctagccgcggcgtcctatgcctgtgacgcgctggtttctttgctcaccaccaacttcatcaggacacacaggagattgtaattaaggtgtcttataatggctgctgtatgtttaggtatatagaaaaatggcgggaagcgtcctcttctccctttacatttgtatatcaccgtagctgtatttgtagtaacgttttgcatgcttgcagcagctgattaggtggttgctggttaggacttttat

SEQ ID NO: 30027 - DNA, 334 bp, Sorghum bicolor
  Clone ID: 9848457
ctcaaaaaatgggaattgccgccgccgccgccaccaccaccacgtcccgactcctccactaccacgcagccgctggcacggaccgccatcaccggcaccagctcaggtactccgcgagtccgtttcctctctcgctgcgctgcggctccggccggcgtgaggcggcggcggcccgggcgctcctgcccgaccgcgtcaccccgttctcctacggcgtggatgaggacgcggatgaccacccgcgcgaggagtgcggtctagtcggggtcgtgggcgacccggacgcggcgtcgctctgctatctgggcctgcagaagctgcagcaccgcgggga

SEQ ID NO: 30028 - DNA, 400 bp, Sorghum bicolor
  Clone ID: 9848461
gcacgaggcacctacctagcaaaaggagtaggaggccagcaagcaagaaatacctcgtggccacatcgtcccccggaccccttcttggtttcttccatggaggagcaaggtgagagacagatccagcttcagctgctgctcctccctgtgcctgcaggtcatcaggtgctccgcgacgtgccgccgcaggcggtgccagccagcgccgtggagcacccacagctggacctcgatctgtccatgagcatcgggccgaggcatcctgcggccccgacaccggcgccgccgccgctgccgccgccacgcgcgcggtcgccacccacgaacgagatcaggacggcgccggggctgatggcggtgctggcgccggccgccagcgcgaggctgaatcaaaagcatc

SEQ ID NO: 30029 - DNA, 360 bp, Sorghum bicolor
  unsure (1)..(360): unsure at all n locations
  Clone ID: 9848481
gcacgagggcacaccagacaccgcccgccgcgaacaccgagcctgatcagcatcccagcccagatgttcctcgccgacaagtacagctcgctgctgccctccctccaccagcaccactccaagcccagccgccgccggagccagcagctgaagggggaggcggaccggttcggcgcggcgctggccgcgcgcctccggggcctgctgccgctgccggcctcccagctcgcggcgctcgcgcgggtggccgacctcctcgctctcacgctcgcggacgccggcgacgcgctcgccggcgccggggagggcgacgcgtncgctgctgcggtcgccgcccaccttgacgccggggtcgcgctc

SEQ ID NO: 30030 - DNA, 547 bp, Sorghum bicolor
  Clone ID: 9848621
gcacgagggcatggcgaccagctcctcctgctgctgcgtctcctcccacggccacggccacggcctctaccgcccgctccatcgcctccgcaccgccagccccgcccgcctccgcctagtcttcccttccgtcccttccccgaggttctcttcccgccgaatccccgcctcgcccgatccgccgctcgacgtcgccgccggagacgcgacccgcgaggacgactggcccgcgcctgacgacgacgacgaccaggaccaggaggaccgcgacgaactcatcggcttccagatccaggtctccaaggtcggcaagcggaaccggcgccttgtgcgcgcgcgggtgcgcgtccacgcgccgctcgaggccgtctgggccacgctcaccgactacgagggcctcgccgatttcatcccgggactctccgagtgccgcctcctcgaccagcacgatggcttcgcgcgcatctaccaggctaggtcggggagcaggacctcgcgctgggattcaagttcaacgccaagggcaccattgactgctacgaggggg

SEQ ID NO: 30031 - DNA, 327 bp, Sorghum bicolor
  Clone ID: 9848624
gcacgaggcagaacaaggccggaggaaccaggcgacacaagggaaaggaaaggggagccaccggaccgcaccgccaccttcccttctcccggcgacctccaggctccagccacggcgcccatggcgtcggcgaagctgctctacattgttgtggttgacgacagcgcctcctccttccgatacacacgctccctcctccacagcaccctccagctcatgggatgcaagccacgccacgccttcgagatcagccgcagggtgttcgatgtcatccggggtgaccaccagggccatggcgacacggccgcctctgcccgggtgcagagg

SEQ ID NO: 30032 - DNA, 428 bp, Sorghum bicolor
  unsure (1)..(428): unsure at all n locations
  Clone ID: 9848706
gcacgaggcctcacgcaagcggcaagcccacgggcgctccctccccttctcgccctgcgcctcgtcacctctccgatccctctccttcttgtctcgctttctctctccatctcgtttcccccgcctgcgcagccagcgcaaaccctagccctcaagcgccgttttgcgaggctctcggcagcggataactcgacctgtcgcgcaaagatcgggggagagaaaccagcggcagcttacgtggatcggggttgtttggtggctgcggcggcngcggcggcggcggcggcgcagggatggaccggaagcgcatcaaggacgccctcgagaagcacctggagaggtcgtcgccgtccacctccaggggcggcgtcgtgcccaaggagagggagcgcctagctgctgccgggaagctgccagcgtcgcttggc

SEQ ID NO: 30033 - DNA, 274 bp, Sorghum bicolor
  Clone ID: 9848748
gcacgaggcctgtccattctttatagcctcgggaccaagccattgcagatatgggacaaagaagttgtgaatgggcacattaaacgacctcaagatgaagatatccaatctaatgtacttgaaatcattggaacaaatgtacagtcaacttacatcacatgcccagctgatccttctgctactcttggaattaagcttccatttctggccattattatgaaaaatcttaagaaatacttgacgtttgagatccaagttctggatgacaagaatg

SEQ ID NO: 30034 - DNA, 445 bp, Sorghum bicolor
  unsure (1)..(445): unsure at all n locations
  Clone ID: 9848751
gcacgaggccgctgggcaggggaagtccatgctcctcgtccgcttcggatccaccctcaggtcgccgctcgccaaggtgctcccgacctggtacttccaccagaacgcgtgcaaggtgttcgagcaggacatggggttcctgtcgtcgcagaacgaggtgctgctccgggagaaggtgcccaccagggagctctacctcaacctccgctcctccgacacctgggtcgccgagtacaggaagtggatggacagggccggccacggcatgccctactacttcggcnnnaccaccctgtcgccaccgccggtcccggccgtcgtggagcaggcgcccgcgggggccgtcgcggggatctcggcctcgttcccggcaaagnnnngcgtcggcacggtgcacgcgcccaacccgaccaacaggtacttccgccacgtcgtgcactgcaag

SEQ ID NO: 30035 - DNA, 707 bp, Sorghum bicolor
  Clone ID: 9848794
tggattggctcattattccgtgaacgtctgcatgtatggttagcaaagtggcctcagcagatagcattaataaaacttgcaggtgaagggaattggttccagcagtttcgggttgttgcgcttttcagaatctcgccattcccatatacaatttttaattatgccgtaactgtgactgaaattaagttcaacccttatctctgtggttctgttgctggaatgatacctgaggccttcatctatatttacagtgggcgtttaatacggacattggctgacatgaagtacggcaactataaaatgacaccagtggaaatagcatacaacgccatttccttggttatcgccatcgtcctcacagtcgccttcacggtgtatgccaagagagctctgaatgacattgaaagttcggacggtatcactaaagaagatcacagcccaaatggctcaggggcgcgtgtgagtcatcgtcaggagcgcgccgatgcgcgttccatacaactagatgttgtatgatggtgtgttgaccgggaggttgcttggaattggaaggaggctggtaggtcggcaggtgcagcccaggtagctagctataggttacaagaggaggttaaaaaaaaacaataacacacacccagctgacgtgggtggtctgattcatttcgtgtgctttgcctgcacggccatacgaatctaagtcactgacc

SEQ ID NO: 30036 - DNA, 457 bp, Sorghum bicolor
  Clone ID: 9848818
ccgcactccctggtgcacgagccgcaggtgcccgtgccaaccagcatgtacgtcgccgctgtcggcagcatggtgcccatggccagcggcggacaggtggtgtaccaccactaccaccaccaccacaacgcaacagcaggaggaggaagagggtacccgcaggcggcagcataccaccacgccgacaaatgacattcgcttcttccgcaccgcagccggccgccctctgtatctactcctcctatcctatcctatcctatatacagtactacatagtatttctcatttgcagccacgaccacgactcggagaagagaaaaaaagaaagaaagaaaatccaagcaacaacaataacaagccaatcctgctctagtatctaattcctgcctgcctcattctgtaatgtactacaactgctgctgtattagagttgagatgagatgggatttcccaattg

SEQ ID NO: 30037 - DNA, 365 bp, Sorghum bicolor
  Clone ID: 9848856
aggatgtcggcgcagatgaaggcgctgttcgactccaccacgggcgggctctggcggacgcaggcgctcgcgggcaagcccgcggggttcctcttctcgctgcgcacccaggacggcgggcaggaggaggcggcgctcacgtccgtgtcgcagctcgcgcaccacgccatggtgttcgtgcccgtcgggtccacgttcggctccggcatgttcgacatggagtaggtcaggtgctgcagccctcacggggccggcacgttccccggcgccgacggcaggagcaggctgcccagcgccgccgagctccagatggccgtgcaccagggcacctactttgccgcattcgccaagaagctcaaggccgg

SEQ ID NO: 30038 - DNA, 678 bp, Sorghum bicolor
  unsure (1)..(678): unsure at all n locations
  Clone ID: 9848963
ccgatgattcatgataacttgacggatcgcacggccttcgtgccggcgacacatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggaaagtggatcatcatgagatcatgagaccgttcagttatggaattatacatctggtgctagtgtaattcagagactgagactgcggtgtcgtggagttgaggattgagcatgctactgtagaggacctcggaaaaggaataatgtagtactcctgtaagagctaagatcaggctttcgctagatggaatgctggaaggcgcgaccttgagccattcgtcttataatttgttttttattgctacttttgtgagtacactattccgaggtacccaaatcattcatggttagttgtgcaaattgagactgctgcttgctacctcgggatttagagcttctctagaaatagtgacaacacttcatatttagggncttgttt

SEQ ID NO: 30039 - DNA, 649 bp, Sorghum bicolor
  Clone ID: 9848965
tgcagttacgagtgggaattttgccaacgattgcagaatgtttggatggatttcaaacattatgtgaaatgcaccaggcagagtttacactaaaatcatcaattatattcttgctgacatggaagagcagttccagtgacactgttgtactacgtcaactcttagtagaccaaccaaacattccaaaagatgaagtccactccatattcgacattatatttgctgatgaaatttgttgaccagctggtatttgattgttgaagccttgttccctatgttctgatcaagctccctgctcaagtgatgaccgagtcagtctgaaaattgtattgttcgattaacccaattgttgaagcattgtggccgaggcaagtcttcatctctgtcagctgtcagcatcggtgattgaagacctagaggctggacctgtacctgccattgatgatgtactggttctgtagcatagaaagtcgcttcaatgtagattagcatattgcaaacgagttgttatagtggcgcgccccatgatctcagcgaatgcacaagtaatctggacatgttacaggtacagaatcgtgtgaagcagctcctgaaattcgcatatgagcactaacaaagggaatctttttggtttgcaatcaatcttatt

SEQ ID NO: 30040 - DNA, 463 bp, Sorghum bicolor
  Clone ID: 9849056
gttatcagaagcacagaagcaacaggatgagcaggatgatgatgaaagcactattgcttccagtaagaacttgactgaaaataagaaaccaaaaaccccaaaggagaataaaaagcgaccccgggaggatgatgatgttgctactgaggaggatcgggttgaggatttggtcttgagctcagatgaagaggatgacaacaatcaggaaccagaggatggtttcgttccggttgaaggtgatagtgatgaagactttgtagatccagacagtgaatataagaaacaaaagaaggcgaagctgaagaagaggaacaagcgcgagccactgccgcacaaggcgccctcgagaacaaaaagaaattcgcgtcccaagaaaaagaccaggcattagttatgatcgataggactcggcaaagatgctgctgttgtgatgtaggcttccggccgataaaaacaattttgg

SEQ ID NO: 30041 - DNA, 472 bp, Sorghum bicolor
  Clone ID: 9849087
gcacgaggcagcaaaacgccaaacccctaaccgcggcgattcaggaattgtctgtccatggaggcgagggcgtcgccgcgtccgtcgatctccatcggcggcggcttcggagcggggcggggcgacgacagcgccttctcgttcctctccaaggggtggcgcgaggtgcgggactccgccaccgccgacctgcgcctcatgcgcgcgcgggccgattccctccgcacgctcgcggaccgcgagctcgagaacctcctcgcgtccgcctccaccgcgctggcctccgcgccgccgccgccgctcgccgcgggggcgcccatagccgagctcgagttcgtgcgcacgcggatccagcccaagatctccgagctgcgccgccggtacgcgtcgcgggagcgggagctcggccgcagggtgctcgaggggtgggcgccgcgcggggccgggggacccgggcgcgcgcgcgtgaacc

SEQ ID NO: 30042 - DNA, 562 bp, Sorghum bicolor
  Clone ID: 9849107
gcacgaggcagcagcgtagtacggcctttttctagttccgtgtgcggctgtgcgctcgcgcttttcttctccttcgttccaccgcgtgaaagcttccagaaacaagggaaccggagaggcggagaccaaggaaaggagccgagtcgcttcaaatgctctgatctccggccgagggctctcctcccggtcgatcctccctccctccctccctccctccctccatggcgcgcgtcctcccgctcagcatcgaggcgggggagatggccagtgtagctgccgcttcgcaggcacagaagcgaagaggcagtgacggacatgccaaggtcttcagcaggggcatcatgcacagcaattgaccattctgagcagaacacaaaggatgatgaatatgagaggctggttatacgggctcaacatgaaacatctggcacggcaattttatctgagcaaacaaagtcaagatccttcatttggtggatgaaagttctgcttggctgcttccttcttatattagtgggttatgtcttcgtgaaatggggagtcccctttgcctttgagaagg

SEQ ID NO: 30043 - DNA, 465 bp, Sorghum bicolor
  Clone ID: 9849163
gcacgaggtcgcgatcggtcttgggctcttggccggctttatttgcaatggcttccaaggcgtgcgcgtgggatgccgtcctcgtcatttgcctggcggcggcagtcgtcgctggctcggcggcggaggcggcgttcgatgagaactacgtggtgcagtggggtgaagatggttatcaccttgtcatccggggcacggaggctaatatcaccatggatcagagctctggtgccgggttccggtccaagtccatgtacggctcagggttcttccacatgaggatgaagctgccctccggctacacggccggcgtcgtcacaacattctatcttatctcgcagccggaagatggaagccgtgatgaggtggacttcgagttcctgggcgacaaggccggcgtgccgataaccctccagaccaacgtcttcgtcaatggccgcggcgacagggagcagcggctgcacc

SEQ ID NO: 30044 - DNA, 208 bp, Sorghum bicolor
  Clone ID: 9849195
tgcaggaagcacttcaggaggctcacaatttgtgtgcttaatgatgttcatagattggaactagcatgtcttatacattacagttgtgatatactgtttttcgtctgtttcgactgttgtcgagatgtagtttgcataggtatcagcttcatctgtggtttgtaccgacttaaaaccgttgttcagtatgtgacttgcatcaaaaaaa

SEQ ID NO: 30045 - DNA, 327 bp, Sorghum bicolor
  Clone ID: 9849251
ctgtagcgggagcttgtgacccgagcgggggcaacaaggtggtgtggatgctgtgcgacggtttctctgggcctgggcctgtggtgtgcctttgcttgctggcctgcccgtcccaagttggtagtggttggcggggctcttgcgaaggcttgggcctctccgaacctaaagcggcaggaatggcgtgaggctggcttcacagagcagcgatcactgcccgcttccaacggtgggaggataacaggccgctgcaccattagcccaacttagggcccagagcctcactatagcagaccaccatctttttttaaaaaaaaaaaaaaaaaa

SEQ ID NO: 30046 - DNA, 514 bp, Sorghum bicolor
  Clone ID: 9849253
ctgatctgtcgattcacatgaccaattacatgtcatttccccttgttctacggtgggcagttaagcaaggcttcacatcgctgccaggcaacttgtcggggcagtgccccggagacataactagcagcatttgcaagagcaaggatagtttttgccggaaagagaacgaaggctttacgtgtcattgcaacaccggataccagggcaacccttacatccccgacggatgcaaagttgatgtcacaaaaggcagacatcgcagaaaggatgattataccaatggaggagcttgcaaaggcgacaaacaacttcgacaaaactcgtgaacttggtggtggagggcacggtacggtttacaaaggaatcttatctgacctacatgtcgtagccatcaagaagtcaaagcttatagtccagaaagaaatagacgagttcataaatgaggtagcaatcctctcacaagtcaatcataagaatattgtcaaactctttggatgttgtctggagactgagg

SEQ ID NO: 30047 - DNA, 116 bp, Sorghum bicolor
  Clone ID: 9849255
gactttacataccaactcgggtctttaggatgcttataaacaaattaactagggatttccataattatctcactttgggtggacttgtacagacccttatgggctatgttggtggc

SEQ ID NO: 30048 - DNA, 397 bp, Sorghum bicolor
  Clone ID: 9849282
gcacgagggtcgcctccgcatcgatccgcctccgccgactgctcgccggctaccggagcgctgcatccgacgaatctgtccgccctgagcccctgacgcactcagcactcggctatagcccttacgtggagagcagaccggcggcacagacgccgcggcagagtccaggcatgaggagacacgcgctgccccggatgtctggcgcggttgtgccacagcccgcaggccgtagcccgtaggccgcaccacgcgagcacggtgcacggcagcacccctccgttctccggcagtacagccttagttacaggagagtagcctgctcggctgctccagctacagtttgagcttgtcttcagttctctcccctctggcacaatgtcgtgaggctcccatagtc

SEQ ID NO: 30049 - DNA, 298 bp, Sorghum bicolor
  Clone ID: 9849314
ttttttcctatggaaccgaagcttgataaataaaatagttttaaaaagccctcagatctatgctgaggtcattgcttatgccaggcattcaggcactatgggtctatgacacacatcgattttagctaaaaaaaaacacgcgcacacacacacatcatcggttttatgatgacttctcctatattatatcatatcttcctgatctgctcatgtggccataacccataaataacaactgtctaagatttgtttggccaggatagcagcaagtgagcaagcatagtagctagtaggaagc

SEQ ID NO: 30050 - DNA, 208 bp, Sorghum bicolor
  Clone ID: 9849323
gcacgaggccgcgactcccgagtcccgacgactcgcgcggtcgcgcccctcgcctcctccgctgatccggctggtcttccccgtcggcatcgcacctccggaaatctcaggcttgtccctccactgcctcggccatggcggtgcgagccacggtctcccgcttcccggccacgccggaggcgctggagtcgtgcgccgtgcagtgggg

SEQ ID NO: 30051 - DNA, 424 bp, Sorghum bicolor
  Clone ID: 9849324
gcacgaggccaggaattaccctgcacgacctagcagattactggattgacaaacgaccaaagggccgagtgcgatcatctgtgggcacacctgcggctgaattcgtgctgaagaagcagcagggcatcgtttcattcataggagccattggttaaggatatcttagcatgtacataggtgttactattatatttcctttatttagttcagtgcatttttactgcttattttccactgacaaagtgtgtacctaggctgtgtaattataattggatgagctgtcgacttgttgagtgagcttgtgctgtaagcaggggaccagtcgtcctctgcatgagtctaggctgatgtatagtggagttggttgattgcactggaaattgtcactgattctggatgtggcataacatattgagtattgttt

SEQ ID NO: 30052 - DNA, 315 bp, Sorghum bicolor
  Clone ID: 9849380
gccctctctcaaaatatgttgctactctacaccagagagcgcaggataggatggatgctctggatgacaccactgtgattgtgggggctgattcctcaaccttctcacggaggttatcagaagcacagaagcaacaggatgagcacgatgatgatgaaagcactattgctttcagtaagaacttgactgaaaataacaaaccaaaaaccccaaaggagaataaaaagcgaccccgggaggatgatgatgttgctactgatgaggatcgggttgaggatttggtcttgagctcagatgaagaggatgacaacaatc

SEQ ID NO: 30053 - DNA, 597 bp, Sorghum bicolor
  Clone ID: 9849411
gcacgagggcgcgacggcatcttcgtcccccatccccttccagcttccctcctcccaactccgccactccggccctcacacaaatttgtcccgtcccgaccaccgctgctgccgccacccattcccaccaccaccgccccaccgctgccgagtgctagccattcggagcagcttcgccatggcctccgtggccgccgccgccgccgccgccacgctggccccggcactcgcgtgccggcgccgggcgcggccggggacgggcctgctgccgccgcgccgcgccgcgcccgcgcccgtccgctgctcgctcgacagcaacgtctccgacatgggcgtcaacgctcccaaagggttattcccacccgagccggagcactacagggggccgaagctcaaggtggccattataggggcgggcctcgccggcatgtccaccgctgttgagctcttggaccagggccatgaggttgatttgtacgagtcccgcccgtttattggtggtaaggttggctccttcgttgataaacaaggaaaccatatcgagatggggctgcatgtgttcttcgggtgttacagcaatctcttccgcctcatgaa

SEQ ID NO: 30054 - DNA, 529 bp, Sorghum bicolor
  Clone ID: 9849432
gcacgaggccccacctcccctcttccctctcctcaaacaccagcgctcgattcggctcgcctcgaactccactcgcgggctccccccccttgcaaagccctctgaaaattctctaaaccccgccgctctaggcagccaccacagccgccacccatggccggcggcggcagcggcagcggcgaggcttcggcggcgggaggcgggaaggtggcgtgcgcggcgtggatccggcgccgggaggagaaggcggcggcggcggtggcgcgggtgttcgcggcgtacggccgggcgggggcggccggctccccgcccgcgctcgaggtgctcggcttcgacgccaaggagtgctccctctcccccgagcccctggcgagggccgtgctcggggagggcggcgcgggcgacgcgccgcgcagcatcgcggtgcaccccgccggcgacgagcttgtctgcgccaccgccacgggctgcaggttattcaaactgatatttgaagagttcacagtacgcatcattccaagagatgctc

SEQ ID NO: 30055 - DNA, 580 bp, Sorghum bicolor
  Clone ID: 9849439
gcacgaggcacctagccatcgtcatggagtacgcctccggcggggagctcttcaaccgcatctgcaatgccggccggttcagcgaggacgaggctcgcttcttcttccagcagctgatttcaggggttagctactgccactccatgcaagtatgccaccgtgatttgaagctcgagaacactctgctggatggaagcactgcgcctcgcctcaagatatgcgacttcggttattcaaagtcatctgttcttcactcccaaccaaagtccactgtgggaactccagcatacattgctcctgaaattttgctgaacaaggaatacgacggcaaggtactatccatccccttgggttctttaagttgccctccgacataggactggacagtaccaagttgtttttgtttgttctacaaaggtgctatcaatctttatgatggcacgagaagcgtctggtctttttttttacaaaaactagcgtctgaatctgaaatgcttgatcgctaataatttgtcattggatggagattgccgatgtctggtcatgcggtgtgaccctctacgtgatgctggttggcggg

SEQ ID NO: 30056 - DNA, 457 bp, Sorghum bicolor
  Clone ID: 9849445
agagtgcactagctcaattttgtgtggatttgaccatgcgagcaagtggaggattaattgatcctgttattggtcgcaaggaggagatcggaagagtagttcagattatatgccggcgaacaaagaacaatccaattctgttgggtgaagcaggtgttggtaaaacagctattgctgagggcttggctcttaaaattgctgatggagatgttcctattttccttgtgggaaaacgtatatgatcattggatgttgctctacttatggctggtgccaaagaaaggggtgaactggaagccaggattactagtttacttcgtgaagtgcgcaaagcaggtgatgttatgctattcatcgatgaggtccatactcttattggatctggaattgctggaagaggaagtaaaggagctggccttgatattgccaatttgctgaagcctgcactcgctacagg

SEQ ID NO: 30057 - DNA, 606 bp, Sorghum bicolor
  Clone ID: 9849454
gcacgagggcgaagcactatgcggatgccactggatttgacattgtctttttcttaccagatagtgaagatgactttgtttcttatactgagttcttgcgctacctgggctcaaaaagccgggcaggggttgtaaaagttgatgcagctactactttatttttggtgccaccatcagatttcttaacaaatgtgttacaagttgatggtccagagcgcctttatggtgtggtattgcacattccacaaatctctgctgctgctgctgcactgaggccacagttaactgggacagaacagcaaccttactatgatgaaagggaaactctgcctacacaaagaaagtatagtatcatttctcctaatggcagtggccaccttgatgctgattatcgggcatctttgcatgaggattcaatgcaacgtttggggcatattcctggaaggcctcgggtggatgaaggccaagcagtccagccagctcttgcaggttttcctgctaaccaagcaactgggctgcaagtgcaatcttcactcaagcctgacattatggctactttagcaaaacttctgcctagtgtgcaatcatcacaactggttagtggtc

SEQ ID NO: 30058 - DNA, 562 bp, Sorghum bicolor
  Clone ID: 9849464
gcacgaggccatcgtcttcctccgtcacacccacctcgcaaaccctagctcgccccggccccacatccgccccctcttgtcgacgccatgtcgaagcgcccgaagctcgagggtttcagcatcccgcggcccacctcctacaacttcgagcgctcgcagcccgtgcagcggctctaccgtccgacggatgacccggacctcgacgacatcgccttctccgacgacgccccctcagatgcccccgccagcaccgcggtggaaggaaaggcggaggatgacgaggagatcgacccgctcgacgccttcatggccgagatccaggaggagatccgcgcgcctcccccgccgcccaagcccgaggcgcttcgccgcgcggactccgacgatgacgaggatgaccccgtcgagagcttcctgcgggccaagaaggacgccgggctcacgctggccgccgacgccatgcgcgctggttacgactccgatgaggaggtctatgctgctgccaaggccgtcgacgccggcatgatggaatacgattccgatgacaaccccatagtcgtcg

SEQ ID NO: 30059 - DNA, 503 bp, Sorghum bicolor
  Clone ID: 9849465
gcacgagggagttcgacgacggcgggtgcagccccgacgcggacgccagccgctgcgtgaagcggccgcggccgcaggagcgcaacaagacccttaagtacaagctgttcgcgagcacgtggaacgtcggcggcgtggcgccaccggacgatctggacctgtcggactggctggacggtggcgaggacgacgacgggccctacgacatgtacgtgctggggttgcaggaggtggtgccgctgcgcgcgcgcaacgtgctgggcgccgacaagaagcgcgtggggctgcggtggatcgagctcatccgcgccgcgctcaaccgccggtcgcactcgcagcggcagaggcagcagggagacggcagcggcaagcagaaggtgcacccggtccgggacggcgggcgcggcgagctggcctgcagggactaccggtgcgtggtgagcaagcagatggtgggcatcctgctcacggtgtgggtgcgctccgacctccgccgcttcgtc

SEQ ID NO: 30060 - DNA, 536 bp, Sorghum bicolor
  Clone ID: 9849485
gcacgaggcaggaaccacgcttattccgaatggatattagctctaatattaaatatggttgcccaagagaagtcagtcatgaagaagtggtctgggctgcaaagcaggcctatgctcatgatttcataatggctttgcctgatggttataacaccattgttgatgatgctcttctcagcggaggtcagaaacaacgtgttgctattgccagggcccttctgagggacccatctatcttacttcttgatgaagccactagtgcgcttgatgcggagagtgaacattatgtcaagagcgtcatcacaaaagttagtcgagattcgaaggctaaaaggactgtggtaatcatagcacacaggtaatgtatacttggcacacaggtgtttgctatcttgatttttgaacatgcctggagatccccacagtgagattttgtattataacttaaaggatgcttcagattttggtgtttacgcaaatactgcaggggagatccccacagtgaaattgtgtattaaaatttaaaggatgcttca

SEQ ID NO: 30061 - DNA, 534 bp, Sorghum bicolor
  Clone ID: 9849496
gcacgaggccagcccagctccacccgcccgccgccatggcgctgctacggatcaccgcgcggaggagaaccgttctccccgccacccgtgccttctactcctcgtgctcttacccgccgttccgtccgcccccacctccggcgaacgaccccgaagccgcccagtccccatcctcctcttgctccccaaaccctggcgcgccgcggaacccggcgtcctcggccttccaggacatcagagatagtctccacacgtctcccgcgtcgccctctccgccccggatcccgacgaacctgccccgccccaacccctcgcgcggagctcctccttcgcaacggacccctgaagacatccgccggatgatcctgaacttccgctcaaccggcggcgtgccttccacctcctctccaggagccgcctcgtcaccctccgctcccggagcgtgccccttgttcgcggacctgttcaagaatgccagcgtcgcccagggccccaacgccgggcagggggtgctcggcctcgatgccggccgag

SEQ ID NO: 30062 - DNA, 133 bp, Sorghum bicolor
  Clone ID: 9849522
acagctacctcatcttcatctctaacaccatggcgcacctctacccgattaccgcgccgacctcctcggacctcctctaccccaaggcgctcgacatctgggcgatgctgccgttccaactcgggctcaatac

SEQ ID NO: 30063 - DNA, 620 bp, Sorghum bicolor
  Clone ID: 9849527
gcacgaggtccgtgccagtcaaattggacaggagtcttctgccacaaagtgaatgatgatgcatttcttcatgtgacagaattgcagttatttaagaggaatctctcaggaactctggcaccagaggtcagtcttttatctcagctgaaaacattggattttatgtggaataacttaagtggtagcatcccaaaggagataggcaacatagccacactcaaacttatacttttgaatggcaatcaactctctggtattttaccagatgagatcggcaaccttcaaagtttaaacagattacaagttgaccaaaaccaattgtctggccccatacctaaatcattttccaatttaagaagtgtgaaacatcttcatatgaacaataattcattaagtggggccatcccgtctgaactttccagattgcctcttctacttcacctgcttgttgacaataacaatctatctggacctcttcctccagaacttgctgaagcgcctgccctgaaaatatttcaggctgataacaatgatttcagtggaagttccatccctactacatatagcaacatatccacactactaaagctgagtcttaggaactgcagcttgcaaggagc

SEQ ID NO: 30064 - DNA, 592 bp, Sorghum bicolor
  Clone ID: 9849529
gcacgagggacatgtgtgacaagaacggcgatgggatgctcacggaagatgaggtcaaagaggttattatactgagcgcgtcagcgaacaagctggccaaattgaagggtcacgccgcgacatatgcgtccctgatcatggaagaactcgacccagacgaccgcggctacattgagatttggcaactggagactttgctccggggcatggtgagcgcgcaggcgcccgagaagctgaagcggacgccgtcgagcctggcgcggacgatgatcccgtcgcggtaccggaacccgctgaagcggcacttgtccaagacggtggacttcatccacgagaactggaagcggatatggctcgtgacactgtggctggttgtcaacctcgctctgttcgtgtacaagttcgagcagtacaagcgccgaactgcgttccaggtgatgggctactgcgtctgcgttgccaagggcgccgccgagatcctcaagctcaacatggccctcatcctgctgcccgtctgccggaatacactgacgacgctcaggtccaccgcgctcagtcatgtcattcccttcgatgacaacatcaacttcca

SEQ ID NO: 30065 - DNA, 587 bp, Sorghum bicolor
  Clone ID: 9849531
ttgatactgcagctaagccatatgaatggaggaaacttgaaccagaaggtgaaggaccacctccatgcatgtatgccactgcaagtgcacgttctgatggacttctcttactttgtggtgggagggatgcaaatagcgtgcccttatcaagtgcatatggtcttgctaaacatagagatgggcgctgggagtgggcaattgcccccggtgtctctccatcgcccagataccaacatgcagctgtttttgtgaatgcacgtcttcatgtgtcaggaggtgctcttgggggtgggcggatggtggaagactcctcaagcgttgcagtactggacactgctgctggagtctggtgtgatacaaaatctgttgttacaactcctaggacaggaagatttagtgcagatgcagcaggaggtgatgctgctgttgagcttacacgacggtgcaggcatgcagcagctgctgttaatgatctaatattcatttatggaggtttgcgaggcggggtacttctggatgatcttcttgtggctgaggatcttgctgctgctgaaacaacaaatgctgctaatcatgcagcagcaagt

SEQ ID NO: 30066 - DNA, 582 bp, Sorghum bicolor
  Clone ID: 9849540
gcacgaggccaaacagagtgcattcaagcttgccactgcaaaccacaccgcatgatcaatggagaagaagggaacagacatgcctaacgagaatattatgctgttgagcctgctcgttggccttagtattgctggattcagtactggagaagaccagttcgtctacaccggcttcactagcagcaacctcaccctcgatggtggagcaacagtcacgccgagtggcctccttgagctaaccaatggcaccgttcggcagaaaggccatggattccaccccagttcactgcccttctatgagtctagtggtgtagtgcagtctttctctgtatcctttgtgttcgccatcctctctacctatcctgagagtggccatggcctcgccttcttcattgcgccaaacaagaatttatcaggttcgttcccaacccagtacttgggcctcttcaatgatcagaccaatggtgacccaaacagccacatatttgcaattgaactcgacactgtccaaaattatgacctacaagacatcaacaacaaccatattggcattaatatcaatagtcttcgctccattcaatc

SEQ ID NO: 30067 - DNA, 534 bp, Sorghum bicolor
  Clone ID: 9849569
gcacgaggtgatgcagctgctacacaggatggttttacagttccattctttgacacagtagttactctgtaggactgatgaagtttagagaatccgcaatgacactgcatgaactgtagtttttttttcacattcacaatgataaattggtatgagttcttgcagctgccccgaggcctttcttatgttggcattttcacactattatttgctaagtagcaaatatctcattgtctatactctatgggcatagaacccaaaacatcttcaactgcatcacacatgttcaccattttctccatggttaataatttctgatgctacgttgttttgtgagagttcattaaatattgctgcttgcactgggtctggttaactatcattgtatctttgaataaaatacatactctttgatctgattgtcaacacccagaaaatatggtgttaaaataaggtattgtggtagcacatccagttcctcttgctccacattctattttatcgtaataggattgctccacactccaaagtgca

SEQ ID NO: 30068 - DNA, 467 bp, Sorghum bicolor
  Clone ID: 9849571
gcacgagggacaacctcacgttcaccatcggccagatcacttggaccaccgtcttcaacagtttcaccgccacgaccatagaggaggcgcaaatctgatctgcgccgatcacttcttcaccaacgtcggttggggcttcgaccacactggctatggctctaaccactctagtaacgtcttcaaccacaacgacaacgtgtcacccgcttccccgctacgaaggaagacagatcgacaacatcgacttgcccgaggtcatcaaccaagtcaaccacgagctttccgagagcatcaaggtcagaaaattttgtcgccgtagactagatttttgtccaaagataaagtacactttcaatattttatacaattttcggcatgatgttctccataatgtcttcgacatgattattctccaaacaactttttgtttaatggttagccgaccagttctttctcctacttagagt

SEQ ID NO: 30069 - DNA, 596 bp, Sorghum bicolor
  Clone ID: 9849578
gcacgaggaggaactcttgcaggcactcaacactgacatgagtgatctcatgctcttgataccttggtactcttacatcacccttcttcctcctctcccctcctcatcccccaagctcctcctgcctctttctagctaggatcttcaacaaccctctctctccaattctctatccccctatagaaagaagaaagaatataggagagagaggtgtgaagctaggcagcaggcagctgatttttcttatgtgcaagagagacaggacggacagcacgtgccggaggagctcatgagctagctgcatcaattcctgaggtaactgacatagagaaatagatatgatagaggtgagagagatggtgatcgaggaggaggaggaggaggcagctgttctgctgagtgatgtgtatgtgtgcgtgcttgtgttgacatctgtgcaacccccgtttctttgttaaatcacttgatgaagatggatggatgcctgccttttcctttcccttattaatatatattttttctgatactgatgcctattccacatctctctcatgctctctccctcttcttctaaatatagctaagctagtgctagc

SEQ ID NO: 30070 - DNA, 561 bp, Sorghum bicolor
  Clone ID: 9849579
gcacgagggtgcctcgcgtcgccttggtgtccccgaagtcgtcgacggtgcagctcgatccgcctcgtcgagcatgtcgaggagggtcccttgcaaattcttcttgcatggagcttgcttcaaaggagattactgtgaattctcccatgactgtaatgaccaaccagataatgtttgcacgttctaccagaaaggggcgtgctcctttggtagccgttgcagaaatgaacatgttgaagctcatcgtgactgcccccaaccagcaaccactgcagcacgtgcatcccccaattcttctcagctagttgcttcttccagagatcctcgttgcagtggatgccaaacggatatgtgtgaccaaacgcagcagatatgcaagtcaacaacaacactttctgcacatcaacctgcatgggcagttgattatcatgacaatgacactccagatgataccacaagctggccgtcgtaccaagctgtgcaaaatcaaacatcacaacatcctgctcatctgtcaaattgctcttctgctgctgttggcacttgtccttatgggaaaga

SEQ ID NO: 30071 - DNA, 547 bp, Sorghum bicolor
  Clone ID: 9849590
gcacgagggtgaaagggatccagatggagtcagtcgccgtcgtagcggtgccgttcccggcgcagggccacctgaaccagctcctgcacctgtcgctgcagctcgcgtcgcggggcctgcccgtgcactacgcggcgcccgcggcgcaggtccgccaggcccgcgcgcgtgtgcacggctgggacgagaccgcgctccgctccgtcgagttccacgacctcggcatctccgagtacgtctccccgccgcccgacccgaccgcgccgtcgccgttccccacgcacctcatgcccctgttcgaggcctacaccgccggggcgcgcgccccgctcgcggcgctcctcgccaggctctccgcctcgcaccgccgcgtcgtcgtggtgcacgaccgcatcaacgcgtacgccgccgaggaggccgcgcggctgcacaacggcgaggcgttcgggctgcactgcctggcggcgtcgacgctcgccgggaagacggacgccgggctccggctcctgcgtgagcgtggcctggcgttcctcgacgtcgcccacca

SEQ ID NO: 30072 - DNA, 515 bp, Sorghum bicolor
  Clone ID: 9849601
gcacgaggggaaatcggcatgaattgcatgcttgtggggaattatgaccgatatatcttgattgatgctggggttatgttcccagattatgatgagtttggtgtgcaaaagattatcccagacaccacgttcatcaagaaatggagccacaaaattgaagcagttatcatcacacacggccacgaagatcacatcggtgcgttgccttgggtcattccagcactcgattcaacaacaccgatttttgcatcatctttcaccatggagctaataaagaagcgtttgaaggagtttgggatcttcctctcatccaggcttaaggttttaagaattaaaaagagatttcaagctggaccttttgaagtcgaacccatccgtgtaactcattcaattcctgactgttgtggcttagtgcttcgctgtggtgatggcataattttccatactggtgactggaaaattgatgaatcaccagtggatggaaaaatttttgaccgacaagcattggaggagct

SEQ ID NO: 30073 - DNA, 637 bp, Sorghum bicolor
  Clone ID: 9849606
gcacgagggtttcgacatgtttacttccagtgtttctataacgttattgagacagaaatggagtgcgctttgaggtagtttctgcaattcaaggtatttggggattacatcttgtgatgtgctggcaaagatcaggcttacaaaagaagctttacaaggagtgcttcttgtaaggctgttagtttctgaaaaccttcccttctcttctctagaggatcaataactgccaagacagaatgttgattggtcagacttaaattctgggcacctatgttgcattccaggtacaaatggttttatcggttgccaaaatttgagagaaactgcttgtgtggcaaaaattttcccaagcagttactttggcttctccaatgtttaagataacagaacttgaagcaaaaggacatttgaaatttgagtatagccttgcattgactatagagcacaaggcatcagataaatttaacaagcagtgccagtattgaacacaaccctggtttgatcacctaccatttatgaaaatccattgaactgctttatggagtatggattactaacaattttgagcttaatgggttttggatgattgcaagctttcaagaatcttgctggaggcgtaacacactaactgatcaag

SEQ ID NO: 30074 - DNA, 580 bp, Sorghum bicolor
  Clone ID: 9849619
gcacgagggtttgaagacctaaacaatcgatttgtgagtttaggaaccgggatgacacgacagcacaagtttagggaccgatagtggactttactcctaaagtttaatagcacatgtaactacaactaatctatggttacttctatataatatgctataggagtactgaataagcttattaacaaagtaatagaatgccttgggtcgcaccaggaaaaaccaattgatccgatcaaactaagggcctgtttagttcacatgtaatgcaaaatgtcgactacttatgaaatataaaatgctaaaattttcaaaattatgtttagttttattcaaaatgcagaatttattgctctgattatggtctcttgagactcttttgggtttttttaccacttgaggcaaaaatctaaaatagagaatggtaatcgttttgccaaaaaagtatatagtgtttatgtttattatgcaaaataatagaccaaaaccttaaatttttttagataaaaagggaactaaacacaccctaaataatctcatgagtagccatgtatgattttaggtgatctatatgagatattac

SEQ ID NO: 30075 - DNA, 550 bp, Sorghum bicolor
  Clone ID: 9849625
gcacgaggagcatctccgcctgcagtgccgtccctctcgtctcgtctctcttctcaggcgccacgcaaaacggactccgcgcttttccctctccggatccggctccggcgaagcagcgggagccacagccaccgatgctccgggccgcgacggtgcaggcgcgtctcctcctcctatcgcgctcctacgtagggcaggcaaaggcagcttctagctggcctctcgtccgcaggaagccttcgcgtcttggatctgtacgccctttctatcagatggacactagagggcaagacgaaaataaaattttgactgcaagagggtgccatagctcccctgagagtcaagaattagcaatgaaaagctgtgttccatgcaactctaaggatttacatcccatgtcagaagattctgctaaaaagttgcttgaacaggtgaatggttgggaactcattactgaaggtgatgttctgaaattacatagagcatggaaggtgaagaactttgttaaaggacttgagttctttcaacttgttgctgctatcgctgagga

SEQ ID NO: 30076 - DNA, 539 bp, Sorghum bicolor
  Clone ID: 9849651
gcacgaggagaagctgaaaggcccatgctgattcccagtggtacctgaaactatcctgggatctatgtatcagatgataccattggaaatgtccaatcatgtgagcatgtggtttaccattggcaccaatgcccaccagatacaaggactactatattagatgaattccttaaacggtacaaatggtcgcctggccatgaagaggagtgtcaaaagatatttgaccgaaaagcggttagacagctaatgaatctcttttgctatgagaagcaaagggttagacaggtgttagcatcaaaaaagaccaaggctctatctgttcgtagggcccatgatgaaatggagctagaacaggatggtggtagagaagatccagatgaacagcaaggagaagcgtcagtaatggtacttgagcatgaagatccgctgaaatggaaaccatttgtccctgtatggatgaagccaaaatggtgggaaatgttatgtgaccattgggccaaagacgagaacatcaaggtgtcttgccaacaaaggaagaa

SEQ ID NO: 30077 - DNA, 545 bp, Sorghum bicolor
  Clone ID: 9849680
gcacgaggctccgctctcgccgtctcggcgagctcgctcctcgtctcccggtccaggaggaggtgggtgtgagggatggagaggctggagagctacctgaaggagcacttcgaagtgccggcgaagaacccctccgaagaggcgcagcggcgatggcgctccgccgtgggcctcgtcaagaaccgccgccgccgcttccgcatggtgcccgacctcgaccgccgcagccaggacgaggcccagcgacaatccgtccaggaaaaaattcggcttgccctggttgtgcagaaggctgccatcaccttcattgatggtgccaagcataaagaatatcggataacagaggatatcataaaagctggattttccattaatccagacgaactggcatcgatcacaagcaaacatgacgtgaaagctttgaagatgcacggtggggcagacggtatatccaaaaaaaatccgatcgtcattcgaccatggcatatctgctaatgacctagacacaaggcaaaacatctaccgcgtcaatcgctatgcggaga

SEQ ID NO: 30078 - DNA, 562 bp, Sorghum bicolor
  Clone ID: 9849681
gcacgaggccgcgcccgtcaccgtcaaccacgcctcccggggcacagggccttcgccgtcctcgcccacctcgccgcacgtcgcgccgtccgcgctcgtgaccaaccaggcggtggggcggcgtcgccgccactcctcgagccgctcccgctcctccgcgacgtcgccgccgcagaccgcccgggcctcctcctccgcaagctccgcctcgtcgccgcggtcttcgacctctcggactcgctcaagcacccgcgggagaaggaggccaaacgccaggcgctcctcgagctcgtcgattacgtgcaggctcctgctcaggccgcgggcgccaacgcgcaagcgcgcctcccggaccacgtccaggaggccctcgtcgccgccatctctgccaacatcttccgcccgctgccacccgcgctgcacgagtccgccgccgcgatcgaccccggcgccgcgcccgacgacgaggaggagccatacctcgacccctcctggccacacctccagctcgtctatgacctcctcctccgatacgttgtttcgcccgacaccgacaccaaag

SEQ ID NO: 30079 - DNA, 526 bp, Sorghum bicolor
  Clone ID: 9849691
gcacgagggccagtttgacctactaaagttcggtccaggatggatgaagctccagaagtttgagtttgagatcgaaagttgccccagtctatttgatcctcgtgatccttcatgtgtggagcactgtcagtatagatatgatttcatctgtgagagtttggtggatttgacattggcgcgagtctcaactgagaaggaaataggacttcgttgtctcctgaggaagtgcaaggcattaaagaagttgtgcctttattatgttcttggtgtacaggacactgacatagttgtgctctccaacaattgcagcaatcttacaagcatctcacttcggttaacacctcagttcaatgaaggtcatgttttcaggacatcattgactgatgacagccttaaggctcttgccctcaggtgccgtaagcttcagtcttttgaactcatattttggggatgtgatgaatgctggccagaaataggattcacacaggagggccttgtcttgcttattcagtcttgtccgattcgt

SEQ ID NO: 30080 - DNA, 529 bp, Sorghum bicolor
  Clone ID: 9849699
gcacgaggctttgaactcgagtctcgagctagctggtgaaacgccggccggcaaagatgtcacacgctgccgtcgcgattggcaccatcgtattcgtcattatcgtcgccgcgataattgtgtgcgcctacagacgggccgaggcatgcgccggcggcgtcgcgagcagctacgcggtggtgtcggaccaacagatccggcacgccaccatcgagaaattcctcttggagatcaggcacgacaagcccttcaggttcacgtcgctgcagctcgccgggttcacgcgcaactacacgacccggctcggtgccggcggcttcggcacggtgtacaagggcgtgctccccaacggcctccccgtcgcggtcaaggtcttcgaccgcagcctcgcccagaggtcccaggaggagcagttcatggcggaagtgggtaccatcggccgcacctaccacgtcaacctcgtcaggctcttcggcttctgcttcgacgacgtagtgcgcgcgctggtgtacgagtacatggacaacgg

SEQ ID NO: 30081 - DNA, 574 bp, Sorghum bicolor
  Clone ID: 9849701
gcacgaggtccgcctgcactgcgccgcgccgagcggaccgccaccaccgaaaccctagagcgaagcagcgatgcacagtccggtcccgctcctcctcctgctcctctgcacggccgcggcggcctccgaccacggctcccagtcccaggtacgtcacgtcacgtcagccgccagcgtctcttcctcccctaccctcaccctcacccggccgcctcgatcccctgctgcaattccggctcacattgcgtcgcgccgcgcgcaggcgcaggcaccgggggcggcgcggcttgggctggtgccggtggcccccgcggaggcggagctcggcaccatggcgctcgccctcaacgacacgcggcgccggctcggggggagcttccagctctgcgcgccctgcacctgctgcggcggggccagcggctcctgcgtcctcgcgccctgctgctactccatcaactgcaacatccccaaccgccccttcgggtactgctccttcacgcccaagtcctgcgagtgcatcggatgcaacctctgagctccacggcggccgcgggattcattcaatttcaattga

SEQ ID NO: 30082 - DNA, 595 bp, Sorghum bicolor
  Clone ID: 9849707
gcacgaggaaaggattaacatggaagcttccaagcgtgcatcatatgtcaagaagattcatgggaagaccaaagaagcaatcgaaagaaggtccaagtactatgctgattgggcaaacaagcatcgcaagaaggtgatacttgagcccggagatttagtgtgggtacatcttcgcaaagaccgttttcctgagaagcgtaaatccaagttgatgccacgaggagatggtccattcagagtgctgtccaggatcaatgataatgcctacaagattgagcttcctgaagattttggtgttagcacaaccttcaacgttgctgacttgacaccgttctttggattagaagaatcagagtcgaggtcgactccttttcaagagggggaggatgatgaggacatcccaaccaagcatgctccatctaattccacgccaacctctacaccgactacgtcggcaccagcccaagccattgatggagcaattacacgtagccgagccaagaagctacaacaagaggtgaacgcgctactttgtgagagttctattaatgttaatgagaatattatactacctaagtgttctactttggttatg

SEQ ID NO: 30083 - DNA, 432 bp, Sorghum bicolor
  unsure (1)..(432): unsure at all n locations
  Clone ID: 9849728
gcacgaggtggggttgcagtggctcatggcggtcaggtacctcttccccatcctcgactggatgccgagctactccttctcgctcttcaagtccgacctcgtcgccggcctcaccattgccagcctcgccattcctcagggcattagctacgcgaagctggcaagtttgcctccaataatcgggctgtattcgagcttcgtgccgccgatggtgtacgcggtgctggggagctcacgggacctggcggtgggcccggtgtcgatcgcgtcgctgatcatggggtccatgctgcgacaggccgtgagccccaccgcggagccggtgctgttcctgcagctggccttcacctcgactctgttcgcggggctggtgcangcatccctgggcatcctcaggctcgggttcgtcatcgatttcctgtccaaagcgac

SEQ ID NO: 30084 - DNA, 354 bp, Sorghum bicolor
  Clone ID: 9849732
gcacgaggcatccacggcgagctgagcgtggacccggcgaggacgcccgaggggaagagcatcggcgacttccgcaggctcctggacgacgcgtaccgcggccgcatcgagttcctggagcgcctggagcggcgcacggctcggaagcgcctgcgcctgcaccgccaccgccgcggcgccgtggtgccccgcgcgccgccaggtccgagtcacgcagacgacgaccgccggcccaggcccaggctggtgatcgtgtcgcggacggggtcccgcgtgatcgagaacgaggccgacctggcggcactggcggcggacgtcgggttcgacgtgcgcgtgatccgtcccgaccgcacc

SEQ ID NO: 30085 - DNA, 337 bp, Sorghum bicolor
  Clone ID: 9849740
gcacgaggtcaacttctctcctctgtgtttctcaagaataataaggtgcatctcttctgtgctacaagatctggcggtggggcatgatgagcaatcttaaacttggtgttgaggttaccagtgctcatgatctcctcccgaaagagcagggcacagccaatacttttgttgaggtcgagttcgatggccagaagttccgcacagccatcaaagacagggacatcaaccctgtctggaacgagcagttctacttcaacatatctgatccatcccgcctcccagagctacaccttgaggcctatgtgtaccatgcagaccgtgccagtaattccaaggc

SEQ ID NO: 30086 - DNA, 417 bp, Sorghum bicolor
  Clone ID: 9849746
gcacgaggcaccattcttgtcccattagcttctcctctactcactgatgctgatcctcaacctccaccgcttcctctctgcttgagcacgccagcgcaccggccgcagtgccaccgagccgccattggcgacggcgagccccctagaagccagtagagcgcgggccaagtatgtcaattggtccgcctcgaatagaggaacatgacggtgccctaagtttccccggagacctcaccgtcgttgagatctccggcgaccgagctcgcctctgctctttgtgtcgctgacgcgtgggacccctctgtcagcctctgtccctccctccccctatttctacttttgggcagacttagagtgtttttggaaaattcataacttgagctaggcagatccaaatggaatgattccaactttgct

SEQ ID NO: 30087 - DNA, 356 bp, Sorghum bicolor
  Clone ID: 9849748
gcacgaggcgcggagcaaggggcggctgggatttgtgctgattacgttgcctcacgtccgcgcgagggcaattatgtcttttctgctttttttttctccccccttttgctggggtatgtccgcctacaggaggacggttcggggggattgctagccgtagccgtagccgttttacacgagctagcacggcaaagttgctgccagtacgagcaggataggatcgtcagtacccaaatggcaaagctctagcttcggtacatatactaggtattatttgagtaagctactgtacagcgggacacggctttgctgctgctgatggcctgatcatggcaacgactgcgattgcccgtgta

SEQ ID NO: 30088 - DNA, 292 bp, Sorghum bicolor
  Clone ID: 9849759
gcacgagggaagagcttgcggtctggtacgcaaggcgcactcacgggtgtaggtttatcgattagttacccaatggcaattaatggatcaccttcaggagttgctgtcatgacagccacccctggtggtcctgcagaaaaggccggcattcttcctggagatatcattttggcaattgatgacagaagcactgaagacatggatatatatgatgccgcagaacgcttacagggccctgaatgaagtccggtagatttgtctattcgtagtgggaccaataccaggcatgtcg

SEQ ID NO: 30089 - DNA, 345 bp, Sorghum bicolor
  unsure (1)..(345): unsure at all n locations
  Clone ID: 9849774
gcacgaggattaagcccgttactgttagcttcaaagagggtcttggtcaaaaattcaggcaaccttcaggaacaggaattgacttttcagtgtttgaagaatcagatttattaaagcagggggacatggatgtatatccacttgtagttaaagctgaaacagcattgtctgctgatcacccatcagaaggggatgaccaaaagatgaaaactcctaactcacagatcacccaggcggtgtttgaaaagaaagaaaatggggattatcaagtaagagttgtttgccagatcctttgggtcaatggaactaggtatgaactgcaagaaatatatggcatanggaact

SEQ ID NO: 30090 - DNA, 169 bp, Sorghum bicolor
  Clone ID: 9849775
gcacgagggttattgctcatgactctgctggcctcctctggctctctccctgccatggcatccaccggtgaggcactctcgccgccggccatggagatgcgaccattggacacctattctccggccaagcttgccactgttgctgttccacccaaagggaggcgtatgg

SEQ ID NO: 30091 - DNA, 330 bp, Sorghum bicolor
  Clone ID: 9849777
gcacgaggccgcgctgcttcacactactaccgttcttttttttcgtttcacaaggatccggagcgatccgcttttctgcactcggttccggttgagagggtttctgcagttctgctcatcggagtcggaggaggaggagcttctgtcgcgtcgggggccggagtaggatctctgcagggccgagatggtggtgcatctctgagttactgcctgcctcgcgaggttcgtttgggttctggtaggcgagagttgctggctggtacctgcggctagtaattgtaaaaggaagcagtactggaggaaacgatgagcttcggcgctgtggacatg

SEQ ID NO: 30092 - DNA, 265 bp, Sorghum bicolor
  Clone ID: 9849787
gcacgagggtcgattgtgtataacattgttcatgtcacatcaaacgtgacggaaggagatgatagtgctcaaacaaatgaaacaaaagtgttaaattctggaaatgctacaggagctattgcagaagagaactgctccacctcaaatgactgcaccgatgaatgtgcacttcctttgatatcgacgagcatacgtgcaattaaagataaggaaccaatgttggggagaggatggaagtttttgtgatcaatttctaaaacagtgg

SEQ ID NO: 30093 - DNA, 413 bp, Sorghum bicolor
  Clone ID: 9849795
gcacgaggtaactccaaaaacccgtcctcagttcggattgcaggctgcaactcgcctgcatgaagcaggaatcgctagtaatcgccggtcagccatacggcggtgaatccgttcccgggccttgtacacaccgcccgtcacactataggagctggccaggtttgaagtcattaccctccggtgtatagctgcacgcgctggctttcctccagtcgaccagcccgcggaagaagagcctggaaacggttggagtagtcctccaccgatccggtgcgccgccactctgtaagctcgaacagcggcgcggatcgcagcgctgggccgaaccgaagattgaggagctccttgaagcgaccccatggcggcgtgccttcatcctcctggagttggaggaaccacaattgggccacatc

SEQ ID NO: 30094 - DNA, 157 bp, Sorghum bicolor
  Clone ID: 9849803
gcacgagggttgcctgatggttggctatgtttggtatgaggtgcatttgatactcaaaagctttctccaaatttcattaagcttgcaaaggatgcctacacacctgatttgatggcagcatctgactgcatgcttggaaaaattggatatggcacag

SEQ ID NO: 30095 - DNA, 359 bp, Sorghum bicolor
  Clone ID: 9849812
gcacgaggggctccccctcggcggcgtccagcgacggaggggcagtcccagggcggcggcgtcggcggcttccccccaccttctctcgccagtcgcctcgcgccctcgcctgcgtcctccgcgcaccggccgacgaccctgcgtataccagtggccgcccttccaatgacggtggagaagtccagtggcggcacgtcaacttcctccaccatggaccgtttccaaaagattgtcctaagctgggattacctccgcctcgtcaccgaatccaagggcggcaagcaggccaaggtgctgcagcgtgtgaagaacacgtacgactcggtggctgagtacctcggtgtctttgagccactgct

SEQ ID NO: 30096 - DNA, 128 bp, Sorghum bicolor
  Clone ID: 9849835
ctgagcacaagagacttcctcggcgtcggcaggggcgccatggcgccgcccgggctccacatcggcgccctggtcccggctcagatgaagtgatggatcatgcatgcaataatgaagagcagcaatgc

SEQ ID NO: 30097 - DNA, 589 bp, Sorghum bicolor
  Clone ID: 9849853
cgtcgggttcgaggtggtgatcggtgacccgcctttcaacgtcgacgtcggggagttcgccagggaggtgaacgccgtggacgtgctggtgggcgtgcacggcgccgggctgaccaactcgctgttcctcccgacgggcgccgtgttcatccagatcaacccgtacggaaagatggagcacatcggggaggtggacttcggcatccccgccgtggacatggggctcaagtacatggcctactccgccggcgtggaggagagcacgctggtggacacgctgggccgggaccaccccgccgtcagggacccggagtccatccaccggagcgggtgggggaaggtggccgagttctacctcggcaagcaggacatccggctggacctccagcggttcgagcctgtgctccgcaaggccatgcagctcctcagggagtaggcaccggcgtcgcagagagcagcaagatgcaagtacagtttttttttattttatttttttcaaaatgattctttagacactatagtacagtacagtagctcttatttttcttccctccctggcctgcttaatttatttctcaattcttttcac

SEQ ID NO: 30098 - DNA, 661 bp, Sorghum bicolor
  Clone ID: 9849882
tacacagagatattaagtctagcaatgttcttctttttgatgatgatgtagctaagatagctgactttgatttgtcaaaccaagctcctgacatggcagctcggcttcactcaactagggttcttggaactttcggatatcatgctcctgagtatgcaatgactgggcaactcagctctaagagcgatgtatatagtttcggagttgttcttcttgagctattgactggaaggaaacctgtcgaccatacattaccaaggggacaccagagtcttgtgacttgggctacaccaagacttagcgaagacaaggttagacaatgtgttgactcaagacttggaggggactatcctccgaaagctgttgcaaagtttgcagctgttgccgccttgtgtgttcaatacgaagcagacttccggccaaacatgagcattgttgtcaaggcgctacaacccctgctgaatgcgcatgcgcgggcgactaacccaggagaaaatgctgggtcataagctttgcttctctcccccgcctcttgtatgatagataagtaagatatatgagtcgtcgatgtcgttcttgcggacatgtggctggcagcgtgtaacatttgtgattattcttacccctgagttgtaaacaagattattgtatcccccacaat

SEQ ID NO: 30099 - DNA, 620 bp, Sorghum bicolor
  unsure (1)..(620): unsure at all n locations
  Clone ID: 9849884
cgacgacgctgccggggccgacggctagctttgagcagctgaagcaggcgttccacggccgcgggctgtccaccaaggacctggtggtgctgtcgggcgcccacacgctgggcttcgcgcactgctcctccttccagaaccgcatccggctccaggaccagggcaccgacgccgacgacccttccntgagcccctccttcgccgccgccctccgccgtgcgtgccccgccaacaacaccgtccgcgccgccgggtccggcctggacgccacctccgcggccttcgacaacacctactaccggatgctgcaggccggccagggcctgctctcctccgacgaggcgctgctcacgcaccccaagacgcgcgccttcgtcgcgctctacgccgcgtcgcaggaggccttcttcagggccttcgccaagtccatgctgcggatggccgcgctcaacggaggcgacgaggtgcgagccaactgcaggcgcgtcaactcatcatgatccggaccatcccatccgatccactgctgtgttcccctttgggccttgtttagttgcgaaaaatttttagatttcgcatactgtagcactttcgtttttatttgataaatatgtaccaat

SEQ ID NO: 30100 - DNA, 542 bp, Sorghum bicolor
  Clone ID: 9849906
aagctctactcgaagaggtttcaagacttcatcggcagaatttttgtggaagatggctaacagaaactgtgtagagatgaaccgcgaattccatgcgacgaaggccagagcacctgcaatgattccggggcagtatttttttgcgggcagtaaagaagtatacatactaattgccaagaatcatcttcgtccatggggatccggtaaagcagcagcagctcgtcggctgggtgacctaccgtgaagcctcggtcatcagtgaaggtgatctgagttcaaagcaaatttgccgcgaattctctccggatatcattcgagtggctggattttgaagcgcagccatgggatgggaggattttgtctgtaaattatgtgtgattcggcgggtgagagattggttcttccgactccattgtagcagtagttctttttttcctccttaattttgttggaggatttctttttttgtttcttttacctacccctttaatttaaatatatcggtccgagtaaaagaaaggggcagggagttttgtttacca

SEQ ID NO: 30101 - DNA, 644 bp, Sorghum bicolor
  Clone ID: 9849923
gcacctggcggcactgacggagcaccaccagcgtcagatggcggacctggcgagcttcctccggacccagcaccagcaggatcttcctccctcgctctttgctccaccaccagtcccagtgcctgctcctgttcagcgtccggctccgtcggcgggttcgaacccgactcccagccctccactgggtgccagccctacacagcaaggctggccagggtacccgacctacccgacctaccccacgcagccgttcacgtgggggcctcctcctccacagtcgcagggctactcctcgtggccgggggcgcagacgcagcaggggcctagcgcaggactatggcgctacgacgccgcgccgtcagggtggactcaggcaccaccacaggcagggtggggttcgtggggcgatgggacccctggggacggcgccacgagttaggaggacctgtggggggtactcggtgacgagcaaagtacctttgcctccatcttctcgactaggacgcatgttagacccttttgccctcatgttggacttgtaggacttgttggacatgtatgttggacatgtatgcacttgttacgcgacgttatgtgtatttcggacatgtatcgatggatttgatgatcatgtgtggattcca

SEQ ID NO: 30102 - DNA, 422 bp, Sorghum bicolor
  Clone ID: 9849929
agaggcaagatcgtggacgtgtgggttggtcacgtgctcatgccagtcgttctgtagattctgatcagaaccctttgttggtcgagacggatatcaggacagctgagaaaaagaggatattttacgggtacctagcaattgcatctgatctggatgaactagactcagattctcgaaaaagggctttcctccagagcagaagagaatttgatccaaatgaatgatctcttgccataaagccaacctccatcagtttatttaatttgcaccgaggcgtgaatacccatctggccatctctgatcccaatttatagattcatgctgctgctgtggataaaagacgttaccttgaatataatatctgcagctagttgagttgtacccctagttctggaagctgtatttgcactaggtgtacttta

SEQ ID NO: 30103 - DNA, 560 bp, Sorghum bicolor
  Clone ID: 9849939
ttccgcgacgtctactcgcccatcccgccggtgtacaacctggtgctcgccatgctgtggaggcatcccgacaagcttaaggtggtgcggctcgacgaggtcaaggtggtgcactactgcgccgccgggtcaaagccgtggaggtacacggggaaggagcccaacatggaccgcgacgacatcaaggcgctggtggccaagtggtggcacatcttcgacgaccagaccctcgactacaacggcggcgaggcggcggcggaccaggcgagtctgccgctgcgccaggccctggctcaggccggcgccgtcaagtacttccccgcgccgtcggctgcctaggcgacgccggttgcatgcaggccggccgggacgacgacgtgccaagcagctgggcgaatcggtcggccggctggtggctccggtcctctactactggcgctcaacgaggcgcttaattattattatattaataataatatggatatgtgtggattaattagcggtctacaggttttggaattgtagacattggccagcagtacaatcgctcatatatattt

SEQ ID NO: 30104 - DNA, 457 bp, Sorghum bicolor
  Clone ID: 9849944
gacctccccgtccccggggtttgaagcagggacccccgtgctgccgttctcgctccggccggcctctaacaagccgacgacgggcgctgacgccgccgcgacgagcagccgtttcgtcacgaccgtctgtgtcagtgtcaccgcgtctcctttcctgtcgccggcgacgccagagagccagctggttagcagcagcagcagcggctactcggtgggcggtggcggcggcgtggccatggccggcgtccggaacgtgcctgacgtggagctcgcctctacgaccaactcccctatggccatgggggagatggatttcatgttcccgctggacgccgccgatttcttggagctggggaacccggccagctatttctagacgacacaaacgtacgtgccttcaaagtttgcgaagaaataccgataggtaaatacgacgagcaagctttgcttcctctcc

SEQ ID NO: 30105 - DNA, 402 bp, Sorghum bicolor
  Clone ID: 9849951
tgcgtgcctggcttttgctctgaatttattttagtgcagcaggttgcttattgttagtgagcagcaatttgttctcacagctggaagccttgatattcatatcaacaacataagctattctttcacaacaatagttgtagctatctactttctcgaccttgatcagctctacaactacaggaactgtagttttctgtgttaaatcttcatcagtgatacctactattgctgctatatgttctcaattgtcagttactcagtttcaaaaacttgttaaatatgcagttcagcaaatatgcagtttagtgtgttcatgagagcagacatttagagtttcagtttagtaaataatgaataatgtgaatttcagttgcgtaatacatggttgttttattttaccag

SEQ ID NO: 30106 - DNA, 118 bp, Sorghum bicolor
  Clone ID: 9849963
accgcgctcaccgcatccgtcgcgctgtgccatggcgtcagcgacgcgctcttccccgtttgtctcggttttactctaattgttatgtacgatgccacgggcgtcaggcgccacgccg

SEQ ID NO: 30107 - DNA, 507 bp, Sorghum bicolor
  Clone ID: 9849978
gatggagtggacattgaccaaggtgtcatggtgctgtgtgatgcagaaggaatcaacccgatacttgaggtattgtgtgagaacagaaatgaggcactgcgccaaagagcggtgtgggcagtggagagaatcctgaggatggacgaaatagcatatgagatatcaggaaaccaaaatgttggtacagccttggtggaggccttcaggcatggtgactataggacaagacaagttgcagagcgagcattgaagcatgtagataagctgcccaatttctctgggatattttctaagatgggggcacaatgacaatgttacatgaaagttgtcgaattctatgacacatggattgcagatccacatgaggcgcagatgaacacatgtagtttggcctgtgttcccagcaggccttcattggttttgctgacctgcactccagatagatggtgtagcaatcttattgatcgaagaattgaagcattgcaacgtgttgtatagtgtatattt

SEQ ID NO: 30108 - DNA, 528 bp, Sorghum bicolor
  Clone ID: 9849986
aatttgttgtttccatatcattttacactgcattgtcttcaatactgttggctatataatttctggtttgtgcagattagctaccaagccggactatacccatctcagtgatgtttatgaatgatggtaagatctatgatgttggacaacttgcccctccgttgtgtgaagataaagctttgctgaaatggggctgaagtgagagacaaataatatttttttacttattactatatttgcttcacaaggcaagaagtgggtatggttgccactggatcgctcagagtaaattccattagaagtaaggttatagtaatgaaatgaaactataaatgggagttgttcatctgcctcatgactcattttgatctcaaacaagtgacctcattttaatctgagacaagtacttgtctgttagtagtagatagtcagtagtagatatatgatgttaatgtattggatccctgaagagccctaattgtccgttgcaagtgcttatcgccttgaagttggacactcgtatttttg

SEQ ID NO: 30109 - DNA, 639 bp, Sorghum bicolor
  Clone ID: 9850027
caggtgcaaattcgccgtcttccaaagcctgttattgctatggttgctggttatgctgttggtggtgggcatgtcttgcatatggtgtgtgacataacaattgcagcagacaatgcgatatttgggcagacagggcccaaggttggaagctttgatgctggttacggatcttcaataatgtcccgattggttggaccgaagagggcccgtgagatgtggtttctgtcgcggttctatacagccgatgaagctgacaaaatgggacttgtgaacattgtggtgccacttgctcaactggagcaagaaactgtcaaatggtgcaggcagatcttaaggaacagccccatggccatccgagtgctcaaatctgcactcaacgctgctgatgatggccatgcaggtcttcaggagcttggcgggaatgccaccctgatattctacggcactgaggaggcaaaggaagggaagaatgcgtacatggagagacgacgcccagatttctccaaattcccacggaaaccttgagtttcgatttggttctgtacatctgtaatggcctagtcaattattttactgaatgttatttttaccaacatggaaataaaaaaaggtgtggtacccaaaacaataagccagaca

SEQ ID NO: 30110 - DNA, 680 bp, Sorghum bicolor
  Clone ID: 9850034
tctttgacactgttgctatgtatgcagtgatgaacaccgtcaagcacacgcggctagggggaatgaatgaacagaagaagtcagagcacgcaggtggtcctcctacaagaatcaatttggattattaagacgcacgcagcgcgttctaagcccatgaccaggcagatcgtgcaagcttgatcatctgggaacctctgagcagccaacacgcggcggcagcgacaccatgccgacatgatgatacggctcttatctgaagaataaatagtgctggggacttgaccatcacctttctgtttgtggaaggactcgatcggtctacaggggtcgaactcggcaaggccatcaggagaggagacgcgcgcactcctgctgatgatgctgtggcggacgtggtggatgatggaggtgacatgcttgattagattggtagctagcaaatctcagaagcacaatgatacagcacaatgcaagagtcgcagttcctctcctcttttcgctgatgttacacttgaagcactgttacatttgtgcctgatttgattaggctctgtgcagttgtctggtgagttctgcaagggcaagaactggtctccttcttttaccggtagactaggttaccggctgtaactagaaatttactagggttctctcagagttaatacatgtatgaaaattta

SEQ ID NO: 30111 - DNA, 115 bp, Sorghum bicolor
  Clone ID: 9850065
atcctggtggtgccacgagaatgcgacttgtcacgcctgtggtagttgcagctgttttgtgtttcacagcttgtcttgttcttttccatccgcatggggtaggggtgcttccagc

SEQ ID NO: 30112 - DNA, 679 bp, Sorghum bicolor
  Clone ID: 9850078
ctactttggtgccacatcaacactatttttctatatacctcgccagcgtggaatttcctatatgttctgataaaatgttaaattattgtttaattcattgcagtagcagccagtggggtttcagccagacaacaaccatgagtcttgcttgtcttgtatgccatggcatgagcagcccctcgaactctcttagaagctactcagtgtcaagttcagaggagggaagccgatgtggagctgctgttgcttgcttagctcgaagagtaacaccagctggaacttctagtgtcgggacatcaaaagtgaccccttttcctcccatggtgagtggtcaagttggcacagagggcactcctcgacttcaacgcagccgtgctgtgtccagggaccttgttagagattggaacttcgatgaagtaattgttgcaaattagagtagccttcaacagttgtcagctggacttgtgctctacttatcagggaggagattccttcatttgatgtaaattttttcatagtaggcgcctgaaagtccatgttactatatatcagtacttaatgacttgatgagaaaaccctcgagagggatggtactttcaggagcaatacttctattgttgccgttctatatgatcgtgtacctctgtagttaggaataaatgttttacagtgtctatta

SEQ ID NO: 30113 - DNA, 136 bp, Sorghum bicolor
  Clone ID: 9850086
aggccaccgtgctcgccgaggtcctctggggcgccacgccgtagcccgtatcggtgtcgtcggcgcgggctcctggcttccccgatgaccgttgacccgcgggtccacgtgccgcgtacgctgtttgctggacttg

SEQ ID NO: 30114 - DNA, 760 bp, Sorghum bicolor
  Clone ID: 9850095
caaccaggggggcagcggcagtggccagcatcagcagcagcaggccggcgcggtggcggcggcggcgtcgacgaagccggcgccgaagctggaggtgccgcggatctacaccacgctgtcccggaaggagaaggaggatgacttcatggccatgaagggcaccaagctgccgcagcgccccaagcggcggcccaagaacgtcgagaagaccatcaatttgatctgccccgggatgtggctgacggatgtgaccaggagcaggtacgaggtgcgcgagaagaagtgccccaagaagcaacagaagaaccgaggcctcaaggggattgagatggagagcagcagcgactccgactgaccgcccgacgacagcctgcgttgccaggccgaagggcggtggcggcagcggcggcggcggcggaagaggaagaagagtcggcgacagtgacgggagacgaggggagcgtgtcaaacagcacgcgctcttagacatgatggtcgcgctgggttcagggaagccaaagaaaaaagaaaggttggattcagagaaaaaaacgaaaaaaaacttttttttgagttaatcatagcggcgccgtgctatttatatagcctcgattccattttgtatatctggcgaggatgtcgtagccggcgtctttgttttatctttttttggtcgacaatcggtggtttgcccgctgcgtttgtggtgggtttgtgcatagcgccggtcaactagactttcccagcaagaggaaacaat

SEQ ID NO: 30115 - DNA, 436 bp, Sorghum bicolor
  Clone ID: 9850128
gcacgaggctcttctccgccacggcagggcaaagggactgaccgacgatacgcgagtacgcgacgacggcgcctattcgcccggtcgaggtcggtccggtcggcccgtggcgtggacctgaagcagcctcctcacaccgccttcgacttcctgtgctccgccttcacccgactcgttcgtcgctcgctccaggcccgcctggcttccccaggcctttgctgctcctgctcgctagctccgtcgctcaggggggcgcctgcgccggcgaggttaggcaggactcaggagtttccccgccgagcgcgcgcgaggctcttcgcaggcgtcccgggaggcggcggcggcggcggcggcgcattcctggataaagttggttgttgtctgctgttttcttctggttggtaggggactccaacctgcctcaagcttcggtggt

SEQ ID NO: 30116 - DNA, 502 bp, Sorghum bicolor
  Clone ID: 9850129
gcacgaggatggtatttagcaagtggtggtgaggattgtgttgtacggatatggcaaatcatagaagtagaagcatctcctaagttgtataggggagaggattcctatgaaaaggtggagaaagttccggtctttaagtcaaatatagaaaagaggcagcaccagacacttgcagttatacccaagaaggtttttcgtatatcagagactccattacatgaattccgcggccatacaaatgatatccttgatatggcatggtccaaatcagattatctcttaacttcatctaaagataagacagtgcgcttatggaaacctggctgtgatggttgtcttgcagttttcaaacacaaagactatgtaacatgtgttcaattcaaccctattgatgagaaatacttcatcagcggttcattagatggtaaagtgcgcatttgggatgtgttggacaagcgagtaacggactgggctgatacacggaatatcataactgctttga

SEQ ID NO: 30117 - DNA, 109 bp, Sorghum bicolor
  Clone ID: 9850134
gcacgagggtgcaacaagcgctacgccgtgcagtccgactggaaggcgcactccaagacctgcggcacccgagagtaccgctgcgactgctgcaccctcttctccatga

SEQ ID NO: 30118 - DNA, 414 bp, Sorghum bicolor
  Clone ID: 9850136
gcacgaggttgatgttgaagcatctgtgagatcagggactactgtatttcaacctggtcttcttgctgaagcacatagaggtgttctttatgttgatgagataaatctattggatgatggcataagcaatctacttttgaatgtcttgacggagggagttaacattgtggaaagagagggcattatctttcgccatccctgcaaaccacttctaattgctacttacaacccagaggaaggatctgtgcgtgaatacttgcttgatcgtattgcaattaatttaagtgctgaccttccaatgagttttgatgaccgtgttgcagcagtggatattgcaacacggtttcaggagtctagcaaagaagttttcaaaatggtggaagaagaaactgaaactgcaaaaactcaccataa

SEQ ID NO: 30119 - DNA, 459 bp, Sorghum bicolor
  Clone ID: 9850152
gcacgaggcccgaacacgcaggagtggcgcatccgcccttactcccggaagcaccagcccgggatcaaggaggtgacggtgcgcgagctggcgtcggccggcgacgcgccgccgtgcgacgtccgttcccccgtgccggcgctggtgctggccatgggcgggctgtcgggcaactactggcacgacttcagcgacatcctgatcccgctctacctccaggcggcgcggttcgacggcgaggtgcagctcgtcgtggagaacatccagccgtggtacgtcggcaagtaccggaccatcctgcgtcgcctgtcgcggcacgacgtcgtggacatggacaaggacgaccgcgtgcggtgcttcccgggcgccgtggtgggcatccggatgcacaaggagttcagcatcgacccggagcgggagccccggggccactccatgccggagttcaccgcgttcctc

SEQ ID NO: 30120 - DNA, 574 bp, Sorghum bicolor
  Clone ID: 9850155
gcacgaggaggaagcatagggagaagctacagagggtactttcagcaatttcagatattccccgcgacgaatgaagagaaacctattctagcaaatcagttctcggcgtttgtttcgcgcccgaatgggaccaagtactccacggtgttgtcagcgccaaccgctgatcttctcaaggaagtcgataaagccagtattggatcttgggactggaagctgaaggaggagaaatgcacctaccatgccctgtttccaagatcatggacagtatatgatggtgagcctgaccctgagatcaagatcaccagccgtcagatatcgcccttcatcccacacaactacagagagagcagcttcccggctgcagttttcacattcacggtacacaactctgggagcacagctgcagatgtgacactgctcttcacctgggcaaattcagttggtgggaaatcagaactgacaggaaaccacgtgaattccaaaatgacggagcaagacggcgtccatggcgttctcctccaccacaggacggcgggagggcaccctccggtgacgttcgcgatcgcatccc

SEQ ID NO: 30121 - DNA, 516 bp, Sorghum bicolor
  Clone ID: 9850157
cagctgcgaggctggtctccgctggagtacgtctctgctgccggccctctcctctccaccctcctctagtccattccaagtcccccaccggccaccaccaccaccaccaccacgccagccagccccacccgagtcttcgactccaagccgccccgccccctgtttctcctcggttccgcgcaccgcgccggcgtcggaggagaggagacgggtcagggcgacgccgatgcaccccaagctgtcgcgggccgcccgcaggctcctctgctgccgcgggaccgcctcctctgaggacctgtctgatgaaagaagtggatcattgaggtgggtgttctcattgagagagcttcgatcagcaacaaacagcttcaattacgataacaagattggagaagggccacttgggagtgtgtattggggacaagtttgggatggttctcagatcgctgtcaagaggttaaagaatgcaaagaatagcacagaagtggaatttgcttcagaagtcgagatattggg

SEQ ID NO: 30122 - DNA, 422 bp, Sorghum bicolor
  Clone ID: 9850174
gcacgagggacgccaccgccaccgccaccgcctctgcctccactgccgccgcctgcgccatgggcgactcctcggtggccggcgcgctcgtgccgtccgtgcccaagccggagcccgcgcggtccggtgacacctccgtggcggccgcggcgaccacggcggcgctggcgctggcgctgccggaggaggcggggacgcgcgcggcgtcggcgtcgccgcaggggccgccggcggaggacgagggccccgccgatagggacctcctctgcccgatctgcatggccctcatcaaggacgccttcctcaccgcctgcggccacagcttctgctacatgtgcatcgtcacgcacctcagcaacaagagcgactgcccctgctgcgggcactacctcaccaaagcccagctctaccccaactttctc

SEQ ID NO: 30123 - DNA, 543 bp, Sorghum bicolor
  Clone ID: 9850181
gcacgagggtagactcgctgaaggcaggcaaagctgctgtatataaagctcgctcacggctcaccgctggtgaccgcacagccagcagctccgtccgcctccgcccgtcggaactcggagaaggcctgcctaccccagctgcccttcctactcccttccctccgccgtcctcctcccgccgccgtctcgcatcgccgccccgcctcgctcccgtcgttcctggccgccggggggcttccttcttctctgtcgctggctacgcgcgtgacgagggagggaggaggagccgtagcgcgtggatccagggccagcggcgtccatcccgcgtgacaagggacaaggagacggttttgtctttgggtagaacatgtcgtgctttgcatgctgcggtgatgaagatacccaagtaccagacaccaggactcaatacccaggacaccatccagcaaggacagatgcataccgccctgctgatcaacctcccaagggtcctcagcctgtgaaaatgcagccaattgcagtccctgctattcctgtagatga

SEQ ID NO: 30124 - DNA, 444 bp, Sorghum bicolor
  Clone ID: 9850183
gcacgaggcgcttgctgcatcatcagcagaggcggctcttcttctcctagtattattggtacgactcgccgcggtggcgctgagatgcggcgaggggctgagcctggctttgtatgacgagagctgcccggaggcggaggcggcggtgacggcggccgtgcggcaggccatggcaaacgaccgcaccgtggcggctgggctcctccgaatgcatttccacgactgcttcgtcaggggctgcgacggctccgttctgctggactcgacgggcaccgtgacggcagagaaggacggcccgcccaacgtctcgctgcacgctttctacgtcatcgacaacgccaagcgggccgtggaggcccagtgccccggggtcgtctcgtgcgccgacatcctcgcgctcgccgcaagagacgccgtcgcgctgtccgggggtccgtcgtgggt

SEQ ID NO: 30125 - DNA, 382 bp, Sorghum bicolor
  Clone ID: 9850186
gcacgagggcgaggttgagccacacacaccgccagatgcgggcgcactagctctagctagtgagactgtgagagtcagagatgtcgccgccgcggcgccacttcctcgtgctcaccttcccgctccagggccacatcgccccggctctccgcctcgccaggcggctgcacgtggccgcgcccgacgcgctcgtcaccttctccaccaccgaggtcgcgcacaggcgcatgttcccggccaagcccgccgccgccgacggcggcgccaacaacgactccgtcgaagacgatgggcgcctcgagttcctccccttctccgacggcatggaggccgggtacgtccggagcaccgacccgggctccttcaacgcctacatggcgtc

SEQ ID NO: 30126 - DNA, 491 bp, Sorghum bicolor
  Clone ID: 9850189
gcacgaggctaacatcgaagcatcctcctccgcccacaccgtagagctcaaattcggccttgccagcgccgccgaactcgccagagagtccagcgccgacccaagcacgtgaagacatcgccgagagggactctctgctcccgctcgtggttgtcgtcgtcatcgaagcttcccgggcctgagaagcgtgatatttctcgtgttctggacttcacctctggcttcccttccatctcccgtccaccccgcgtgatctcgctcgcgcggcaaggcgtacgcgtccagccctcgtgcggcaaggcaactgccgccgtcgtcctaagccaggtgcccaggtttccgtcggtcccttctccaggcccttcctcgcttgccggcgacgagcacccactagactacaattgcatcttgaagaataaaatggaccaacatgattccatggctgactcaccaaggaggcggcacaaccttctgcgtgacaaggtccaact

SEQ ID NO: 30127 - DNA, 534 bp, Sorghum bicolor
  Clone ID: 9850207
gcacgaggctgcgacatcgttgacgcgctcgaggcgtccgtgctctacaaggaggccgccgctgtcgccgggggaccaacgtacatgcggaaactaccgcagaggaatacccggcgagcagccagcggaatcccacgctgggcttcgtcggcggccaccacgccggagagtaagcgacccgggcagacgatctccaagggacacaagaactacgagctcatgctgcagctgcaactgggtatcaggcattccgtgggaaagtcttccgctgttccgatgcgagcactggaacagggcgattttgacccaggggagaagttctggacacggttcccaccagagggttcgaaggtcacactaccacattcaactgcagagttccggtggaaggactactgccccatggtgttcaggcatttgaggaagttgtttgctgttgatacagcggattacatgcttgcgatctgtggcaatgatgctctgagggagctgtcttcacccggaaagagtgggagcttcttttaccttacccaa

SEQ ID NO: 30128 - DNA, 545 bp, Sorghum bicolor
  Clone ID: 9850209
gcacgaggttagttttggcatggtttaaagattgttttgctttctctaactcaaaatgatgtgataactagttgtctgtggaaaactggaatttcatgcttctataggttaatacttaggacattctttttatcgtgtacttggaatttgagtataagttacagtatggttttggacaatttctttgctgcttctgccatgaatgtacaactgtcatattcttgtagttctttacttctcgtccttgatcctttgttttagtatcacagtgttataagttcatctctttgaataaattcctcatctgtgggattgtggttgttgttcatgcatacagtgcatgttactggataagaggacatgatatgtatcactatgttatattttccttcgatgcagaacagctctgggtccttgattcagtccctggacaagtagaaactgataacagtgatggtgaagttgaacgagttttgcaaacactagcaagtcttccttcttcacttccatcacgcaagtgggttgtcgaccacatgctcagtctt

SEQ ID NO: 30129 - DNA, 656 bp, Sorghum bicolor
  Clone ID: 9850235
gcacgaggggaggaacctttaaagagaaattcatctgaaaaggatgtaatagatccctggccagtaggcaacaaggaatcacccagtaatggtattgaagactcctctgaatggcaagcttttgcttctgtgtctggtcaaggaagagattttgtgacatctgtggaacgatcaacaagtggccatggactaaaattggtgagaccagttggagttgaagagacaatgatcaacatctcgcatcaacattcttcagaaattaatcctgttgatctgtggcctgtgggcaatgttgaagcacaaaatgctgcagaaatggttaaggaaacaaataatgacaattggcaagattttactgccactggtcaagtccaggacacttcgttgaatcaaactggggacatgatggaggtcccaaaagccagtcacaaagaaacagacatggactcatggttcattggaaattttggggagccagcaaatactggtaccgtgaatgaaaataacatgttggacgattggcaaggtttcactggttcagatcaagcacagccaaattcatctagcaccggtgcagaaatgacaagtgttccatttgagcagcatgatggaagtgtttctgtccaatcgtgggcaaatgccagcagtaatgatgc

SEQ ID NO: 30130 - DNA, 123 bp, Sorghum bicolor
  Clone ID: 9850239
gcacgaggcttgagcagtatgaggcggaaaaagccgattccgtttacacaaaagttcccaaatgcagatccacttgcactaattttgttaaagcgaatgctaacttttgagccaaaagacagg

SEQ ID NO: 30131 - DNA, 555 bp, Sorghum bicolor
  Clone ID: 9850246
gcacgagggcatgcaagaggtagcagcactgtggcgtgcggtttcatccaataatgtgctctcgccatcattgtcgtttctgtggtggagtattctgtaatggttgttcaaagggtagaagcttgatgcctccaaaatttatgactgcagaacctcagagggtttgtgatgtctgcggagtacgtctagagagtatccaacctcaattgatgaatcagatcagtcgggcctcacaacttccaactcgggatgtcacagacctgagtaccctgaggtcatggctgaatttcccttgggcacacacaatggaatatgagatatacaaggctgcaaattctttacgtagttactgtaaggtgggaggactgaaaccagagaaggctatccctgatactattcttagacaagcaaaaggtcttgctatagttactgtggtgaaggttgggatgatggttacatacaaacttggcactgggctggttgttgctcgaagagtggatggctcctggtcaccgccttcagcaatctccacctgtggtattggatatggggctc

SEQ ID NO: 30132 - DNA, 407 bp, Sorghum bicolor
  Clone ID: 9850249
gcacgagggcatcatcacctacacctcgacgacacacacacgcagccgccaagacaactcgtatgaacagccagcactcaggtgagtgagcgagcgagtcagctgccagccgcagggagccgagtgagctagctgcgagcgactgcgatggaggggggagtgccagaagagaagtgcgccctggtggcggagctggtgcaggtgctggagatggcgaggcagctcgagacgcacatggcggtggtggtccagcagcagcagcagggcggaggcggtgccggaggaggggcggaccagcggtaccgggcgctggtgagcaccatgcgcgcctccatcgacagggccgtgcacatggccgtgtcctgctgcgccgaggggcgtccgggcaccgggcagctgccggagtc

SEQ ID NO: 30133 - DNA, 400 bp, Sorghum bicolor
  Clone ID: 9850259
gcacgaggcaagcaatggcacacgggagccgctcaccagtgggctgccatcgtgtgcctcagttgcgtcaccatgcttgcatgcccactgctgctatgaaggtaataatggcacaagcattgtgggggacctcatatagtggcatgggcatgacattttttcagaagctagcttccttctcatatggatttcatatgcacaaaattaagtatctagagctatagtctctattttttcaactgggcttattagatatttgctttggctttacttgacattcaactagacagatggaaccaaaatcctgtctatacactataagtaagcagttgcaattatattagaatatttccttacgagcagttaaatcactagcctagttttgaagggctattttgaa

SEQ ID NO: 30134 - DNA, 587 bp, Sorghum bicolor
  Clone ID: 9850262
gcacgagggattcaagaatcaaagccagataggaaatgcatatggcactgcagtggtgattgttatgctagttacaacatttctcatgatcccagtgatgctgctggtatggaagagccactggatacttgttgtcatcttccttgtactctccttgacggttgagctcccatacttcacggcctgcataaataaagtggatcaaggtggctgggttccactagtcatcgcaataaccttcttcgtcatcatgtacgtgtggcatttctgcaccgtgaagcgctatgaatttgagatgcacagcaaggtctctatggcttggattctgggactggggccaagccttggccttgtcagggtccctgggataggctttgtgtacacggagctggcaagtggcgtcccgcacatcttctctcatttcatcaccaacctccctgccatccactcagttgttgtcttcgtttgcgtcaagtacctccccgtatatacagtgccagccgaggaacggttcatcatgaagcggattgggccaaagaactaccacatgttccgttgcgtcgcgagatatggatacaaggacatcc

SEQ ID NO: 30135 - DNA, 162 bp, Sorghum bicolor
  Clone ID: 9850272
gcacgagggcggcgatgcggagcagaagcaatggaggtgctcagctccagccgcttcgctagggcactcctcccgagcctcctcgacccggcggcctccaggcccctcagcaagcccccgtgccgccggccccgcggcgccggccataccctagcctgctcc

SEQ ID NO: 30136 - DNA, 526 bp, Sorghum bicolor
  Clone ID: 9850275
gcacgaggcccatgttcatcatagtggaatgcataaaaggctggtatttatacaacatgttaatgagctatatataaaagataattgttgaactaaccctgtattagatccctctgccctgcttctgaattttagtgccgtagggaacttctgattctacttcagttagcctatacttcaaacacttggcatttgattatgaaaaacatatgcttgaacgtttcatcttgggttagatatcattgtgcagcaaaatcatgttttgtatatgatttcatatataaaatttgataacactatttgaagttttggtatgagcttttgttcgagattaaccctattaaatcttgttgtatgcacattgattttatatcttgctcttgtaagcagttcatggggcttccttctgctgctctatgtctttgtacagatatctcgacttatagttgctggtgttttgtaccctttgttgcgtcagtttgggtatgggttggactggaaagaagccatgattcttgtttggtca

SEQ ID NO: 30137 - DNA, 519 bp, Sorghum bicolor
  Clone ID: 9850289
gcacgaggagaagttcaggatggccattatgattcaacatcacagtccactgacagcttgcgtgttgagcctatatatgagtcgttcctatgcccgcttaccaaacaggttatgcaggatcctgtctctattgacagtggtgttacgtttgaacgtgatgccattttgaagtatttcaatgagtgtcttagcagtgggaagaggcttgtctgccctgtaactaagatggagctcagcaacactgagttaaatccaagcatagctctgaggaacactattgatgaatggatgaatcgcaacgaggcagccaaacttgacgttgctcgtaagtcattgacttctgatagcatggaaagtgatatcctacaagcactccagtatgttgatgagatatgtcagagaagtagatccagtaggcaggttgtgagaagagatggattgataatcatgattgctgacttgttgaagaatagcagtacgaaagtacggcaatcagcactagagactcttagctccatt

SEQ ID NO: 30138 - DNA, 571 bp, Sorghum bicolor
  Clone ID: 9850297
ctccagcttgcttcattatgcctttgttttgatagtagttctcaattgatggctttagcttgttagttgggaaaaacaatctgcagttctgcactgtcatttcagcaaaaactatataaagtttggaactgtcatcaatggctttgtcttttgaattgagaaggagctgctgatcaaattaaccatgagtaaaagtttttctacagaaggtactatcacctcattacttatcttaaattagccactttatgtaactgcttccatttttatcgttcttaatttttgaaatggagaaagggagagtcagatcagagggagggaaggacattattttagagggagagcttttttaaaaaaattacttatggctatattattccttgaagcatccaaaatagttgttccagttagatgctttgtgtaaattagattacttaatgagcctgctccaatcaaaatgtgtccctgctattgtttataatatatatggccacttttgtgttgtcatgattttagaacatgtcacttaggtatagttcaaatgagactacagaaaaacctccaaggtgaa

SEQ ID NO: 30139 - DNA, 453 bp, Sorghum bicolor
  Clone ID: 9850334
gcacgaggctctgcgcgcggtcggagttggtttggttgcaggcagcaggcagctgcaaagcgatacgggtagccttgcctagctctcagtctcagccatgggcgacgccgcggagaggaggctggcccgcgtcgccgcccacctcgtcccgtcgtcgtcgttcccggttacgcacgccaccgtgcgtcccctcgcgccctctgccacggcagcgtcgtcgtcgtcctcgccggcgaaggacagctaccggcgcgtgcacggcgacgtgccgtcggagccaccggagtggcgcgccgccacggacgagtcggggaaggagttcgtcgacatcgtctacgagaaggccgtgggagagggcatcgccaagatcaccataaaccggccaaatcgaaggaacgcgttccgtccgctgaccgtgaaggagcttatgcgcgcattcaacgacgctagaga

SEQ ID NO: 30140 - DNA, 463 bp, Sorghum bicolor
  Clone ID: 9850335
gcacgagggagagcgcatgaatgtgttgaatccttatgtaagacaatttctggtggggtggataacagtgttagacagtgttcctgatattgacatgcttggtttccttcctgattttctcgatggtttattcaatatgctgagtgattccagtcatgagataaggcagcaagctgatgcagcactttctgagtttctgcaggagataaagaactcaccaaatgtagattatggtcgtatggctgaaatactcgttcggagagccggctctactgatgaattcactcggttgacgtctatcacatggatcaacgagtttgtgaagcttggtggggaacaacttgttccttactatgcagatatattgggcgctatcttaccgtgcatatctgacgaggaggagaaaatccgagtggttgcacgcgaaacaaatgaggaactccgtgctataaaagctgatcca

SEQ ID NO: 30141 - DNA, 577 bp, Sorghum bicolor
  Clone ID: 9850341
gcacgaggaaaccttcccttgctctgctagtctgctcccatttagagtactttcttgtttcgttccccccgcgtcgcgttcgagttcttgaccctttcccgttcgcgtggaacgaagcgcagaccggacggcgagctcgtggagctgctgtggcaggacggcgctgtcgtggcgcactcacaggcgcaggcgcaccaccaccaccaccaccactaccggcggccgctggtccaggtcgccgccggcaacacgggcgccagcggcgtcaccggggagcaggcgcccgcgctgccgtggctcccgtgcagcggcggtgcgatgggcggggacgtgtactcgcagctctggcagagcatcgcgcaggccgacggccgcgtggtgggcgccgacgccgtggcgggcgcgccccggccgcccgccaggagcgggaacagcggcgtcgggtccagccggacggccgggcaggaggtcggctccagctttagcggcagcaaccttgtcgccgcggcgatgcacctggacgacgacatcgacgacgtcggcgtcgccgccgcgctgcccgtgccgctggacgacc

SEQ ID NO: 30142 - DNA, 531 bp, Sorghum bicolor
  Clone ID: 9850359
gcacgaggcgtccttccatcgcaggttatcgctacccgctctctggctccccccgactcctgcgtcctgcccacgcccacgccgccggcctccaaccgcttgccgagccccgaaccccgagctccctttgacacctgctcccccagcctcgagctccctccctcctaaccgcctctccccactccatgctccctccgatcccctgagatccggcgccgcctccactcccaccgcaggcatccccaagcggcgtcctttggcttcgacgcagtgcagagagccggagaccacctccacccccgctctcagcctccgcgttgcggagaccgcctcgacatgcctgctcccaaccctcggtccgccgttggcactggtgccatccatcgaaccctaaaatcgtggtcaggccgccgatctgataggctacctggtcgtcgccgcgacgctgccgccaccttcgctcctagcttctcacctgtgccatgacgttccctccgggaacgacccgcgcgcgctcggcgcggtcgaagg

SEQ ID NO: 30143 - DNA, 479 bp, Sorghum bicolor
  Clone ID: 9850363
gcacgagggggcggccgacgctgccgtctccctacgccaggtggcgaggtctttcatcttcgagatcttcgccggcgacgagcagccacctggaatgcagtggtggaaatttgatgagtaagagcaacgggtctgatactctgatacgatgtcactgaaacttccaattccgcaagggctttccttcttaagaagtgttggatggtttgaggaccggaaggttgattcatcagccaaacagcagttatccccaacgttgaaactccagacagataaggaggcctacagacctggcgattcagtcactgtgactattgaaatctgtagcccagctagtttgaaggatgatgctgggcagacagtatcgggcgaggataccccctcgctgttgttagatgtgctctcctttgaacttaaggggattgagaagctggatagtcaatggttctctgttccaaagcccttaccagggtctaaac

SEQ ID NO: 30144 - DNA, 486 bp, Sorghum bicolor
  unsure (1)..(486): unsure at all n locations
  Clone ID: 9850369
gcacgaggctcaggtattaaacttgatcccaaaggaaggtgaaggggagtcttttgaggatgctcttgctcgtgtccgtcgctgtcttgggggtggaggtgctacagacaatgctgatagtgatagcgatctggaagtggttactgaatctgttacagtcaaccttcgttgccctaatagtggatccagaatgaggattgctggaaggttcaagccttgtgttcacatgggctgttttgatcttgaaacttttgtggaattgaatcaacgctcacgcaagtggcaatgcccaatatgtttaaagaattactctctcgagaacttgatgatcgatgcttatttcaatcggattacttctttgttgcaaaattgcagtgaagatgttaatgagcttgatgttaaacctgatgggtcttggcgtgtgaagggtgatgccgctaccagagatctatctcantggcatatgcctgatggtactctttgtga

SEQ ID NO: 30145 - DNA, 508 bp, Sorghum bicolor
  Clone ID: 9850382
gcacgagggtggcttaccgcatgaatgtgagggagtaccaggcactcacctcctatgcctccttgctggaggagaactgggggaagccacctgggcacctcaactctgatggcgagaacctccttgtctatgggaagcagtacggcaatgtcttcatcggagtgcagcccacttttgggtatgaaggcgatccgatgcggcttctgttctcaaagtctgccagccctcaccatggctttgcagcatactacacctttgttgagaagatcttccaggccgatgctgttctgcactttggaacacacgggtccctggagttcatgcctggcaagcaggttgggatgagtgatgcttgcttccctgacagcctcattggcaacatccccaacatctactactatgccgcaaacaacccatcagaggctacggtcgccaagcgccggagctatgcaaacaccatcagctacctgacaccaccagctgagaatgccggtctctacaaggggct

SEQ ID NO: 30146 - DNA, 545 bp, Sorghum bicolor
  Clone ID: 9850386
gcacgagggctgtgcggtgggcgagctcgccgccccgattcgccgccggtgatgtccccccccgccacaaccaaccgccgcataggggaggtgatgcatccctccatttgaggtagagggggctatacgtggagactcgctataggtgaggggatgcttccccttcatttgagggagaaagggggctgggtttgaggtagaaaatttaggtataaggtattcaattgaatgattaatctgtgtgagccctctagttttttcggtattggggatgatttgagtaatctgtcggagatgccctatttgtgttcggatctgactacatgcatgataacttcagagtttgtgaaaaatattgggtttacatccatgtcctgtactgggtccgccactaggattgagaaatgacaagttggtccttgcttctgatctggcaggggagcttccccttttctcaaatttgtaatgcttaggctttgctgcctttttttcttcttgatcaaaaaagttgtttcttaaacatatccatgctttcgttcattgtg

SEQ ID NO: 30147 - DNA, 597 bp, Sorghum bicolor
  Clone ID: 9850390
gcacgagggttgcttccacaggttgtggaggcaccagttactgtcgcaaaaatgcatatgttgcttcccacgggttggatagatgcatctgtgggagtggttcaggtggcatatgttgcttccacaggttgtggaggcatcagttactgtcgtggaaactggagattggagagggattggtgggctttgtggggaagagtgttgtggtggtgcattaggaaaatgatgtagggaattggagagttcagagctatggaggagtatttaaggctgtgctcagtggaaggctacctgccattattccacagttgtggggtgtcccatttttaggtgaggagatggggttccttggttagatagtctatttatttcaatttattatatctgtagttatctatcttccattcttttgctcatgatgcccctacttctttcttgttggaaaatttatgtgatttaaaaaaaatatgtagccagttattatgcatctgtgcagagatattcaccaaatatgtaataactatttactttatcaaaaaaaaatctttactagattaaataacagtggtgttatattttaacttgataagggttcaa

SEQ ID NO: 30148 - DNA, 456 bp, Sorghum bicolor
  Clone ID: 9850393
gcacgaggcctccttcccttcccttcccttcccttccctcgcagacacgacacgcagctcgcgtggcagcactgcgtttgcagcgcgcgcgccgccctgcttctcttgttctcctaccgctcgcgatcacccggcccgctaagctgcgcgctcgcgcgacatggccgccgccacgccgccggtgacgtcgccgccgggtccacggaaggaggacgcgcgcccgcggcttcccaacggatacgttatgatcgtggtccccaacgacggccgcgacttgcccgcctcctctcctccgcatgacggctacgacggcccagacaaggaggatgaggaggaggagccgcgggcgacgtcctcgctgtggcgacccgcggtgctggcgctggcggcgctcgcggcagtggcggcgggctacgtctgcctgcagtacgcgggcggggacgccgccggcgcggc

SEQ ID NO: 30149 - DNA, 371 bp, Sorghum bicolor
  Clone ID: 9850394
gcacgaggcgcgcatcggggccggtgcgttgcgcgacgacgcagccgccgctctcgcgcgccgtgtccgagtgctccgcctgcgcccgcatcgtcgtcgagcgccacctccacacgcaccccttcttcccccttctcccctcactccatccgcttcccctagtcacccccgacctcgccaccgccgtcgatcccgccccctccccatcacccggcgacgaagatgacgaggacccttttctccccgcgggcttcgtctccgctttctcggctttctccctcgagcgccaccccgtcctcgcccgctccgcctccaccttctccggcctcctcgccgagctcgagcgcgcgctcgccgtcgactccgccgcc

SEQ ID NO: 30150 - DNA, 535 bp, Sorghum bicolor
  Clone ID: 9850398
gcacgagggaatgataccaaggcttgggaagttgatactttaaggggccacatgaataatgtgtcttgtgtgatgttccatgcgaagcaagacatcattgtgtccaactcagaagacaaaagcattcgcatttgggatgccacaaagagaactggtattcagacatttagacgggagcatgaccgtttctggattcttgctgctcaccctgaaatgaaccttcttgctgctggtcatgacagtggcatgattgtgttcaaattagagagggaacgcccggccttctgtgttagtggtgacactgttttctatgtgaaggatcggtttctccggttctttgaatacactagccataaggaagttcaagtggctccaataagaagacctggatcagtcagcttgaaccagtcacccaggacgctgtcctacagcccaactgagaatgctgtcttgatttgctctgatgctgacgggggttcatatgaactctacattgttcccaaagattctgctggcagatctgattacttgcaag

SEQ ID NO: 30151 - DNA, 505 bp, Sorghum bicolor
  Clone ID: 9850403
gcacgaggccgaaaccctagaagcgctccgccgagctccaggctcccgagctcgccgcttctcgcgaagagaaagccgaggccgagacaagctatacctcagcggctcagccatggatctggagatcgttgggcggcacgccttactgttcgacgacgacgcgacggcggaggtcgtcaactccggcggctcccttgtcccctgggcggccgtcggcgcggcagagctcctcctcgaccgccacgacgtgcgccacctccttgatcgcgtgccccctcgcccgcgccgcgcctactcagtggccctcctctccgcgccctcccccgacggcatctctgagaccgagctcgatcgcgagcgctacctggacctcccggctggcgacggcgaatacgagggttctggagatgcgcccccctcaggaaatggcacagatactggacaggctgattataatgctgttcctttctcatatggatattctgctggttcagatgaaccaaat

SEQ ID NO: 30152 - DNA, 505 bp, Sorghum bicolor
  Clone ID: 9850404
gcacgaggtccgctcctctctgttgtgtcctcgccgtcagatttcgcaagaaccttcgttccctgcgatctctcgtcggtttggtcggccgagatggttgatctgtagagcgagacgccgagcccggagagagagagaggaaggagtgcaccggcaattgtagaaaccagcaccggcggaggatttgaggacgccgattcgatgcgcggctccgcggacgccgtcgcggttgctcgggacgtggcctcgtcgagcccgtcgaagcccccgtcggcattggacatgatgagatacccgaggccgagctcagacggcctcccgctgcccaatggcatcggcagcggcgtgagcaagaagcctgcagcggcggcggctccggctccaccggcacccggatcgagcaaggatgacgtggcgccgccgaccgtcgccaccgacagctcccgcctcgcggcgttccttgccacgacgtcgctcgagtccaagccgcgccctcgcgtgccgg

SEQ ID NO: 30153 - DNA, 346 bp, Sorghum bicolor
  Clone ID: 9850429
gcacgagggccaagcgagcgagcaggtccgccgtccgccgatcggccatgagcgtcaagcagacaccgtcgtcgtccacggcggccgccttctacgcgacgctggcgcgcggcctcgacgacctggaccgggcgctggcggcggcgtcctcgtcctcgtcggcgttcctgtcgctgcccacgctccgcgccgcgctggcgctgctccacgccgcgcacgcgggcctggcgcgcctcgtcgcgtcgctccaccttccggggggcgccgactggctggacgagtacatggacgaggcgtcgcgcctctgcgacgcgtgccgcgcgctgcggctcggcgccgtcgtcgt

SEQ ID NO: 30154 - DNA, 194 bp, Sorghum bicolor
  Clone ID: 9850442
gcacgaggcatccaccacttccgccgacgggctcgcctccaggctcctcctccgctgatcaccgcgcctgctgcgccgcctcagagtgtcccgcgcgccgcacgcggcactcgcgtcgtcgtcgggccgcggcctcccgaccctcgtccgccactcgctcggtcaccgagcccggatggggcacaccgccgccg

SEQ ID NO: 30155 - DNA, 491 bp, Sorghum bicolor
  Clone ID: 9850446
gcacgaggcattgatgatggcgttttcaatggcacgtcgtgcagctgcagtgccacttcttttagttaatggcacctataagtcaactgttagcacataccttgattctgctattctccaacatcagctacagaggctaaatgagcacaattcactgaaaggaggacattcaaatcacaggtcaacattagaggtcccaatattctggttcatacataatgaacccctattactggacaaacattatcaagccaaggctctctcaaatatggttgtagtagttcagtcagatgatgattcctgggaaagccatttgcagtgcaatggaagacccatcttatgggatttgaggaaaccagttaaagctgctattgctgcaactgctgagtatgtatctggtctacttcctccacatttggtttatagccatgctcatgaaactgcaattgaggactggacctggtctgtgggttgtaatccctcagctgtta

SEQ ID NO: 30156 - DNA, 109 bp, Sorghum bicolor
  Clone ID: 9850456
gcacgaggctgtcctttcccggcggcggcaccacggagcggcaccgatgctccacctgcgcgccaacccgctcgccgccattccggtgtacttctccacgtagccggcg

SEQ ID NO: 30157 - DNA, 255 bp, Sorghum bicolor
  Clone ID: 9850458
gcacgaggctggggaagaagaagaagaagaagaagaagaagaagaagaataagaagagtggggaggagggaaagaatataaacaatttgcgccaataaggttgctggtgtgcgtgcgggaaagggccccacaaatttggtatatagattattgttacctgccatttatcattcaaccccttcaatcatgtggatgagtgtcttttttaagaagtgaagttaaggtgtatgttttttgtattttctcttgatctct

SEQ ID NO: 30158 - DNA, 573 bp, Sorghum bicolor
  Clone ID: 9850470
gcacgaggccgtgtgttgccttgtccagctttttttttttcataaactgatgccttgctgccatgccgccatggtcgtggctgtcgtgctggctagccatggtcatggctttctgtcagtagaatattggatgtcggctaggtacctcacgctgttggtgcttcacgctgcctgcaacccgatgttccggcagattgcccgtcactgttgggggctcggcgggcgatgacggatcgccggggagaggtggtgccatgatggggcggcggcggagttgaacaggtctgggcgatggaagagtcacagttgaaacgccgatgtacaggagagagaacacgtcgatcttttttttaaactgaaacgtagatctgtgaagggcagtatcattaactgaaaatacatgtattttaaattaccaaacttgattaaaaaggcccgaaatgtcattagagcttataaacaacgtttggagtcctatttggaacaaaacaatgttaggagttttattatagagaaacctgttgtttggagtcctataataaccattttctcgcttggcttaacttgcaactg

SEQ ID NO: 30159 - DNA, 557 bp, Sorghum bicolor
  Clone ID: 9850483
gcacgaggggcccgtctccgcatcgagggatcccccgcatcgagcgtctccccaccgccccaggagctccccgccgccggcaccatcaccgcctccaaggcctccccgacgcccgtgccacctccccgaggggcctccccgactccaagccgtcgccgcgccgcgccgccgccgcaccgacgggctctccgccgcccgcaatgtcgccgccccaaggggctcctcggcgcccgtgccgctctgccctgaggggctcgtcaacgcccgcgctgctgccctgaccggctcctcgacgtccgcgtggccctaggggtccgccactgccctcaggtgtactctctctctctctctctctctctctctctctctctctccctctcccaacctccctctcaaatctgctgtgtttttagttttctgaagggatctattttcacaattgcataaaactgatgagatctatgttttgatttagatttagaactagcaaactgcgtgaaatcttaatgttaattaatttgttgtattaacgatgcagctaatgcacgtattggtgg

SEQ ID NO: 30160 - DNA, 587 bp, Sorghum bicolor
  Clone ID: 9850495
ttcttctgttagcactgaaccaaaaaaaaatgaaaataagacactggatttaggttgtccaggtatgaatttacttaaaataagtccagaggcaaataatgcgtgtcctttgacaaagcagataaaatcagaaaatgactcacagctgaaggaaccatgcgtgaagaatgaattatcatgtccaaccagcaatggtaccagccgacaacataatggagggattgtaggccacaaagttgcagcaccaagcttgatggttccttctggtcaatcacttcctgcaaatgctgtgacaaaacccttaattacttcaggtgaatctatgagaagtacgcatgtcttggcagtattgaaagagagtagagaaacctcttcccaaactggagactgtacatcttcacttacaattagggagtatcataacaggccactgtcaatgattgataatggagttaacatgaagccagatctggaaaacttagacaattctcataggttgatggcatcatcagacttcaatgcaactctatgtcattcttacaaggatcaaacattcttaacaccggaaactaatacctcagtgatga

SEQ ID NO: 30161 - DNA, 550 bp, Sorghum bicolor
  Clone ID: 9850520
gcacgaggcttggagttaaaatcaagcattcaagatttcattatttgcatagagatgggcattgcttcagttgttcacctctatgtgttcccagccaagccctatgcactcttaactaatcagtcacctggaaacatttctgtacttggggactacgtatcatctgaccctgtggacccttttgaaattaaggaaagcaaccggcctaccaaaatgaagcttcctcaattcgaaccagatgagagaagcgtgacaaacataaaagaaagtgttcgggactttgttgttggcagtggagaatatgtgatcaaggatttcaagttcactgttaaccaagcagtgcggccagtggagaagcgctttgataaattgatgaaaaagaatgataagcgtaagaaaagccaggatgacaactgggtgagtgcagcaacaccagagagacctgttcgtgggattgatgatccattgttaagcggaagctcaagtgacagtggtgtcacaaagggcaagaaacatcgcagaattgtgagcacagctgctgctgtggaca

SEQ ID NO: 30162 - DNA, 521 bp, Sorghum bicolor
  Clone ID: 9850528
gcacgagggtttccatgaacttcctgacaggagcaataccatcttctggttcacttatcaatttcaatgagacatcctttgttgggaaccttggtttatgtgggaagcagataaactcggtgtgcaaagatgcacttcaatcaccatcaaatggtctgcagtcaccttccccagatgacatgattaataaaaggaatgggaattctaccagacttgttataagtgcagtggcaacagtgggagctctcctattggtggctttaatgtgtttctggggttgctttctttacaaaaattttggaaagaaagatatgcgtggtttcagagtggagctttgtggaggctcttctgtcgtaatgttccatggggacctcccttactcctcaaaagacatcctcaagaagctagagactatggatgaagaaaatatcattggagcacgaggcttcggaactgtttataaacttgcaatggatgatggcaatgtctttgccttgaaaagaatagtgaaaacaaatgaa

SEQ ID NO: 30163 - DNA, 507 bp, Sorghum bicolor
  Clone ID: 9850532
gcacgaggagccactgatgaccagcctggtcgaggactacggggaagtagttggccatgacgtgctcatctcccgctgctgatcggacgacgatttcatagagagtgatccagttttctggattttccttgccatcgtattttttaagttttttgagcttgaaattgcggggccacatgacctggcggaggtgtggggagaattgtcttaggcccggggggccgtgtgttgcatcgtactcaatacggcgcaggttttcgtggactgctctttctgtagcacgcctgttgatgcggtcccggtcgtctttgggagggatgttgtgctgaagatccctgtgttggtttacttcctgaccgcgtctgcggttctgctcacggtgaccgtcagtgtcccgaccaccatcgtcgcgccgtgaatcttttcgatggttgtcgggagagcggctacggcgacgcctgctgggaggtggtgaggtccggctacgattagtctggtcggaggtgg

SEQ ID NO: 30164 - DNA, 402 bp, Sorghum bicolor
  Clone ID: 9850578
gcacgaggcttccaagcgagtggttgccgccgtggtgaaggagagggctgcagacggactgaagggaaagggcgatgtggtcaaggtggatcagctacgagtggagagatcaaaagcggtggttgtcgaggcgccaagagagactaccgctgccgtggttcaagctgtagcggagtccccttctcgcagcaccgagtatttgatctcaccgtcgccaaacaggcggcttaggagaactatcacgtcttggctcaagggacagcatctcggcagtggatcttttgggtcagtgtacgaggcaatcagcgatgatggctttttctttgctgtcaaggaagtatcattaatggaccaaggactcaatgcaaaacaacgcattctgcagcttgaacatgagatatc

SEQ ID NO: 30165 - DNA, 534 bp, Sorghum bicolor
  Clone ID: 9850602
gcacgagggcagaacgcgccggttcctgcatttgctaggccacaagtccacaactgctacgccatgaccagcctcgcccactaacttgcttcgccgcctcacaaaaaagcgaagtgaaacaatcgccaatgtcctttccaggcagaatcatcacttgtggctgcgagctagagtctgcttactgcatatagaatcggacatggtgcagcaccgcggcagaacagcgagcatgctggaggtgccggtgccggtgccggggagcctcccgctgtgcacctaccgcgattcgatccgtagagtctctgtcgtctccggcggcctgtgcgggtcggtgcagctgttcttccccgtgagctgcgacactgaggcgggagatggagcctactgctggtcgagcgcgagctccgcctccagtccgtgtccgtccttggatgcatgggcccgttgctcgcccgtgtcctcgtccttctccggctgctgggaggctgaagacccagatgcagtcatggagctccgcgccatcgcgcagcagat

SEQ ID NO: 30166 - DNA, 587 bp, Sorghum bicolor
  Clone ID: 9850611
gcacgaggctcttggctactgtcatcagacttcagtactcaagtactactagtaggctagcagcgcggcgcaggttgcgtagctgcgggagtccctcttcccgcgggagcggtcgctgaagtaagcaagcggataggatcgagagagggaggccggaggagcagggccgccttctcagtttctcacttgcgccccctctccgcttcctcctccgctccgcttcgtgcagaacctgaaccgccatttcttcttggcttcctgaaaagaagagcttttcaattgatttttcaggaattgaaattttgaatatttgcgctgttggggatatgacaagttgctaattttctcggagggatggctaagtttggagacgtgctctgtgcatttaccctacttgtgttgctcccctgctcggatgttgcattggggcagactactgacccttctgaggtcgatgggctcagggctatcaagggaagattagttgatcctatgaacaaccttgagaattggaataggggagatccgtgccagtcaaattggacaggagtcttctgccacaaagtgaatgatgatgcatttcttca

SEQ ID NO: 30167 - DNA, 290 bp, Sorghum bicolor
  Clone ID: 9850612
gcacgaggcccgtacctgccccgccccccgacgcaaccgcgtccgaccaccgccgccgaaaccctacacgccacgccccgcgcctcgccgcgccatggcggatccgccgcccgtggccgcctccgcctcgccggcgcagcccgaccagctcgcggccacggcggcctccgtgtacaccccgcagaaccccaaccctaaccccctcctctccccgcaaatacccccgtgcccgaccgtcttcgacctctacgcgcacatctcgtccccgcagcagctggaccaggcggccg

SEQ ID NO: 30168 - DNA, 352 bp, Sorghum bicolor
  Clone ID: 9850628
ggggccgcgttcgcgtcggcgctgtcccgcgcgcagcagcgcgccgcggcggaggccggcaggtccgtggccgcgcccggcggcgccggggtgatgatgcacgagttccggcgcgcgcgggcggcggtggaggacgccaaggacgccgtcgagcgcggcggcgacgtggcggcggcggccgcggaggtgggcctgcgcgcgggcgcgctccgcgccgcgtgcgaggacgtgctggcgctcatcgacgacctgttcgacgaggtggtggaggccaggaagaagctgctggacctctgcagcggcggcaactgtccgactcaccggcgcacgcacacgacgatgacgatgtgag

SEQ ID NO: 30169 - DNA, 372 bp, Sorghum bicolor
  Clone ID: 9850654
ttttgaagagaatccaagggaccttgatttgctcaagcacgataagttgctaagcaacaaggaaattcctgcacacctgcgtgatgtccctgactacctaattgatccgaaaacaaaagaggcgagcaatgttgtcaaactttccagggctgctatgggtatcgacaagccccaaaggcggaaaagacaggggttcaagggaggatcagggaaaagcagagaccctcttaagactttctctgctgagggcaaacgacggagacggaggaaagatagagagggagaaccaggtagaacaaagaagagtaggaaggccgaaagttgattttagtttgcaaggagctcgatgctttattgttttaagccacatga

SEQ ID NO: 30170 - DNA, 597 bp, Sorghum bicolor
  Clone ID: 9850701
acaatgtgtgatcatggaatattagctgtattaacagtgaactgtagtttgtagtgttaggactattgggcaagtggacatgtggaaagtatcaatgggagactgatgtacacatgagaatcatgtttcttgttacagacaaattcaagtcaaaaaagacagatcattgtcttcatacaataataagccctaggcagacaggaatcttgcttagatgtaaagctatctaactaaccttgtttcctagccctaattaattggcttatgtctcttgtgttgctgtgttggaggcatcaggatagtgtgcttttaacatcttgttttgaatatataacatatagaggaagtgcaattctaaaatagcatttctgagctctcacattatattgaagaatttgatcgttacatctttatatgcagcatcttggatcaagtcaaacttcagacttctcatccttcaggcttgaacagtttccaagttttgactcttgtgggttgttgcagtgtcggtataataaaaaagagattggttcggttatgaaattacaaaaccataattttagcattcttaagaaaccaggctgtttagagcatatg

SEQ ID NO: 30171 - DNA, 503 bp, Sorghum bicolor
  Clone ID: 9850719
catgatccagagcttcatagaagcttacctcgacgcctcttgggagccagtgatgtcttgcttgtactatgacatacctcggggcttcctgaagcttggcggaaggctggataaattcgaatgtgagttccacaaaacttacaccatgcaaaggcaatggaaggttccaaaccctgaacttaggaagagattgcgcaaagctgtgattgagaaagtcattccaggtttcagcaagtacttggcggagcgaacgacaaaggcgaagagcaataggccacccaagaacactgcccttgaattggaggagctattggaagagctattcgaaggatgatcgctggtgttttaatcacggaccaaggggaagagcaataggccacccaagacttgtacattttattatgatttactctatttaaaaaaaaacagtccactgaatataatcaccagttggcattggcaaagcgaaaacgaattgtttttggggaagccagtgacaaaat

SEQ ID NO: 30172 - DNA, 623 bp, Sorghum bicolor
  Clone ID: 9850734
aatccagaagtaatattacagaagactaaaatatttttttctaacattttacggctgctgcgatctggcttagctagctactggatgactgaaatatggtaaggactacaaatcctttgcaattttcctctgaggtgtaaatggtagataagaaatgttaacaactattagaactagtaagagttgaagtatgagaactatcagaatatgagcctgtttgccatttaccttgtttatagactatccttcgtgatacttaggagtttcaatttgtctgttttattcaacttgtggcatccatttggcaattttaaaccctttttggcatgctaggttggtgatttgtgaagactaaagttgggccacaatgtttcatactaacatttagcatattcttctgtaggacacatggaagactaaagttgcatatctactgatggagggtaatccgaacttcagcagtagaaaatattttacttgatagaaaagagtacaggaaacccatgtagtatacttaactttgtaatcgcaacttagtatgttagttgttagcatgttatgttaccttgtgtggtgaaggtgaacaatgaatttgtaatgagaagcagtatatgcagtgtact

SEQ ID NO: 30173 - DNA, 321 bp, Sorghum bicolor
  Clone ID: 9850747
tagcagatgcccacatgatttcaattcagaacatcattttctccaagtgaaatcaaataagaagaggtagagaatatgacactatatattggatattggctgcagtagtatacagattggtcgcacgagctatagcatgaaaggcggatgacaaagagaagcaatcttattcaatggcctgtgcaaatcgatgatgctctattgtgattgctcttcaatttttttcaaagcaagcagttgggatgtgcggtggcgacctcgctcaagtagctctagcccgacgttcgactgagatgataggaggaatctccgatcatcagc

SEQ ID NO: 30174 - DNA, 418 bp, Sorghum bicolor
  Clone ID: 9850771
acctcttgtggagagaatcgagaagactgtggaggaaggagagaagaccatcgtcagggaggtgaaggagattgaggaggaggttgaggagctggagaaggaggaggcatcattgtttcaaaagctggcagaaggtctcatggaggtgaaacaggatttgatgaacttcttgcaggggctgagcaaggaggagatggagctgttggatcagctgaacatggaagcgactgaagttgagaaagtcttcagccgtgcactgccattgaggaagctaaggtagctccagcagcaaaagacttggagaaaacaagccatcaagtaatgaccgaaatagattctatttgccacagcagtacctacagtgacagattgttgcagacagaaaacatttgaattcttttttcattttcatttcttt

SEQ ID NO: 30175 - DNA, 448 bp, Sorghum bicolor
  Clone ID: 9850788
accagggtctccagccagcgatgattctcttgtcagcatctaagccacagaactaatcatcatcctagcggatccatgggtgtgattccagtgtacatagagagaacttaagaaacacgtagcaaggtgcacgctgacataatgcgctaactattcgttggcacgccatcgtccagctgtgcccgaagtactgacatggttgggcttgttcagaggccagaacagctgcagatggaagcagctgtatagggggctatatagaagtcatgtgattttgattgggataattatctcaattgcttgtaagtagatgatagtaataaatagagagatatagagttactggagcagctcgacaaacatttactcatatatggacaattgggcattgattgcacttccgcccaaatagattaagtatgattagcaagggaactcacattttatg

SEQ ID NO: 30176 - DNA, 350 bp, Sorghum bicolor
  Clone ID: 9850821
ctcatccttagtttagtgtctactaacaaaataagaaacggaaatggcgtcatcccttttcaaccaaacagaaggtagaaacatcccatctttaaaaactggaatgagaccatcccaacctacttgattcccaaaccaaacgttacctaaaagcaaaactgaagtgcttgttttgcatggcttacatttattttgtccatgttttcttttgtgagtgttgaacatattgatactatgatctgttactgcaactcgttcctttttgagaaccctttctgaaaaaaaataaatcgattggaaggtttgggaggtaaagctatggaagatggatgcatccacaggaaagaaag

SEQ ID NO: 30177 - DNA, 369 bp, Sorghum bicolor
  Clone ID: 9850833
tgctcggtggggcagggcccgacgaggaggccgcgctgcggcgctacggccgcaccatcggcgtcctgtacgagctcgtcgacgacgtccggagcgcgtcgggcaacggaaagatgaggaggaacgccagcgtcctgcgctccctggggatggaccgcgcgctgggcattgtggaggagctcaaggctcaggccaagacagaggctgacaggttcggggacaagtatggcgatcgggtgctgcccttgtacagcttcgtggactacgcggtggagagagggtttgagctccagggtgcagcggcaacttcatagagtggacgattgcagttgctactgaacattggaggcttggagctagcgagatgta

SEQ ID NO: 30178 - DNA, 407 bp, Sorghum bicolor
  Clone ID: 9850835
gacgacgacgacgacgacgacgacaagctccctggcggtggaaggcgcgtcgtcgacacgcacctggtggagtgcggcggccagctgctcctcgtctcggtgcacgacgacgtcgtgtacaactcggacgacgacgtcgtcggcatggcgggcctcgccgtggacgacggcggcaacaagggcggcgacgcgcgtgcggtggaggctcacagggtggagtggctcggggatggggcggtgcggctggtgcgcgtggtggacatcggcttgaacaatctgttcctggggaggaaccgcgcgttcgcgctctccggcgcggagttcccctgctgccgcgccaactgcatcttcctcgtcgaccggcagggccagccggacggggtcgtcagggtgctgggcatggagag

SEQ ID NO: 30179 - DNA, 335 bp, Sorghum bicolor
  Clone ID: 9850876
gcacgaggcccaattccggaagcgaataaacgccactagattccggccgaagtccctactccagcgccggcgtcacccccgaaccctgcggcttcgttcgcgccatcggagctggtttgtctagaggggctctgttggtgttcatcttgtataggggacggtggggggtgtcagagttgccggcgttttattttggtccttttcatccggtgagctggagctttctcgcaaattactcgccgcggcagccgacttggactgcatgggcttgctatctctggttcaattggcccagcttgcgctctgagtgactgatcccccaaaactgcgccggt

SEQ ID NO: 30180 - DNA, 552 bp, Sorghum bicolor
  Clone ID: 9850884
gcacgaggctacatactgagagatagattatttagggaccactgaagatgctcttacacatgtttatttgatgggagggtagaacatcgcattttatgaccatagcccaccatcaatctcacgtccctactgaaattttctaggctctactcgtttagtgggtacggaaatattcccttttgagagccatcttatctctcatcatctacaccagccaatataaaaaataggctaagattatcatctgtctcatcccatcaactaatcattgagctacgcatgatgtttgcctcttggctatatcttgtagttaccattaggagacttattagggtataatcctgatgggacgactagaaaattcttctagaattgtcaaaaagccataaatttagttgactctaatcgccattgacaataatacatgaagtcttaacattaatcattagaaactattttgaagcctctagaacaatcctcatgagatgtgggaaaaagatatatattgtatttaaattcctaagaaaagacataaacatcctaccatcaatt

SEQ ID NO: 30181 - DNA, 556 bp, Sorghum bicolor
  Clone ID: 9850894
gcacgaggaatcctcccaaattctccatcgccatggctctctcctccctcttcatcaccctccccgtccccaaggtcccttcctccaactcccgccgcttgctcaccgcccgggcgtcctccgccgccgctcccgccgcctctgcttccttcgacctgcgccgctactggacctctctgatcgccgatgtggagtccgaactcgacgccgcgatgcccatgcagcctccggagagcatccactccgccatgcgctacgcggtgctcccgggcgccggcaaggagggcgccgccaagcgggcgccccccgtgctgtgcgtcgccgcgtgcgagctcctcgggggcccgcgcgcggccgcgctcccggccgccgcggcgctggagatgctccacgcggcgtcgctcgtgcacgacgacctgccctgcttcgacgcagccccgacgcggcgcgggcgcccgtccacgcacgcggcgtacggcaccgacatggccgtcctcgcgggggacgctctcttcccgctcgcctacacccacgtgatctcccacaccccgtcccc

SEQ ID NO: 30182 - DNA, 440 bp, Sorghum bicolor
  Clone ID: 9850896
gcacgagggttaggggtcaaccagtttgttcgtcagctatcctctccctctcctcggcgccctcatccgggcatggcgtgcggcggcaggggcggcacggggtggtcctcgctgccggcggacctgctgctcaccgtattcgccctcctcccctccgacgtcgaccgcatccgcttccgcgccgtctgcgcgggctggggcgccgccgcggccgcgtggcgcccgcgcccctggctcgtcggatccgtcaccgaccgctccggccgggccgccggcgccatgtcgtcgttctggctctcccccggcggcggcctcctgcccttcgccgccaacgtgccaccggggctggactacctctcctcgtgctcccacggctacctcgcgctctccgaccccaggattagccccaaggccatcctcctcctcaaccccttgaccgg

SEQ ID NO: 30183 - DNA, 512 bp, Sorghum bicolor
  Clone ID: 9850906
gcacgaggcataaaaatattgactgctttttcagcgggactacagcggtggcagtgatcaagcaggggcgcaatcttataattggcaatttgggggattcaagggctgtcttaggcaccagagatgaaaataacgagcttgttgcagttcaattgacagttgatctcaaacctaacattccaagtgaagcacagagaatcagacaacgcaggggcagaatatttgcacttcctgaggagccggaggttgctcgtgtttggcttccaaagtataactcgcctggattggccatggctagggcatttggagacttctgtctgaaagatcatggtgtaatttctatgcctgatgtttcctatcaccacattacagaaaaagatgaatttgttgtgctggctactgatggggtttgggacgtgctatcaaatgatgaagttgttagtactgtcagccaagccacatctcgggcctctgcagcacgatttctagtcgaaacagctcaccgtgcttgg

SEQ ID NO: 30184 - DNA, 665 bp, Sorghum bicolor
  Clone ID: 9850921
ctaacacctcagttcagcatgaacgaagtagcaattacgtggaggaccctgcagacctttccttttaccacatggtttgtggtctgtggtgacatgcttctcatggttaatctcacatttgcttctgttccatcacttgggagctcgcttagctttggcgggtccgatgttgacatgaggttttttaaggtcttccgccttgacttctcagtgaagccagccaagtgggtacagatggagaagttggaaaactatgcgctgtttcttagcctggataggaggaaccctgcattttcttgcgtgaaccctgagagatggggaggaaagagtaactgtgtttacgttgccaagctatttaatgatgctgatcctgaagagacttggactgcgctggaggttggtcagtcagtgccgcaccaccacatagttgacctcatgatgtatagtaggcattcccaccggactacagtcagattggtagcctttggcttttccccagtctggtttatggcgccagccagtgatcgtgtaagccttgcagggtattggctagttttgcacaggcaatggcgattgctgtttttgtagtttcagttagcaaggtcgatgtaaacaatttcttgagttggaccagcgttatgtgttcaaaatacttttgatgtgta

SEQ ID NO: 30185 - DNA, 106 bp, Sorghum bicolor
  Clone ID: 9850957
gcgtggcatccatgctccatgttataaaggaagaccagtgcaagcgcaccaaggagaatgcagttccggtgctcttctcagtctgtatgtacggccgcaccaaact

SEQ ID NO: 30186 - DNA, 543 bp, Sorghum bicolor
  unsure (1)..(543): unsure at all n locations
  Clone ID: 9850960
ggctangactccaagaccacccacatcatgcccttctgagcaagcgaagcggacgagaatggcttgccggaatccttcctgggctagctgatcaaatggattcgatgaatcgattaaattgcaggcgatggtgttcttgttcctgtgatgtttcttgatatttttttccattttcttttgatgtaagtcgatagagaaacaaagaacaattggttcatggtggaggggagaagaataataatctgtacagttcatgggtagagtttttgacatgatcagaacaggcacaggggacaacttaaccaaagaattgattttttaggccaaagcaattggaagcgtttgattattcctcctgaaagatttgcgaattttcagagaaatgatgatcgacaggagatgtggaatgataaggttgttactggaagcaataatgcttgttgctgctcacatcaaaacttacgaagaagctgaacgacgacgatcacatcaaatgatttcatttcgaatcattggtctgcacttgtggtaatgcgtacgtag

SEQ ID NO: 30187 - DNA, 205 bp, Sorghum bicolor
  Clone ID: 9850979
aagaacaagggaaggcagaattccactgaaacatctggaggctaaactcatctacgtccaggatgaagttatagctccgaacaagacctggattgttcattaatgcttggattgcctgagcaccataagaacgtgttgaaatcagcagcgatgttttctcgtgaagattcagctggcatttaccatgaagttttggaggaacgtg

SEQ ID NO: 30188 - DNA, 519 bp, Sorghum bicolor
  Clone ID: 9850989
aacccgtagaactgcagcacatcttctccagaagctcttatactatttccccccacaggataaggatttgagcagctatttggttggcgataaatcaattctaggtgatgctggagtgcattccatggaagatgtggaagctcttccaccacctccagagatgaaggtaccggatctgaaattcaagggtgatgttagctacttcatctgcagcaggcttggggctggtccaaaggtcattgccgacgaaagtcaagcattgatcgattcagtcaccggacttccaaaaggggtgtaatttcagattagattaaaataagggtttaagccagagattaaagaaaatgttaaatacaagcaatgctagattgctaggctgggaaatggactaacagatttcacgaagatacattaggcttgtgtattggttggtttcgtgcttagagctggacatatcctactccaatttgtaagacagtatattgtcatgtattatacatttgcgtctggtgttccgtt

SEQ ID NO: 30189 - DNA, 613 bp, Sorghum bicolor
  unsure (1)..(613): unsure at all n locations
  Clone ID: 9851008
tggtgcagatactttcagtcttcatgtctcttgatctctccaacaacgacttccagggtatcatccccaacaacattggcaacttgaagtttctcaaggggctcaacctgtccaggaactccttcaccggcgggatccctccccggatcgccaacatgctgcagctggagtcacttgatctctccagcaatcagctctctggggagataccacctgcaatggcactgatgtcattcctcgaggtgctcaacctttcctacaatcatctgtcagggatgataccacagtccagccagttcttgacgttcccggtgacatcatttctggggaacgacgagctgtgtgggaagcctctgctacgcatgtgtgctaaccacacaccatctgctgctcctacaccgggctcttctaaagagctgaattgggaatttttttcgattgaggcaggggtcgtttccggcttgatcatcgtgtttacgaccacgctgctgtggggcaacgggaggaggtggctatactggcaggtggacaagtttctgccagatgttctgcagccaggatnccgcggccgtcgccactgaaatgaattgttagtgtttgcataccgtaatga

SEQ ID NO: 30190 - DNA, 666 bp, Sorghum bicolor
  unsure (1)..(666): unsure at all n locations
  Clone ID: 9851009
ctcagcatataaaaatgagtgcacctgtacagactgggatgccaaaaacaactgaaagtagaagaagtcgtagatctagtagtcgagatggagcaagcaagcaaaatctgagagaaaacgagctgaccagaactaagaggagaccccgagcaaagcatcagctctccattggtccctcctattcggcggagcagatgcactcaagaggctacgtggagcgtcccttgaactatttggttgcaacatcaagcacctggatacacccacacatttgtgtcacaagcgcgagcaaacagctaaaagacctccttgagcttgagaatctgaactcgcttgctcatatccagcacactggcaaaaaccagcatgtccaggaagatatccaagagaacaaaagcgatgaatccattgcctctgctcaaactcgaagcggtggtttcccgatgataaacgggtggctgataaatcagggagtgcgtgctgcaattgtggtgatagcttgcggggctatgttcttcaacaacagatgaaaatctttgtgtgaagcagtgccgctgccattaatttatcctttttactgcaaatttcggacgatggtcagattttgcatacaaactcacattattacgttagctatataattgtaaagttttgagtgcagattcn

SEQ ID NO: 30191 - DNA, 582 bp, Sorghum bicolor
  Clone ID: 9851020
ctccgacgccgggctcggcatggccatgttcagtctgggtctgttcatggcgctgcagccacggatcatcgcgtgcggtaacaaggtggccacgttcgccatggccgtgcggttcctcaccggccccgccgtcatggccgccgcctccctggccgtcggcctccgcggcacgctcctccacgtcgccatcgtccaggccgcgctgccgcagggcattgtccccttcgtcttcgccaaggagtacggcgtgcaccctgacatcctcagcacggcagtgatcttcggcatgctcatcgcgctgcccatcacgctggtgtactacatcctgatggggctgtgaaaaaggccagacaagctgttggttctcgcccggccaggcacagctcacagctcgctcagcgatgccggatgcatggatggagcgggcacgaggggacaagagaactgcagcgaacgtacgtgcaggggagcaggcctgaggaggttaatttgtaggagtattagttcttaggtgtagagaatcatgcatgggaggcgattggggagagcaaacaaaatgtttaggacaagagtttggaggaa

SEQ ID NO: 30192 - DNA, 518 bp, Sorghum bicolor
  Clone ID: 9851027
ttgcccttgattacgagcaggagcagcctttgttgcccttgattacgagcaggagcagactgcttacaacaaaggttgttttcttgttttggaagttcatccaatcttaaggttatttcaaatttagtctaataaagaatggactagatgttgtagtctcacaggcttttaaactgttgcttatgccatctgctgagcttgttttctgtggctggtaatatccttcgttcctctttcgtttgcctttcgcagtggttattttcttccactttgtattttgaatattatatattaagtgctcgacagttgaacaagtaaaaaaaactaaatctgtactaatcatggatagttgatgatatgtctgccggagatggaggtggtgttgctggtcttattgctaccgtcaacgtatccgagatttctgatatctgcatgaccgttatagccagaaatcgaagagccttcctcccttttgcttagcacagtctcttggaaaagaagcaagggcatatacaaac

SEQ ID NO: 30193 - DNA, 529 bp, Sorghum bicolor
  Clone ID: 9851035
tcaattctttcgggcggcactgaaaatcgccgccgagatcgactcagatccacaggcttggctgtccccgaggacgaacctcgcgcatgcgtaccgtcgcctgcgtctctggaaggatgcacatatagagtttgacgaggtgctgcgccagggcggcaaggatgccgctattttttgcgccaaggcgctcatctacctggaagaggggcgtcctgagaaggcgatcgtaccgctgcatgaggcactcgccatcaatccacaggacggcactgccacggagttgttaaacaaggcactcgaggagacatcgacgattgactttgcagatggagacgagctggaggcctttgagcaggagcttgagttgggcaaggccgccgctagagagcaagtgtcgaacaagctgccgaagctgcggcgagacgtcaaaggcaaggccaaagctagcaggccacgggtacttgtggacgaagacgagaagggaggaagcatgatggagatgactgacgacgattagcccgcggaaaca

SEQ ID NO: 30194 - DNA, 575 bp, Sorghum bicolor
  Clone ID: 9851049
taggagcacactagaagttgtcataccaaacagtgctgttgcaagcctcaccatgagagctggtagcaagcttgctcaaataagcgagatctctggtgctactgtaacgctagctgaagacagacctgacatcttggagaaagttgttcgaatatctggtacccctgagcaggctagcaaagctgagaatttgcttcagggatttattcttagcattccagatgacattccttcggcctagttgaagacactctgcatgtcatagttaattcttaaaagttcctgtgtattttcgaggtagaatatgccgagtcatgtgattatttgtttaattgagcagcatgttttcatgtgtggagacatgccattttctttctagatgtgactctaaaatgtctgttgtttttgttaactgtggctgacgggggtgtaagattagcaagtgtttttatagattgattcaacattcaattttcatgtccatagatgaccgcagaacatgaaacctccaactttgtagttaaataattatcaaatttggtcattagctgtgaacacagtatgaacggcaggaa

SEQ ID NO: 30195 - DNA, 632 bp, Sorghum bicolor
  Clone ID: 9851054
tttgactgtcgacggaaagccctcttgttggcttgcaattgcatgattgattggcgatttcaggccaactgtcgaagcgaggtgcaacggaggagtaatcgctatcagtttgatggtggtaaagtgaagtgttacttctagtgctctcctgcaagcaagtgccacggctcaaatggcaggcagccaggcactgctgcttttccaatgagttctgaaattacaggcacgtcagtttgtctgctgcggcatccaattttggtcagacctgaaccaggtgatcgttagcattctgcttcttcgtttacacatgaacaggttccactaggtgactggctgagtactgcagagcaatagagtgatgggttggcttgttttttctttttctttttttgaaaaggcaatagagtgatggttgaatcagtggatcaatgacagggatcacggcaaaaaagaaaagacaaggctagtggaaaccgagtgcagacgggccgaaaatgtggatctcagatgcttgggaacgggaagcccactccatagaaaccgaggcctagacaacctttttgggctaggatcttatgtgagtgaggccaaatttgccaccccatattggaaatccattttgtctctataaa

SEQ ID NO: 30196 - DNA, 473 bp, Sorghum bicolor
  Clone ID: 9851069
ttcctctccttgagacaaattctgatgtgtgtacactcaaagagaaattggaagatgaatatcttgagataccagaagacagtgtgaagcgtgtttttgcaggacttatactccgcgaaataaaggacttttggcgggtggcactgcttttatccattatctcctacccagaagctgaaaatgctgctgacaccctcaacaagcaggatgaactgcatcagaggaaagagacatacatcatagttgagcatttcatcactgacctagatcttgatggggtgtggaagttgaagccggtactcgacgggaagtctattatgggagttatgcaggtcaaaggaggtccactgataggaaaatggtttggtgagtggtgaagcaaaacccatctggtgcacactctgcattattgcacttcgtttcagggagaattcggactagctttctttggcatcaatacatctcgatgtttc

SEQ ID NO: 30197 - DNA, 623 bp, Sorghum bicolor
  Clone ID: 9851071
tatgacttgaggcaaactgggtttattgaacgtgaagaggttaagcaaatggtaattgctattttgatggaatctgatgtgaaattatcagatgacctacttgaggccattatagacaagacatttgaagatgctgatgccgataaggatggaaaaataaatcaagaagagtggaaggaatttgtgttacgccaccctaacctgttgaagaacatgacactgccttatctgagggacgtcacaaccgttttccctagtttcgtcttcaacacagcagtggaagattaagcagtattgggattgcttgagctgcacagggttcctgaaccttgatgactgttggctgtcaattatgtcaacgtgcggcattcaaccactgagaagcagatgcaatccatcatgagaacttggtggtgataaaaatatcaccactgatggctgaacatcaaggctacctgagcatcactcctgcaataaattaaggctcgtacgggatggtggatcggcaacgaattataatttatggttgccgtttttgtccggcaatacattgagttggtaattaactgtaaatacagctagtatatcactcagtagacagaaaatcaggaacgtgtacatac

SEQ ID NO: 30198 - DNA, 585 bp, Sorghum bicolor
  Clone ID: 9851139
cctggtgcatcaaacaatgccatgcttcggcttcatatggaactgaagggtccattccctaagaagatgcttcgaaagggtgcctttacaatgcaacacttcgatcaagatctcaattttcatgctaccgaggaggatcctgtgacaaaaacggctgtgagaaggttaattttgaacattaagccaaaggatgttggttctttgatttcaaactctcctggcgaggatccaaaaatgctatccagttttaaagatcttcttgagaaaatatttatcttagatccagaaaagaggataaccgtatcacaagcacttagccatccatttatcactggcaagtgacataagatgctgattcctcttgacattgaacttagcatctacactgtaaaatacaatttgggttcctcttgtctaatcatcgacgtttctgtcttgtgtcctgtgagctctgagaacaagtacatggatgaagcatggaactatggaagagatggatatctgcagaccttgttgcatgcacttatcatttggatatattctgttgcttgtaagacaactggccagttggcattccattacctg

SEQ ID NO: 30199 - DNA, 181 bp, Sorghum bicolor
  Clone ID: 9851169
tccgcatcgtgggcaacatggtagaccagtgtagcgacctcaccggcgcgccggagggcgcccgcaccttcaaggtgcccgaccccatgtattacgttggctgaataatgcgagtatatatgccacgtactccaagctccaataacaggcatcatgcaggtatatgtcatgtgaggccgat

SEQ ID NO: 30200 - DNA, 439 bp, Sorghum bicolor
  Clone ID: 9851212
gcacgagggcctcctgttgatagccgtggttgcagccattgtgttctgctttgtgtgttctgggaggacagggaggaggaatgatcagaggggaagtggggcatcaccaagtgcgccatcgggagtgtcagccaccggcacagctgcagctactggtggctcacagccttctgcattgtccgcaaacacggcgaaagtcggtgattcatttgcttacgaccaacttgccaatgccacctcgggatttggggaagagaggctcatcaagcacggtcactcaggtgatctataccatggtgttctccaagacgggactgccgtggtggtgaagaggatcacttcgcgtgtggctcggaaggatgcatatctggcagaattagatttgtttacgaaaggattgcatgaaaggctggttcctttcctggggcactgccttgat

SEQ ID NO: 30201 - DNA, 539 bp, Sorghum bicolor
  Clone ID: 9851224
gcacgaggctgggaccttcccttcatggatatttcatatcaaaagcttgacagttctggaagtatcacaaaatgagaatctatgtggagagttaccggagttcatagagggtagctctttgcaggagttgagttttagtggaaccaagctttctgggaaaataccagattctatggctaacctccgaaatttgactgcattggacctttcttattgccaattcaatggcagcatcccacactttgctcaatggccgatgattcaatcaattgacctgtcaggtaacaacttcattggctcattaccttcagatggatacagtggtctgcacagcctaacaagattagatcttagtaacaactcgataagtggagtgatacctgcatctttgttttcccacccttctttggagtatttagatctctcacaaaacaatctcactggaaatttaatattatatcaaaatatatcttgtaatttggaatcgattgatcttagtaataacagactgcaaggaccaatcccaaaattactgtcgg

SEQ ID NO: 30202 - DNA, 582 bp, Sorghum bicolor
  unsure (1)..(582): unsure at all n locations
  Clone ID: 9851225
gcacgaggccatgggcaaactgtattcactcaatccatgggcaaactgtcttccctggatctgcagggcatcatttcagaaacagatgtatcacccacgcccaccgactcaggcagcacgcaggcaggcaaaacagtcatcccttttgatgatcataaagcttcaaattacaggtcagggaaaactgtttcgtctcagcatataaaaatgagtgaacctgtacaaactgggatgccgaaaacaactgaaagcagaagaagctgtagatctgaaactggtgtatcacccacacccaccgacgactcangcagcacacaggcaggcagaacagtcatctcttttgatgatcataaaggttcaaattacaggtcaggaaaaaccgtttcgtctcagcatctaaaaacgagtgaacctgtacaaactgggatgccaaaaacaactgaaagcaggagctgtagttctgaaaccggtgtatcacccacacccaccgactcatgcagcacgcaggctgcagtcatcccttttgatgatcataaagcttcaaattacatgtcaggggaaaccgtttcgtctcagcatata

SEQ ID NO: 30203 - DNA, 582 bp, Sorghum bicolor
  Clone ID: 9851226
gcacgaggcatggctctagggcgcggagaacgtgaatcgagtcgcggggaggaagaggacgtccgcgtccggatccagaacagagagggctcgagtgcgcggagtgatttgtggcgcaaggaaggaaagagacgccgcaggtggagactttcctaaacttgcgaccaggagcgtcagtcgcaggcagaagaggcagatggaagaaccaaacttttttttcaccaaaagatgtgtctttttagttgtaggagatttatacccgtgtttttcaaccagggtaaaacgtagcaacagtaaagcatgacaatatggaataaaataaaaaaaatattggaaatacatttagcacaatcgtccctgacatcatacattacaaccttcgggattgtcagcaaaatatggacagaaggggatgatttcataatttccagtagaaattgttttgatgctttgtcaaaatgcacgatgggctccagaattgtgttcctctggtcgacatgataaaaaaggtatacagaacgtttaattaggagtctaggtcaagaaaagatgactttgggaaaattattatccgataaaaac

SEQ ID NO: 30204 - DNA, 207 bp, Sorghum bicolor
  Clone ID: 9851237
cggcaagatacacgtgacggtgcgccgctccaacgcgtcccggtcggacatctactcccggcggtccatggggttctccagcaccacgccgcggcccatctacctgaccaacgccgagatctactcgctgcagtcgttgcggaacccgacgccgcgggggtccagcttcaaccacaccgacttctactccatggtggggcgcagctc

SEQ ID NO: 30205 - DNA, 579 bp, Sorghum bicolor
  Clone ID: 9851244
gcacgaggcctttatctgttctcctgaactgggctccgggacagccccttggccccagacaaggaccaaagcatagcttcctcctgagcaagagtcaaagctgtggccagatttggggtggctccattgaagactgctcctgttgactccgtgttgagcttgattgatctcaaaaaaggcttactgatattacatgattactctatgtgctgtgtttcgctatcatcacacaagatcttctgtttgtcttactcctcaggattattctatgtggtacgcttcatagtatcttggttatgattctctattttccctgttcctcagataaaacatctagggatatcagacaatgaaacatgacgcaagggtagatgctactcgcaaaaactcagcttgtgctttatgcttgttgtctgcagcatgttagcacttagcagctcacttacctgctgctgtgaactgcacttgatccttgctgagttttagtccatagaaaaccatggatacaatactgggattcgaattcgaatttcagtgcatcaaaaagagtggattggtgactataatctatcggttaga

SEQ ID NO: 30206 - DNA, 476 bp, Sorghum bicolor
  unsure (1)..(476): unsure at all n locations
  Clone ID: 9851252
gcacgagggccaaacagnacctggtcgcccgcatgtctcctgccggtatctcgctgcgcattgcctcgttaagcagtcaagattcgacgaagcagtggccctcctcggcgaaaggaacccgacccacctcatcaacaatgcgagcaacaagcggaagatgaacacggcacccctgggacgagcggtgggccacagggggaggatggctcgcgacgaagcagccgaggacgaggctacaaacagaaagtacgaagccgccatgtgctacctgcggggcatatgctacgccaagcagaacgccttcgaccgggctaaagagtgctacaaggacgctgtccggatcgacgtccagtgtttcgaggcgttccagcagctcatgacgaacgccctgctgtcgcccgacgaggagtgggcgtttctcgagtctctcgactttgatgcaatcacggtatcgggagacgtttcgtcgtcgcagg

SEQ ID NO: 30207 - DNA, 159 bp, Sorghum bicolor
  Clone ID: 9851261
gcacgagggaggggatgggtctagggtttacactgttgtggttgtggagactggtgatgcagagggtatgagggttgtcgttgggaagcaccggcatgcttgggtggttggaaaggctgatgaggttaaggctgtcacagttattggcaaggtatttgc

SEQ ID NO: 30208 - DNA, 510 bp, Sorghum bicolor
  Clone ID: 9851262
gcacgaggagaaaatggtgtggttactcttatgcagtcccactatgttgaaaagattctaagtcgctttggctacagtgactgtaaacccgtgtccactccctatgatccaagtctaatcctgagaaagaacaaaaggatcatgagagaccaattgaggtactcccaaataattggctcactaatgtacctagctagtgcaacaagacctgacatctcgtacgctgtgagcaagctgagccagtttgtatcaaacccgggagatgatcattggcgtgctcttgagagagtaatgcggtatctaaaggcaaccgcaagctatggcatacactataccgggtacccaaaggtactggagggtttcagtgatgcaaattggatatctgatgctgatgagttaaaagccaccactgggtatgtgtttacccttgcgggtggtgctgttttctagaagtcttgcaagcagaccatcatcacgaggtcaactatggaagcagaacttgcagcacta

SEQ ID NO: 30209 - DNA, 376 bp, Sorghum bicolor
  Clone ID: 9851266
gcacgagggcctcatctccctccctccctccgccgggttccccgacctttgtaaaccctaatcaagttcgcaccaaatcggtcgcacctcagctcaaaatccgaaacgattcgaacaatcagaacgaagaacgattcagcttcagctcctgaatccaacagcaatggatcgctcccgctccaagcgcggctaccactacgaccaggactccccgcctccccgctccaagcagcgcttcgaccgccgcagcggcggcggcggcggcggtcagaatgctaactcgagctaccaccgccgcggcccccccagcggcggcggtggctccgaccgccgcgcgttcctgcctcccgacgccgcgccgcccccgcccccgccg

SEQ ID NO: 30210 - DNA, 520 bp, Sorghum bicolor
  Clone ID: 9851271
gcacgaggctcttcaggaaatgtctgctctatagctgctttcattgctgcatcttgatctgttatgatggttgttggatgctttccacccattgcttcaatgaatgattcaaagacccatttgaaagtatcaatggtttcatcacagatgaatgcacaaccaaagaaacagttttccccagtcgaagtttcattatcgagacctgcaagctgcaattcaagtatgaagaagataagtatctttttggttttcttatttagctagtttgatgatttctttatgattgacttacctcttcatcttgttcttgtccatcataatcccagttgatgtagtcatttgatttttcgaagttgagtccatgtacctgttgatgattattgtgtagttgtaagttcaaatggatttctattttatgcaaaggtggttaaattttataatctatatgaatcataagtgtaaataagattatttatcatgtgtacctctgtgttcatgtcccccaatagtagagatgtat

SEQ ID NO: 30211 - DNA, 505 bp, Sorghum bicolor
  Clone ID: 9851285
gcacgaggggatgtctcacttccagtgagaaagcaaggaactttccagaatctgtggatcaagctaatgaaatctcgaaggcacttcctatgagtcagaacaatattgcgccagtaattgctcaagcagactgtggagtagagatcagctctggtggtattatgcaggttgctgtggctgcttcatgcaatggaactacagcgaaaaaggtgaatgtgaagtcgtcgaagaagcttgtgaggtaccctgttgtgaacatgtggttagggtccagacaactgttgttcacttcgcgaaagccagggaagaaagcgaaacataagagaagtagaactgtaagacgtgttgtaggttgcaaggacgcagcaaatgtatcttgtttgaatgagcagctgacatcaacatcggccactgcacgctctgaaactgtagaatgtacctccagccgtcagaaacgatcacatgctagtgcaaggtccaaagatgacacccagtcctccaaaaa

SEQ ID NO: 30212 - DNA, 435 bp, Sorghum bicolor
  Clone ID: 9851286
gcacgaggggacacggaagtacagatggaaggaggatctccaggccgacctcgccgcgggcatcaccgttggagtcatgcttgtgccccaggcaatgtcatacgcaaagctttctggtctgcacccaatttatgggctttacacaggctttgtcccattatttgtatatgcaatatttggctcgtcacgacaactagcagtaggtccagtggcacttgtttctctgcttgtatccaatgttcttgggggtatagttaatccatctagtgagctgtacacagaattagccatattactggcactcatggttgggatcttggagtgcttgatgggattgctaaggcttggttggcttattcgtttcattagccattctgtaatatctgggttcactacagcttcagccattgttattggtttatcccagataaagta

SEQ ID NO: 30213 - DNA, 559 bp, Sorghum bicolor
  Clone ID: 9851291
gcacgagggttcttgaagacagtgctgctcttgacctcttcaccaaaaagtatttaaagaggccataaatctcgatgagtatcccacattgattgaagaggccaaaatgatcctaaagaagtgcaagggacttccccttgcaatagtaaccataggtggcttcttggcaaagcagccgaagactcctattgtatggagaaaaatgaatgagcatattagtgctgagctggagatgaacccagagcttgggataataagagctatcctcatgaaaagctatgatggtttaccatatcatctgaagtcttgtttcttgtatatgtccatctttccagaagattacagtattagccgaagacgcttggtgcatcgatggaaagcagagggttactcaagtgaggtacgaggcaagtctaagggggaaatagctgatgcctacttcatggaacttattgagcgaagcatggtcctaccatccaaagaatcaattggtagtagaaagggtatttcctcttgcaaacttcacgatctcatgcgtgaaatcagcatctcaaaagca

SEQ ID NO: 30214 - DNA, 459 bp, Sorghum bicolor
  Clone ID: 9851330
gcacgaggctcctctccgtcgcccgcagccgggcgccaccgtctccgccgcgccacccgccatcctggtccggattcgttccagcaggctcccacaccgctccttgcttcgcttcacaagctcaagcaaacgatctaggctgacaattcctcaccatttggtcctagagccgcctgagatgtaccacgcgatgcggctgcgctgcctcctcctgcgccctccgatgtggagcaattcaagctctctcggcatctccgctaccggcgtcagtggaggttccttcgtcaggaggttcagcgcgctcggcgcgccgcggccgcccggccctgcccgacggctgtgccggttttacggctccaagggcggcgtcgggagcgccgaggcgaggggcgccgctgcggcctcggcggcggcggggagcagcggcaggtgcttcgagcaggagcacgcgcggctcgg

SEQ ID NO: 30215 - DNA, 443 bp, Sorghum bicolor
  Clone ID: 9851347
gcacgagggccgccgcaggcatcgtgtcgtgctgatacgaacgcctcccgaccccggcggattcgactctgttctagcctccgaggtctgtgctactcgatctccccccgatccccaacaagctccatcagccaccgcttccgtcagcggcgccccagccggccgccctgcgctccgtcgccgatccgccgcgccacgggccgattcgcggtccgtccgtccatcgagcgccgccggataggcaatcgcggccctgcgacgccctcatggacgccagatcggtcccggggcctccacagcggccgaccccgtcggcgcccctccccgccggttgctcctgcctgcccaagacctcgtcgacgagcctgaccaagtccttcacggcggtgcacgacttcagggtgagcgactactcgctgttggagggcatggggttcggtagg

SEQ ID NO: 30216 - DNA, 111 bp, Sorghum bicolor
  Clone ID: 9851363
atcatggaggtcagcctatggctatggtgtgctactcgatgggggcaatcaactcccttgtcgagaagatcactccactaattgtataaacatcccatgaccgagcacttg

SEQ ID NO: 30217 - DNA, 514 bp, Sorghum bicolor
  Clone ID: 9851369
gcacgagggcttcatgaaatcattgttctcatcaactcattccaggacttccttgcttttagtggcacctgccactcttggcgtgcagcagtctcttccttcccccctgtgtatgctttcagcttcccacctctgcatctcgaaccagatggtccttatgtccctccacatagcaaatgtttcaagtccctcgatttgtctaattgcaaatggaagctcagtgaccttaccaagaaaaacttatcccttcattgttcagtgcctcaaaacactccaaatgaaatggactatctgggttgctcacatgggtatcttatctttacgtatgaggagcactgcctacttgtcgatgcatacactggtgccaaggtgatgccccccaaactcccatgcaacaacaaacttggttactctggcattggcatcctgacggctccattcagttcacccaactctcgcctcctcctgttctcatgggtctccatgtttgagtggcaggttggaacaacctcct

SEQ ID NO: 30218 - DNA, 535 bp, Sorghum bicolor
  Clone ID: 9851375
gcacgaggtccacctccgccaccgcggggtcgtcgtcgacgagtacctgccccatgtccgccgccagggccgcgagatcctcttcagcaaccgacgccggcggctctacaccaacagcaagtcacgagatccctacagctacgagtacaagtcatggagctacatcgacttcgaccacccgacgacgttcgacacgctggccatggacggggccaagaagagggacatcatggacgacctcgacacgttccggaacagcagggacttctaccggcgcgccggcaagccgtggaagcgcgggtacctgctgtacgggccgccgggcacgggcaagtccaccatggtggccgccatggccaactacctcgactacgacatctacgacgtggagctgacggtggtgcacaccaacagcgacctccgcaggctgctcatcgagacgaccagcaagtccatcatcgtcatcgaggacatcgactgcaccctcgacgtcaccggcgaccgcgccagcagcagcaagccgcggcggcgagag

SEQ ID NO: 30219 - DNA, 589 bp, Sorghum bicolor
  Clone ID: 9851394
gcacgaggcttccccgttcgcttctccctttgacaccccctcgcttcgttctgcgtagtttcggggtttggcatcgcctgtctatcccgttcatatagcctttagggtttcgagctcgacctccacgccggcgtctcagcacctgtgtctagtgctatctttggctgagctcgagtgagccaaggtttggaagtcaaccttttgaacctgttgcctccctttgccagaactattgaatgtgaaagcacagttaagtaatgccacatccagagaatccaaaaggtattgttgatataaaaagttgctaagcgccatggaactttcggcagagtaaattgtatgcctttatgaaataactgaagtagatgtgttggcatgcaattgtttgattcaagaaatgatatattatacaaaatcacaagatgggaattagtgagaaacaatgattgtatgaaagcaattaaggcaaatacaaaacctcttcatcttgtgttggcaggctatgattatataattctttactgttctctacacttctcacatacaaagtgctgatgtctcaatggagctaaatcagtcccagatcatg

SEQ ID NO: 30220 - DNA, 294 bp, Sorghum bicolor
  Clone ID: 9851402
aagaatggttaagcgctggaaaccggacatgcccgcagactcaacaagtcctttcaaatacaattatcatcccgaaccaccttgcgagaagcatgatctcacagtggtgcacagataatgggatcactctgccaccagttgagaaccaagatgaagatctggttacaaacaatgagcgaaagacatttagtaaaatatttgagaggatcgcatcggcgtcaaacctatctgagcagagggaagccatcaaagatctcaggctgctgacaaagtgcaacagttcactaatagcag

SEQ ID NO: 30221 - DNA, 507 bp, Sorghum bicolor
  Clone ID: 9851562
ttaggcaagattctatgcatctgcgatctgaagcaagtaaactacagtctttgaggcaagaattggctgcaaaggttcaaggtctattgaaagagcttgaacatcagaaatctgaaagccagaaaatgactgctatggtagctgaacgtgatgctctctatcaagaattgctccaggctagggcgaaccttgagttcgagaagaaggcaaagccagagctaactgcacaggttcaggcaatggagaaggatcttgtagctatggctcaggaggctgagaagctgagggctgacattgcgaagagaaacacacctagcagtttcagcacccgtggaacttatggagcctctttgtcaactcctgcgatgggtttgcaaggcatgtatgatggcagctatcctacggttgggagccgctatggcagtggcactggggcttggagctcgcatgatccccatggttacccgcatctttaattgtacctgatgaaccagtgttatacccctg

SEQ ID NO: 30222 - DNA, 433 bp, Sorghum bicolor
  Clone ID: 9851579
gcacgaggccatcaaacagctacctgaacccgcagaggcggccggcgcgcgcacgcagatttttagtttagttttagtttcttctccagctctcctccggcgacggcggaactgtctctgcagcagcaggcgcagggagggatgactctgaggctgctcaccaccacagagcgcaaccatcttctctccccgaagccacagagcccccgggatgccgccctgtcgctgctgaggtcacccaggctgtcctgcggtggtactggtagccccaagcccaagagcgccaagatggcgcacggcggcctggagcgctcgctcagcttcaagaactgggaggcgtcaacggaggcggcggcggccagccggggcggcggcggcatcaacggcacgcgcccgggcaccctggccctgcagcagcagcagcagcagagcc

SEQ ID NO: 30223 - DNA, 492 bp, Sorghum bicolor
  Clone ID: 9851588
gcacgagcaaggcgtgcccatgccgatggaagcacctctcgccaagcccgccttcgccgctgtgccgatggaggtgccgccgcacaagggcatggctatgtccgtgccgatgccggtgaaggcggcgcccgccaaggccggggtgatggccatggacatggacctcatcgagggacacgaagaagaggggatggttggtgccggcgtcaaggtggccaaggaaaaggtgaaggagatggttatgagcggcggcggcggctgggaggtggttggtatctccggcatgggcggcagcggcaagaccacgctcgccatggagatcttcagggatcacaaggtccgagcctacttcaatgataggatcttctttgagacgatctcacaatctgcaaatttggagacaatcaagatgaagctgtgggagcagataagcggcaacctcgtgcttggtgcatacaaccagatcccagaatggcagctcaagttaggacc

SEQ ID NO: 30224 - DNA, 556 bp, Sorghum bicolor
  Clone ID: 9851599
gcacgagggaagatgtatataaggatgtgcagttcatatgggataactgtaccaagtacaacagtaaaggcgattacataattgagcttatgaaacgggtcaagaagggcttcatgaaatattggttggccgctggcttgtattctgatgtgccagacagtggtggtaatgacaatactggtgatgaggatgccaaaggccactcaaaaagcaaggctaagaacaaaaggcgacgcccagggaacgatcgccacaaaagtgactgcatatgtgctgtttgtcaagttacaaggcgcaagaaagaaagggatgaaatattggctattatagacaatgagactgctgcaatggatagtaacacttctgagcagcatgacatggagggaaactctggtggtaataatcttggtaatcatgacacttgctctagccaggagcaaccgtcacaaacttatgtgtacaaagagacatcagaagcaaacgattctgggattcggatggaagatgctggaaagttctccactgatcagacacctagtttgctgctccctgacta

SEQ ID NO: 30225 - DNA, 445 bp, Sorghum bicolor
  Clone ID: 9851634
ttcggccgaggcgcctccgtccccaccctccgcctccaatccccaccaaaaccacccgcgccgtcaatcgcaaccagcggcgcttccatcgccggcgccaccagcgagccgcggttgttgctcggccgattgattgatcgatcgatcgattgattgatccaccgcggcaagggcgggtggggagggagccgtcgtcggtggcggccgcgcgcaccgacggtttcctggcggttgcatgtatgcgggcggggagagccggcccaatggtgcgggcgggggtggaggtggagacgcgctccggcggcggaggcagcccggcccgtcggccgcctctcccggcgcggccgccgcgtcttcttcttcgtcgtccggcagaggacccgaggaggaggaaggggaggtgcttggacgagggcagcagaagcaggcgcggcgcaagaagaag

SEQ ID NO: 30226 - DNA, 634 bp, Sorghum bicolor
  Clone ID: 9851663
agaaaagaagattataattgcattcagcatagttgatcacataaagaggttgttttattctgagcaaggggctaattcaaggagagatgacccagaggtcaagagcttaattgaggagattgagaaaatgagggaatcgtttgaatctatagaaaggccaacactaagcatagaatctgagcaagcgaagccactacctgttgatggatccaaactgagtccttcacctcttcaggcaccttctaccccgaaagctgcacacgtcgactcaccgaaatcccccatgaaacccgagcagcatttcgattcagatgcggagcttgcaaccctgggatcagagctcgggaaagaggacaaagagtattcaggtgaggagatcagcgggtgggagtttgacgagctcgaagaggacctcaagagctgacaccatgaatcgacaaacagaacacggttcgattcggtttgcttcactgacatgtattatttgtctgagccttgcgtggacaagaaatgcacactggttgatgtgtgtgtacatagtgctgtttgattgtactgttgcactctccgagttgtcactgtttttagagatatgcggactgagctggtgtaacctgggcaaggcatttgctat

SEQ ID NO: 30227 - DNA, 475 bp, Sorghum bicolor
  Clone ID: 9851672
tgtgggtggtgcgcccggacttcacccccggcctcagcaaggcgtggctccacgagttccagcagcgcgtcgctggcaagggcatgatcgtcagctggtgctcacaacaacaggttctggctcaccgcgcggtggcatgcttcgtgtcgcactgcgggtggaactcgaccatggagggggtgaggaacggcgtgccgttcctgtgctggccctacttctgcgaccagtacctgaaccggagctacattatcaacgtgtggagcacgggcctgccggtgacgcccgacgcagacgggatcgtaacgcaggagtagctgaggagcaaggtggagcaggtcgtcggcgacgccgacataaaggacagggcgctggtgttcaaggatgcagcccgccggtgcatcgccgaagggggatcctcgaatgacaacttcaaaaagctcgtcaacctgctcagtgaatgatttgaggactactg

SEQ ID NO: 30228 - DNA, 577 bp, Sorghum bicolor
  Clone ID: 9851695
tccgagtacagcgccggtctcggcttcgcagagaatggcacgtccaaggctgacagcgggaagctggggagcaccgacggctccccggccggccggtcgtcgtccgacgcgtcccaagacttcttcggacaggtgccagagttccaccagtggtccgtgccggagctcccttccccgcccacggcctcggggcttcactggcagggcggcccgcgccacggcgcgacgaccaccaccgacaccaacacggccgccgtgtccgtgccggacatctcgtccccggagaacccattccgctgctacgccgccaccgccgctgggcagccgccggcgaagcgccggagaagatgttgacgtgacaagtaggggagatcgagtgtgtcttcttccagtactggagtggcgtaggctttgcaaaaaaacaaaaactttctggtgtgtacttccatggtgacgttgtatctagctcgtaggcaaagtgcagtgctaggatgctacttgtaggtaggagacgatcgagggatcagggcagctggagaagacgaagcagacagagataactactctactagttgta

SEQ ID NO: 30229 - DNA, 662 bp, Sorghum bicolor
  Clone ID: 9851721
ggaaagcaaacaaacactctggaatgcttcagagcgagacaagattttggaggcactccgccattcacaaacccgtgctagagaagctgatatggctgccaagaaagcgcacaatgagaaagacgatgtcatcaagcttttgttccgacaagcctcacatctctttgcttgcaatcagtggctgaaaataatgcagctggagaatattgtcctgcagctcaagcacaaagagcatcagatagcagccatcatacctgaacttccatggttaaccctaaaagagaagcctacacacggtcaggaacagagagattggactaggaggaagggtagaaggcagaagaagggaggtgggttctttgacacgatcttatttgctgttgggttaggtcttgctggagctgggtttcttcttgggtgggctcttgggtggctgctgccaaagttgtaaagttattgttatttttctttgggtgtagcgagctaggcaactgtattttgctgggtaggatccatacatggaagaccaagtgcaccccttcatgaaaatggtgtcaaatgatcaaatttgttagaccctagcatctgttgatctggaaaccatgatggtgcaatggtgtaaatgaatgtcaagttgtccacactgcaccaggagagcattt

SEQ ID NO: 30230 - DNA, 586 bp, Sorghum bicolor
  Clone ID: 9851736
gcacgagggagcacgtcgctgacgcaccacctcccctctcgccgcattctccactccagttccagtggtcttcgccttccgcgtcgccgtggtcggtgccttccaaatccaaaaaaccccaaccccaagccctagctgtagccgccccgcaaggtcgcttcgccggagatgtcttcgtggctgcggagcgcggtgagccgggcggtggaggccggcggccgcagcggcgtcgcccgcgcggtcaaggggtacgccgatgccgtcgcgcaccacgccggccaggccgtcgcggacatcctccacgaccgcatgggcactcagaactataaaagtttcaagaaaacagtagcacgattggaagaggctgcagtgtcatgccatgggggtgaaagaattgaattgttaaaacgttggttgggagcactgcaagatgttgatgctgaacatggaggttcagatttagaggcttctgaagctcatgatccttcgggtgaaatggacactttgaaagcaccaatggttttgttctatgatgctgatattgatggagcacctatgaatttccatgacgtattcttgtacagcc

SEQ ID NO: 30231 - DNA, 277 bp, Sorghum bicolor
  Clone ID: 9851742
gcacgaggctgcaacgaggcgctgttcccgacggcgcgggcggcacctgggtggtgggtggccgagctcgccgcgctgtcgcccgcgtcgttccggaaggtggtcaccgcgctgcggtgccgccgcgcgggtccggaggtggtggccgccgcggccgtcgcgtacgcggagcgcgtcctggccggggtcctcgcacccgctgcgcccggccgccgggacgccgtcgtcgtcgtcgcgaggaacgcggacgcggacgcggaccggcgggcgctgcttg

SEQ ID NO: 30232 - DNA, 132 bp, Sorghum bicolor
  Clone ID: 9851746
gcacgaggcacctttgtcaacaccgatgtggaccacgccttggtggtaaccgcgctggatgcctccggcggcgcggtggcgtttggcggcggcatccacctggcgttcatcccggacgggcttgccgacgac

SEQ ID NO: 30233 - DNA, 537 bp, Sorghum bicolor
  Clone ID: 9851750
gcacgagggtggattccttttttttctttctgtaaaattgtcgtttcaccttttcctttcctctattttcttgattcctgcgattttccttggaaattcctccaatcttttttttagaaaaggaaatatattggaaattaaaacccggtttatcatcttgcattgatcagtaataattttacacagtatgcaatttttgaatccatttattttatatgcaaattttagctataatattgtcttccagtacaggtccacttatgcttcaggttatggcattttgaatccatgagttggtttgtgtaattttcttcctcttctgcagattcctctcgaatcacatttgcttttcgctgatttctctacactagattagctgttcagcgcccaagatagaatggtttggttagttaatctgcagttacagtaaaatcctgcccactgcaatttgtgggactagtttgtcactgttttactaaatcttcatgataacaatcagaacaccttaaattaatctgcaacaaaactttgcaattg

SEQ ID NO: 30234 - DNA, 388 bp, Sorghum bicolor
  Clone ID: 9851752
gggatagacaccgacgtaaatcatgcttcttgtcgtattgttacagagtcagaacccaaccagttaccagatggtaagattcaagatgaggaagctgaagatgacaaaaaatttatggatgaagctactttggatcacaacacttctgatggtgaggtgacaaatatggaagttgagatgcacgttggtaagaagagtttgattgactattgtaacttcacaagaaccccaacaaggcccaggtcagtgcgtgcacacagaaatgcagcatgtatcccaggagaaactgcagtagttgaaacagttgatctagtttcttctggtcaagcttcacagatggtaatcggtgaacctgctgagagatctttgactaacattgcgtcagaaa

SEQ ID NO: 30235 - DNA, 551 bp, Sorghum bicolor
  Clone ID: 9851760
gcacgaggcacagggagcgcagcgcgcagtacaccagccatggaggcgagcggcagtcggggccggagcgggagcgcggttcccaagcgccgcagaggcgtcggcgcggctaccggctccggttcgacggcgcagtcgctgaacgacgacatcctccggtccgtcttctcccgcctggacgaccacttcgacctcgcccgctgctccgccgtctgcggcacatggaataggataattgaaacagctcatctcatgaaggatctgtattacaaaaggaatccatcagtaagaggttcaagctctaacatttctgtaaaaagttactttgagatgcttgccatggatgagcatgcatcctctttctctagaggacctgctgaagcttttcagtggattgggcacccaatacgggctaccttgtgccgtatgaagagtggttcaattttaactggagttggagataagattctccggctttggtctgctgaaagctgcaaattgatgaatgagtacaatgtgccaaattctaaaacattagtcgacttcgattt

SEQ ID NO: 30236 - DNA, 576 bp, Sorghum bicolor
  Clone ID: 9851771
gcacgagggccggccgtcgcgctccttcgtacgactgccttcccgcccatccatcccatcccctccccctcgataataatatctcccgcctcccgccctccgccgcacctcacctcccaaccgtccccagcgtgcgtgacgctgacggcggcatccggccggatccgcatccatccacccgacaaaaccgcccgccgctaggccgctaagcttcccttccacgtctccgcagagcccaatcgcctccgccgctgcgagttcaatcggtgcatggtcgcagcagcagcaggtcctccatgaaggtgctctgctccgcctgcgaggcggccgaggcgcgcttgctctgctgcgccgacgaggccgccctctgcgcgcgctgcgaccgcgacgtgcacgccgccaaccgcctcgccggcaagcaccaccgcctcccgctcatcccgcacgccgacgtctccgcgcccaactgcgacatatgccaggaggcccacgcctacttcttctgcgtggaggaccgcgcgctgctctgccgggcctgcgacgtggccgtgcacacggctaacgcctttgtctccg

SEQ ID NO: 30237 - DNA, 326 bp, Sorghum bicolor
  Clone ID: 9851794
acctagtttataatattgataactgtgccatgaaactatgcattgagactggccttatagctcatggatgatcgcaaacatcggataactgaagcgtattgaatcttagattaggatcctgctacatagttctttgcatccaatggatgaccatttattttctatttaaaacaataatggatccctctatccctaattacaagagttgtcttaagttaaaattttaaaattttgatcaaatttctagaaaaaacaactagtatttatgacatcaaattaatattagtagatataatatagaatatatgtcattatatatttattgt

SEQ ID NO: 30238 - DNA, 516 bp, Sorghum bicolor
  Clone ID: 9851797
gcacgaggcggcgacggccgtcctctcccggccagcaccgtcgccggctgcgtttcaaccctgccttcgcttctcccttcaccccgcgcggctctctctctcttggcgacgattgggggaccactgccgccgctcaacgccaggtagacaggtcttggccggctctccgccggcgacgagcacccgccagttttgtgatcagtgaaactaatggctgctgctgaagcaagggctgcttggcaacgtgctgcaaaccgttgccttgttcaggaggacaggaagagagctccaaaactagcttgctgtccaccatcggctgaacaacatggtacaaacaatgggaactgtcgaaattccgctgatcgtcccatctgcagtttagtgcctttgagatggaatcccatgcattctaatctgccaccagatttcagatggtgggttcagtcacagccaaattttgggatccagaaggatattgttagtgagcggctgcgttcgctgggcacggacattcat

SEQ ID NO: 30239 - DNA, 241 bp, Sorghum bicolor
  Clone ID: 9851802
gcacgagggccacggaagacgctccccaaggcgctcgtgtccgccgtctccatgacctcgctcgggtacctgctgccgctcttggcggccaccggcgccctcgacgtcgcgcccgacagctgggggaacggattcttcgccgacgctgcaggcatgatcgccggcaactggctcaagtactggatcgaggtgggcgcggtgctgtcctccatcggcctctactcggcgacgctgagcaacg

SEQ ID NO: 30240 - DNA, 589 bp, Sorghum bicolor
  unsure (1)..(589): unsure at all n locations
  Clone ID: 9852001
ntacctcgccatccacccggacgtngtcgtcgtcgccggcccgcagccgcggccgctcaagggcgccgtgctcatccacccctggttctggggctccgaggccgtgggcgaggagaccacggaccccgccgcgcgcgccatgggcgcgggactctggttcttcgcgtgcccggacaccagcggcatggacgacccgcggatgaaccccatggcgcccgccgcgccggggctccacacgctggcgtgcgaccgcgtgctggtgtgcgccgcggagggcgacttcctcaggtggcgcggccgcgcgtacgccgaggcggtggccgcggccaggggcggcggcggcggcggcctcggggacgccaacgccaacgccggcggcggcgtcgagctgctggagaccatgggagagggacacgtcttctacctcttcaaacccgactgcgataaggccaaggagatgatggacaagatggtcgctttcatcaatgcgccgtgatccgcgacaattgcgcttaatagtgttgcttttgtgtttatcgtggtctcagaatcaccgtgataggcatttatcgtgacattgtggnaaaat

SEQ ID NO: 30241 - DNA, 701 bp, Sorghum bicolor
  unsure (1)..(701): unsure at all n locations
  Clone ID: 9852003
ggagttgatactgcgggagtggcgtgaagaatgggatcccaagccggcaagcccaagcagcatacggntaattcactttggaaagctgttggacgacaaggaccaactaaagcaatatcacttcagcgcagaggcagccaatgttgtgcatatgacagtccggccagctgacatcgttgaagaggaagagcccaagggaggtaataagtcaacttccggcggtggtcgcagccgagaaggtggcagcggatgctgtgtcattttatgatggaaacggccagcatgcatttcctttctgcaaccattgtcttttccactcaccaagagccattcctttttcttcttgctggagagaacaatgtgcatggaggaaggtccgattaggaggagctgtttgacttgaccaggggggccctcggtgctttgcgtgctacaggattccaaaaggcagacgcttggctggggtcatggtttttcaacacttcatacacctcacaactgtgtccacaatggatgggctgtatggcctggagaggggtttgggatgggtcgactcttcaggccgctttttctcacgtcttgtgtttctctctttgggagacattacccaaatatccatcgagcgtattacagagagcgaagacgataacgggaaaccaggagtacggcggcgtatcatagctttatgtatttgttnctgt

SEQ ID NO: 30242 - DNA, 534 bp, Sorghum bicolor
  Clone ID: 9852070
gcacgaggggacgacgacgtcgggtactccttctcgggcgggcacatcaagggccgggtcagcttcttctcccgctcgggctgccgcgactgcgccgccgtgcgcgccttcttccggcagtccggcctgccctacgtggagatcaacctggacgtgttcccggagcgcgaggccgagctggcctcccgcgcgggcgccgcggcgcgcgtgccccagatcttcctcaacgagaagctcctgggcggcctcgtggtgctcaactccctgcgcaacagcggcgagttcgagcgccgcgtgcgcgacctcgcgggacgccggtgccccgactcggcgccgcgggtgcccgtgtacgggttcgacgacgaggccggcgccggcaagggggaagaggccgccgaggacgccatggtgggcatcgtgagggtgctccggcaccggctgccgatccaggacaggttcgtcagggtgaagctcgtcaagaattgcttctccggaacagacatggtggacggcatcgtgaaccacctggactgc

SEQ ID NO: 30243 - DNA, 482 bp, Sorghum bicolor
  Clone ID: 9852084
gcacgaggctctcacgagcgtgtccgccatggcgtcgtccaagccttcgttatcgctccccttccccatccccgcccccgacccgtccgacgaggtcgtgcgcgagttcggcccgctgctccggatctacaagagcggccgcatcgagcggcccctggttgccccgcccgtggatcccggccacgacgccgccacgggggtccagtccaaggacgtccacctcggctcctactccgcccgcctctacctgccccccgtggccgcttccagcgccaagctgcccgtcgtcgtgtacgtccacggcggcggcttcgtggccgagtcggccgcgtcgccaggctaccacctcttcctcaacaggctggccgccgcgtgcccggcgctcgtcgtgtccgtcgactaccgcctggcgcccgagcacccgctcccggccgggtacgacgactgcctcgccgcgctcaagtgggtgctctccgccgccg

SEQ ID NO: 30244 - DNA, 549 bp, Sorghum bicolor
  Clone ID: 9852086
gcacgaggcgacgaccctttgcgtctcacccggcgaccgacaaacaattcatctttcccgattccctttcgcgcaccatcgatcccatatatcgactcatcgtcgccacctaatcgcaacttgccgcatgtattgaaccattgcatccgagttgatccaacgacctccgtcacgagcccccatccctccccgaggctcgtcgctctgtgtgcccctgccttgtcgtcttctccgcaatggccgacaccaacccagccgacgtcaacatgagcagtgctcaaccagccaagggctcgttggccgagtccaaggacgccgttcccatgaagacattgccgcagtcatcatcgacagagaccgatgccgcagccgcctccaatacagcaaagacaacgacatcgacttcatcgagcccgggggccatcgtcaatactaccacggatagtgccactgcaatcccagcgacgagcgacgccagcgattcaatcgaaccatccgccaaagggaaggagaagcaatccgctctcccgccggtggataaaaaccaag

SEQ ID NO: 30245 - DNA, 538 bp, Sorghum bicolor
  Clone ID: 9852114
gcacgaggctctgctgaaatggtctcatccccgaggtatagtaatgctgaccagggtgctatgttttcaccttctcacaaggctgctattctgaatcagttccagcagcagcagcaagcactgctttctccaatcaacacaggagtttactctccaaaggcagacaaccagcagttaccttcacactcatctctgctgcaagcatcacttgggatgtcctcccctggccggatgtctccacgatgtgttgaatcaggctccccaatgaactcccacctagctgctgctcttgtccagcgtgagaaacaacagcagacaatgagaagtctcagttctcgtgaccttgggcctagtgcggcacgagcttcagctctcggctcccctctaagctcatcatggtctaagtggggatctccttcagggacaccagattggggcgtaaatggtgaagaattgggtaagctccgccgctcatcgtcctttgagctgaggtctggtggtgatgaccctgatctctcttgggtgcatacactggtta

SEQ ID NO: 30246 - DNA, 620 bp, Sorghum bicolor
  Clone ID: 9852224
cagtgcaccagcatcagttcgtgaaaagttggatgatttggttttcggtagtggttgtgccgccacaggaagaaaagataaaccttttggtaatgatacacaaaaaggtacgagtacaagctggatgaaccataggaagagcccagatgcttcttttgcatcgaaacaaaaacttgaagaggacttgtggcgagatcttgtggacaatccagcaaactggtgggacaaccgaacagacaagccgacaccaaagcatcctgatttcaagaacaagaattcagggcaaggtctatggttaggaaccaaatcgcctcaatgggctagagatgcactgccatccttgaaatttaagggaggtagcaagggtacaaggaaagaaaccttactgtcatgatggatatgagctttggcagcaatggtaagcccttgtgctatatgcccagctctctgcctctcttactaaatatattgggtctgtctctgcgcaaaaggcgtgtggcaatatacgctaacacctgattcaggttgagcactagacaaaattcaggttgggccattttgacttatcaggatgcaggatgtaaatagtttaccaaattgacgcttattatgtaattgtc

SEQ ID NO: 30247 - DNA, 665 bp, Sorghum bicolor
  Clone ID: 9852240
caattaggggtaataacctagcttgccatccaatggggtttctagactactgattgatgtttgatgataagggttatgttccatccattactatgcttgaaaagtgatcaaatcgataaatcctcggccatattggaagagggattctagcgatgacatttggatttaaggtaaaaaatgtgttactttaaattcttgagtctgttctagttcgtactgatagttttttttcattctaacaattatttgaaatgctatccagagcatgaacttttccactttggatgcatggtatgttttcaacggtaatggtattgtctctgaaggtggaatctccatgtttaatgagtgtgactagcttccatcatacattgctatgtctggagatactccataccattgtccatacttatcatagctttagtctttttactttgttgtttatgacaattttagttgccaatatgcccgcctttatatagtgcaaaggttgttcaatagaggcttgtatatgtaccaaacttttgtctaacaaatgtgccccccaatattgtctttgctgaacatttagacacaattcaagattatgattagaggccattcatcccaagagtaaatgagatatatgcatgtgtttcattggtactgatgttggttgagaccct

SEQ ID NO: 30248 - DNA, 650 bp, Sorghum bicolor
  Clone ID: 9852244
ctactaattgtatgttccagtctgctccatagatgatgccctgatacacatatatttgatacagtccaactattttattggctcaaagtttagtttgattgtttctgcaggttcatcttctgccgagcaacccattccctgttcaaacctacaaaccataaggcagagttccttccgacctgcatgcctcctctgcctgagtctgttgatgctgagagcatgctctcccaaagctgtgtgatgcgagtcgcatcattctttggcgctgtcagccagttctcatttgctgaggttacgacatggcctgatgttgaccctgaggaggctgttgccaccagttcatctggcagtgccaacaaaggagtgccagagacagccagagattcagacatttcaaactcatcttcatctttttgattgatgattaggctgctgtggcgaccatcgggctaccttcggccgcttgtgttatgttactcatctgcatttgcagatccattctgtaattacttgtgctccttcatgcttgatattacacacatcaagcagaaggactgccttgcctcattttttttttctttttacttagtgaattgttagtcactagaacattttgttatcccttactcaatttggagacgtggaaagct

SEQ ID NO: 30249 - DNA, 658 bp, Sorghum bicolor
  Clone ID: 9852271
acaaggatcggggtttaggttctgttttcaaacgtgatgatcaaaggcttaatcagctgagggaaaaagatgcacgggagagagatccaaattttatttcagatagttactcagagtgttatcctggttaccaggagtataataatgagattgcaggaagcgatgatgaagatgatttatcgaagatggatatgggtggacgggcgaagggccgtcttcacaggtgggactttgagactgaagaggagtgggccaagtacaacgatcagaaagaagccatgccaaaggctgccttccagtttggggtgaagatgcaggacggcaggaagaccaggaagcagaataaggaccagaagctcacgaacgacctccacaagatcaacaagatcctggctaggaagaagggcgagaaagatggggcggaagatggcggtcactatgatgatgatttacctagctcgaagaaacagcgtggctgaagctgtcaccttttgtttctcctgccaatacagtaggcaggcgaacattgtatgaagagttacagtgccatgtttagctggcagctgtatcctgcgtttgtttaaggtggccggtaggaaattatgttgatgctattgagctgaaaccaggaagaagtatgcctgtatacgtattttat

SEQ ID NO: 30250 - DNA, 649 bp, Sorghum bicolor
  Clone ID: 9852291
cctatcaaaaactgtgtggcagtattacagcggagttcaatgattgctcgaaacaagtcattgaaataatttccctgctctcaatgccagaatttagtcgtagtgatcttgccgatttactgaagggtgttcaagcacatgagaaagagaagttgcatttgacagcgaagattcaggtgctgaagaaagccggcaggccttcagagcgcctggtgaaccacgaggactgcaggtcacgcagcatggcccagcacgtgtgcgtgcacgtcaaggagatcacggaggccgctgggactgaggatgcagaggcagacgcggagtatgatgccgccctcaaggaggccatacagggcgtgcaggaggccgtgaccagcataaacgaacacatggaggaggtgcgctacgagattgacggactcgaggcggacacgatcggtagcaagtggagcgaagtcgaggaagcattccctggtaccctgtctataaaatagatagatgatttgttttctttggcaccgttcagttcattctacccgtgttgttcttttctttaaaactatgtgcccgtgttattcggctcagtgtactcctgttagtggagccctgacgctgaggaatttggtgtaggttaacttatgttttagtgtgc

SEQ ID NO: 30251 - DNA, 613 bp, Sorghum bicolor
  Clone ID: 9852294
ccatgatgatgatgcatcaatccttgatgactttgacttttatgaggagcgtgagaaagcactgcaggaaaataaggcacgcctgcatcagcaacatctacccagttctattgttgttgagcccaagaaacccttgactgtacccactgacctcgtgagccatatcaccaagagttttgctcaggctgtgcggcttggtgaggccaagactgtaagccctttggctgagaaagtttctggcggtgattcgtctattcctgtgaagcctgttgaagttaagcagagtggtttatcttaggaactcttgatcgatgttattgaactgtactcaaaacatcatccatacggttcctgatcaaaatatcaggaatgcatatacagatggatgatgatgatgaaacctaagacatcggcaaagatggcttcttgcgcttttggtcaagcatgcatgtacactagggtaggtctttgccaaccttggaagcatagtttcttgaatagtttctctctctttttttcttcctcttcctagtattcctctccttctctctgcatcatatgatgattccttagtgtctagccttaaggggaggtgcagtttttgtgcaagact

SEQ ID NO: 30252 - DNA, 604 bp, Sorghum bicolor
  Clone ID: 9852298
ggaagcggcccgcggggcggaccaagttccgggagacgaggcacccggtgttccgcggcgtccggaggcggggcaacgccgggcggtgggtgtgcgaggtgcgcgtgccggggaggcgcggctgcaggctctggctcggcaccttcgacaccgcggacgccgcggcccgcgcgcacgacgccgccatgctcgccatcgccggcgcgggcgcctgcctcaacttcgccgactcggcctggctcctcgccgtgccggcctcgtacgccagcctcgccgaggtccgccacgccgtcgcggaggccgtggaggagttcctgctccgtgaggtggtccaagaggacgatgcgctttcggccacgtcctcgacgccgccgtcgtccccgtccagcagcgacgacggaagcacctctgatggcggggagtcctctgaatctgattcgtctccggccgccaccggggcctcgccgttcgaattggacgtgttcaatgacatgagctgggacctgtactacgcgagcttggcgcaggggatgctcgtggaaccaccgtcacgcggtcaccgcgttcatggacgaaggcttcgccgatgtgccactatggagct

SEQ ID NO: 30253 - DNA, 650 bp, Sorghum bicolor
  Clone ID: 9852299
caagcacaacagtattaccggttgtataaggaaactatacctgttacacaacttgtcagagaaacagctgctgttatgcaggagttcacacagtctggcggtgtaagaccatttggtgtatctttgttgattgctgggtatgatgacaatggcccgcagttgtaccaggtagacccttcaggatcatacttctcctggaaagcatcagctatggggaaaaatgtgtccaatgcaaagacatttcttgagaagaggtacacagaagatatggagcttgatgatgccatacatactgcaattttgactttgaaagaaggatacgaagggcagatctcttccaacaatattgagatcgggatcattcgctctgactgtgagttcagggttctgagccccgcagagatcaaggattttctggaagaggtggagtaagctgcccctcaacgatttgcgagtttcagaaacgagagaagcataaattcaagtggccgggtccaagccccacgaagtttttcagatcctttagttttattatttttcaatctttgaacagactgtctgcagtagggacattcagtggcgaagctagaggagaatggaggggggtgcgctattacctattactgtactaaaagtatggctatgcatat

SEQ ID NO: 30254 - DNA, 664 bp, Sorghum bicolor
  Clone ID: 9852338
attggagagacaggcaaggggagattgcgactggtggccgagatgatccataagcaactacaactttctctgcaccagctaacgcttcctgcgggttgaatatatctcatctttagtacttgatgactgctggcagatgaagaatatgcttgctgaaaagaaaggaaaggtgctccacagtgggggtaataacatacaggttgtctgctgaaggcattgcattatatatataatatacatagataacgttaaccccattaacttactgtatgctgctgatcaactcttgaaccccgcaaagcttgtggagcatggctgtggcagcatgataggaatgtaacctgccactattctcgaaaggatattgacatactgtcagtaccccctcgaaactgcaatatacaggatggggcaactgagacttgggttgtacattagagtttagaatatggctctgccccatttttagtgatattccaactagtgtctctgttgggtcagtgaaagttttgagcagttgttgaggaatttgcaggactttgagactatattcattttaaagtgattttaagagcacgaagctgagtccctagaaactcaaatctgatatggctctgggcctattgtgtacctgagaccatgaagcataatgtttgtgattggt

SEQ ID NO: 30255 - DNA, 661 bp, Sorghum bicolor
  Clone ID: 9852380
atttctcttgcagaattctggtataataccagtgaacattcagccctgggaaaatctccattcgaggtactctatggccattcgcctcgacattttggtcttactgatgatatggtttcccctgtttccgatgtgacgaaattgctggaggagcgctctactatgctcgcggcggtgcgacaacaccttcttcgcgcgcagcaacgcatgaagcaccaggcggacaagcgtcgctccgagcgttcatttcaagttggcgacttcgtctaccttcgcctccaccccgcatgttaatcagaggtgattattccgggataaaacttcaaggttaatttatttcggtaagaagatatacgaattatgtacgaccatagctattgctggtaccgtttggtacacagtgcatgtttagtcgggaccagtcgtactcgttctctctcccgtctgtcctagtgaacagatatagatcatgcaccacgggtccacggccgtgcttgattgatgcgtggtatagtattccgtacgtgaaagagagcttctccggttcgtgctctcaacaactcaactgcggacttgtttagttccaaattatttggttttatatactgtagcattttatttttatttgataattattatccctcatggattaactaagctc

SEQ ID NO: 30256 - DNA, 706 bp, Sorghum bicolor
  Clone ID: 9852392
ctttcttgcagaagacatgagcgcccgagttggagattttggcatatctagaatcatttcagcaagcgaaagtataattccgcaaaattctagtaccacaattggcataagagggtccattggctatgttgctcttgagtacggtgaaggttcttcagtcacaacttttggtgatgtttatagccttggcatattgctgcttgagattttcacagggaagagcccaacagatgatatgtttagaggttcaatggatctacataagttttctgaggatgctcttccagataaaatctgggagatagctgatacgacaatgtggctgcacaccggcacctatgacagcaatacaagaaacataattgagaaatgtttggtccatgtcatttctcttgggttatcctgctcacgaaaacaacctagggagaggacactgatacaagatgcggtcaatgagatgcatgctatcagagattcattcctcaaatttgctagagctcttgtggtggaagatgaagcaggaacgctttcacagtaattttcaaacaacagtgaataagtagagctgaaaatgggcaatatgtttgcaggtgataacctaaataaaataattgaaggtggcttcaatctattatcctgtctttaaaaatctgcatttacatcagattttatgcaaatggattgttatgtgaaatacgacaatcag

SEQ ID NO: 30257 - DNA, 673 bp, Sorghum bicolor
  Clone ID: 9852455
gatcacttcaaggagattagctttttttgcattctttgctgggtggagcattgcaacttctgctgagactgggcctgcctttcagcttgcactatcactcgtctcatgcatatacttcctcaatgagaagatgaagaatcttgtcagggcgtccaccacagggctcggagtatttgtcggtggctggatcttaggttcttttcttgttccagtgatcccagctttcatcatcccgcctacatggtcccttgagctccttacttcgctgacggcctatgttttcatgttcttgggttgcactttcctcaagtgagactttgcaacagtcctctaattttgaaatccctgttgtcatcacaaagaagattgctcctgctgacatctccactgcaaatcccaacctcctgataagcgccctcattcacatttttggtccgagagtatatgatgatctatgggcaactccgcttttccacggaaggatcggccagatttaagctacatacatttttgtcaccccttacgatcttactcaagtagtcaagtgtacgcaatagctagtagctgattaatttttgtaatcaaacatcgctgggagttccatgattgtaatacctgtatgcaaatgagtcccatgattgtaaatttgtaatcaaacattgctgcagccaat

SEQ ID NO: 30258 - DNA, 517 bp, Sorghum bicolor
  Clone ID: 9852456
ccaccaactacacctaccccgacgccgtcgtcccagcaccgccgccgtgcgccgccgcgcaggttccgagcgccagcgccagcgccagcgcccgggaagagtcttgttcgtcctcgttctccaccagggacgacgactaccacccgctggcagtgaccgtagcggtcgctgcgccgccggctccgtcgcagtcgcagtcgccgtcgtcgctcgacctaggccttgggctcttcccggcgatggtggccgcccagccgtacctgttcctgaacccgatgcagttggcgccggtgaagagggaggcggagcggagctgctactcggggtcgtcgtcgccgtcgccgtcggtgctgggactgggactcgacctcaacctgcctccgccggccgagatggtcatgtagcgtcggggatagtaatttgtcgcaaaaggggttaccaaatgtgctgtaaataggaagcacatttggtttgtttaccgtgtagctgcgcctccatttttttacccccctgtgca

SEQ ID NO: 30259 - DNA, 470 bp, Sorghum bicolor
  Clone ID: 9852470
gcacgagggagagatcgatgcggggctcggcggcggcactgctgctcctgccgtggatgctgctgcatgcggcagccgcgagcaacgggagctgcgcgcggagctgcgggaacttgacggtgcagtacccgttcggcttctcccccggctgcgagataccgctcgggtgcgacgaccaggcgaacggcaccgcgtgggtcggcggcgcgcgcgagctgggcctgctggtgcacaacgtcacggcgcgcgccgtcgagctcgccttgccccaggactgctcccgcggactcaacgcctccatccaggcgctcttctcgaggagctacgcgcctggctcgcagaacgcgctcgttgtgagcaagtgtagcccggcttcgccggcgcataccaccaactgcagcgacggcgacaggtacctggacaggtggtgccagtgcaacaccaccggcgagcccatccgctgcgtcctg

SEQ ID NO: 30260 - DNA, 497 bp, Sorghum bicolor
  Clone ID: 9852471
gcacgaggaaattctctctcgctgccgtgcccaccgatcaatcactccgcctcgccttcgcacgaccgcgtctccgccctccgcctgcgtctcggtcggagcccccttctcatccgcagcctgcctctgctcggcgccgtcccgactgcgggagaggggagcgccccgtcgccgatccgatcgggagccgcaggccaagcggcgaggcgagcccgtccgtcaggaagcgccatggcagcagcggccgccgccgactccgatcccgccgcagctgtggccgccatgtccacctgcgcccactgtcagcgcgagatcccatcttcaaacatcgacttgcattctgtacattgtgcccgcaaccttcaaaaatgccagcactgtggcgaaatgattcctaggaaacttatggatgaacactatgatgaaagccatgccccgatcaattgctccctctgcaaagaaacaatagaacgtgagagttgggatattcataaagg

SEQ ID NO: 30261 - DNA, 298 bp, Sorghum bicolor
  Clone ID: 9852496
gcacgaggagagagccagttttggaaactttacaaggaagatcctgcatcatgtgcgatcgtgatgaaaacttcagttggtcttgtctacctgcttgcctgtcttctggagcctttcatgccctccttttctgatgaagtgctgcgtcaattaaatttatgtccagaagaaaatctgtcatttagtgaagaaaagggagaaattgcaaaggcaaaaactccttgggattttgtaccagctgggcacaaaatagggaagcccgcacctctgttcaaggaattgaaagatgaagatgtag

SEQ ID NO: 30262 - DNA, 507 bp, Sorghum bicolor
  Clone ID: 9852499
gcacgagggtacacggctctctcgaggctcgtttgctttctctcgctgtcccatggcggctgcgacggcggcaggggcagccgccgcggccgccgccgtatccctgatcgcctgctacctcctcctccacaagggtagacccaacctcccgtgggtcccaacagttgggttttcccgcgcgagcggccggcgggcgcgacggaggggtctcgtggaggccatcggcaacacacctctcattcgcatcaacagcctctccgacgccacaggatgcgagattctggggaaggctgagttcctgaacccgggtggcagcgtgaaggaccgcgtggcggttaagatcatcgaggaggctctagaatctggagatctcgtatatggtggtactgtaacagaggggagtgctggaagcacagctattagcttggctactgttgctcctgcctatggttgtaggtgtcatgttgtaatccccgatgatgctgccattgaaaagtctcaaataat

SEQ ID NO: 30263 - DNA, 573 bp, Sorghum bicolor
  Clone ID: 9852544
gcacgaggcctgcctcctcccctcgctagggtttagggttctacggccaccaggtagccaccatgatgcaccatcacctctcgcgcgtcctcacccgccgcctcctcctcctccccgtcccactccccaccgccgcaacctctccctacgccgcggcgctctccacgccccacagacgcgcgtacgcccgccgcgccaagccgccggcgccaccagcggcggacgccggcgaccacaccgcctcccctgcagcgccggctgactcggatgcgaaggccacgtggcagagggagaagctcccgggcgagctgccgcggccaccgaccatcccgttccagccgcgcgtcgctaacgccgtgcacctcgtcggcaccgtctgcgcccccgtgcacgtgcagcaactgcccgacggcagattctccgcggtctccgtgctcgtgcacgaccacggcatcaacttgcccaagttctgggttcccatagttttcaaagatgacttggcacaagtagctgcttcccacttgaaagaaaatgaccttgtctccgtgtctgggaaattaacttgtgattctc

SEQ ID NO: 30264 - DNA, 610 bp, Sorghum bicolor
  unsure (1)..(610): unsure at all n locations
  Clone ID: 9852563
gcacgaggcagatatcgacagggtacccatatttttaatgaatttcttcagacattagagtatatttaaagccttgacatgaattttgcaggatgcatacaacaaagctgaggagttattgttattgtccctaaatgaatgggccacgactttagttgcatcatcttcacttcatcctgtttgggttgaagttttaggtgatccactcctaagaaggctacttctcaggtgatcttgtgactcttgtcaaatcttgtcatgaattgaatctctactcaatctgtcaaaagtagtcctttttgtctggaactatgaatgattgattttgggccgcctttgttttatgaacatcactatactgtgctcgcttgtaagaggtttcttgttactccctctccaaaatgtagatcattttagttttctcctactcagttaaacttctctaacttttgctaggtttatgaaaagtacacctacatctacaaaatcagtttagtaaatccaacctgaagtatgtcttaatagtgcacttattcngtattgtagatgttaatgtactgctctataaacttgatgaaagttaatttgacttgggacaaaactaaaatga

SEQ ID NO: 30265 - DNA, 490 bp, Sorghum bicolor
  Clone ID: 9852596
gcacgagggtacagtttgacaagcttgccaatgttaacaggcttgatgaaatctccaactacacgtctttgtatacacttctaattgttggtggccctgcaaattatccacctagcatcctaaatgacgtgcttcaaaatacacttcagacagttcagaggcttcgagttttagatgtgagcaattttggcctaagtgagctgcctgaatcaattggagatctgatacaccttcgctgtcttcagctccgaggcaccaagataagaaggcttcctgaatcagtctgtcatctgtaccaccttcaaactctgggcctcagaaattgctattatcttgaagagttgccaactgatataaagtatcttggtaagctaaggcatattgatctacatctggataatcaccagcctacacagttgaagcatatgcctgagggtataggttcactgattggtcttcacacactgtcaaggtttgtgataagtacgag

SEQ ID NO: 30266 - DNA, 441 bp, Sorghum bicolor
  Clone ID: 9852607
gcacgagggccgagtgaatcgctgtgaaaccagccgatcgccgtttccagtgaagggggaatcgtttgcgctccgattctcgacgctgggaacccgtttggaaaggtttctgccgattcctccaagaaacgtatcggatccaaacggtccgtcgccgtccagacgctgcggcgaaggaacgaggacggagggagtgcgactccttgtgaggtggagaagccatggcggaggaccaaccgactccggccgcgtccgccgccgaggaggccgccatggatgcagataccggcggcgagcggcttagcgcagccgcgttggtgggcctgctccgcaggttcctcgccgtgcagcagcgccgggccgaggcctactccacgctacgaaggggtttttctgagtatatggctaatggtggtgaattggcctatcaaaaactgtgtg

SEQ ID NO: 30267 - DNA, 432 bp, Sorghum bicolor
  Clone ID: 9852610
gcacgaggctgataccctgagtccaaacagcttcctgtttggcccaagacctgaatggttcagatcttcagaaggaactgggtcatttccatcacctgcagcttcacctcaaccttctagtggtgttccagggacctatggccaaagcaactttccaatggcttcaggaatggcatcgcctcaccagaagcccttctatggtttgggatccacagctgactcctacggaaggggtttttctcatggtggaatgttcccacaggccagcaattatggaggatccttcaccagctttggctttaatggtagaagttcgatctcgatcgagaaagggcgtaggaggggaaggggtaatgcacttatttgcagctgcaatggcccacttgactttcttaatgagcaaagtcggggtccacgtgctactaagcctaa

SEQ ID NO: 30268 - DNA, 554 bp, Sorghum bicolor
  Clone ID: 9852611
gcacgaggtacaatacaagcagcgagttcggccgatgtgaattgccattgccagaggtgttattgccttcttggtcgctgctatggttgacttccggcacgcgcggtctcttctcgccgccggcgtcctcctagccggcgtcgtcgtcgccgtcctcggcgccggcgaggacgatgagcacttcgtctactcgggcttcaccggcgcgccgctcgcgctggacggcacggccaccatcacggcgtcggggctgctggagctcaccaacggcacggcgcagctcaagggccacgcggtgcacccggcgccgctgcggttccagcggacgcctggcggtcccgtgcgctccttctcggcgtctttcgtgttcggcatcatcccaccttactccgacctcagcggccacggtatcgtcttcttcgtcggcaaggacagcttcgccaacgcgctgcccagccagtacctgggcttcctcaacaccaacaacaacggcaacgccagcaaccgcgtcttcggcgtcgagctcgacaccatccggagcaccgagttcaaag

SEQ ID NO: 30269 - DNA, 128 bp, Sorghum bicolor
  Clone ID: 9852629
gatcagatgaacaaaaacatcagtgaaccatttccaaatgtgcataagaccagtacatgataatcaaaatggttttacttctatgggttcatacctgcattttttgttgttgaagattccttcatttg

SEQ ID NO: 30270 - DNA, 399 bp, Sorghum bicolor
  Clone ID: 9852636
gcacgagggtcacacaggaagcggaagcggcggcgggcgaagcgcgcgacgcagcgcagcgtaacaccaggccgccgggcgctccacggatcatcctctcctcttcttgccggagatccaccaccggggcggccattttccccttcctcaatcaagccgcgctcgagatcgacggccgctgcttgcagcaattcttcgtccgttgccgtgcgaccgagaataaactgaggctcaggcatgagctttcgggaccaggagagtggcggggaggatgcgggcaggacgtcctccgcgtccgacctgcggaagccgctcctgaacaccgggagctggtaccgcatgccgccgtcgggcggtatgatgggctcgcggcagtcgagcctcatggagcgcctaggc

SEQ ID NO: 30271 - DNA, 580 bp, Sorghum bicolor
  Clone ID: 9852646
gcacgaggcttgtcattcttgtcttggatatcttctacccactttcctatgaaggtttaaatatattctggaagaactccatgaacaaattgaaggttcttcttctcttcatcttagcatgcgacatacttgtgtttatgcttaatcctggacctttcagagtagctccgtacattcgtgttgtatttctaattatgacgatcagggaactgcgaatgtgtgctgttacgctggttggtattgttgggacataccttaatgttttggctctgtcactgttgttcctattatttgcaagctggctagcctatgtaacatttgaggacacgccacaaggaaagatcattttcacatcatacggtacaacgttatatcagatgtttgtcctgttcaccacatccaataatcctgatgtatgggtccctgcttacaagagctctcgttggaacgccctctttattgttatttatgtgctgttaggagtttacttcctaacaaatttaattcttgctgtcatttatgatagctttaaagagcagcttgcaaaacaagttgctcaaatggactctataaggaaaag

SEQ ID NO: 30272 - DNA, 603 bp, Sorghum bicolor
  Clone ID: 9852648
gcacgagggacacacccgtcttctggaaattcaaagggaattgagcaaaaatgttcaaatttcacaatcacctgctgatgttgtcctgaaaagagaagtcattcacgtagacagcttagggaagaaagtggatggaagcaactttggtaattgtacgaatgaagttctccaggttagagcatatggacaattgtatattcaccttgggataaatatcaggagtggtcgcctcctccttcaatcatccaaaaatatcttgctaccttccgcgctattagaatctgaagaagctctaaacaaagggagtctaacagcaagtgaggtttttgtgagcttgaagaccaggagcatcctccacttatttgctgcaattggaaggttcctgggtcataaggtttactcccagtcccaggttcctctaaaaattccaaagtcagtgttatatggttcagattttacggtcatggggtttcctcaatgcacaaatgcctattatctgatgatacaacttgataatgaccttacacctgtttttcatttgcttgagacacagactgatgaaagtaacaagtctagtactgattctacgactgatgctaatca

SEQ ID NO: 30273 - DNA, 460 bp, Sorghum bicolor
  Clone ID: 9852659
gcacgagggtatactgcaaggatggaacctgcaagcccaacgagagaaagcatatgatggttgtcatcctgctcctccacttgaactgctttgctcagtacgcgctgtgtggcctgaatcttggttaccgaagaccacagcgtccggtgatcggagttgccctcaccatatcggttgccatctgcgcgccggctgtcgccgggctgtacaacaacctcagccctcttggcaaagactacgaggcggcacaaccagaggcagacgacgaagagtcacagctccagcggaaaacgcccgagacggagaggaggtacacgttggtgccacgacaaggccatggcagcggcagctcgccgtcgtcgccgcagtgggtcggcgggctgttgggggatatgtgggaggacatgtcgctggcgtacctgtcggtgttctgcagctgctgcgtgttcaggtggaacat

SEQ ID NO: 30274 - DNA, 429 bp, Sorghum bicolor
  Clone ID: 9852661
gcacgagggtccatgctcaccatcgggtccagcttctgcgggagcaaccacgtgcagacgacgacggggggtgccggtacggacgtcgtcgtcgtcgtcgccagggcacgcggcgccgcgacggacacctcgtcggcgacgcggtccaggtcctgcaccaccaggaacgagcatccctgtcctggcgctgccgctgcagcagctgctgcccaccggagcggcaagcggaagcagagcgtcgacgccacggacgccgaggacgtggagttcgagtccgccgacgtcacgtgcgagccggcgcataagacggcgacggccaagcgccgccgcgccgccgaggtccataacctctccgagcggagaagaagggacagaatcaacgagaagatgaaggccctgcaagagctcatacctcactgcaacaaaacg

SEQ ID NO: 30275 - DNA, 554 bp, Sorghum bicolor
  Clone ID: 9852667
gcacgagggtccgtgccccgccgccgccgcccaaaccctaaccctagccttgccgccggcgaggccaggagcgtccggaccccccgcacctccgcccgctgaccccggagacgacgtccccccccgcggctgtatcgccgcaggggagatttaggtgaatgttacaagcatgatgactcaaaccctgcaagggaaagttatggcctacacaccaagcagctttcctgttcagcaacagatcttgccggaggatattgaaatgcttcagctggataacatgaaccagaatacctctccgattcgggccatcattattgaaaaaattgaagcatgcctgagaaacatggaagaattttgtgacttgtgcccagattcatgtctgaaagcttcaagaatcattgacaacatgctctacaaaaatgctccacagctccatttttacttggatcttgaaacagtagaaggcagggtgaatgatttgctcagatcttttccgtatagaaagcaaagagatccatgtatatcttcagcagttccatcaacaaaagatttgc

SEQ ID NO: 30276 - DNA, 549 bp, Sorghum bicolor
  unsure (1)..(549): unsure at all n locations
  Clone ID: 9852690
gcacgagggttgtctggtactattcccggtgccttaggaagtatcagcggcctggaacaattgtgtctggcgcacaacaatttgtcaggaccaatccctacagttctacagaatttgacatcattgttcaagttggatttgtccttcaacaatctgcaaggggaagtgccaaaagaagggattttcagaaattttgctaacctgtcgatcactggaaataaccagctttgtggaggaatacctcagcttaatttagttccatgcaagacagattctgcgaaaaagaagagaagacggaaactgaagtatcttagaatagcactagcaacaacctttgcactcttattattagctgttgttgttgcactcgttcgcttgatctacaggaagcaaacacgaaggcagaagggcgcatttggaccaccaatggatgaagaacagtatgaaagggtttcttttcatgcattatcaaatggaacaaatggattctcanaagccaatttgcttggtaagggcagctttgggacagtctacaaatgtgcttttcaa

SEQ ID NO: 30277 - DNA, 479 bp, Sorghum bicolor
  Clone ID: 9852716
gcacgaggcacacagcacagcacagcacagcacggcaacttttattgcttgtcccgtcctgccgcttcctcttccgtcttcctcttgcgttgcgcgtcgccgccaccaaattccaaaccgcaatcccgccgcaatccgctccctgcgcgcgaaatcagctcacggttttcggctcacgggtcgctgaattcctcctcctcctgctcgctcgctcgctcgctgacttccactcaactgctcgcctggcctgctggcctgctgctgcttcaatcaatccacggaggctggtctgctcgaagctcggccccttccttccgctcgctgctaggtggctgcacggatcttcctcccaaggttcctctttcctcccgtcgaatcgaattcttcctcaaattccgagtctttgtgccgcccggagctgctccgtccggtccgggttcgtcaagaccgaggcagcagactaggcagcgaagcgaagc

SEQ ID NO: 30278 - DNA, 481 bp, Sorghum bicolor
  Clone ID: 9852721
gcacgaggatcggagaactgggacgtcccacctgcgaagatgccgggaatattcactgaaaagaggggcgacctcggacctcaccccacgaaaaagcgcggacaggggcatcccacctcgacgccgtcttctctccagcggcgcttttctctctccccggcgctattcttcttcctcttctccggcgcccttctctcccagtggcgggctggctggagcagcagaagcggcacagcaagatctgaccgtttgctccatccagcgcccttctgctccatcaggccagatccggctgtttgcttgcgccggtgatgcagcagcagcagcggacagggcggcggtggcatcggacaaaggagaagcggcacggcaagcagaggagcagcgacgccggatggggtgcgtgacctcagacgggcggaggagcagcggcggcggacgcaggcggcctcagtcgcgcgagcggggccatctccggccg

SEQ ID NO: 30279 - DNA, 527 bp, Sorghum bicolor
  Clone ID: 9852729
gcacgaggcttcgcttatcacttatctttataaaagttttaaaatttcacattttcctcatttcataaaaacaataattaataaaaatcttgtaatattttagaaaaattttaaatccttatttaatttaatgtttttctaataacaatccaaaattaaaaattttggagtgttatagattccgagcctgtagtgtagtggttacagtgttttagtagcacctccaaatcctaggttcaactctttgtgggagtgaatttaggctcgttataaaaaaaatccccttgctggcaaagccagggtccagggatttttcttggccatgaaggttgagttcttctggctacttgagttttttcttgcgagggtgttacttttcttatttaactcataaaataatgtttttgctagttgaatgtggataagaacgtatgcagtattcaaggcaaaagtttattacaggttttcaagcttaccttgttggggggtgcgtgagagatttgctactcaaaagggtacctaaagat

SEQ ID NO: 30280 - DNA, 570 bp, Sorghum bicolor
  Clone ID: 9852747
gcacgagggcggagtcctgtagttccaccgaacctcccaggcaaagaagggcggcggcaacctcatcccatatgctgtcgatttggactctggtaacgaggaatttggcgattggtggatctgcaggagcttccagccatcaccgtggactcctcaaattctactgtgtccgcttcagctggagccgccaagtaaatatgatgtacagctagatctgtagaggtcgtttcctgagaactccaatcgacggtgccatcctggaggtattttcttccccattttcattctcagatgtggttttcattagtaattgatttgcatatttcccggattcctaaattacctttgatccccaaattggttgctgatccactagttttatttatttgtctttgatctatgatctctgttctttaataaaaaataaagaataggccgcagaagcatggtggtcagtggtcatgctcacgatggcctttctgggggtctatatactgtgttactggcgttttggatgtattagtgattcagagggggcaacaaaaacttttaacctgttaatcttagaag

SEQ ID NO: 30281 - DNA, 635 bp, Sorghum bicolor
  Clone ID: 9852770
caacagttctgtcgtcccaatggtgcaaggtccaccgccccagatgacagccagtgttcctgtctccttcccagatcatagcactacatttcacaatgtaaaccctacactgccacctccacctgttttgaatcatctacctccagctattccttcaggtaccatgaatgccccagcaagttcaagtcaagcaattagttttccaagtggcccagccaggggtttgaactattaccagtccctgatccatcagcatggaggggagaggcaggagccacttcaacagcatggaaggcagtttgcaatgcatcaccagcctgttgcgtcacaggctagtgccactgatattgtcagtagtggtactatggcagctagggataataagcaaaggcctacgaagccttgtgcttactttaacagcgcaagaggatgccggaacggtgcgaactgcacgtttctgcatgatatgtctgccgcaaggaaagaacagccgaagggatccaaaaggattaagctagacagcagaatagccgggcggtattgaggggctgctgcctgttgatttttgactgtctttggttcaaaatccttatttgccttttttcccttaaaaaaagattcagtaaatatgcgca

SEQ ID NO: 30282 - DNA, 638 bp, Sorghum bicolor
  Clone ID: 9852782
gccgatgaagggagcgtgttcttggaagcgatggtgctccaggagctcgaggacgtggtgttccagctgacgaagaggacgcgggtgtgcttccgggacgccttcttcaggctggctgagagttcgagagccaagtgcagcgccgcaaccgcaaacgggacgacgccttcttctcaaactggtgcccagcaagcagcagatcagggcaatgcgtcgtccaggatgtcaacgccatgctgcccggaacgggagacgaacgccatcgacaggacggtggcggacctcaccatgaagctgccgcgttccgttcctcttgatgaggtccgccgctgccccgacgacgacgactcagcggcggaggcgcagtccgcaaccacctccacctggacgacgacgacgacggcggcggcgtagaagtagaaggggactgatgtgaggatgatccatctttttgccacctatagcgtgatttaagattcggccatggatttgcttggcgcagagatgtacatacttgcgtactgctattgcatcttcttcctcttttttttttttaacgagcttgcgagcagatgatgcagagaactggctgtttgttgtttatgcgtttgtacttcgtatactgaagtcacatatga

SEQ ID NO: 30283 - DNA, 607 bp, Sorghum bicolor
  Clone ID: 9852789
ggactagcgatgcgtatcaagcaacaggatgctacaacctgctgtgctcggggttcatccagataagcaatcagatcgccatgggcgccagcatcttccctatctccaactatggtggttcccaatatgacatcaacattttggtctggaaggacccaaaggagggcaactggtggttgcagttcgggaacgactatgttctgggctactggccgtccttcctcttctcctacctggccgacagcgcctccatgatcgagtggggcggcgaggtggtgaactcagagcccgacggcagtcacaccaccacacagatgggcagcggacactttccggaggaagggttcggcaaggccagctacttcagaaacatccaagtggtggactcgaccaacaacctcaaggcgccaaagggcgtgggaaccttcaccgagcaatccaattgctacgacgtgcagaacggcaacaatggtgactggggcacctacttctactatggcggccccgggaagaactctaactgtccatagtgaagattgaaaccgcctatcaggagccctaacacctctttgacacctctgtattaccagccagtaaattagtttat

SEQ ID NO: 30284 - DNA, 622 bp, Sorghum bicolor
  Clone ID: 9852790
cgtgtttgcaatttgatatatttaacatacttccctcacaaaattgtagcaactttgagagaattgactccctgatgctgcagctgttgagcatatcttattttggtgaagttgaacgagttcgtttgcaatgtgctttgacctttcaagtctgtaaaattttccagaactaacttatattatagatcctccatgtgcccagttgttcagttggcatgttagatttgtgaatccagttgctatcttctggtcccataaataatggtactctcgtcacacatgctggaacccggaagcatcacatcatgtccaaccacccaagggtactacagtgctgggtgctgctccactaattgcggtggtacttcttgtgtttctcatgtgcaccaagcttggaccatgcatggacagcctaagcaaatggcgtgaccacaagaggcatttctcccttggtgcatagttgatcgctcgacgccctaaatgggaggaaagtgtgattgatgtctccaaattttggtaagatagtaacaagcttggcctcttgttggcttggttgagttgcctacctgcctggacctgaggcttcaacgagtgtgtcccttaaaaaaaacagtgtgtcaac

SEQ ID NO: 30285 - DNA, 431 bp, Sorghum bicolor
  Clone ID: 9852831
cacggcgccgaccccacaacgacgcgcatcgtcgggacgctggggtacatggcgccggagctcaccgtgaccgccagggcaaccaaggccactgacgtgttcgccttcggggcgctgctactcgaggtcgtctgcggccgccggcccatcgaccccgtcagcggcgtcaacctactgcgctgggttcgagacctcggcgccaggggcgacctggtgcgcgccgtggacgagaggctcaacgggcgctacgacatggaggaggccaagctgctactgtggctgggtctcatgtgcagccagacgcgcccagaggcgaggcccagcatccggcaggtctgccagtacctggacggcgagatggaaatgcaggaggcggccgtgctcgtcttctccgatgtcgtcagctccttcgacttcgggtcgttgccgcc

SEQ ID NO: 30286 - DNA, 573 bp, Sorghum bicolor
  Clone ID: 9852844
gctactacgcagagaagcagctacgatgaacatgagctgatgatccaacaggaaggaggagaaggagagcaagctgcagccgctgccggcgccatcgactggaactttctggacagcctgctgtccgcgacgtcgcaactccatgggccctcgggatccttgttgcagtgacctccatcggtttcatcgtgtttcctccaatcgattgatcggctgctgcagcatgcatcccacacgtggtgcacaccactgttgatccaatggagaacattattcattcatcgggcggcattatatatattattggttccatattaattatatatagtatgctaataattcagatgctcacacatacacacttcagtgtacaccttatgtgttgttacacattatacgtacagagatcgactgtttcacttactcgactcttactgggttgggagtgggagctcatcatcattcagtcagtgttgtttaatttgtggctctctggccttctgccttagattcaggtatacaatatgatgcacagtgtagtagtgagcagtgtaataattaattcagcaggta

SEQ ID NO: 30287 - DNA, 590 bp, Sorghum bicolor
  Clone ID: 9852854
acggtggttaggctagccacaatgggcccgatcgagcttttggcacatcacggcaatgggtccgtgtccggccatgtgagcaaccggacgagcatgcatgcgtccatgtccatgcgacgggacgggattaattaacataacccaaacgccatgccgtctttttggcgcacgcttgcaaagctgaaggatcgaagggctgtcgcatcgtatcgcatggatgccaaagcgaagagaggcagccaggagtcaggcctcaggcccgcaacacgcttgcgcgcggcagcgaacaggggagggagccacgagccagggaccgtcaccctcgaccaccacgcgctggccactcactccatcggccggctggctggccggccgcagcgacgtgtgtgccctccctgcacgcggcaacagatgacgaatcgagttgggagtcgcgaggcatctttctcccgtcccgctcccgtgagcacacacgcacacccgtgacctttgtattgtactactgcactgctgctactactaggaatccaacatcttccgctccgctgccgtacgtgtggtcgtcatcggcatatctacgtacgctgcgt

SEQ ID NO: 30288 - DNA, 461 bp, Sorghum bicolor
  Clone ID: 9852859
cccgcggtgtgggcacccattccacgcgcgctgcgtcgacacgtggttccgcttccacaccacctgcccgctctgccgcgccaccgtcctcgccgacgccgcgccgccggaggagccggcgccggcgcaaactgccaaccaaccgccgcctcagcaaattcagcatcgtacggatacgacgaatagtacggacgcccatacagattctccggtgtgaaaagaaaaacagtcgacgatcagtgggtagtaggcatgaatggtttaacatgagaagtcactttcaaattgcgagtgatcacatcaggtttgtttaggctgtctgtggattggtgttgttcgatttgctgaaatttagcttatactgatactaaaatgttgtgagagaaaaaaatactgtcttttttcttctactaggtgagtgcccgtgcgtgcgacgggataacactcatgtatacatgatg

SEQ ID NO: 30289 - DNA, 301 bp, Sorghum bicolor
  Clone ID: 9852887
gatcatctcatcggtgcctcccataaaaaacttgtgaaaacaaaaacaaagagaaatgatccctccgccgctccactccactccctcggcaagagtgcacgctcttctgacggcatgtggccacccgggcagctgagctagactacaagtgaagctgaagctgatacacttcgcgttactgaaaccgttcgtttgctttagcctctagtaggcatcttctcttcctgtggttgctcgttttggggtaagtagctagtgtggagcaatggccaacgggactgaatccgcggctcgctgctgc

SEQ ID NO: 30290 - DNA, 476 bp, Sorghum bicolor
  Clone ID: 9852913
gcttctcacacgcaaaaagccctttaaccttgatgcgcctgaagatgagaagagcctagcattgaggtttatttatgtgacaaaggagggcaggctggaggagatactggatgatcagatcaagaatgatgaaaacatggagtttctggaagagattgcagagttagcaaagcagtgcttggagatatctggcgtcaataggccgtcgatgagggaagtctccgagaggcttgatagattgaggaaggtcatgcaacatccatgggaacaacagcagaaccctgaggagatggagttgttgcttggagagtcatccttggcaagctccgagattgtcaacagtgggattttaagcatcgagaagaaggctgccaggaatcttgaatcaggacgttaatcagcaggaagtgcaaaaggaaagcgagattacttttttatcgattacctgtgcatacagcatatggtaagataatgtc

SEQ ID NO: 30291 - DNA, 587 bp, Sorghum bicolor
  Clone ID: 9852925
cggcgagcggaaacgccaagaaccaggcttgggccttttccctttgccactcaagtgcgcgcgcaaaacggttccggttttccggctcggaatggcactttgcaactttttttttgtttggtttttttttgcagcgcgcatggcataggacacgctgggccttgattaaccgcaacattggaccgaccaggaacggccacccctcgcgaaataatggattggggctacctggttaatcgacagcgagaatttggattggatcatctgcccggcagtcagggcttctaggcatctcgtcatcagaagggggggcaggcttgcaaggaacagggaaatgggcaagacgacgggctgtatttccccttccatatttcgttcaccaattcccaagtcctctctgtctctgtccctttttactcctcacctcattcaccaagaccttaacccttctctctcactccgactactctttgctgtggcccggatcatggtggttctcttgcttctttctacattagggatgggtaaattcatcacgcaggcaggaatatttcgataggacagttggcgattggagtgcacttaaa

SEQ ID NO: 30292 - DNA, 452 bp, Sorghum bicolor
  Clone ID: 9852950
gaagggtcatcgctcccatcctgacattcctgttctactgcgtcgtgatcccactgtctgttatggtccctgaagtcagtatcccagtctggggaatgttctacattcccactgctatcacggtcatgaacgccatcaggaatccatggtctatccatctggtgccaatatggatcctgttcgagaacgtcatgtcaatgcaccgaatgcgcgcggcactgacggggttgctggagaccatgtacgtggatgagtgggtggtcaccgagaaggtgggcgaccatgtgaagggcaagctcgagatccctctccttacaccggtgaagccaaccgagtgcgtcgagaggatctacgtgcctgagctcctggtggcgttctacctgttgctatgcgcgtcatacgatgtcgtgctcggaaccgggcactgctacctgtacatcttcctccaggcc

SEQ ID NO: 30293 - DNA, 575 bp, Sorghum bicolor
  unsure (1)..(575): unsure at all n locations
  Clone ID: 9852955
gcgcctacgaccgcgccgcgttccgcctgcgcgggtccaaggccatcctcaacttccccaacgaggtcgcgttcggcgccgccgcacggtgggcggcggcgcctgctgctgctcctcagcccagcgtgaccgtggccgggaacaagaggggccgggcgaggtcgccgcaggagcaggacgccgggtgcttattggtcagggaggtgaagaaggagcgggttcaggagcccgcagcggcggcagcgggttgtggctgggatggcaaggatacggcggcaagcggcggaggggcggactacttctgggaggacgagtcgctgaagggggcgatctgcagcctgccgccgctctcaccgttgtcgccgcacccgcacctggccgtcccgcagctctccgtcagctgagacctgagatgtggcagcaagacagcggacggtggtcgcttaattaactgattagttagtcttagtcttaatctattttttgagttctttgattatgctagagaggagtgtacaggtccaaatgtctttcgttctttaattaggccctgttcactnctgcccaaaagccaa

SEQ ID NO: 30294 - DNA, 490 bp, Sorghum bicolor
  Clone ID: 9852958
agtagcaactctatctatctctgcatccatcactcatcgatcgtcatatactaaatagtaattggttgactagatagatggcatatattcctgtcccctcccaccttaattcgttagctttgttttttcacaagctaaatgaattaatagcggcgtcgcgtgaggtggatggagcaccacgcacgcatgattctagtctagtctagtaggaataacaaagaagtgtcttgtttggtgttagttgcttctgctatagttagtatagtgggtgctgttgctggtatagctagctttatacttagtattgctgattgtattaattaattgtcagtcaggggaagagccatcattagatgatgatgacatgacaccacgcatacacatcccagtttatttggatgtggattcatgtatatatatatatatatatatatatatatatatatatatatatatatatatatatgcacatgccacatgatggatctgt

SEQ ID NO: 30295 - DNA, 706 bp, Sorghum bicolor
  Clone ID: 9852987
cccggaggccaacgccaaggcgatggagagcgtgcgtgccgacaaacttcgcgaagtcaaagccggacacgacggaacatgggtcgcccacccggcgctggcttccatcgcaagcgaggtcttcaacgagcacatgcctaccgcgaaccaaattttcattcgaccggaggtggacgtcaaacgcgacgacctcctcaaccccgttgttcctggcaagatcaccgatgatggcgtgaggaagaacctgcacattaccctcgcgtacatggaaggttggctgcgtggcgttggctgcagtgcgatcaactacttgatggaggatgctgccaccgccgaggtgtcccgcacacaactttggcagtgggtccgtcacggcgtcagtaccgccgagggcacgaaactcgacaagacgacgatgctcagcatactcgacgacgtcacgaacgaactaatcaagtccgcgcccgctagcaacaagtttgagttggcggcaaagtacctacggccgcaagtgacaggtgaggattacgccgactttgtcaccactctcctttacgacgaaatcacatccattggtccgtcctggaaactttagaagagggtatagctatagagatttatatttaacgaattcacgtttaagaactttaagaactatctactagtaaactgcatacaagtagttaggcagcaagtaataacgaag

SEQ ID NO: 30296 - DNA, 558 bp, Sorghum bicolor
  Clone ID: 9853011
cgcatgacgagggcgacgtcgcggtcgagctggcgcgccttgtcccggaggagcgcctcgcgggtcttgaggcggagcagctgcgggatgaaggtggggagggagacggcggcgacggaggcggcgaccgcggccagcgccttggcggcggtgatggccacgaggaggcggcgcgagtccgggcgggcgtaggtgaagacggcggcgaggtggacgaggccgcagaggacgatgaaggcgccgaactggaggagcacccagcggagcggcgcgaggtcggcgcaggtggcaaagtgcagcagctccagcgggatggacatgtaggacgccccgatgaggaagtcgctcaccttctgccactgcaccagcgcctccaccgcgccgtcctcacgcccgtcgcagccgccgctgcaccgcgcagccattgatgatcccgttctctgcattccttgggagcacgcagctacacaaattgagacacacgatatcaagcactgctcatgcagctagacagatcacctgttgagtcatggtgggatgatgtatgtaacagatgaa

SEQ ID NO: 30297 - DNA, 692 bp, Sorghum bicolor
  Clone ID: 9853020
ctggctgcaattgacttcattgtttgtgatgagagtgatgtctttgttacaaataataatgggaacatggccaaagttttagctggccggaggcgatacatgggccacaagagaactattcgcccaaatgcaaagaaactcaatgtactatttcagacacggaatcagttgggctgggataccttttcacggaaggtacagaaagttcagaggggtcttatgggtgagccggatgatatcagaccaaaacaggatgacttccatgaatttccatcatcttgcatctgcttaagaaaacctagaaatatatcggtcacaacctgaaaaccggacaccgcaaatgctgtagacaacacaaggatgaaaacatatgattgctttgaaagaaacacggtggaattgacagggcagggatgcagagtgcatatacaacgaaatagatgacatggctcagtagagatgccatgtctcggcagatgccacgtcaaggagagttgccaactggtgatatgccatgcctgtaaattattgttcgtaaatgagattattagttctttgaatatggtgtgcctctaccctctataacatgaccatctgtccaagtaaagtctcagggcagttacaattatctgccaaaatgacaaatggacaagtacaataacaatggttacccctcttttgtgattatggta

SEQ ID NO: 30298 - DNA, 640 bp, Sorghum bicolor
  Clone ID: 9853053
cttattccgtaagatggcaaaggatgttttgtttgccaaggacatatcactcgtcaagaaaatccatatgctctatagcttcttctctgtgaggagagttgtagcgccaacggctgcctgtattctcttcaatgtcataatccccatctcagtcacagtcccggagctctacttaccagtgtggggtgttgcctatattcccatggtgcttaccatagtcacagttataagacatccaaaaaatctacacataatgcctttttggattttgtttgagagtgtgatgacattgcatcgcatgagagctgcagtgactggtctgctggaattagaagggttcaaccagtggactgtgaccaagaaggtggggaatgatctcgaggacactgaagttcctttgcttcagaaaacccggaaaaggctaagggacagagtcaatttccttgagattggattttcgcgtgtttctcttcctctgtgcgtcatacaacctggtgttccatgggacaagaagctactacttgtatatgtaccttcagggattagcatttctgttactagggcttaacttcactggcacttgttcttgttgccaatgacagcatgtcaaagctgtatgcaattgctgatttataatcat

SEQ ID NO: 30299 - DNA, 411 bp, Sorghum bicolor
  Clone ID: 9853066
aaatacaaagcaggcaagagactagcacaatacaggtttgtgaagagagctcggagctctgctgtactgcttcgaagcacatggaagatgataatgttgataaagcttgcgtaagcgatacagatccaataccagttacagagaacattgttgagttggatgacgagggagtcgatatccctacagtcagggacactgagtgggataatccccattcttctgaagtgtctgatgtaagggaagtaaccacagaacctgaagaaaacagcttggatattcctgtcgatacttgatgaccaaccttttattttgtgagaattgcttagaaggtttagctggactctgaacattcttgttctccgtgatgagttgtactagtagattctcattttagttcatcattacattttg

SEQ ID NO: 30300 - DNA, 637 bp, Sorghum bicolor
  Clone ID: 9853073
caaggtgggagttcacagcatgctgtcattcaaattgaacaacctggcgaagaagagacatcacctttggtatctgcagcatctaccaacaatgcagctttggatgaggagcatagacaaagttcatcatcagagcctctggattttgagatgtttgaatctacaaggggcatcaagttgggccttggcgattttgttttctacagtgtgcttgttgggagagctgccatgtatgatctgatgactgtgtatgcatgctacctcgccatcattgctgggcttggttgcacccttatcttgctttccatatgccagcatgcgctacctgcactcccaatctctattatgctgggagtgacattctacttcttgacacggttgctgatggagccatttgtggttggtgcttcgacaaacttggtgatgttctgactattcactgatctgttgttgtcatttacatgtggatgaagacctcaaccgaaagaaagtggttggtcagcaactcagcattctatgtgagagtgactaatattttgttggtcacttgtgaactgccattcgtatttattgctaggaatgcttaagaccatagactctgaggtagcatcgtagatagatttagctcgtgttctgt

SEQ ID NO: 30301 - DNA, 615 bp, Sorghum bicolor
  Clone ID: 9853075
ttgaaaacaggccattaatggttggtgaagatttaacagaaggtgaggcacatgttttggaagaatatggttgggttagaaacactgggcttggcacgatggtcaactaccgtgatcgtgtggtccatgacaggtggactgagaaatgtgttgctgattggagggcgaagatagggaagcttctaatggttggttatgccgagggccaatcagtcacaactcatggtccgaagaaaatagtggacctgttggaagctactggggatgctgaacttgaaataaagttggaggatccttattgagagatcccttgtgtataggtacaatatgtactttgtagtcgtacgtatagtcctgaatgcatccaaataaactttaggttgtacaaaaagacttgcaacttatctgaccttcactaggctagtgatcggtaacctttttatgtgtgccagtgccagtgccactgtagtttgggacatagctatctcggttgttgccaggacactttaggtaggttgatgaatgtacttggttcgtagcgatatgagcaccctggttgcagttctctgatgaaataacgtggcacttgtatatctgaattgtaaactgaattcg

SEQ ID NO: 30302 - DNA, 652 bp, Sorghum bicolor
  unsure (1)..(652): unsure at all n locations
  Clone ID: 9853076
ttccgggaggatgggcgcagcacagcacttcgtctagtggacatggaggctgcatacgtgacggtggaattcttccggaagctccctcaggatcctgctgatcctagtagtaaggtcggacctaataaacctccagtggagccgtcgccgacgccggaccgctatggtgatgggcacttcaggaatattgcctccaacgtgtcccagtacattcggatggttggagacgaactcttgcagaagatccccaaggcagctgtccactgccaagttcgcgaggcgaagaggtctctgctcaaccatttctacgtgcagatcgggaagaaagagggtggggagtttgggcatatgctggatgaggacccggcgatgatggagcgccggcagcaatgcttgaagaggctggagctgtacaaatctgcgagggatgaggtcgattctgtggcatggagcagcagcagataagcgatacagaggatcggaattgggcatacatttttgggctattagcgctatatacgtagcttttatataggtactatacatatactgtagtcacgatcttgctgctagcaatacacatgacatacttgtatgtaatagtcgtactttattagtagggatagggatattcttgttgtgtatattncgg

SEQ ID NO: 30303 - DNA, 578 bp, Sorghum bicolor
  unsure (1)..(578): unsure at all n locations
  Clone ID: 9853079
agcctcgtctccaactactcggccgccatccggagcctgtacgcgctgggagcgcggaggctcgccgtcgtcaacgtggggctcgccgggtgccttccggtggctcggctgctggacgccacgggcgcgtgcgcggaggaccgcaaccggctcgccgccggcttcaacgccgcgctgcggtccctgctcgccgacgacctcgccgcctcctcttcctctgggttgccgggcctcgcctactccctggccgactcgctgggcctcatggcggacaccttcgccgaccctcgggcgtcagggttcgtggacgtcgccgacgcgtgctgcggcggcggccggctgggtgcagaggccacctgcgcgccaaacgccacgctctgcgccgaccgcgggcagtactacttctgggacaacgtgcaccctaccgagcgggcagcggcgctcagagcccatgcattctatgacgggccggcccagtatactacgcccatcaacttcaagcagttggtccacatgagctgatggattttagcccatttgcttatccattcatncagggacnccagtgaaataattaa

SEQ ID NO: 30304 - DNA, 275 bp, Sorghum bicolor
  Clone ID: 9853082
tcgagcaggtaatcagcggggggcgcacgatcacggaggagagcgaaggtaccaggggcgtgtcggagcaggaacggtccagaggccccacgccatgacaacgacgacgacggtgcaacgccacgcgcatacgtacatggcaaaattgtttcctttattttgctcgaattttagcatcaccttcattgtctagttggtgtatctaactcggcctggcattagtatcgaaaaaagggggaaaaaaagatcatcctggcagcgactcagtctcaggc

SEQ ID NO: 30305 - DNA, 673 bp, Sorghum bicolor
  unsure (1)..(673): unsure at all n locations
  Clone ID: 9853097
tgcgcatgccccggcggagctggagctgagctgggtggtgatcgaccccagcagcgggcgcgcggtgaacgtgtccagccgccgccccgtcgccgtggacaggcactggtacacgggcgacacgctggtgcgctacgcggtcgtgctcggcggctgcaagttcgaggccaccgtcacctgctcccaggagaccgggcacgtccgggagatcagcctcaccgtcgaggacgccgacggcgcggccgtcagcggcgaaggcaccctgcggctgctcgcggcggccatggcggggccgaggaaaggagcggaggaggagcaggtggagacggccaagcggaggtacgaggacttcgtgaggagcaagaggggcaggaaggagtccaaggctaggaaggaggtgctcgtcgatctctgctgctccgccgtcagcgccgtcgccgttctcagcttcatcgccaccgtcgtgctccggtagagctgacgatgcacgatgcattctcatcctcaacgttatttatttaggagttcttagcatcatgtgaatacctctggccgggagagttctctttctttctttctttcaatttggttgctattttatttattaggtacagtacagtgctaaatttggtgatacagcatgtacaacaattttnccagtgaaaccaaagag

SEQ ID NO: 30306 - DNA, 421 bp, Sorghum bicolor
  Clone ID: 9853106
ccttttgcctttcaatattttagtctatctaattgcagttttagagctgcacattggattagacagaggagcagagcatcaatgaggcatcggtgcgaggggccaaccaacaaccaggaagctaggggtgcttcctcagtcctcacgctgccgagtcgactgctggatggttcaatttcagatgtcattggccttagagcccacttacaacaagtctgatgatgccctctcaaacttacaaactagacttacttgaccatgtacgtttatgactgtgcatcttagattgcctcatatattgtattaattcgaaggtgaactgaatgacatatctctaaacaaccttacgtgttgatggtagatttttaatcattggtttttaaaggtggtgcttagtaaagtgaagtataagttgtacttg

SEQ ID NO: 30307 - DNA, 264 bp, Sorghum bicolor
  Clone ID: 9853116
gcacgaggggcgctgcttctgggcgtgatggaactggagtggtgggtggtgggcgagacgtgccgctgctcgcgccacgctaactgcaaccgggtcaccacgccgatcgctgggcaacaggcgttccggtgcgagtgccccgaggggtacgacggcgacggcttcgccgacggcaccggttgccggagagctcgcgccatcagaaatggcttgtaccatgggctcggctatgcgctatcaactggccgtaatcatatcgtcgtc

SEQ ID NO: 30308 - DNA, 558 bp, Sorghum bicolor
  Clone ID: 9853124
gcacgaggctcatcatcacttaataaaaggcacgctgcaggcaggctaattttcagagtagtagaggagatcgagcgaggagtggagctgaggcacgtggatcgaactaattaagcagctagctagcggatcgaagaacataataattgattaattagccgatcgaccgcgcatggatcagcaggaggagtcttgtgttcccccaggcttcaggttccaccctacagaggaagagctggtgggatactaccttgccaggaaggtggcctcccagaagatcgacctcgacatcatccaggaggtcgatctctacaggatagagccatgggatctgcaagagcggtgcaggcagcacgccggcggtgggcacgacgagcagacgacggagtggtacttcttcagctacaaggaccgcaagtaccccagcgggacgaggaccaaccgcgccacggcggccggattctggaaggccaccggcagggacaagccggtgctgtcgtcgtcgtgcaccaggaccagcaggtgcggcggcggcagcagggtcgtcatcggcatgag

SEQ ID NO: 30309 - DNA, 175 bp, Sorghum bicolor
  Clone ID: 9853130
gcacgagggtcttctaattctctcgagtccatagcttttgctcttcatctctcatgatcacaatgcttgcagctagttctgtagtgaacaacaaccttgcttgctcatcaaggatatcatcctgttcggatttcacatctggccatacatggcgtcccataaaggctgtgaaact

SEQ ID NO: 30310 - DNA, 522 bp, Sorghum bicolor
  unsure (1)..(522): unsure at all n locations
  Clone ID: 9853133
gcacgaggcctcgtgccgaacggcacgaggtgccgatatatatgaccgagagagggacagatatagcgacctggcttccttgttgggagaggaggagcgcgaccaccattgcggcgcagcaaagcagctgcagcagcgaccatgggctcttcctcttcatggctgatgctagctctccccgcaccctgaagcctgaactgaaacctccagcaagacggaatgatggaacaagtgaaggagagtcaagagtgagcgagcgcaggtggtgaatcggccggccttcaaagctagctatatatgtgtggtatacctagtagtagctctttgcgacctgcaggccaggggaggggagtggagggccaagcagcggttagatcgggacaatatgcttgcggcggttttggtagctttctggcggcgcctgccggccatgtagttcaacaataatagtgaaacgaacgggacgacgaacggtggttangctagccacaatgggcccgatcgagcttttggcacatcacg

SEQ ID NO: 30311 - DNA, 372 bp, Sorghum bicolor
  Clone ID: 9853135
gcacgaggctgacacgcatgcaccgtcgccgccttatttttgtgcttcctggattcgtcccttcccttctatattttccgccggcgcgcggcgagatcgatcgctgaaatggcgattcgcgttcggcagggcatttggaggcgtcgacgacgcgtggcttcgacgttaaccgtgcgccgtcgctgtccgtggccggtgccgccgcggcggaggaggacgaggagcacgacgaggcgggcgcggcggcggcgtcgtcgtcgcccaacaacagcgcgggctccttcccgacggacttctccgcgcagggcggccatgtggcgcccggaggcgggggcgaccgcggcgcgtgctcccgcgccagcgacgacgacg

SEQ ID NO: 30312 - DNA, 423 bp, Sorghum bicolor
  Clone ID: 9853140
gcacgaggaggagtagaaatactcctataaacgaacccacgcctccacgtcccacctcctagatcgatccatctccctaacttcccgttccgttccagtcgcattgcatgcctctggatcactctacatcgatcttggactagtaataatggatgaggccatgagccccagcccgcgcgccggcggcggcgccggcggcatccactgggaggcacacgggcggctgctcacggcgtgcctcgtcgcgctcaacgtcttcctcgtcctcctcgtctacgtctacttctggcgcttcttctcgcgctcgcgctcccgcggcggcggcggcgaggacgacgacgacgacgcgtcttcggtggcctcctcgccgccggcgtcgcccaaggcccgagaccggcgcgaggtggagctggccatcaccgg

SEQ ID NO: 30313 - DNA, 304 bp, Sorghum bicolor
  Clone ID: 9853147
gcacgaggcgctcctgctgcgtcggcgccccttggaaaggggaaaggaagggtcgccgagctcgagcaggagttgcatgaatatcagtacaatatggggcttcttttgattgaaaagaaagaatggacagcaaaatccaaagaaatcactgaagtgctgacgcaaaaggaggagatattgaagagggaacaggctgcacatcttaatgctatatcaaaatacgaaaggcgggaggagaacatgcggaaagcactgggtgttgaaaaacaatgtgtggctgatcttgaaaaggccttgcgtgata

SEQ ID NO: 30314 - DNA, 314 bp, Sorghum bicolor
  Clone ID: 9853174
gcacgaggcacgcgatcaggcgcgctctcagcgcgagcatcgacagcgtcgggagcgacggcggggacgatgaggagttcctgaggaggatccaggagctcgcggcggggcagcacccgggcggcgccggcgggtggccggcgagcgtggagcggagcgcgagcagcgtcgggctcccgctgtccctgcggatgctcaagcggaggaagcagcagcagcagcagctggagcaggggcggtgggacgagcggctgatcgactgcgccggcgagtccgcgcgcgccgcggtggggcgcgccttctcctcgatggtg

SEQ ID NO: 30315 - DNA, 122 bp, Sorghum bicolor
  Clone ID: 9853175
gcacgaggcttgatcagatggttaatctcattgtagagaagttgcagagttggggtattgacagaaaggtaactgctgttgtgctagacaactgcaacggtggtgaaattgttgccagagag

SEQ ID NO: 30316 - DNA, 295 bp, Sorghum bicolor
  Clone ID: 9853196
gcacgagggcgggactggccgcggcatgcggacccgtgcgcagcgtgggcgggcgtgggctgccgcgccggccgcgtcgtctcgctcaacctcgtcgggctgcggcgcacgcggctgggccgcctgtcgccgcgcttcgacgtcgacgggctgcgcaacctcacgcggctcgaggccttcaacgccgcggggttcgggctccctggctccatcccggcgtggctaggcgccgggctcgcgcccactttccagtccctcgacatctccgactgcgccgtctccgggaatatcccgg

SEQ ID NO: 30317 - DNA, 530 bp, Sorghum bicolor
  Clone ID: 9853201
gcacgaggcatcaccggccacctacagaaagctaactagctacaagctactgcatagagctgatgatgacgaagtactcacctgcaaggctcctctccattcgatctctcctgctctgcctcccggccgtctgggtgctagccgccaccgccggcgtcccgccggcgcaccggcccgcaagctgccaatccaggtgcggcgaggtcgacatcccgtacccgttcggcgtcggcgatgactgcgccatcaacgatggcttcaatctcagctgcagtcttgtcaacggcaccgaaaggcctttcagtgggccgttcgaggtgaccaagatctccatggccgacgccaaagcctggataaagatgaacatctcttggtggtgctatgattctgacacgagccagatgaggcagggcacatggggaggaaatttcacaaactcggcattcaggttctcacacgaggataacaagatatttgtaatcggctgcaacacgctcgcttatatcacgagcgaatattacagcataggt

SEQ ID NO: 30318 - DNA, 234 bp, Sorghum bicolor
  Clone ID: 9853202
gcacgagggccaccgagagggaacgcgaggtcgccatcaccatggggggaggagtcatgcgcaccgccgcgaaggtcggcatcgccggaggcgcggcggcggccgcaaatagcggccggttccgccacgccgcaccggccttctccacggccgccgccgccgctggttctgaggcggcgccgcttgtctccgcctccggtggcgaggcggtgccccccgctacggagcagtggg

SEQ ID NO: 30319 - DNA, 303 bp, Sorghum bicolor
  Clone ID: 9853214
gcacgaggctcctgccttcgcctgcccgcgaccacccacacatacgactggaccgcacaccctgctctgttactgcacccaatccacgcctttattctcccccacccccgtccccttcttccgcccagtcgacgcctacgtccacattcacgtcccacgtctccaccgtgcatctttcccgccctgcagcgacgggcaaccaccaccactaacattgcaactaccattcaccactctcgctgccactccaaccccccaaaaccacccacgcctgtgccagcgctggaaatcacttccgactcc

SEQ ID NO: 30320 - DNA, 568 bp, Sorghum bicolor
  Clone ID: 9853221
gcacgaggatccacccaaagctccccggccgctgccgagatgtccgacagcaacgagttcgccgagctgctatgggagaacgggcaggcggtggtgcacgggaggaggaagcagacgcaggccgcgttcccgcccttcacttgcggcgctgccagcagcagcagagctcaagaaaagcagccaggtaccgacccggtggcgctgctcaagacgggcctctttggcgacttctcttccggcctagacgccacccgagacaacgttgatcttgatgacaccgtaccatggatcaactaccccatcgtcgaagaagacaccgccgcacctgccctcgcagagagctacagcccagatttcttctcggagctccatgcagcggcagttgcagcggcggcgacgaacctcagcgctctgccaccaccagtccagcacaccggcaacaacaacaacagaagcacaccggttgccaccaccagcagaggaccagaacccgcaaaggaaacccaccgcataccgattgcaggtccagccaccaggcctgagccacaagctgagttcgcggccacca

SEQ ID NO: 30321 - DNA, 576 bp, Sorghum bicolor
  Clone ID: 9853241
gcacgaggagcaggagccctcaagaagggcatggaacagggttatgcccaagaatgtgattttgtcgccatctttgatgcagattttcagcctgatcctgacttccttttaagaactataccatttcttgtgcataacccgaagattgctttggtacagacacgttgggagtttgtgaactacaatatttgcctactgacaaggatacagaagatgtcactagattatcatttcaaggtagagcaggaatcaggctcatctatgcatgccttctttggtttcaacggtactgctggtgtgtggcgggtatcagctattagggaagcaggaggatggaaggatcgcaccactgtagaagacatggacttggctgtgcgagcaagtctcaagggatggcaattcctgtatgttggtgatataagggttaagagtgaactcccaagtaccttcaaggcctaccgccatcaacagcacaggtggacttgtggtgctgccaacctcttcagaaaaatggccggggacattgttagaagcaagggggtaactgtatggaagaagcttcatcttctgtacagc

SEQ ID NO: 30322 - DNA, 425 bp, Sorghum bicolor
  Clone ID: 9853247
gcacgaggcatctctccagctctccactcgatcgaccaccgcgcgtcatggccttgttgcgcgagcacctcgacctcatccgcgcccacctcctcgacgaccaccacgtcgccgtgaccgtgagctccgatgactcggcgtcgttgcagtcgtcatcgccatcgccatcgcaatcgccgccggggcgtagtaggccgctgccagcgctttccgtctcgctgcccccgaggccaccggcggtagacctgcagcagcagcacctgtgggcgccggcgccgccgccgatgcagattcatcggcaggagcagcagcactactgctacccaccggaacccgaggaggaggaggacgatttccggcggtaccgcggcgtgcggcaggggccgtggggcaagtacgcggccgagatccgggaccccgcgcgg

SEQ ID NO: 30323 - DNA, 434 bp, Sorghum bicolor
  Clone ID: 9853250
tccacacatacacaacacacaaaggagcagaagcagctagatagctagggagaccaaactttcgcaagaaataaaccactgcctgaatcatctcctttgatacagacaacaacagaaactgtgtatggagcaagaagaggtcgggctagccctgggcctctccctcggctccggtcatcaccagcagctcaaggaacagccaccgccttcttcgcatccatgtgcgctgttggagccgactctgtcgctgagcagcctcccggccaaagatggcctgacgaccacaccgatgaggaggatcgctgccgtgaaaagggagctgcacgtggaggaggacgatgaggccaccgacagggcgcttatttactcggtggcatcgtcggcggtggtcactgccgacgacgacgaagggtgcaacagccggaagaagctga

SEQ ID NO: 30324 - DNA, 479 bp, Sorghum bicolor
  Clone ID: 9853252
gcacgaggaacgaagaagaggcagtctccaagtacctccactccgtgccaccgaagtacatccaaattgctctctccatagagacaatgttggacctgtccatcctcacttgaggatgtgacgggccgtctacgggcggtggacgagcgcatggagcaggccacagcaacgacggacagcggcaagctgctgctgacagaggaggagtgggctgcccggatgaaggagaagaagtccggggaagcctcctccagccgcggtggcgatggcaagcgccgtggcaaggcttcttcggagaagaagaagaagaagatcgaccccaacgcttgcaggcgctgcgggaagacaggccattgggcaaaggagtgcccaaatcgcaagcaggagaagaaggccgaagctcatttggcgcaggctgatgatgatgatgaggctactctcatgatggcgacgttctgtgcactgcacgacgttgaggc

SEQ ID NO: 30325 - DNA, 516 bp, Sorghum bicolor
  Clone ID: 9853264
gcacgagggtcctcctcctcctcctcctcctccttcctgatcgaacccgctttatctccgtcagccggactcgccgaattctccaaaccctagcgccaaaatccccactccggtagccgcaatcggagccggattctctcggtttccggctggcgccggtatcgcgtgcgtctgcgcatgatgcagcgagcgcgctcatgaactcgatggacgaaatcaacctgcttcggcaggcgcagcggcagcatcagcaccacctcatggtgcgcggcatcggcgaggagatcgacctcgagatcggccccggcgacgacccctcgttctccggggcttccttagttgccgtcacgtccacgcacgacgccgtcgtccacgccgacgaccacaagagcctcctcatcccgtgttctcagaccggcgcggcggacgggctggcgccgcagcagcagcacctggcgcagggggaggaagagcatgacgggatgctcaggcagccgtcggggcacaccaagaaga

SEQ ID NO: 30326 - DNA, 575 bp, Sorghum bicolor
  Clone ID: 9853277
gcacgaggctcgagtgtaatcagatatccaccgtcttcaaccttgagaaagtttaaaatgtctcagtcaagatcaatactagacagtattgccatcctcggcgccggcaacgaagcatcccgccggattctaactcaggatgccgtcaagttcctcgctattctacaccgcagcttcgagccaactcgcaagcatctcctgaagctccgcgaacaacgtcagattgaaacagacaaggggcgcttaccggatttcctcccagaaacccagcacatccgtgatgatgagaagtggaaaggcgcggcgcctgcgcctggattggttgaccgcagggtcgaaatcaccggacccacagaccggaaaatggttgtcaacgcgctcaactctgatgtgtgggcttatatggccgactttgaagattccaacggaccaacatgggacaacatgattcacggccaagccaacttgtacgatgccattcgtcgccaagtcgatttccgactcggggagaaggagtacaagctcagaaccgaccgcgctcttccaacgttgatcgccagaacgcgcggctggca

SEQ ID NO: 30327 - DNA, 506 bp, Sorghum bicolor
  Clone ID: 9853295
gcacgaggcaggaggcatgaggcggagtggctggcttggttcctggtgccagctccattgccaaggtcgtcttcgtggtcctcacctctgccgacaagatccgcaccgctgaggacctcctgcctcctctccctcctgtcgcacccggtgccggacatgcatggcggtgaaggccacttcaccgtgttccgacaaaaggccgtcctctccaacgaccccaccgcgcggcttgaggcaaccacgcacttcagaaagctgctctcctcggttgtgcctctctttgtcaagctcctcaactctcacatcaagaattttcaaaaacaggctatatggctttaggtactgttggtggtgcctctccaaagtgttgtgatctggtactatatatgactcaatagagagctatttggggttatgattcagttttcacgtgagtacatttgttgatcttaggcatataatttccttgtgttggttaaagtgtgtttctaaaccatcattttggt

SEQ ID NO: 30328 - DNA, 462 bp, Sorghum bicolor
  Clone ID: 9853296
gcacgaggagagcaggatccgcaggccgttgaagtactgaggaggagcaccggtggacgatgacggcgctctgaatctgccaccgacgcggtagaatccgccgccgcctgatcgggaggtggcagagggtgatgccactccatagcccagctggaagtgcaggatgaggctcatgtgctccccatgctggcatctcgactctgacgtggattcccgccacatcttgccgttcatcatctgacgagagatcggtcagccaattttaaacatggaagcacgcatttttataggaacagagctcacctgcacgatcttgttgcacgcagcgatgcttagccgcgtctcggagctgagtgaactgctgctgcgcctgcatcagcgagagcagccccgcgacggagtgcatcggcctcagcacgctgtcgcgcatggcgctctgcgcggcgtccctggccccggtgg

SEQ ID NO: 30329 - DNA, 464 bp, Sorghum bicolor
  Clone ID: 9853298
gcacgaggcggaaacatcccactccccgggccaccaccacctgcctgcccgtgcccactgcccagcgcgcaccatccccgcctcttctccccagctaccgcgccccccctccggccctccctcttcttccctgtctgctcgaccagcaggggctcagctacctgggcctggctattcgctccgctctccgagtacggtagcctcagcagctggaggatctcgcctgggcgcccgccggacgacgggagagattctgtttgatcttcataaactactcctagacaactagaagacatattcacacatatcagcaatcaaattgcaaactacgaattgacttcaaatttgacatgcttgtcttaccagaagcaattgataacttggagttgtagtctaccggactctctagtgaaccagtatggctgacactccaacttcccgcatggtgcacccctttggcgacg

SEQ ID NO: 30330 - DNA, 512 bp, Sorghum bicolor
  Clone ID: 9853303
gcacgagggagagaactagtctcgagttttttttgaaaatcttgtttcttttgcttctttgctgccctacattgattacactgctgcactaaccaatgtctgaaacatattgttcatgggtacagcctcaacatgcaaggagattgctttatgtcttcttccctgtttctgaatataacttattaatggttttgggcaaggttcatgacttaaatatatataataaggcgaagttaattacttgtaaactaactttttctattacctactgtggtaggcctgtttactggttttccacagaaactgcagctaaagttttgacatgccttgatttgaaattcatatggttgttcgtgtcatatggaatatgtatgatgctattttgggtaaaaaccaactagtccttgttgccacctgttctactcagtggctattgtttatttattgcaccatatagagccaattagtgtcattagcttgccaggaggactgcaaactatcctggagagcag

SEQ ID NO: 30331 - DNA, 591 bp, Sorghum bicolor
  Clone ID: 9853305
gcacgagggtcgcgttcacacgcggacgcgactgcctcctcctcccgtcgccatggacgtctgcgcctccacgatctagtgcgggtggctagcacgccggcgccagctaccctgaagggaggttgggcgttgtatgccgagattttgtgctctaggcgctcgagctggtgcgggtgcggcgcgtcatggggaggaagcctgacgcggcagccaaatcgtactactccggtggcggcggcgccggcgcctcctcgccgagggcagcgaggaaggcgccgccttctccggtgttcctgggaactgcgctgttcgttctagggttcgtgtccctctttacgggacacgtggtcactgacgctgactgggcgcggatccggagtcggtggcgatccaagcagcatagaaactacgagcctatcgatatttgggaatccaagtattccagcatgtactatggatgcagtgggagaagcgcagatttcagatctgctgtgccagagaacagttccactggttacttgttgatagctacaagcgggggcctgaatcagcagcgcatagggataacagatgctgttgtagttgcctgga

SEQ ID NO: 30332 - DNA, 533 bp, Sorghum bicolor
  Clone ID: 9853309
gcacgagggtgatctggctagcttagagggaaagaaatttgagggtgtgctagaggagtttgcaagtcatgcattcagtctgcgatgcttcttggagtgtttacagtctggtggagtttccgcaaatgaaattactgataatgctggtgaagcaaagactccaagaagctctgttcatgatattgacaatgccgctgaccatttggccaaggtaaacattgagggtgttgctgacaataatcataatgaagtttccgagcataaccagtgtgtaggtgatttagatagtagtgatgggaatatactatcaccagctttggctataccggaacatgcagaaagcatggcaaaaaatgacgaggagaatgattcaaccgtgcagctagatgtttcaactgaatctcgagttttgaagaacaaaaggaagtacaaagttgatattcttcgatgtgagagcttaacctcacttgccccagctacattggaacggctattccttcgggactatgacattattgggtcaatggttcctc

SEQ ID NO: 30333 - DNA, 561 bp, Sorghum bicolor
  Clone ID: 9853314
gcacgaggaacaggtttactggcaagctcccgccggaccttggaaagtactcaggcttgcttattgttgaggctgattacaatgagctcaccggtgctatccctgaagggctgtgcactggaggcaagttccggttcctcaccgccaagagcaacaaactgaacgggtccatcccagcaggcctggcaaactgtacggctctcaaatcgctggctctagacaataaccagctctccggcgacgtgccagaggctctgtggacggcgccgctgcttaatttcgtgacactacggagtaaccagctctccgggagtcttccggtcaccatgcccagcaaccttacaacgttagccatggagaacaacaaattcggcggcagcgttccggctactgcagttgcgctcaagaaattcacggccgacaacaaccagttctccggcccaataccggccagtattggtgacgggatgctgcagctccagacactgaacctgtccggtaacctgctctccggcgatatcccgacgagcgttactaagctcagccagctgacgcagatgg

SEQ ID NO: 30334 - DNA, 519 bp, Sorghum bicolor
  Clone ID: 9853334
gcacgaggagtggccaaaggacaggataatggttcaagtgctggacgattccactgacccctttatcaagaatttggtggagcttgaatgtgagcactgggcgaacaaaggcgtcaatattaagtatgccacaagaaccagccgcaaggggttcaaggcaggggctctgaagaaaggaatggaatgtgactatgcaaggcaaagcgaatacattgccatatttgatgctgatttccagcctgaaccagattttctgctccgaactgtcccattccttctgcacaatcccgaagttgcacttgttcaagctcggtggtcctttgtgaatggcaccacaagcctgctgacaagggtacagaagatgttttacgactaccacttcaaagttgaacaagaagcgggatcagcaacctttgccttcttcagtttcaatggaactgctggagtgtggcgtaccatagccataagagatgcaggaggttggaaggaccgaactacagttgaagacatggacttggc

SEQ ID NO: 30335 - DNA, 619 bp, Sorghum bicolor
  unsure (1)..(619): unsure at all n locations
  Clone ID: 9853345
gcacgaggctcttcttcctcttgtccggccggctggcaccggcaggaagccatggcctcgaacgggagcagcagcacggtggtggacgagatgcagagcagcttggacagggtgcggcgccagctctcctccacctccacccgccacctcctccagggccctctcttgaagcgatccgacacgctaagaaagtggaatgagcgctgggtcatacttgatccaacaaccggaaagatagaatacaaggtccgtaggagtgacaaagatgttaggggagtgatcatgttcgattcaacaagcacagtgacgttatcgcctatgaacttccatggactggcaaaatacgatggatgctgtttctatattggaactccacagaaaaaggaatactttctttgtgcagaaactcccagcgctgcaagagcatggtgcgactcagttggtactacaggctcataaggaggcggtgaattcattgngtgagaatggtcctgcaaaattgggaacagttgcaactgttgtggctgtagccaatgccactgcaattgaagcaacaaaggaggtagaagctgcaatgaagatttccctacgggcagctttgggctcaactacaaataaa

SEQ ID NO: 30336 - DNA, 581 bp, Sorghum bicolor
  Clone ID: 9853350
gcacgaggcgatagcgaagtagtaccgtgagggaaaggtgaaaagaacccccagtgggtagtgaaatagaacgtgaaaccgtgcttctccctctctctgtcgcgatgccgggccgtactggctggcgggtggtgccagtggccggcggcgtacaacatcctcgcagctaggcagccggggttccgcggccgtagcggcgacgcagggtcatccctcgtcctcccctgtctcctgctgctcaggagcccagccaccagtttattgctctgtttattcccctacaaatctgaaccttgtttctgaatgtttcatgattattgtgttgtttatttccaactggatcaacaactcagtgaaaaaacatatgaacaactcccccacgctaaccatgttgcaaacctggtagcttggcctgaagttgcgccacaacgcttttgcttactcattgtcttttttcagatttttcccttcagattaactaatgagcctctaacatcaagttaactaatgattactatcttctttctcaacattaccttacaatagtgactcattggctactctattttatctctcattct

SEQ ID NO: 30337 - DNA, 592 bp, Sorghum bicolor
  Clone ID: 9853353
gcacgaggcccagtagtcctagccgtaaacgatggatactaggtgctgtgcgactcgacccgtgcagtgctgtagctaacgcgttaagtatcccgcctggggagtacgttcgcaagaatgaaactcaagaactacatgcgcttctccgccttcttcgtcatcttctccatgggaggcgccatcctcaccgccgtgctccgccgccttgcggctcctctcgacgcgcccaccgcgctcctgctcctcttcaacggcgccgctgtcggggtcctctctgtcttcgcctccgctgtccccatcctcgtccgccaagggtacatggtcgccctcgccgtcatcgtcgccgcctggctctctaggctccccgagtggaccacgtggatcatgctcgtcgcgctcgccgtgtatgacctcgtcgccgtgcttgcaccccggggaccgctcaggatgcttgtggagctcgcctcctccagggatgatgagctaccagcactcgtctatgagtctcggcctacagtcggcccagccacaagctcttcctcttatgcttcggccatggggtctgtggagatgcaaaccatgactgattctg

SEQ ID NO: 30338 - DNA, 542 bp, Sorghum bicolor
  Clone ID: 9853356
gcacgaggttcagactttgcccttgttcgccaagaaattgctgatgagacggatagactgactggaaaaactaagcaaatatctcctgtccctattcatctcagcatctactcgcccaaggttgtgaacttaaccttgattgatcttccagggttgacaaaagttgctgtagagggacagtctgaaaatattgtgcaagatatagagaatatggttcgctcatatgttgataagcccaactgtattattttggctatatctccagcaaatcaggatattgcaacttctgatgcaattaagctctcaaaagaagttgatccaacaggtgaaaggacgtttggcgtgttgacaaagctggacctaatggataaaggaacaaatgctctcgatgttcttgagggaagagcctatcggctgcagaatccttgggttggaatcgtcaaccgctcgcaagcagatattaataggaaggttggcatgctttcagcgagggaaaaagaagggaatattttgaaaccagtcctgactatgctcatttagca

SEQ ID NO: 30339 - DNA, 541 bp, Sorghum bicolor
  Clone ID: 9853358
gcacgaggcctgcatcagccatggtggagcgatttgtgttgtgcctcattattgtgttatccatggaagtcgccctcagtgccgctgccggcgtcttcgagtccaagccaccgccggcgatgtacgtgttcggcgactcgacgctggacgtcggaaacaacaactacctgccggggacgaacgtccccagggccaacaggccctactacggcgtcgacttccccggcggcgttcccaccggaaggttcagcaacggctacaacaccgccgatttcattgcaaagtgcatagggttcgtgagcagccctccgccatacctgtcgctggtggcgccgccagcaagctccggcggccttctggtcccgacggctctcaccattggcgtcagctatgcttccggaggagctggcatcctcgactccacgaacgccggcagcaccatcccgctgtcgaagcaggtgcagtacttcaacgccacgaggtccaagatgatcgccgcggcggcgggctcctccgacgcgctgatcaacaagtccatctt

SEQ ID NO: 30340 - DNA, 519 bp, Sorghum bicolor
  Clone ID: 9853363
gcacgagggacaggcaccgcgcgcgcttgtccgcgcggcgggagtcgagagagaagcgcgcgcgccttgccttgcaatccaatcatcattccagaaccaccaatcaagcatgatgatggcgcaaccggaaccggaagggggccagcagcagcagcagcagcggaggaacgccggcggcggcggccggggggacgaggcatggcggcggtgggcgatgctggtggcgacggtgtggatccaagctctgacggggaccaacttcgacttctcggcctactcgtcggcgctgaaatcgtcgctggggatctcccaggaggcgctcaactacctagccacggcgtcggacatgggcaaggcgctggggtggtcgtcggggctggcgctgctctacatgccgctccacgccgtgctcatgctctccgccgccatggggctcgccgcctacgccgtccagtacttgtgcctcgtcgcgtccgtcgccgtcccttaccctctggtgttcttggtctgcttgatagc

SEQ ID NO: 30341 - DNA, 589 bp, Sorghum bicolor
  Clone ID: 9853371
gcacgaggagtggagtcactcgaccccgtcgagcttttgcttctgctttgcaccaccgtaccgtggaggaggacctgcttcgtccccgccgacgtgctcgatggtggcccagaacatggcgagaaggagcaccaccgtggaggaccttcccgccgacgtgctggcctgcgcgctgcgccgactcgacgggccgtccctggccgccgccagctgcgccaccgcgggactccgggcgctcgccgcggacccggagacgtggcgcgcgctctgccacgcgcgctggccgtcgctggccgcgcgaccggacctcctcctctcctcctcctccgccgtctctccgcagcgcctcttcgccgacgccttcccgttcccgtgcgatgcctcctcggctgagctgctccccgtccccgtcaccagcgagctcgtctccgccgtggacgtctaccaccgcggggagccactgctctcccgcgtcgtggagacctccacctcctcctcgtggttcctcacctcgccgttctgcgtcgacgccgtggagtgcaagagccacgccgccgtggccgtgcctgcgcatgccccggcggagctg

SEQ ID NO: 30342 - DNA, 477 bp, Sorghum bicolor
  Clone ID: 9853407
aggaggccaatgtgaagcaggggccggcacatgacagcccagcagatgtcggcatagtctcgagaggccgtaagctcgctatataacttctgcagacgcatggcggcgacggcggcgaaggcctgtgggaggcgctggccgaactgtggtgcgagctgatcgtgtcgatggcgccgcacggcagcatagtcgcgcaccagaaggagctcggcaagggcggcgagttcatcacgcacatctggacgctcctctaccacgccggtatcgacgacaagttctcgggctcgtccgccaccgccgccgccgccactgatgcgccgcctagcagagacgacaactacggccggaacatcccctgctagctccgcgttccagagtgtgtgttgctgtgtacgttttacttgtactcgtataagaagagtctagggtcgtcagtcgtgtgtgtccacgcatacacgtttcaaaccattggcccct

SEQ ID NO: 30343 - DNA, 548 bp, Sorghum bicolor
  Clone ID: 9853434
tcggccgagttatactgaaacgcagccggatcctcttcatggacgaggcgacagcttctgttgattctcaaacagatgcggccatccagaagatcatccgtgaggaattcaccgaatgtaccatcatcagcattgcacatcggataccgactgttatggacagcgatcgagttctggtgttggactcaggtctcgtggcagaattcgatgcaccctccaaattgatggggaggccatcactctttggtgcgatggttcaggagtatgcaagtcgctcttctagcttgaaggaaaccgttggatgagaccacatttcatggcaaaagacgacgacagtataggagaaagtttaggcatacgcataggcatacgctagcatctaacgaaaacgaaaaataaattataggagtttctgtaagctttattcgctacaacatgtcttatcttcaatagaactggactatttggtttacatttccaccaatttgtagtgagaaagttagagcaactacaggaagtttgtgtaatttacttgctaaaccaacgac

SEQ ID NO: 30344 - DNA, 606 bp, Sorghum bicolor
  Clone ID: 9853445
tccgcaatgagaagctgctcccagagacaactacaaataatggcagcggcacgtcgtcgtcccacggtgtccttgtggcgtcgctgagcccgtggtactacgagaggctcaaggatgagtacaatggcagactcgccggcggcgtgcaccagccgagccacgaggggcggcagcggtggcgtgacgaagcgcacgacgtcaaggcgctgagcgagatgtacctgctcagcatgtgcgacgtgcttgtcaccagtggcttctccacgtttgggtacgtcgcgcagggcctgggcgggctgcagccgtgggtcatgtcgaggccgtccccgttcgaggagtggacggagggtcaggcggcgccagaaccgccatgccagcgcgcgctctccgtcgagccgtgcttccactcgccgtcatactataactgcacggtgaggagggacgtggatctggacaaggtgacgccctacatcaggcgctgcgtggacgtcagctggggcataaagcttgtcaatcaaagcagtgaccatcaatggtagcatattgtcaaataggcgccgtaggcctttgaacaaacctgtcctagctttgctttgttaccttgtt

SEQ ID NO: 30345 - DNA, 638 bp, Sorghum bicolor
  Clone ID: 9853447
gtgggacgccgcccagcgcacatcgttcaacttcctcttccacgactgcaccaccctccagcccctggacgtcgagctggacccagttgacgacgtgcacgagctcctcggccgcaaggctcgccgcgtcaacggcaaagacggcgtcgtcttcgtactgcgctcgctgcccgagaacggcagaaaattatttcagctgctcgtcatcgaggtcttgtccgccatggacgatggcgaccagcagcttggggcggagaacccgggcgtggagtaccgtatggtgtataacaaggccgtcgaggacttcatctgtagttccgagatggccttccgcaccttgttgaaggagtttcacgatcaccagatcatcaccagcaggaaggacgctttcggtacggaactgctgaccatcccgttccggcgtgaggaactggaagccatacttgaagagttgatgtcatgatacaagacgggacgaaagttgggggcttgttttatcttacatatctaacgtaactcattcggaggggcgcagcgtcatgtttcgtaaagtacggacgcgggagagacaaaaatcagcatgggccacggtccacttcaatcacgtcgcagtgtcatagcaaaacaacaagaacaag

SEQ ID NO: 30346 - DNA, 696 bp, Sorghum bicolor
  unsure (1)..(696): unsure at all n locations
  Clone ID: 9853455
gcctgctgtttttgnagatgatgcaagattttgcttgggggttcttgctgtaactgcaccaatatttctcagtgatgttggttggttctggttggaggcaatgtcttctagtacagtagtactgaagcattatgctagtgggatgttcatgatcatgaactgatgggcagagaataaacaactatgatgcatacttcacaggatgcaaaggacaaggagataaatattcttcagaagggcttgctattgggccaggcagtccagagttcaactctactcacatgggaactttcaagcctcatcgtgtacccctttctggtttataactgggagccttatgctctcctgcccagtttaatgctgggattttggggctgccaagtctttgtactgtccaggcttacatgagcacgttgcctatccactcgcttatataactataaaatggtctaccaactactatttattaatctgatttatatagctgcattacctatgtgataatattggactcttggtcgctttcctctgtatgccttatgtagctggtattgttgcctggtctggtttggtcgaaagtactccatccgttccaaatgatatgttgtctttttaagaatagattgcttttactatgagaccttgttttgagaaccacccaaaagcgatgtcaaggccatttttggcatatatata

SEQ ID NO: 30347 - DNA, 537 bp, Sorghum bicolor
  Clone ID: 9853458
atcgtccaagcttttgtcagtcggtaagtatgccagggccgtacccgctgatacaagatatatggacccagtgtatatgaagacaaatcgttttgtggccaagagtgatgtctatagcttttcaattgttcttcttgagttgatcacccggaagaccgtcgactacgggcaagataaaatcaatagcctccccattgtttttgacaagttttttaagcagaagggtaacggaagggagatgtatgacagaaacattttatctcatgatggtgttcaatgtcaatattgcatagagtgccttgacaagattggtgctctggcaatccaatgtcttaagtatgatgtcgacgagagaccgacaatgaaagaggtcgtgaatgaattaaccaaagcagccaaactactggataaatgcaagcagataccatgacgaagaaagccatcctgcaagcatgcttggtcagatcatattcgctaatttatagggctagctatatggcttttcaaggagttgtactgtatatttttattttctgt

SEQ ID NO: 30348 - DNA, 659 bp, Sorghum bicolor
  Clone ID: 9853462
gcatcccccccgcgccccgtggtgttccccagattgaggttctttcgagcttgatgccaacggtatcctcaaggtctctgcccacgacaagggcattggcaagcaggagtccatcaccatcaccaacgacaagggccgtctcacccaggaggagatcgaccgcatggtcgccgaggctgagaagtacgccgaggaggacaaggctacccgtgagcgcattgaggctcgcaacggtcttgagaactacgccttctccctgaagaaccaagtcaacgatgacgagggtctcggcggcaagattgacgacgaggacaaggagactatcctcgaggctgtcaaggaaaccaccgactggcttgaggagaacagcgccaccgccacttctgaggacttcgaggagcagaaggagaagctgtccaacgtcgcctatcccatcacctccaagatgtaccagggcgccggtggtgctggcggcgaggacgagccccccagccacgacgagctttaaatccatagatttgttgttgcttcgtttgggatttaaaaagagacattgcccaaagatattccatgatgcaattttcgtctctggtgttggcaggttgatcggcgtcggcagcatgaagcatgacatgacttcactattgtgtacactaaac

SEQ ID NO: 30349 - DNA, 605 bp, Sorghum bicolor
  Clone ID: 9853470
tggcggatctctgcccactgcttgccatcacgctcattctcaacggcatccaacctgttctgtcaggtgtcgctgttgggtgtgggtggcaacaattcgtagcctacgtgaacattggctgttactacatagttggtgttcccctcggcgccatcctagggttcgtcttcaagctcggtgtgaagggtatttggggtggtatgattggaggaacttgcatgcagacggctattttgttgtgggtcaccttgagaactgattggaacaaagaggtagaggaagcacagaaaaggttacacaaatgggaggataagaagacgacggagccccttcttgcgggggtcggcaatggcaattaattaatttactggatggatggttatccacgtcaatgtccggccggtttcaccgcaccaccgtcaccatcaagatatggaccctggcctgcaagtgtttctccagagtttttagattttctttaccgtaacagtaacagtgatatcgatcaagccgtggggaaaatttgtatacgttgatttgaggcatctcacgacgttagatgaattgtatactcgttcgttgctcacaaattttgcaaaacataa

SEQ ID NO: 30350 - DNA, 612 bp, Sorghum bicolor
  Clone ID: 9853485
ctttgtttcctgggaaggattatgttcatcagctgctgctaataactgagctggtaggctcacctgatgacaccagccttgggttcctccgaagcgatcacgcccgcagatatgtgaggtcccttcctcaacaccccaagcaacaattccgtgtgcggttccctactatgtctagtggtgccatggatttgcttgagaggatgctcgtgtttgatccgagcaagaggattactgttgatgaggctctatgccacccatacctggcatcccttcatgagataaatgacgaacctgtctgcccagcgcctttcagctttgacttcgagcagccatcgctcaccgaagaagatatcaaggaactcatctggagggagtctctcaagttcaatcctgacccaatccactaaatagttccctgtgtacacacgagcaaaccaggatggcatgtctatcagctccatggggacgaaaggcattacagcaagatgagtgtacaagtgaccacccctcatcgtcatcatcatggcatctcgtggcttgtcaatggcgacaccctaatgtcgaaaacattggacattagaaacatgcttaatcaataatttgtagggagac

SEQ ID NO: 30351 - DNA, 629 bp, Sorghum bicolor
  unsure (1)..(629): unsure at all n locations
  Clone ID: 9853503
gcatggcatcaaaaaaatggtaatttcttgtctacattgcctgtatagaatcttttatctggtattaattcccgtcatattataaatccactcttttcgcaatgagccaggtttgtggttaccagtgtctttcgaacttccaggtgaaaacaatgtttgctgttcgaacatgtgaaggcgcaccgggttacaatcatgcttgttggcttccgtgcatacggtaaggcggttgttggctctctgcaggttgttgccaaacgttacgcacttgtggcctttactgaagatgggtgcggccgtgcggtgattggccaattggtgtaatcctggacctccgggttgtcctcctgaggaccaattccgtgcaaggttgcttcagacacaaggtggtgggtagttggtgcaattctgcagttttggggctattagtactagattagatggattgggaggtgcgcggttttctacaacagatcctccggttttgccatttttgcctttgtgttctctttttggtgcgtgcgattttttcccccaataggactaccttgtacatagttcgtttagcgtgatccaccatgtacaggcaaatttttacattgttgggttgctgataatgaaatgtncaa

SEQ ID NO: 30352 - DNA, 647 bp, Sorghum bicolor
  Clone ID: 9853507
taacatcaaggagagtatcgtttcaatggctggcgcacgaggaaccattggcttcattgctccagaagtattctctagaagctttggtgttgtatcaaccaagtcagacatctatagctttggaatggtgcttttggagatggttggggggagaaggaatgtgcaagtaaatgctaataattctagccaagtctatttcccagaatggcttcatgatcacttatctaatggtggtacacttgaaacctttgaagtgacaagcacaactgaggaggtcgcaacaaagatggctttgattggtttgtggtgcatacaaatgatgccagaatctcgcccctctatcacaaaggtcatagatatgctagagaggagtgttactgaaatagaaataccaccaatgcaattcttttcttgcacctcagaaccatcaatccattcaatcaatacaacttctgcagaagatactcagaatttaagttttctttctcatgttaacaaatgaaagaaaagtgcttactctccttgttagtacagctgttgtaccaccactgtgtagataacaaatgagagaatgtatgtttggttgtgtggccgtgtgaacccaggctgcattactactcttctgtagaaagtccaggtaacagaag

SEQ ID NO: 30353 - DNA, 691 bp, Sorghum bicolor
  Clone ID: 9853573
tttagaggaatggtttgcttcagttaacatacaattcacatctttgattcctttaaacattgtatcccttttttgtggatattaaattatggaatggtaagatgtgctcaactaactactaggtataatattaaattatttttgtagtcaacagtcaataggcaacacatagagcacactagtctgtgattgtagtcaacaaagatggtactggtgaacccagccaggcacactgggattctaggaatttgccaatatgagatgatccaaatgatttaagctactgattctatcattttttctgaaatttttggatgctgctaccagcctgtgaacagcaagccaatcatagtactaatgattgtgcaaccaactgattcattggtcatgacctgatggctatatggttgaggatttggagctccttttatggaagtagaaggaatgctagcagtttgtacttctaatgtttttcagtgccctttgaggctgaccttgcagatgccattcctgtggtcaagacatctattggtggcaccagaataataggtcgactctgtgttggtgtaagttattttccagctagttttgttggttcatcatattggtaggatggatctagctacagtagtggaattctgaattttatttgtaaagggtgtgtttcctgaactacatagaatgaacatgt

SEQ ID NO: 30354 - DNA, 639 bp, Sorghum bicolor
  unsure (1)..(639): unsure at all n locations
  Clone ID: 9853581
ccaagaattgctgaaattacgaaatgtgcaataaggattaatgaaacacattatggctgtaattgaagatctggctatctatgcttctgataaaaggtgagctgaagcttttgggatagcaaaagattcctctattgttgcctttctggacagctggaatgaaatctccagatccacgatatatgttgggatggaccaaatttacactgggaagcttcagtggcagtcatttcatcagcttcctgatatgatttaatggtggataaatgacacgattgctaactggttatgtgcgttcagaggaaagtttactgtcaggcatattttccatggtttgaactctgacggccttagatgttgccatcatgctatattgctatgttcccatctgtgaattcatctgagaagcttggcaatctaattccggacttccccagaaactgggtttcaggagtgcaggctaacaactgaatcagtatttaattgcatccgtacttctgcgctgcggtattttattggaagtcagtttaatctctttgtgtgtgtattactgatgaactgtggttttagctcgatgggttaaagcgggacatgtgctcacttggttgtcactataagaactnaacaccagttactnaa

SEQ ID NO: 30355 - DNA, 610 bp, Sorghum bicolor
  Clone ID: 9853592
ctacgtcttcaagtacacatcctcgtggtggggccagtccttcgtcgccgagatgacacgtctgtcccaggagacgatgcagcccaagacattgaggaacatcagcggaaacgtggttggtcaggtcagcaaggcgttgcatggtgcaatcgagggggcttcaaaattagcgggcaccaaggacggcgcagaagagacgaagcagggaaaccaagaagcataacggccgctgcacatctgacttgcataccactcgcatctttttcgtcttgacttttcctgcagaagcattcgtctccgagggccatcttgacgaaggcatgattgaaagtaagaaagaaaacgaaaagaaaaaaaacccaacccgccttgctacgtcacccagcctgcaagcaaaccacgccgtttgaagggcaggggaagcaaaggcagcgaggctacatcataatcattcaggcacaaggcaccaagccgatgatggggggcggagttctacgggatattctacgttgttgctgttgtttttctttcccattaactgagggcagaagagtttacggaacggttcacacaaggaagggggaattgtgtcgtatacgacggtcatacc

SEQ ID NO: 30356 - DNA, 278 bp, Sorghum bicolor
  Clone ID: 9853666
gttttggtgtggcttgtcagaataatgtggatgaatatcaggtgcgacactggatgtgtcggagctctgagtagtgcttctgttttcattcgcatggagaacactcctggtgttcctcccagcttgcagtacccgggagtgaggatggatggatttaattcctatattgtgaatactgaagatgggttccgctggaccaaaaaaggagtgctatcttttgtagtgtattcttttaatgttctaagaattagaatatgtagaaaaacttgagcaaggat

SEQ ID NO: 30357 - DNA, 626 bp, Sorghum bicolor
  unsure (1)..(626): unsure at all n locations
  Clone ID: 9853676
accntacatgtaagtccttttattgctcaggcattctaaccgtacaatctgatccctaagtcacacttaataaacatccttggccaacataactcattgacagactgtatcttgatcttggagcctttaatgccattactaatgtatctgctctttgttcggatatcttgcatacatgaatgaacagaaagtggtttcttgagaagattgggcatgaaggttgtagagccaactgattctcatcccttgtgttccttgttcttttatgttttgactaaataaccttgtgcaccatttttttataggtttgaacaatctgttaaaagcttatgaagataaatcagcgtttgctatgtgcatcttttctcttgctcttggacctggagaggaaccaatcacatttgttggaaaaactgcgggaaaaatcgtacctgctagaggtcctaatgattttggatgggatcctgtattccagccagatggttttgaacaaacatatgctgagatgcccaagtcagtaaagaatgaaatatctcacagagggaaggctcttgctctggtgaaagaacactttgcatctgctagctatacagttcagagcgataactcagcttaagtttgacttc

SEQ ID NO: 30358 - DNA, 618 bp, Sorghum bicolor
  Clone ID: 9853698
ccacactatactttgtttttgtatttgatagctctgagaatgagcttgccatgctcgatctgattcaagtttttgttgaaacattggacaaatgcttcaagaatgtatgcgagcttgacattgtgtttaacttcaacaagctgcacacgattttggatgagatgatattgggcggacaggtgatcgaaacgagttcagaacaaataatgaaatccgtggaagagattgaaagactggagaaacaatcgagcacaaccagtttcatacccaagtcaattacagagcgttttacccgttaagcttccactcgtttccaggacaccgagcatttaggtgtgaacagaactgagaagacataccattccagtctcattttagttcacctgacgggttttgtcatgtttcattgtatgcccccgagctgtactctgtaagcctgtaacatggatatgaatgcggcatctgcagtctaataatacttcctgctttatatgcttgatcgtctgacagtgcttgctgaggttcagacatgcatcagtaacaaactagcaatattatagagggatcgctggtctctcgcctcatgtatcatgataacttagatcactgttatttttt

SEQ ID NO: 30359 - DNA, 562 bp, Sorghum bicolor
  Clone ID: 9853720
aaccgcgttcagttcggcggtgacgaggtcgtcaaggccaaggacggcgctggttccgccaccctctccatggcctacgccggtttcagattcgccgagaaggtcctcaaggccgtcaagggcgagaagggtcttgttgagcctagctacgtctacctgcccggcgtgccaggcggcaaggagatcgccgagaaaaccggcgttgacttcttctctgttcccattgagctcggccccaatggtgctgagaaggccattgacatcctcggcaatatcacggagaaggaaaagaaactgttggaggccgctgttgcgggattgaagggcaacatcaagaagggtgtcgactttgcccacaacccccctcaaaagttgtgaggtgatactgttggtctcgcacgatgtatagcggaagagcgtacagcgtcaaactgatttcgtaattccgcggtgcatctggcagtggcgtcggtgtttttttttgtttttggacatggcgacagtcggtggtgtttccacccgctcactagggagcttgggatataagggagtttgacacttc

SEQ ID NO: 30360 - DNA, 495 bp, Sorghum bicolor
  Clone ID: 9853739
gcacgagggcgcctcatccggtaccgccatgacgagcgcctccgagctcttcaccgcgcgacgcggcgcccgtgggggccgcctctccgatcccgacccggacccggacccggatccgcacgccgacgcgctccgggaccagcacggcatcggcgggcggcgccggcgacgcgggtgccgcccgcgacgccagctcgacgccgctggggacgtgcggcagcacctgcacaccggcgccccgccaccgcgtcgccgcgggtcgtacaccgatcagatcttatcgtacatagacaataacaacattggggattctgcagctcggaggaacagacttgataggctgatgttcaggacaaatgagcggcttcctggtgctgtactgcaagcacaagcacgtgtcctggagagactcaggggcgtttctcttggttcatctgcctccaggccatccatctcattagatgaattttctgctagcgatgtgtttagaatcat

SEQ ID NO: 30361 - DNA, 174 bp, Sorghum bicolor
  Clone ID: 9853740
gcacgaggcacaatccatagtttcgttcccctctctctctctcctccttccgaaccctccaggccccaaaccccaatctccgctagggttagggtatttccatggaccggcgccggcatccacccgttccagtggccacccgcagcggccgcgccgaccccgccgggggcggcg

SEQ ID NO: 30362 - DNA, 524 bp, Sorghum bicolor
  Clone ID: 9853744
gcacgagggcttctcgaaatttgctttcttaccttgaaagtgatcgaagcaatgttggtaccttcttgggatcattggacaacaacttcatcacaaaccctctagagtacaataacaatagtggggaactatccaatataggacatgctagtgagtcagatgatggcagagttatcatgggcatcaggcactctagcaggcctcattttggagtgcagtttcacccagagagcgttgctactcatcatggaagacagattttccgaaactttaagaagatgacaggagattttggattgtgctcgtcatggctccaggaaagaaaggtcaattctgcaagacatcgtgattctatccctaaggacttgttgcgtactaaaagaatggagctttcagagcctgttgggtcttgtgtacttggaaagagaggcactgggaaaaagtgtttacgattacgatggaagaagattgaaaatttcctctgtcccacagttggctctgaagacatatttgcggtgcttttt

SEQ ID NO: 30363 - DNA, 458 bp, Sorghum bicolor
  Clone ID: 9853745
ggcacgagggcagcccctcctccacgcctacgaggcgcgcaaggaggacccggcggcgtgcgacggagaggcgcacggcttcggccccgcagagcccgacggcggcgcgagcttcgtgcggacctgcttcaatggcctcaacggcctctccggcgtcgggctgctgtccatcccgtacgcgctgtcggagggcgggtggctgagcctggcgctcctgctcgtcgtcgcggcggtgtgctgctacacgggcctgctcctgcagcggtgcatggacgcgtccccggccgtgcggggctacccggacatcggcgcgctcgcgttcgggcgcggcggccgcctcgccgcgtccgcgttcctctacgccgagctctacctcgtcgccatcggcttcctcatcctggaaggggacaacctggacaagctgttcccgggcaccagcctcagcctcggactcggcc

SEQ ID NO: 30364 - DNA, 480 bp, Sorghum bicolor
  Clone ID: 9853748
gcacgagggccaacggcaggtatggcgacgccagcaccagcttcgtcaccgactacatgaagcacgagcacaagataccctcaaagggctcggataaccagcaggacttgtgcttgaaagattgcaactacctcatcgtcggcgactccgaggcgaaggccgaaagggtggagagccagcagtacgaggctcagtacaagccggcggaggacaccgtcaccgtcgccaaagtctgggggtgcgatgggacgctcctgaaatcgaagaaacacgggaaagagctgagagacgtgtgcctctccttcgcgctgtgcaaactcctacggaggaagttcgccggcgtcgcgacggccgagagcgagaggccgaaggcgcagctgctggtcttcgacgacctcatcagctccggccgggaccggacgttccgggtggtgaggacggagctgggcttctcgagggacttgctctacaccaagtacc

SEQ ID NO: 30365 - DNA, 492 bp, Sorghum bicolor
  Clone ID: 9853756
gcacgaggctcctcacagtatcaatatttatgcaggctgctcgcaataatgttcttcttgcagtacctgcttttctatatgctatcaacaactatttgaagttcataatgcagttatattttaatcctgctagcgtgaaaatgctgagtaatctcaaggttctagtaattgctgtgcttctaaagatgataatgaggaggcgattttccataatccagtgggaggcccttgcacttctgttaattggaatatctgttaatcagctcaaatcgttgccagaaggttctagtgcactaggtcttcctgttgcagctggagcctacctatatacactattttttgtgacagttcccgcattggcttcagtttacaatgagaaggctcttaaaagccagtttgataccagtatttaccttcagaacttgtttctgtatggttatggtgcaatatttaactttcttgggcttgtgatcactgccatcatccaagggc

SEQ ID NO: 30366 - DNA, 459 bp, Sorghum bicolor
  Clone ID: 9853788
gcacgagggcggtgcttacagagcgcgtcctcctcctcaacggaggcaaggatgatgtggccgatctcttctgcgaacccttcccaggcgcgacatggctgctgccgcgccctggttggttctccccgttcaggaagctcgacgattacgacggggacagcaaggagagcctggggaacatgctgcagagaggcgccgccggcgtgtccgccgacgggaacatgtcctggctgtctccaccgcacccgccgtcgtatgtgtatctccacctcgctggcgagtacggcttccacgacaagctcttctactgcggggagcaccagcggctcctccgcggagtgccgtggctgctcatgagggcggatggctacatggttccggggctgttcctcacgccgccgttcgtcggagagctcgaggccatgttcccggagaaagacgccgcgttctaccacctgg

SEQ ID NO: 30367 - DNA, 406 bp, Sorghum bicolor
  Clone ID: 9853802
gcacgaggctttgcctgcccgccttggtttgttggttccatcgtcccaagcaagcaagacgcccggccggcgaccccgcgtacgtggtggcgcggcgcgctagaggtagacacataacctaggctgcggagagcatggccggcggcgacgaggcgcacggcggcgcgtcggggcggctggagagcatcctgacggcggaggcggatgcgtcgtccccgtggccgtgggcgcggcgcgcgtgggcggcggcgtccatcgagctgcggctgctgacgcggctggcggcgccggcggtggtgatgtacatgatcaactacctcatgtccatgtcgacgcagatcttctcgggccacctcggcaacctggagctcgccgcggcgtcgctcggcaacaccggcatccagat

SEQ ID NO: 30368 - DNA, 256 bp, Sorghum bicolor
  Clone ID: 9853806
gcacgaggcggcgtcttcccggacggcagcgtcacctacggcggctactcgaagatgctcgtggcgcacaagcggttcgtggtgcgcgttccggacacgctcccgctcgacgccgcggcgccgctgctgtgcgcggggatcaccgtgtacagccccatgaagcaccacggcatgctgcgatccgccggggcgagcctgggcgtggtagggctgggtggactcggccatgtcgccgtcaagttcgccaaggcgttcg

SEQ ID NO: 30369 - DNA, 420 bp, Sorghum bicolor
  Clone ID: 9853818
gcacgaggctctcgcggcgcattgtcctctctctctatctcagctagagcatctatcagagagctttgcttgcttgcttgcatgcgcaaccgcatcgtcgtcgtccggccggcgttcgtccgtccgtccttgttgttgagtgagtctcgtcttgtggttgtttctcgtcggccggagagaagagagggagtagctaggagcgagaggtagccgccggccgccggggatcggattcggatcggagcggagtggaggtggtgtcgtcggtgtgtgtatatatacatgcgcatggagggtggcggaggacgaggcgccggcggtgtcggagggtgcctgggtctgggccacggcggggaggcgcagagcaagggaacgcacacgcacggaggccgctacgtgcagtacaacgtgtacggcacc

SEQ ID NO: 30370 - DNA, 580 bp, Sorghum bicolor
  Clone ID: 9853837
gcacgaggccctgttctatgataaatctgcttgcaaggctcttgatgatctatccgcgcttctgagatgtttgagagtatggtctgtagaacaaccaattacaactattgatgtactcatgcctccctcagaatgttactatacagatttgtttttccaggtatactcaaaagaaggtaatcatggaccgagtttccatgaaaagttgctggcagttggtggacgatatgatcggttggtggaacaagcttgggataaggcatatgtaagttatactcgatgcctcctgtatgttaaaggggatacctagaatcatttatcttaacaaataactacatataaatgccacaaaatcttactttgtaattgtatagtgacctctttcagacggtgtatattatcccatacttgtccaagtccaaggaagatatattgttgttgttgctgctgctgttttgtcacaaaaatacctttcattttgtgaaaagaaaatagagagattttgtccatgatttcggtattgtaactgtatttgatataacctgtgcagaaatctaacccccaggtgctgttggtgtga

SEQ ID NO: 30371 - DNA, 574 bp, Sorghum bicolor
  Clone ID: 9853841
gcacgaggcctctgcacttgtgctagcgtcgcctgaacctgaagggcatcggcatctgctttttgctggacattgcaggtgcaattgcaaagcctgttgctagtttgtgaccagcaatgagtccctcacaggtctcctcggtctctctggccatcttcctcttaatcctcccagccttctccaccagttcatgcctcacgaaactcccatgtgacagtaccatagagatcaggcctcctttcttcgttggtactcccggtctcgatccagcctgtagggaatcgataaacgttagctgtggcaacttaggtccagagctgggcctccttacgcccagcaagctactactcaaggaaatttcttacaataccagtaccatacaagttcaggatgtggagctcagcgtcctcacgaatttgtcctgcagtctcatgttcagcttcacaccgcctgtctccgactttgtgggcagctattcagacttggagaagtggttctcattgattagctgtggcgacagcaacctgacacttttccggagcatgtttggggatgacaaggccgttcaccaaat

SEQ ID NO: 30372 - DNA, 563 bp, Sorghum bicolor
  Clone ID: 9853844
gcacgaggacaccctcccaatcccatcgcgtctcctccatacctctcttacgccacgccggagggacagagagcgagcgaaacccaagatgtcgacgtgcgcggcggacctggcgccgctgctgggcccggcggcggcgaacgccacggactacctctgcggccagttcgccgacacggcgtccgcggtggacgccacgtacctgctcttctcggcgtacctcgtcttcgccatgcagctcggcttcgccatgctctgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcggcctccagcacctgcccaagaccggcttcgactacgacttcttcctctaccagtgggccttcgccatcgccgccgcgggcatcacgtcgggctccatcgccgagaggacccagttcgtcgcctacctcatctactccgcgttcctcaccgggttcg

SEQ ID NO: 30373 - DNA, 637 bp, Sorghum bicolor
  Clone ID: 9853875
gcacgagggagaggtctaaaacaaaacctattaggaatgatagaattcagagcacaaaacctgtgccatctgcattgactgttgacaaagccacttcagttcgtgggagttgttctgttacacctaatccatctaaaatagcagataatcttcctgatagaagttttaaaaaaccttcagataggtcaggttcaacagcaaataaccttgcaacatctctgaagaaaatggtcaggcagcaaactgcaccaaaagttgtgaggcattatccatcagaatcgacactcttcccatatgaactttttgtgaagctctacggcaaggttgagttgaacccttttggtcttcataacgttggcaacagttgctatgcaaatgctgttcttcagtgcttgatgtttactcgaccactcacaacatatcttttggaaggccttcactcaaaaaactgttctcaaaaaggatggtgcttcatgtgtgaatttgagaaactcattgtggagggcaaacggcgcaagactgccttgtcaccaactgggatactctctcatttgcatgacattggcagtagcttgggtcctggtaaacaagaagatgctcatgaatttcttaggtatgcaattgatgctatgcaatc

SEQ ID NO: 30374 - DNA, 494 bp, Sorghum bicolor
  Clone ID: 9853883
gcacgaggacgactcggcgacctgcggcgaagagatcgagagcctcgagcgggagatcggtgaaaaccgcgcctcggagaggtggacggacgccatgatcgcgctcgtcggcctgctgcggtacgccaagtgcgtcctgttcagcgccacgccccggccttcttcggattccaagccggaccccgaggtcgacgaggaaggggagcctccggcgccgccgccggacttccgctgccccatcaccctcgatatcatgcgcgagcccgtcgtcgtcgccagcgggcagacgtacgaccgggagtccatcttccggtggttcgactccggcaagtcaacgtgccccaagacagggcaggtgcttaccgttctggagctcgtgcccaacaaggcgctcaagaacctcatcgccaagtggtgccgggagaacggcgtcgccatggagagcagcgaggcgagcaagagcgagcctgcgcaggcggtggccgcgaacaagg

SEQ ID NO: 30375 - DNA, 494 bp, Sorghum bicolor
  unsure (1)..(494): unsure at all n locations
  Clone ID: 9853892
gcacgagggtcactttctgcgctgggtgatgcatttgcctctttaagcgcaaagaaggagcctgttctatctgggaattcaagaatcacgcaaatcttagctgactctctaggaagtagctcaaagatcttgctgatcgtgcatgtaagtccaagtgcttcaaatttgtcaagaactttatccacactcagtttttctgcaagagcaagaaatgctgagctgagccttggaaatcgtgacacaataaagaaatggaaagacgtggcaaatgattcacgcaaagaattgcatgacaaagaaaaggaggttctagaactgcggcaagaagttattgggttaaaacattctctaaaagaggctaacgaccagtgcacactgctgttcaatgaagttcagaaagcctgnagagtttcgtctacactccaagctgatctcaagtctgaaaatttaatgcttgccgagaagcacaagattgagaaagagcagaataacca

SEQ ID NO: 30376 - DNA, 619 bp, Sorghum bicolor
  Clone ID: 9853897
gcacgaggtgacgacgtgccgcgctcttcgcccactcccaggtctgttcatccccttccctagactgtccgtgcacatgtgtgcttgagcggggtagaagctgagactgagactgaaattggccacaccccgctgcctggctgttgctgcaggggctacgcagggagcacatagactatgagggctactctttgctactggatccatcatcgagttgtttgaggtcccatgattcatggatctagaggaagacaaaaccaacgccatggcttttgatttcatctcccatctggattccatgcctctgccttccaatccttctggttttttgattagtcaatgttgccatggattgtgctgagtcttgtcaatttatttcatttttcattctaaatttctagttgattctcctgttgggctactactattaccagagctgaaagcacatttaggacacatgaacaaatagaacagttgtaagaaaaagtacagtttgacagagtaagtttctcctttaaacacagtttgaatgtgatactaagtacatgatggaaatatcagatttctaaccttaagctctttgttctttcagggttacagattcctttaaacattggtt

SEQ ID NO: 30377 - DNA, 115 bp, Sorghum bicolor
  Clone ID: 9853902
caccggcgtggacaatggtcctgtcgttgccgctgatgctcgcctcagacaggacactgtccgccagtgctatgcggcgacgtgaccatctccttcccgttcgggatcgttcagg

SEQ ID NO: 30378 - DNA, 582 bp, Sorghum bicolor
  Clone ID: 9853904
gcacgagggtccgctcccctcccgtccctcccaaaaatctctcgctctgccgaaaccctagggcgccgccacctctggagcaagctcagggcacagtgccaagatgaaatcgagcctgtgaacaccgccgcccctcatccttgtcgaggagccgggacgccatgctgccggagtccgggacgcccctgcactttgagtttgagggcagctgttaacgtcacccaatatattcttctcaacctaaaaccctacaaacctcctttccccagtaccgtccgccgtcgctcccagcccctacccccggtacaaactgcggccgccagccagcgcgaacctaccagcctagagagggcccccgatggcgggaggctccggcggcggaggttttctgggcgacgtgaacgacccgtggctgaagccgcggctgctccgcgcggtggtcaccgagcgccttccgcagcctggcggcgccgctgagctctcgccgacggaggtcgcctccatcttagaggcggtccgcacccacggcctgctcacgggagctctcccgggccgcggcacgcctccggcgaacccgaagct

SEQ ID NO: 30379 - DNA, 546 bp, Sorghum bicolor
  unsure (1)..(546): unsure at all n locations
  Clone ID: 9853906
gcacgaggcagaagtcaatgaacttgagtggtcttttgatcgcaatcctgaggttcttattccaattgcaaatgggtctgaagagatggagatcataattctggttgatattttaagacgggcaaagataaatgtggtattagcgtcagttgaaaaatctctaactattcttggatctcaaaggatgaagattgttgctgataaaagcattacgagtgcctctgattcaatatatgatctaatcgtgcttcctggaggacctgctggagctgagcggctgcacaggtccagaattctgaagaagttactcaacctacaaatgcaagctggcaggatgtatggtggggtttgttctgctctgaaggttctgcagcagcaaggtttacttgaggataaaacagtgacagctcatcatgccgtagccagtgagctcacatgccaagttatagaccaaccaaagagtgtgatcgacggaaatttgatcactggcaaggggcttgggacagttgttgattttgccctagctatcatcangaaattttttgg

SEQ ID NO: 30380 - DNA, 534 bp, Sorghum bicolor
  Clone ID: 9853911
gcacgaggcacctccgtcggccggcaaggcatccatccactccccgtacgtccggtgcctgacctcattccctctccctccactccgagatgcccaagccgtggaggccggtgctggcgtcggcaaccaagtgctgcgcggcggaggacgcggcggtggcccccgacgggctggcgcggtgcaggccgcagcagtcggagctctcgcgccggctcgcgtccttcaggcggctctcgtcgctggccaacagcccggcgtcgggtggcaccaccgtggtggtggacaaggacggcagcgtcaagcagcagcagggagaggagatggtggagggcccgctgcagctgcactcgttcggcctcggcgagctccgcggcgtcacgcacgacttctccagcagcttcctcctcggcgagggcggcttcggcgccgtctacaagggcttcgtcgacgccggcatgcgccctggcctctcctcccagcccgtcgccgtcaagcagctcaacgccgccggcttccagggccaccgcgagtggc

SEQ ID NO: 30381 - DNA, 470 bp, Sorghum bicolor
  Clone ID: 9853914
gcacgagggtggaatggccaggtttgaggtgattgaaaagttagggccagatgtgaagtgccgctgcactgatcctggtttgttgctgccacgggctaatcttactatatggcgcgatggcagtgtagtgcgagagaggaacgctatgcttcctacaatttcatcaaaggattggattgacatagattttggaattgctgaaggtgttgatttcgtcgccatatcatttgtcaagtctgctgaagtaattaatcatttgaagagttacatttctgcacggagccgtggaagtgatataggggtcattgcaaagattgagagcattgatgctctgaagaacctggaggagattatccgtgcatcagatggaataatggtagccagaggggacttgggggcacaaatccccctggaacaggtcccttccatacagaagaaaatagttagaatgtgcagacagctcaacaagc

SEQ ID NO: 30382 - DNA, 518 bp, Sorghum bicolor
  Clone ID: 9853917
gcacgagggtaccctcccgccacagcaccactaagcttggctgccgtgctcccattttccgctcttcgaacgaaccacctgccaacgatttcgccttctctcccatcgaacaatctcttccagcactaccctgcctcgcgcaaatcgcccaagatgcctgcgctcgtcgacgaggagactgcgcccggacgtctcttgctgctctccaaccgactgcccatcaccatcaagcgttccgaagatggcagctattccttctccatgtcctctggcggtctcgtcaccggcctgagcggtctgtcaaaaaccaccagcttccaatggtacggctggccgggtctcgaggtccccgagaacgagattgccggcatgaaacagcgtctcaaggacgagtacgacgcacaccctgtcttcattgatgatgagcttgccgacaagcactacaacggtttctccaactctatcctctggccgctcttccactaccaccccggtgaaatcacattcgacgagagtgc

SEQ ID NO: 30383 - DNA, 536 bp, Sorghum bicolor
  Clone ID: 9853920
gcacgaggcacacctccaaaattttgagctagctctcgagtacgtggccatggctcaagcaacagttattggtcatcagctctccggtgattcaccgtcgttggtggtgaaagcattgttcccattcctggtcccattcctcctgctcttcgtcctgctgcgctacttctctactggagcaaccattaacaacaataaccaaagaaagagaccgcctccgtcacctccggccctgccactgatcgggcaccttcaccttgtccgtgcgcaccctcatgtctctatgcgcagcctcgccgcccggcacggtggcgaggacctcatgctgctccgcctcggcacggtcccgacgcttgtggcgtcgtccccgcgcgccgcacaggcggtgctgcgcacgcacgaccagtcgctggcctccaggcccagctccatcttcggcgacatccttgggtacggtccgtcggacgtcgggttggcgccctacggcaacgcgtggcggcaggccaagaagctggtcaccacgcacctgctgagca

SEQ ID NO: 30384 - DNA, 473 bp, Sorghum bicolor
  unsure (1)..(473): unsure at all n locations
  Clone ID: 9853940
gcacgaggcttgctgttgactatccggttgacaaggtatcttgctatgtttctgatgatggggctgctatgctgacttttgatgcgctctctgaaacttcagagtttgctagaaaatgggttccattctgtaagaagtacaacatagagcctagggccccagagtggtactttgctcagaaaattgattacttgaaagacaaagttcaaacttcatttgtgaaagaacgccgggccatgaagagagaatatgaagaattcaaagtccgtatcaatgccctagtagccaaggcacaaaaagttcctgaggagggatggatcatgcaagatggtacaccttggcctgngaacaatactagggaccatcctggaatgattcaggttttcctangtcacagtggaggccttgacgttgacggcaatgaacttcctcgtttggtttatgtgtctcgtgaaaaacgtcctggattccaa

SEQ ID NO: 30385 - DNA, 602 bp, Sorghum bicolor
  Clone ID: 9853953
gcacgaggagcatatgcatgtaaggtgtttgatgaaaatccctgatgaggggatagctctcgaatgcttggcaaggcatccatccatcaatgaaggtaaggcattggcattggcccatattcctctcaactcgcctatggaaagaactgacaacaaacaccacacattgcagctcttctttaatttgtggtcttcatggtagattttattattaatctttcagttgactagatgcagtaaggtataacgatcacaacaccatcaagaagcatgatactttccttgttttgcatccatattagatgcatagcttgttattaagcattaagcagtgaagatagttctcacaagactactaacctgtggtaaccactccagctagctcaagtaaagctcacctatgttatgcactgtgctgctatagtaacaaggaaacctatatgaattaggtctttattcacatgtttgatgctactagatagaaaaaggcctacattcataatagcacactgaagtcatgcctgaaataaattaacatatagatcagcaaaaccattgcgattctcagtaatttagaataccaacaaaatgtttcaaccctt

SEQ ID NO: 30386 - DNA, 564 bp, Sorghum bicolor
  Clone ID: 9853960
gcacgagggctccaactgctggattgaaaaggggcaggagggtggcatttgaatctagtgagtctagcatatcagaaaccagcagcgacagtgaggaagaagttctaaaacatggtctttctgaaaatagtacagggccagctcaacaaactcgcagatctagcaggcagaagcaagaagttaggtgtaatgaggatagtgatgatggcgatgttgaagatgatgataacacggttgaggatgattttgttggctctcctgctttgaagaggttaagaagtggcctggttcacggtgattactgtactaaaacagcaaagctgaatgaaggcaccgctggccgtaatggtctgagtaactgcagtaacataaaagatacaaagaacagtggtacaccatgtgaagagaaaacttctgatggagttgagcacatgaagagagaaacaatgcatgctcgagaaaatagtgatggcaaagaagaggcttttccttctgctaatccagaatgcagttctgttagaagtcaggaccgtgactccaaacatgctggtttgtccagtggag

SEQ ID NO: 30387 - DNA, 596 bp, Sorghum bicolor
  Clone ID: 9853969
gcacgagggcaacatcaagtggccatcgaggtgggatgcgtatctgaagatggatggtgccaaagtccactggttctcgatcatgaactcgatgatggttgtcttcttcctggctggtattgtgtttgtcatattcttgaggactgtcagaagggatctgacaaggtatgaggagatggacaaggaggcacaagctcagatgaatgaggagctctcaggatggaagcttgttgttggtgatgtcttcagagagcccagctgtccaaagttgttgtgtgttatggttgctgatggtatccagatcaccggtatggcagttgttacaattgtgtttgctgctctgggattcctctcacctgcttccaggggaatgctcctgaccggaatgatcattctctacctcttccttggtatcattgctggatatgttggtgtccgtgtttggaggactatcaaaggaacatcagaagggtggaaatctgttgcttggctgactgcctgcttcttccctgggattgtgttcatcatcctcactgtgcttaactccattctatggggcaagaagagcactggagctctacccatctcactgttct

SEQ ID NO: 30388 - DNA, 572 bp, Sorghum bicolor
  Clone ID: 9853986
gcacgagggttcacacttcagacatttaagaagtatgcagatgacttcaatgaacagtattttaagaaagaagtgtctggggactcagtgccatcagtcgaagacattgaaggcgagtattggcgcatagttgaaaagccaaccgaagagatagaggtagtatatggtgctgatttggagactggaacttttggtagtggattcccaaagttttctcctgaagtaaaatctgatgttgagcataagtacgcagagtctggttggaatctaaacaacttgcctagactacaaggttcagttctatctttcgagggtggtgacatctctggtgttttggtaccttgggtgtatgtcggaatgtgcttttcatcattctgctggcatgttgaagaccaccatttgtactcactgaactacatgcattggggtgctccaaagatgtggtatggagttccaggaaaggatgctgtgaatttggaggctgcaatgaggaaacatctacctgacttgtttgaggaacaacctgatttgcttcataacctggttactcaattttcaccatcattgcttaa

SEQ ID NO: 30389 - DNA, 144 bp, Sorghum bicolor
  unsure (1)..(144): unsure at all n locations
  Clone ID: 9853994
gnacgagggtcgatcaagatccccgacgacgagtacgccatggtgtgcaccgacaacaggaccaccgcgttccgcctactcgcggagtgctactcgttccaacccgggaagcaggtgctccccgtgtacgactacgacagcgag

SEQ ID NO: 30390 - DNA, 393 bp, Sorghum bicolor
  Clone ID: 9853996
gcacgagggccgaccccgcacgcgcacctcctcgcgcacgcgccctcgcgccgcgccagcgaccccacaccgactccccccgcgcccgcagccggcgcgccgtaccgcgggtacctcccgcacgccgtcgcctcgccgcgcgccgccgtgtcggcgcgccggaggctgcccatcgtcgtgcagttccacggcggcggcttcgtcaccgggagcaacactgccgcggccaacgacgccttctgcaggagggtcgccaagctctgcgatgccattgtcgtcgcagtggggtacaggcttgcgccagagagccgctaccctgccgcgttcgaggacggggtcaaggtgctcaagtggatcgccaagcaggccaatctcgccatgatgaccaaggtc

SEQ ID NO: 30391 - DNA, 566 bp, Sorghum bicolor
  Clone ID: 9853998
gcacgagggagagagagaaagagttaaacattgagaggattggctttcttccgagattagaagttactaatgaagagcatcctttaagctctggtaaatctagcttgtggaatcaatattttcaggattcagagatactggaacagatagaccgagatgtaaagcgaacgcatcctgatatttcctttttctcatcaaagtctaaccaggaatctctgaggagaattctaattatattttcaaaattgaaccccagtataagatatgtgcaagggatgaatgaagttttggcacctctattttatgtattcaagaatgaccctgacccaagcagctcagcgtcagctgaagcagacacgtacttttgctttgtcgaattgttgagtggctttagagacaactattgtaagcatcttgacaatagcagcgtgggtatccgatctacactttcgaaattatcacaactattgaagcggcatgatgaggaactatggcgtcacatggaggtcacaacaaaggtttacccacaatattatgcgtttagatggatcacactgttgttgaca

SEQ ID NO: 30392 - DNA, 581 bp, Sorghum bicolor
  Clone ID: 9854008
gcacgagggcaaccttataggagtagcagcctagcagagagggttttagcgttagtggttcaagtgcgcgccaccatgactcggtggcagactggcagtctggcagaagggggtggcgtcgctgaactgtggcctttgggcttgtggttatcttccaatcgaggaattgagaatctgagatacactggtacatcaacgcaggagctcccgggtcttgttatatccgattagctgataccgctgggatttttagtaactggagattcaggatttttatatctgattagctgataccactgatacaccacgttcccttttctgtgatcatcagtcataccttcagggtgtcagtaatttgatagcaaagcttcgctgaagtttctcaaggactagctgtgtgatacaatcaggaagttaggtagcaaacataggaaaatacagatatataagggcaggtgggctgcatcaggcgttctgggttaaatagacttgtagccaatgtgttgtttagttactgatgagcagaattctaaccgcagccttgtgattcttttcttctgttgttctgagattaacactga

SEQ ID NO: 30393 - DNA, 443 bp, Sorghum bicolor
  Clone ID: 9854011
gcacgagggagccgccgcgtcgttgctcctcgcctacttcttctggcggtgcaccgggaagggcaagggagggcgccgccgccacaggcgcggcgccaccgagtccggcggcggggaggacgggagctggtggaccgagaggctgcgggcggcgcacaaccgcctggccccggtctcgctgttccagaagcccatcgttaaggtcaagcttgctgacctgatggccgccacgcaggacttcagcaccagccatatcgtggtcgccgggagctcgcgggcggggacggcttaccgagccgtgctacgggacgggtctgcgctgacggtcaagcgcctgcactcgtgcccactctcggagaaggcgttcagggctgagatgggtcggattgggcagctgcggcatcccaatatcgtgccactgctgggcttctgtgttgtcgagg

SEQ ID NO: 30394 - DNA, 493 bp, Sorghum bicolor
  Clone ID: 9854012
gcacgagggcctggtccggcgccgcgtcccgatcccgcgccatcgaggttgcacaagagttagcagaatgcatctcgctgcctgacagaactacagcacagttgagcgtagctcgctctctggccaaagctgactcggtcagtattgaaccctacagtgaggatgactgggagatactggagagccgtgctgatttggctgaagaaacaatcttgaagcaggtcggcatcgtttatgagggcatgaaatttccattgtggttggatggacataatattgtgaagttcgttgttgtgtcatcttttcccgagaagacagttgttcaacttgtaccaggcactgaagttgctgttgcacccaaaaaacgaaaagagaagccttctcaggatctgcaaaagcaaagtgcactgaatgaaccagtcaaaacaaaggcactcctgcgtgttcaagcagctgataggaagtatgcacatacattcaaatataaaggtgt

SEQ ID NO: 30395 - DNA, 585 bp, Sorghum bicolor
  Clone ID: 9854021
gcacgaggattatacctccacatggaacatcagaagctggtcaaatgggaacctatgttcatctgtacaaattgcaaagaggcataaccaatgcgatcataaaagacatcagctttagtgatgatagtgactggataatgattagctcttcaagaggaactagtcatctgttttcaatctctccatatagtggatcaacaagatttcgttacagtgataacaatcccgcagaaaatgattacatagtggattcatcagttaatcatactgctcactggtcccaaaattcagcaacctctttgagtctcagtcagaagactctctttgtatctggaccccctgtcacattgtctgttgttagtaggataagaaatgggagtaacatgtttaagggtgctgtccatggcgctgctgcatttgcaactggtgcttccagtccaatttctggtgctattgcttcaacatttcacaactgcaagggtggtgacattaattcagatggcagttcgcgcatgaagtattatttactagtattttctccatcaggaagcatcatacagtatgttctccatctctcagctgaac

SEQ ID NO: 30396 - DNA, 553 bp, Sorghum bicolor
  Clone ID: 9854030
gcacgaggcttcctcaggcttccgagttccgacccaccccggcgctccagcagtcccacgcggccgcgccctggcgaatcagtagcttcgctccggcggctccgctccccacggcccacgcccccggtcaggtgactccgcggctccgctccggtgcccacggtccagcggccccgcgccccggcgcggcgctttgcgcgcacggagggacgttttctgggagggcgaagcggacgcccgctgtcccgtttagttggcgtggaggcgaagctgctgctggggctcctccaggctccaggagcgctaccaaacggcttcctccgctgactagcgctcgcgatctgatcgtcgccctgccagagtcccagccagcgcagcctcctactcgtagcccaccatgatccaggcggtgatggtgatcagcacccaggccaagccccgcctcctcaagttttataatttccagccacccgagaagcatcaggacctcgtccgcagtgtcttccaattactctctgcaaggcctgacagcgtgagcaattttgtcaaggtg

SEQ ID NO: 30397 - DNA, 500 bp, Sorghum bicolor
  Clone ID: 9854051
gcacgaggcctactttgcccaatctaccttggaacatcacagtttaacaccaagccaccacctcggttacccgtctccaacccgagatacataaaacaccttcaaaatggtcaaggccgttgttgctggcgcctccggcggtattggacagcctctgtctcttctcctcaagctctctccccttgtcgatgagcttgctctctacgatgttgtcaacactcccggtgttgccaccgacctttctcacatctcatctgtcgcgaagaccaccggctacctacccaaggaagatggggcaaaggccgccttcaaggatgccgacatcattgtcatccccgccggcattcctcgcaagcccggaatgactcgcgatgacctcttcaacatcaacgccggtattgtcaagggcctgatcgaggtcgccgccgaggtcgcccccaaggcgttcatcctcgtgatttccaaccccgttaactcaaccgtccccatttccgctgagg

SEQ ID NO: 30398 - DNA, 623 bp, Sorghum bicolor
  Clone ID: 9854091
ggtgaccacggccctgccggcggtgctgaacgccaccatggtgcacagagataaaatactcgaggtgtccgtcggcctgacgacggagatctgcaggttcatcgacggcgagcggtttgccggcgagctgcgccgcgccggcgtggcggacgaacgggcatacgtggagcggctggcgagcatcctgcggcagtacaggtatccggagatcagggtcccgcgaatgcgacgcttcgtggtgcagcaggtcatctggctgatgacgaattcgggcggccgcggcgacgacggcggcgggtacgttgagctcctcagggaggtgggcatgcagcggctgctagagtctgtcgccgacaccacgtcggagctggagtgctaccacgttttctcgggaagcgtgggcatcagcaagcaccgtgagagcttctccgacatcgtggactccgcgctggtgctcatcgccggcagcggcgatagagcccgagatgaagactgaaaggttgcatggaaattcataatgggcagctaagtgtgcacttcttttttttttgtttcttttacatccaaattcacagagtgtaaaaagaatttgaagaagtatgaaaattacaaggggataccga

SEQ ID NO: 30399 - DNA, 506 bp, Sorghum bicolor
  Clone ID: 9854155
gcacgaggagcacatcctccattccgcctcctccccaccttcacccccacctcccgtctcctcctcggctccttccaaatccacacacttccgccgccgctatcgccaccggtcaccatccgtccgacgaggagggagtgaaaggggcgggcgggagggaaccctagatgacccgatccagggtcgggaccagagagagccttccggattgcgccttcgatcgctgcctcgcccccgccacggctgcctagggttcccgcgcctgtagatcgggtttgggggacgaggaagggggagtgccaagtaatgatggggtcgaggcgctccaagcgcgtttcgtgggccaccggggccaatctctgcaaggtaaggctttttctttcggaggattccccttctcaagctggattaagaccgcaggacaatctccaagcaaaaggctcatggttaatgcatgcagctggcccaagctcagatgattcgctgccacctggcttcgaatcgtt

SEQ ID NO: 30400 - DNA, 352 bp, Sorghum bicolor
  Clone ID: 9854164
gcacgagggcgcaacgacaccttcacgctctggaacgccgacatcccggccagcaccgtggacgtcaacctctacggctcccacccgttctacctcgacgtgcgccaccccgcctccggcggcggcgccgcgcatggcgtgctcctgctcaacagcaacggcatggacgtcgagtacggcggctcctacctcacctacaaggtcatcggcggcgtgctcgacttctacttctttgccggacccgcgccgctcgacgtcgtcgaccagtacacccagctcatcggccgcccggcccccatgccgtactggtctttcgggttccaccagtgcaggtacgggtacaagaacctgg

SEQ ID NO: 30401 - DNA, 456 bp, Sorghum bicolor
  unsure (1)..(456): unsure at all n locations
  Clone ID: 9854170
gcacgagggcaagagaataagccaccgccgccggcggcggcgggggggaggaggggaancccgctgctgcggaggtgcaagcgcgacgggtacacgcacgggctgcgcccgccgcagatggaggcgctccgggccatgtgcggcgcgctcatcccgtctctgcccgtcgatccggagggggaccaacagcagcccgcccgcggcaaaggccacgacgacctcgagcggttctaccgcgcttccgccgccgacggcgtcatccctgacgaggtggcggagatggtgacccgatgcgtatgggaggcgatgctgcttatgagggttatcctgtggatgctgagcaccagggtgggcacgttggcgctctgcggccgcctgtgcttgtgcttctccgacaacggcaagttcttcccgttcgtctgcaagttcgcggacatgccggtgaagaggaaggag

SEQ ID NO: 30402 - DNA, 562 bp, Sorghum bicolor
  unsure (1)..(562): unsure at all n locations
  Clone ID: 9854175
gcacgagggatcccggagaggaatgttgtctcctggaacactattgtcgctgcattcacgagggcaggggacatggtgtcggcacacgctgtgtttgataggatgccgatcagggatgccatttcttggaatctcatgatttcagggtatgcaggaagtggcaatgttgagtctgcgcgaacactttttgatctaatggatcggaaggatgtggtttcgtggacagctatggtctctgcctatgcaaagattggggatctagattcagctagagttctgtttgatcagatgcctgataagaacttggtttcatggaatgcaatgataacagggtacaaccacaactcgaggtatgatgaggcacttcgcacatttcagcagatgatgcttgagggaagattcatgcctgatgaagcaacattagtaagtgtcgtgtcagcctgcgctcagctgggcagtgttgaatactgcaactggatcagttcttacattantaaaagcaacactcatataactgttgcattaggaaatgctctcatagacatgtttgcaaaatgtggag

SEQ ID NO: 30403 - DNA, 566 bp, Sorghum bicolor
  Clone ID: 9854202
gcacgaggccaacattggtgactcacgcgccgtgctaggctcgagggacagtggcggcggtggcggcatggtagccgtgcaacttactgttgacctcaaaccggatgttcccagcgaggcagaacggattaagaagtgcaggggcagggtatttgctcttcaggacgaaccggaggtgccgcgggtctggctgccgttcgacgacgcgccaggcctggcaatggcccgggcgtttggggacttctgcctcaaggattatggtgtcatttcggttccagagttcttccactggtcgctcacggagaaggaccagtttgtcatccttgcatcagatggggtgtgggatgtccttagcaaccaggaggctgttgacattgtggcatcgtccccaagccgatctaaggctgcaaaatccctagtcgaggccgctacccgtgaatggaaaaccaagtacccgacatcaaagatcgatgactgtgcagtggtttgcctatatttggacggcaaaatggaccatgagcgtgactctacggcctccatggacaacatcagcctcgaaggttcag

SEQ ID NO: 30404 - DNA, 118 bp, Sorghum bicolor
  Clone ID: 9854207
ctgatcttgggaagaacgtatgaccaccacatatatgaccttgctgaagtaggagttgagaactacaagtcgatggaatcttatgtttatgataagaagctagcaccgaaactaggat

SEQ ID NO: 30405 - DNA, 561 bp, Sorghum bicolor
  unsure (1)..(561): unsure at all n locations
  Clone ID: 9854209
gcacgaggctcaactacaacactgtttttcctattgtgctttgttccctcaagattacaaatttgaagaagtagagctaattaacttttggataggactcaatgttttgcactcatcacatggtgacagtaaaagggttgaagatataggtgaaagcaatttgagagaactagttaatcatggatttctcgaaaaggaaggggaaaaggatggaaagtcttgttacatcattcatgatctcttacatgatttagcgcggaaagtttcatcacatgaatgccttaacatatatagttcacaatctcaagtaaggtccttacaagtacagccatcaatccgccacttgtccatcaacattgaagacactagtgtcaaggacagattcattctaaaaagttgtgtggaggatttcaatgcattatttacaagattaaaagttgaaaaactacggactttaatgttatttggggaacaccatggttgctttgtgaaggcttttggtggtttactcanggtagcaaaggctcttcgtgttatttttatatcggaagcatcctataa

SEQ ID NO: 30406 - DNA, 507 bp, Sorghum bicolor
  Clone ID: 9854218
gcacgaggcttatctgactctgagtggaagttttcatccatgtctccgatttgcatttacctttttggctgcctcgccgtgatcttcctctctcatcatcgccttctttattctgttgctgccgtcgacttcctctacaacggcttccagcacgccgcccatctgagcctagacggctcggcgtcaatcttgcgcggcggcgcgctccagcttaccaacgacagcaacaacctcatgggccacgccttcttcgactctcctgtgcgagctctcagcggcaacaacgccgtcgtctccttcagcacggccttcgtatttgacatcgtgaccgtcggccacagtggcggccacggcctgaccttcgtggttgcggcttctaaggtgcttcccggtgcaagagccgagcagtatcttggcctcctcggcaagaacaatttgggcaactccagcaaccacgtcttcgccgtggagttcgacacggtgcaggcgaacgggctgctgaacgag

SEQ ID NO: 30407 - DNA, 387 bp, Sorghum bicolor
  Clone ID: 9854244
gcacgagggttcgatgttgccatatatatcattattttatactgtctgtcataaattattggttacctactcacaggattgttgacacatcaattggatttcccagtagtaaatagtgtattcaagtctaagatgctgatctaagacatgcattaggtgcaccgtactgacataacaaattggactataatttttagttgcccttgataattttttttatgaaacccatctagctctgtccccatatcatcttgaatataatccaggaagttctcctgttgctgctgctggaatgcaaaatgccctttggtataatgataaatttgcctaactctctggcatggtttacaacacaccccctataatttgcccgattcaatagatcat

SEQ ID NO: 30408 - DNA, 526 bp, Sorghum bicolor
  unsure (1)..(526): unsure at all n locations
  Clone ID: 9854256
gcacgagggtcagaacgcgctccgggtgtccggcatccctgggtccatcgagtccgtcacgtccctgctctacaccggcaggggtccgcccgtgtccggaatgcacccgcggctgccgggcgctcccgccgacgccgaccacggggcctcaccggcgagccgcggctacgaccacctgccgttcaacctgctgggcctgctcatcctcaagaggctcgccagggaccacgacaactgcggcaagatcgggaacgcgcgaggcctgctcgccaaggtcatcaacttcacgcaggcgtcgccggttcttctccggaacccgcacgtgatcgactcgcaggtgagcgccgtgaagcgcgcgctcaaggtggtcaagatgctcgtctccacgacggggaacaccgggaaggcgctccgggagagcgtcgccgagaacgtgttcacggtgagcaacctgcgcgacatcctgcggtacgggcagcagcacagggagctgcagaagctcgccacggacgtgctcactgngctg

SEQ ID NO: 30409 - DNA, 642 bp, Sorghum bicolor
  Clone ID: 9854382
tatggtcatggtggttgtgattagatattttggaggcataaaactgggaactggtggactggtgagagcttatggtggggttgcttctgaatgtcttaaagatgctcctacttgtcttgtgaaaccaaaggctcgtgtgggtatggaggtaccatttgatcttttgggcacggtctatcatcagctgcaacatttccaagctgaagatattaaacaggactacgacactggaaaagatggtactgttatggtcatgttcgaagtggaatatgaaaaaattgagaatcttggaaatgcagtgaattcagcttgtagcaggaaaatagaactatatctataaaccgcaagcacgggtgaaggatgattttcagttggtacaacttcaattggtcgagtgtgtggagacactcaatcgtatgtacttgcaagcctctagttcttattcatttgccttgctacttattctggaatccccatggcttttttcgcaggtatttagcgccttatttaacttctaggccatattgaactgctccagtgtaaactgtacagcctgctatttgatctcgaggggcattcttgccttctaaatgtttttgtagctactagctatcatgctctgaacgacaccagtgtttaata

SEQ ID NO: 30410 - DNA, 659 bp, Sorghum bicolor
  Clone ID: 9854401
gtgttgtgaagaatgcactacatcactcgttgctgccaggattgaagctgaagagagactaaacaaccaacgtttgcgtgaggaacaagatgctgcttacagagctgcacttgaagctgaccaggccagggaacgtgaaaggatagaggaactggaaagacgtgaaagagaggctgcagaggctgagagaaagcgcaaggaagatgaggaagctttagcaagggcagcccaagaagcagctgaaaaggaagccgctcttgcaaggaggaggcaagagaaggccatggctcttggagctgaacctgagaaaggaccaggtgttactcgggttctcataagattcccaactggagagcgcaaagagcggagattccacagttctacaaccgtcacttccctctatgactatgttgattctttagattgcttgaaagcagagaagtacagcctagtttcgaatttcccacgtgtcacatatggtccagagaagcactccctgacactggaggaagcaggcttgcatccgcaggcgagcctgtttatcgagatagaacaatgatgctgtaagttgagataaccgaaactcaaaagtataggtgctcccttttcgaatttgttcagcaacagttaaggatttccagatgtattacaccacaggt

SEQ ID NO: 30411 - DNA, 644 bp, Sorghum bicolor
  Clone ID: 9854404
caccggatgcatgaaggttcctgtgtcactgagagggttaagtgccacttcgaggactgcaaatgttcattttcaaagaagtccaatttggacaagcatgttaaggcggtccatgagcagcgtcggccttttgtgtgccaattttctgggtgtggcaagagattctcttacaagcatgtaagggataatcatgagaagtcaagcgctcatgtgcgcaccgagggtgattttgtcgaggctgatgagcagcgaccacgttcagtaggtgggcgcaagaggaaacctgtatctgttgagagtttgatgcggaagagagtagccgctcctgatgatgggcctgctcatgctgatggaactgagtatttgaggtggcttctatcggggtgattcgtcctggatctgaaatacccgcaaattacttggcatgtataggaagaggaatgtatgtagtatgttatatatatgtttatgtacggtaccataaagacagatcattggaccttaattataaaggcaatatatgctgtattaacaagatcttgaatgtaagagcagttgctcgtgattattagggccttgtttagttggtgaaaatttttagttttggctactgtagcacttttgtttgtatttgacaattatta

SEQ ID NO: 30412 - DNA, 472 bp, Sorghum bicolor
  Clone ID: 9854424
ctctccttcttcccggaggccgtcacaattgtcctgtgctttgcggtgaagctgttctcggcgtgtcaaacccgagagcagagctcaccgcttgacttcaccttcaccttccggatcgttgctgccgcggggttcacgctaatgaccgggctctatgcggctttcatggggacagatcactatggcttgtacctcaggaccgctatgttcatcctgttacttgcagttctgtcaagcttgagccgtctggcaatcccacttcagcctagagttggaggaggaatcatcgagttcggcactactggtgtcgctctcgcttttcccctgctggcgcttctggctgctattccattggtgctccttgtcttcgtcgaccactacgtcaaccgctagtctttggctgtttgttggggaccggcacaattcttgctgtggtagggtacatgctgtagagtgccaggagtaacttttt

SEQ ID NO: 30413 - DNA, 681 bp, Sorghum bicolor
  unsure (1)..(681): unsure at all n locations
  Clone ID: 9854442
acacaagcggtgacaatccgatcaatgcagcacattaccaaggtacaaataatttccatgcaggaaccaatacagacaccattccggtgtccaacaatgccacttatatggtggataggtgcctagtcctactcccttctcagattccaggaaatagatgttatgtagatgcttccatttaaccggaccaatcagtctatacccctagagaagctgggattggcatcttcttggtcaatacacaagtgcacccccctcataatatcttcatcaaagcagccatgaagaatgcctcttcggtccttatggcagaagcggcggctcttgcccttgcggctgcagtgatcaaggctttgcagttggatcatactgcaatgctttctgacaatcagcagcttgtccatttcctaaatggacaagatcaggaacatccacctgacagagagttaaaccttttactcagttaattaagaccagcttgcagggcattgcatcatctataaaaaggatcaggcgtacacaaaaccaaatggcagatttgctcgccagacaagctcttacatgtattagggccaatcagattaccttcaacggtgactgttcttttgcacctcacgagcaggagtgtcccttaatgacggcacttcacaatgtaaccgttaactntgtaatggtttctaa

SEQ ID NO: 30414 - DNA, 363 bp, Sorghum bicolor
  Clone ID: 9854456
gccttgggtcatcagcagccgcggctggtgggagatgaagaaggtctacatggaccgtcagaacgtcaccgttaacatcaagcgcttcggcgagctactcagggcggcgcggactcacctcaagaacaccacggcgtgctccaagggcgccggcggcggcgccaccgcggcactgaggtagaagatgctaattgagcttggttggttaggtgttaattacttagtcacacttgtcaatttctttgtgttttcgtcctcttttttttggctggggagagaagggagggaggtggataaaaaggagacgagatcctgtaaatatgattgggttggttcttggatgagagattggtggggatcgat

SEQ ID NO: 30415 - DNA, 555 bp, Sorghum bicolor
  Clone ID: 9854472
gcaacaaggctttctcgtcttctcgcgggagcggtggcggcggcatccaccatccaaggcgcggccgccgtgcgtggctccgtccaagcgaccaggcgtggccgcaactcgcgcgcgagtcgcggcgacggcatccaatccaagcgaggcaaagaaataaagcgaaaaagtttaaacgggtacacaggagatccagcgaaatggcggcgccgccgccgtcatatccagcggccttgaagccggagatcggccctgacggcctcgctcgagattctcccgtaatcgcctacaccgagaaggtcattttggaggagcagctgcagctgaagaaatacattcaggagaactattccaaaattcgtgacgtagaaaaggagttagagagtcttactttagaaatgaaactgacagctgggccaaagaaagcagcacttgagcacctgaggaagaagattgaaatatcaacagagaaaatacgtttagctaaggtgaaagaggaacaggcaaaaaaggcctgggaagttgctgcacaagttgttaaagacgaagaggatg

SEQ ID NO: 30416 - DNA, 477 bp, Sorghum bicolor
  Clone ID: 9854477
gcacgagggtctgttaactctttggttcaaccatggggctacctcagaagttcaaacagcgttgcagaaaggcttttcacttgtcaagattgagatgtggctggttgtgctgccccagataattgcaaggattcattcgaacaccagagtagttagagaactgatacaatctttgctagttcgaattggaaaggggcatccacaggctttgatgtatcctctcttggttgcctgcaaatcaataagtatattgagacaacgtgcagcgcaggaggtcgttgataagatccgccagcacagtggaggtcttgttgaccaggcacaacttgtatcaaaggaactgatacgggtagcaattttgtggcatgaaatgtggcatgaggctcttgaggaagctagcaggatgtactttggtgagcacaatattgaaggaatgcttgctgtacttgagccattgcatgcaatgcttgagagggg

SEQ ID NO: 30417 - DNA, 390 bp, Sorghum bicolor
  Clone ID: 9854489
gcacgaggctgctctacgcggtggcgttctcgcagtcgtcgacgttcttcacgaaacaggcggcgacgctagaccggcgcatcgggcggcacggcttgcaggtgccaccggccgcgctgcagagcttcatcagcatcaccatcgtcgtcttcatccccatctacgaccgcgtcctcgtgccggtgtcgcgccggtactccgggaagccatcgggcatcaccatgctgcagcgcatcggcacggggatgctcctctcgctcctgtccatggtgatcgcggcgctcgtcgagaagcaccggctcggcgtcgcgcgggacgcgggcctcgtggacaagccgaaggtcccgctgccgatgagcctgtggtggatggtgccgcagtacgtgctgt

SEQ ID NO: 30418 - DNA, 505 bp, Sorghum bicolor
  unsure (1)..(505): unsure at all n locations
  Clone ID: 9854490
gcacgaggcttcctcctgcttgtacgctactcggtgagtaggaagcagcagagagcgaggaagaggcagcagctagacgacgaagacgaagacgacgacgaccatcatctacctctgccgccttcgcctccggcgctgcccctcttcgggcacctccacctcatcggctcgctgcctcacgtctccctccggagcctcgccacgaagcacggccccgacctcatgctgctccgcctcggcgccatgccggtgctcgtcgtgtcgtcgccccgcgccgccgaggccgtgctgcgcacgcacgaccacgtgttcgcgtcccggccgcactccctggtcaccgaggtcgtcctgtacgggccgtccgacatcggcttcgcgccgtacggggaccactggcggaaggccaggaagctcgtcaccacccacctgctcaccgtcagaagggtgcagtcgttccgccacgcccgcgaggaagaggtgagcacggtgatggctgagnatcgcc

SEQ ID NO: 30419 - DNA, 600 bp, Sorghum bicolor
  Clone ID: 9854515
gcacgagggtcatgggccaacagcacagactgctgccaatgggaaggaataaactgcggcaacggtggcgtggtcacagaagtcttgctgccttctaaaggcctcaaagggaggatcccaccatctctcagcaatcttacagggctgctgcatctcaacctgtcatgcaattcactctacggcagtctgccagcagaattggtgttctccagcagcatcatcatcctggatgtcagcttcaacagcctatctggtcctctgctagagcgtcagtccccaatttctggccttcctctcaaggtactgaatatctcaagtaactcctttacaggacagttaccatccacaacactgcaagtgatgaacaatcttgtcgctcttaatgcaagcaacaacagctttacgggaccattgccatcttccatttgcatccatgcaccatcacttgtcatacttgaccttttcttaaatgacttcagtggcactatttccccagagtttggcaattgctccaagttgacagtactcaaggctggccgcaacaaccttaccggaggtctaccccatgaactgttcaatgctacctcactggagcacctt

SEQ ID NO: 30420 - DNA, 545 bp, Sorghum bicolor
  Clone ID: 9854528
gcacgaggaatgggcagtttcatggggaaactgccagcaacatgccaaatttgctgccaaaccatctacaacgtcacgaatacattcatgccccctcaaatgccgacaatacgccaacaccatggcttgctcccaattcagcaatcttcacagcagtcatcaagaacacaggcacacatgtttggtccccagcatccaccacatatgatgaataggtttgataattttgggatgcctgagttcagtgatccaagagcaagatcatcaatgcaccatggaaggcaaggtcaccattttccattccaaggctctgagtttggtattatgaagatgggtaatgggaggtcaagatttagatccaagtatatgtccactgaagaacttgaaaacattttaagaatacagcatgccgccactcacataaatgatccatacatcgatgattattaccatcaagcttgtctggccagcagatatgtggatggaaggtcgaagcaccgcttctacccaaccttgattcgggatccatcatcatgtgcgcggag

SEQ ID NO: 30421 - DNA, 485 bp, Sorghum bicolor
  Clone ID: 9854531
gcacgaggccacgtggtcctcctgccgtacccgagtcagggccacgtccaccccatgctccagttcggcaagcgcctggcgtaccacggccttcgccccacgcttgccgtcacccgcttcatcctggccacctgcgcgcccgacgccgccgcgctgcagggcctgggcggcgcgggcgcgggcgcgggcgcggtccgcctcgcggcggtctcggacggcttcgaccgcggcggcttcggcgagtgcggcgaggtgacggcgtacctgtcccggctcgaggcggccgggtcggagacgctgggggagctcctccgggacgaggccgcgcggggccggcacgtccgggcggtggtctacgacgcgttcctgccctgggcgcagggcgtggcgcggcggcacggcgccgcggccgcggccttcttcacgcagccgtgcgccgtcaacgtggcgtacggccacgtgtggtcccgccggctaagcgtgcc

SEQ ID NO: 30422 - DNA, 570 bp, Sorghum bicolor
  Clone ID: 9854547
gcacgagggcggaacagcgagcgagcaacaacaccgctagaccggagcagtagcagtaatatagctactatcgccgtcgtcgtcccgggctgccggcgaggggaaaaaatggtggccaagaagcaggccccgttcgacgagttgtcgctggtggaggcccgcggcggcggcggtggcggtggcgatgacgcggagtggcgcgacgacgacgggcggccgcggcggacgggcacggtgtggacggcgagcgcgcacatcatcacggccgtgatcggctccggcgtcctgtcgctggcgtgggccatcgcgcagctcgggtgggcggccggccccgccgtcatgatcctcttcgccgtcgtcatctactacacctccacgctgctcgccgagtgctaccgctccggcgaccccgtggcggggaagcgcaactacacctacatggacgccgtccgctccagccttggcggcgccaaggtcacgctctgcggctccatccagtacgccaacctcttcggcgtcgccatcggttacaccatcgccgcatccatcagcatgctggcgatcaagagg

SEQ ID NO: 30423 - DNA, 439 bp, Sorghum bicolor
  Clone ID: 9854548
gcacgaggagaaagcttcgttagtaccagaggttcaagttgatacaactcttattgataaactcactgccgagaatgagaatcttaaggctttagtgggctctcttgagaccaaaattgatgaaacagaacagaagtttgaagaaatgaagaaagcaagagaagagtggctgaagaaagctacagatgctgagtcaaagataaatgaattgacaaacacaatgcaaagttttcaagaaaaggtaactactatggaagcagaaaatcaactacttcggcagcaggcgctgttgcgtactcctgttagaacaatacctgaaaacgcatctccgaaatctaatttgactaatggcagtccacgcattgatgaacaaaagacacctcatggaactcctcctgctcccaaagattatgggagctttggacagccaagagcatcc

SEQ ID NO: 30424 - DNA, 171 bp, Sorghum bicolor
  Clone ID: 9854565
gcacgaggcccactacgcttgacgactcgctagtcgagggtttctctcctgcgcggcggctgcctccctctccacggcggcggcgggcgggcgatcctgcagatcccgcggctcaatccaagattcaagggggttagtcagactcagatgggggaagggggagagagcggc

SEQ ID NO: 30425 - DNA, 550 bp, Sorghum bicolor
  unsure (1)..(550): unsure at all n locations
  Clone ID: 9854576
gcacgaggcgtcccacccgccttcgcccccgacgccgaagccgcgcagggacaggggttgaaatcaaggtattgtgataaatgttgcatgttcaagcctcctcgcacccaccactgcaaggtctgcaaaaggtgtgttctgaaaatggatcatcactgtgtctggatcaacaactgtgtagggtacgcaaactacaaagccttcatcatttgtatcctaaatgcaactatcgggtctctgtattcatttgcgatatttctatgcgatctacttctgaaagagcatgacttcgatattctatatgtgaagatactctatatcttggcaggtgtactgttgttcttcttaagcttgacaataggttctctactatgctggcacatctatcttttgtgtgataacatgacaaccatagagtaccgggaggcagtaagagcgaggtggcttgcaaagaagagtgggcagaagtatcgccaccggttcgatcttgggatacggaagaacattcaaatgatcctgngtccaaacattctttgctggctttggacta

SEQ ID NO: 30426 - DNA, 222 bp, Sorghum bicolor
  Clone ID: 9854586
gcacgaggcttccttcccccctttcttcgcctaccggtaaccgacgtagccaaagaacctggcttcgccttctcccgcggcggcgcgggcggacggtgctgctgcgccggcgcgtgagatggaggattgcggcggcgtaacggctggaagcggaaagaagccgttccagctgacgcggtcgctgacgtaccaccaccaccaggggcaccggccggcggcgta

SEQ ID NO: 30427 - DNA, 458 bp, Sorghum bicolor
  Clone ID: 9854589
gcacgaggcggcggggccgtgcctggtgctgggttctcaccatcctcgtcgcagtcaccggcgtgatgctaatcgtggctgacacaatcctcctcatcgtggcgaaccgaagcaacatgttactgtcagttcttctcgggccggtggtgttgcttgtcggtgtggccgtgagcactggagcatggatgctggaggagcccagctcggactcggagcttggaaaaaggtacgacgcggccatgaaggtcacctttgatatggccaccgttggcaccattgtctccttcactcttcaggggggtgtcgcctttagctacctgaagacccctggcactggcagtaataatcatcaggtgaagcgtgacccgccgctggacctcgctgcgtgctacgccacctcgacgctctccctgatcgctatgatggtgtgcgccatgccgctggcgcttctcccaaac

SEQ ID NO: 30428 - DNA, 593 bp, Sorghum bicolor
  Clone ID: 9854595
cccaagcaggggctatcttgtgaatgacacagttgttgtagaagctgaggttgctgtccgcagaatggttgattattggacttatgactcaaaaaaaagaaacaggttttgtaggtcttaagaatcaaggtgctacctgttatatgaactctctccttcaaactttataccatacaccatattttagaaaggctgtatatcatatgccaacaactgagaatgacatgccatctgggagtatccctttagccctgcagagccttttttacaagctccagtatagtgacaacagtgtagcaacgaaagagttgaccaaatcctttggatgggatacttatgattctttcatgcaacatgacgtgcaagaactcaacagagttctttgtgagaaactggaagataagatgaagggaactgttgtggaaggaacaattgaacaattatttgaaggccaccacattaattacatcgagtgcattaacgtggactataaatctagcagaaaagaatcattttacgatctacagcttgatgtgaaaggttgtcgtgatgtttatgcatcatttgataagtatgtggaagtggagcgtcta

SEQ ID NO: 30429 - DNA, 481 bp, Sorghum bicolor
  unsure (1)..(481): unsure at all n locations
  Clone ID: 9854602
gcacgaggaatataactgcaaaagctgtgaggggagatgaggagtcagtagcactccaggctattgaattctggagttccatatgtgatgaggaaattgacattctggatgagtacagcagtgagtttacagctgattctgatgttccttgctactactttatcaagcaggctcttcctgccttagtgccgatgttgttggaaactctcctcaagcaagaggaagaccaagacttggatgaaggtgcttggaatcttgcaatggctgggggaacttgtttgggcctggtggcaaggactgttggtgatgacattgttcctcttgtaatgcctttcgtggaggagaacataaccaagtctgaatggagacagagagaggctgcaacatatgcctttggctctatcttggagggcccatcagctgataaactggctcctcttgttaatgttgcattgggcttcatgctgtctgcactgacgna

SEQ ID NO: 30430 - DNA, 565 bp, Sorghum bicolor
  Clone ID: 9854603
gcacgagggcgcggccggcccggcaaactccctctggtttctgatgatgggtgtatcgcaagctgccgctgtcgtggtggtcatggcgttggccgtcgcggtcgcgttgccggcgtcggccttcccgtccggcttgccgcctggggcgccaccgttcccgaacccgtgggcggcgttccagaacctctctggctgtcacatgggggaggagcggcagggcctggcggggctcaaggactacctcagccacttcggctacctcccgccgccgccgccgtcgtccccgttcagcgacgcgttcgatcaggacctggagtccgccatcgccacgtaccagcgcaacttcgggctcaacgccaccggcgcgctggacgcgtccaccgtctcgcagatggtctcccctcgctgcggcgtggccgacgtcatcaacggcacgtccaccatggccaagagctccagctcctcggcggacgacgcccacggcaggcacctgtacgcctacttcgccggcgagccgacgtggccgccgttccggcgggacctcaagtacgccatcaccgccacg

SEQ ID NO: 30431 - DNA, 487 bp, Sorghum bicolor
  Clone ID: 9854621
ggcacgaggctcttcttctcctccccccactccagccatgaatatgatcgtcagaagctgctagcatcatctgccgcctcaacttcgtcacctcctcctctccattctatccccgcgcagctgccccagctgtatatatccccgcgcccaatttggtccctccctggtgtgggtgaggtcagctgttttagcgcagcgcagcgcgcgggcgggcggcgtggcagcaaaggaagcaaggagaacagcggcggcggcgtagcatgcggcggtgagggagggaggaggaggaagagggagccgccgagagagcgagagccggaggatgatgcagctgccgcagcatcacaagccctccgcccactcctgctgctcgtcgtggatccggaggtccccgccgccgtcgccgccgcacaagaagccgggcggcggcggagggagggggcggtacgcttgccggctcgtgcccctgctcgtgctcaccgtgtac

SEQ ID NO: 30432 - DNA, 168 bp, Sorghum bicolor
  Clone ID: 9854630
gcacgaggagctcctccaggctggcaccgacttcgcggcactggtcgcagcgcacgacagctccatggagctcgtggagagcgcggcgccggcgagcgagcgcgagctgcccctctcccggcagccgtggaacaagaacgcagacggcagggcgtgcaacggcgactc

SEQ ID NO: 30433 - DNA, 436 bp, Sorghum bicolor
  Clone ID: 9854632
gcacgaggcggagcttcgttcgagcatcatcagccttgggcagatggacgagcacggagcggaggtcctcatccgcaacggcgtgctcagaatcaaggaccaggatggccgactcctggcgaaggtacagagaacgcgtaaccgtctctacctccttgatctgaaggttgagcagccggtgtgtctggcggcggcgtgcgcggaggagccctggttgtggcacggccggctcggccacctcaacttcgacgcactggggcggctcgggaagatggtgaccggcatgccaagcatcaagcacgccggggagctatgcgatagctgcctcgccgggaagcagaggaggatggcgttcaccaagatggccaagtatcgcgcggcggaacggctcgagctggtgcacggggacctttgcgggcccattacgccggcgacg

SEQ ID NO: 30434 - DNA, 422 bp, Sorghum bicolor
  Clone ID: 9854978
gcacgaggctcacagttgcctgctgacttgcaagccaagatttttcagaaggctgaagagggcgctcgcaagtgtattgttgctaccaatattgctgagacctcattaacagtcgatggtatcttctatgtcattgataccgggtatgggaagatgaaggtgtacaacccacggatgggtatggatgcccttcaggttttccctgtcagccgggcagctgcagaccagcgtgcaggtagggcaggaagaactggccctggtacatgttacaggttgttcacagaatcagcctaccagaatgagatgctccctaaccctgtgccagagatccaaaggaccaacctgtggaatgtggtgcttttactgaaatccctcagggttgaaaacttgcttgactttgactttatggacccaccccccca

SEQ ID NO: 30435 - DNA, 418 bp, Sorghum bicolor
  Clone ID: 9854986
gcacgaggctcaatcccttccttgcgtggcccttgcgtttgccatggccatgcaagcgcggcaccactcccacgactacttcctatcgagggccggctccctgttcttggacgagtacgccgggtgcgtgcccctgccaacgtcgccggcggtggggatccgggacatgccgctgctcagcgactttgcaggcagcgagcttagctttggctacagtttcctgccgaggaagcgggcgcgcatggaggatcaccgcgttgttctgcccccggcggtgatgcaggggctggtgcaagtgcaagtgcaactgccgatgacatccagtaacgtgatgggttccggcgccgtgacgtccacaagtgggagggagatcgacgcgctgctaagagtggagagcgagaggatgcgcgcggcgctg

SEQ ID NO: 30436 - DNA, 459 bp, Sorghum bicolor
  Clone ID: 9854987
gcacgaggcacagtcgaagcatggagaagcctatcctgttacgattggctcagctatagtcgacggggataggctaccagccggcggttctttcagctcctggcatggcaaggtcgacatggagcatgagctgctgaaggtcagctacgacatatacacacgccatgttcctccacgtgtgaatttcatgaacatgacgtccccaattaccatagaagaacgcctgatcacagctgagggtgtttacgatccgaagacgggtgtcctgtgcatgatcggttgccaagagctggaaggctccacggaaacggactgccagatcttgatcaccgtgcacttcgcctcgctggatgccaaggcgcagggccgtggaaggggagtgatcggcagcctgagagccaagacgacagaccctctcttcttcagcaagatggacattgctctgttcgggaggtaccg

SEQ ID NO: 30437 - DNA, 275 bp, Sorghum bicolor
  Clone ID: 9854997
gcacgagggggcgagcagcactcccagcctcagcaggctgaacaaggccggggtcaggggaaccaggacaatcagtcccccgctgctggtaacggtaccgcggacagcgacaacaacgtgagctatgattcaaaaaaggtgttcattggtggtttgcgggataacatcaccgaggaggagttccggtcttactttgagacgtttggcactgtaacggatgtcgtggtgatttatgacagcgcgacgagccggtcgagggggttcggtttggtgac

SEQ ID NO: 30438 - DNA, 553 bp, Sorghum bicolor
  Clone ID: 9855001
gcacgaggctcgagttgcatagctggaacagctggcactcttgtgaccgcacctgtagacatgatcaaaacacggttaatgctgcaacgggagtccaaaggtaccagagtatacaggaacgggttccattgtgcttaccaggtgttgatcttaatctttcattttgatgtttgtggtattaggaattactgctggtaaaacattgcgaaaagtactttctacaagtgcctgaaagcactgccaaattgttagggcttcctgggagcttttggacctttcaaaagccaaaaaaactcccggaagccaaaagccatgagcttctgggtttttggcttatgggagctgttttgcttttggaaagtccaaaagctagtagtctaaaaatgaccaattgttcgtttggctgataagtcatggcagaaagtactgttggctgatttgttatgagagaaaaatactgctgaatggatgttacaactgaggagattggaaatacaatacctttagcaccaacaacataaaagtattcttctgatggttatttccattctct

SEQ ID NO: 30439 - DNA, 448 bp, Sorghum bicolor
  Clone ID: 9855005
gcacgaggattaccttcagggatcagttcattggttgagctgcagtacctggatttgtataacacaaacatcaggtcacttccaagggagctaggatctctatcaactctgcggttcttgcttctctcacatatgccactggaaatgatcccgggtggtgttatatgcagcctcacaatgctgcaagttctgtacatggatctcagctacggagattggaaggttggtgcaagtgggaatggtgttgattttcaagagcttgagaatctgcgtaggctcaaggcgctggacatcacaatacaatctgttgaggccctggaacggctgtcacggtcatatcgtcttgctggttccacaagaaacctactgataaagacaagctccagcctgacgaagatagagcttccttcgagcaacctgtggaagaacatgactaacctgaagagag

SEQ ID NO: 30440 - DNA, 564 bp, Sorghum bicolor
  unsure (1)..(564): unsure at all n locations
  Clone ID: 9855032
gcacgaggctggccatccgcaccgccaccgcagatccccaattcgtttcctcccaccgagccaagcggcgacgacggcggtcgcagcgtccccttccctcctccctccgtaccgccgccacagacgagcagattgggccgagcacctccccggcaagcagcagcgctgtcgccggtaccaagtcctggtccgccgcgccgtggggctcgctgaaacgggtctactcccaagtgaaatcagcctcttcaagatagcttactgagatgtggggttttgcatcaaatgcttgggcatctgggctggggaagaggagtcccccaaactgcacttcttcaagtgctgctggttctgatgatgaagcatcctcatgcacaagcagggaagaaggcctggaatgcccaatttgttgggaatctttcaacatagtggaaaatgtgccttatgtgctgtggtgcggccacaccatgtgcaagaactgcatcctangactccaatgggctgtcatcaaagttccaactgtgccgatccagctaccattcttcatttgctgtccctggtgcaacc

SEQ ID NO: 30441 - DNA, 378 bp, Sorghum bicolor
  Clone ID: 9855041
gcacgaggcgcacccaacgccagcgtcaacttcttcagctacaagaaccggataccgggcatcggcaacttcgtgctggaagtgaacgggcagatgcagcggcggcagtggagcccggaggcaggcaagtggatcctcttctgctccgagccccacgacgggtgcgacgtctacggctcctgcgggcccttcggtgtgtgcagcaacacctccagcgccatgtgcgagtgccccgcggcgttcgcgccgcggtcgcaggggcagtggaagctggggaacacggcctcagggtgcgtcaggcggaccaaactggactgtcccaacgacggcttcctcaagctgccgtacgccgtgcagcttccggtcggctctgcagag

SEQ ID NO: 30442 - DNA, 454 bp, Sorghum bicolor
  Clone ID: 9855050
gcacgaggcgaggttattgtcatcaatcaccaaaaagggagattgaaagagcatctaggcccctaatgatttcggtgattaatgacaatgttgattactatgactaacgtgtgttttgcagaggcaaagtcattagtaaggtcttggttacaggtactcaatgaacagggacgtacttgcctacttaatagtggaaatcgtttcagatttcaaaggatggatggacatcatcaagactagactaggtctaagtgccatatggtgaagaagggcacttagagtagtttaggattttgttttcctttgaccgtactattaagaggggctttgatctagtagcttgacttaggcaaggctttaagtttaagtgtggtgcacacttggtaaacctagcactaggcagctcagagacagtccttagatcgagaggaaccaacttcgttttggaacgatc

SEQ ID NO: 30443 - DNA, 524 bp, Sorghum bicolor
  Clone ID: 9855053
gcacgaggcaccgacttgtcataaacagcttaaatgctcagggtagggggcaacatggtggcacatcaatgccatatcaaactataatgaatggcttgcaccatctgaatgtaatgccccctgtcagcagtcaaggcatgcctccacgagttgggcagtctgctggacctcctggatggtatgttcctaggggtagtgtatcaaatggtcaaccaccggcttatgcatcatcaggatcaggtcattatcagtatgaaaggtcagggccttcgcaatatgaacaaggtaaccatggaaggcaacaatctcacccatatgcaagagacggcctccatgatacacgaggcagggctccacctgcatatgggtaccagcagagcaacatgtatccgctgggtcctggattgtatgggcaacctccgtcggcatatcctggggtccatggtggaggctaccaaccccctccatatggcggaggccagcagtggcagcaacaaccatatagttcgtatgctgggcgaagg

SEQ ID NO: 30444 - DNA, 595 bp, Sorghum bicolor
  Clone ID: 9855059
gcacgaggcagcttctccctttccatccaatcgcaaaccccgtacacctcgatcttcagcttcggggattccttcaccgacaccggcaacttcgccatcatcgccggcccgacgacgccaggcctgctcatcaccaaaccgccgtacgggatgaccttcttcggccaccccaccggccgcatctctgacgggagattagccatcgatttcatcggtaagttcccttctttcgtttcagcaccgatgctcgacgacgacgattagaggatttgtttgtttgacgcgcgtaaacgtgcacgcgtagctgaagcgctggggcttccgctcctgctgccgtcgatggcggcgaaccagagcttcaagcaaggcgcaaacttcgcggtggccggagccacggcactggaccggacgttcttcgtgaacgacggcgacacagctgttacggcgtacaacatctccgtcggcgaccagctccggtggttcgacgccatgaagcccactctctgcgattccacccaagcgtgccgggagtacttcgcgcaggctctgttcgtcgtcggggagttcgggtggaacgactacggcttcatgctgc

SEQ ID NO: 30445 - DNA, 365 bp, Sorghum bicolor
  Clone ID: 9855061
gcacgaggtgagggcctcggacgcaagttccgactcgcccgacccctcagggcctcggacgcaagttccaactcgcccgaccccgtccaggctcgggcaccggaccccactccgcctgggcagcaagacttccaccgcacggcacccgtacctacgacatgacagacgcgttggcttccataccgcagcagggcaaggcgacaactattccaaccaccctgggcactgcagcatcaccttttcactatgtgcccttacctctttcactgcagcgtacagccgcacagtagaaagggaatgggagaggtaaatcagcaccactatttggggtcttttcccactattgacgagatgtgaagcagtgc

SEQ ID NO: 30446 - DNA, 576 bp, Sorghum bicolor
  Clone ID: 9855088
gcacgaggaaactgataccagtcatctcggtcacaaacaagaattcacgcaaatagaggcagggaatgtggtaactgtgcagcgaaatggagcaagccaagaacaaattcctctcttgcagccctctggtgatactgcgactgattcggtgcacctaggtcaaaaacaagatattctggaaggtatgacggcaccctctgataacagcccatttttcagcaaaccattttttgagccagtacccccaataaaagtttttccgggaggggacaaccagacggttgcaaaaccaactttagttattcaccaaccggttgagtcagaagctccacctcatacagtagtggcagtccctgaggctgagacaccagttcctgcattatcagctccaagggatgaatgggatatactgaaagcaatagtgtatggcggccttgttgaatcaatcatgagcctctcagttgtatcagcagcagcagcaagcggttccaagaccttggatatattcatcctgggcatagcaaaccttattggtggtattcctgtaatttaccacaatattgctgatctgcgaaa

SEQ ID NO: 30447 - DNA, 546 bp, Sorghum bicolor
  Clone ID: 9855089
gcacgaggcccgaccgcgctctaccgctgcgcgtcgctccagtacctcgacctgtcccagaacaacctcaccggtgagctgcctgcggacatcggcagcctggggaagaatctgaccacgctgtgcctatacagcaacgggttcaatggctccatcccggcgggtctcggggcgctgacgaggcttcagaccttgtggatcgccagcaacccattcgtcgcgggcgagctgccgccgtcgttcaagaacctcaccaacctagtcagcctctgggcacagcagtgcaacctcatcggcgacttcccgagctctgtgcttgagatgaaggagttggagttgctgagcctggccaataacatgttgaccggaagcatacctgcgggtgtttggagcctgaagaacttgcagcaattgtttttgtacggcaacaacctcaccggcgacgtggttgttaatgacttggccgcgacgaacttaaattacatcgacctttcggagaattataagcttaccggagccatccctgaagcctttggggccttgaag

SEQ ID NO: 30448 - DNA, 508 bp, Sorghum bicolor
  Clone ID: 9855097
gcacgaggcagaagtgacacatcacacacacacacacacacagaaatgagatagtgctcgaaaaatatatacacagttactccagatagctagctatccgatccacaacaatataatggaggagaaggtgctcctcgccgtggccgtggccgtgctactcgtcgtcctctccaagctcaagtctttgctcgtcaccagggcgaagcttaacctgcccccggggccatggacgctgccgttgatagggagcgtccaccacctggtcaccagcccgtcgatctaccgggcaatgcgtgacctcgcgcaggagcacgggccgctcatgatgctccggctgggcgaggtgcccacgctggtggtgtcgtcgccggaggccgcgcaggcgatcaccaaggcgcacgacatcacgttcgccgaccgccacttgaacgccaccatcggcgtgctcacctttaacggcaccgacctggtgttcgggacctacggcgagcggtggcgccagctccgc

SEQ ID NO: 30449 - DNA, 577 bp, Sorghum bicolor
  Clone ID: 9855104
gcacgaggcttttatgtgatggagggcttcctaaaggagcagaagactgctgaatcaattggaatgcatgacatgtggcttagcaaaagcaaagaactagatgcattttcttaccgatctgtgttgccttcattaccatggctggatgcagatcgagccaagaacttggtagagtctatgctgaccatgaaacttactgaattcccatattgtggttgcatcgtgaaggaattaatgcaaacaaggaatataaagtgggccatgccagtcttgcaagaatcaagtcctgggaagctcagtgccactttgttaaattccttacttcaagtctatggttggctaaaaaattggagaaagttagatgcagttctttgcaagatgctaaagatgcatgacaccctttctatatctagctaccgctttcttgtgtgcagaatgtgtgagcaaagtcggttttctagtgcttcaagccttagagcactgttccaatatgctgacaagtcaagagaactaattgcatgcaacattctaatattttatctttttcaaagaagaaacagctcacagattcatgatt

SEQ ID NO: 30450 - DNA, 454 bp, Sorghum bicolor
  Clone ID: 9855107
gcacgaggcaccactgctcagtaaactgccaaacacagacagcaagctagatagatagctattccgttccagccagagccatggctcaagtgctgcaggaagtgcaccagtatggcctccatgaacagctgcacgaatcacctccacaagcagcactgatctactctcttctgctagccgcttgccctgtaataattctcctcctactcatacgccgctacgcgacgacgtcgccgtcggcaggggccacggcggcgagagcaaggcaagaagagctgctggggaagctccctgcgcctccgcgcaagctccccgtcgtcggtcacctacacctcgtagggcccctcccgcacgtctccctccgcgacctcgccgccgagcacgggcgcgacggcctcatgctcctccgcctcggcgccgtccccacgctcgtcgtctcctccccgcgcgccgg

SEQ ID NO: 30451 - DNA, 540 bp, Sorghum bicolor
  Clone ID: 9855115
gcacgagggcacgtcgaggtggacgacaggtcagtgcacaacatctacaaactgctggttaactcagggcttgcctttggagcacgccggtgggttggaacgctagatcgccagtgcgagcgccttgccagtgtcatggccagcaacattccgactagtgatattggtgtgatcacgagcacggaggggagaaagagcatgctgaagctggctgagaggatggtgatgagcttctgcggtggagtgacggcctcagctgcacaccagtggactacgctctcaggcagtggtgctgaggacgtccgtgtcatgaccaggaagagcgtcgacgaccctggcaggccaccgggcatagtcctcaacgctgccacctctttctggctccccgtcccgcccaagcgtgtcttcgacttccttcgtgatgaaagctctcgcagcgagtgggacatcctctccaatggcggtgttgttcaagaaatggctcacatcgccaatggccgcgatcatggcaactgcgtctcgcttcttcgtgtcaatagc

SEQ ID NO: 30452 - DNA, 399 bp, Sorghum bicolor
  unsure (1)..(399): unsure at all n locations
  Clone ID: 9855141
gcacgagggtgatccatcgtcaagcgagcgagcgaggaagcagatcgagaagcacccaaccacactgcaggtggtggtgagtcctggttgctgctggcaatggcgattgaagcgatgatgctgagcgggctcaactccggcgtggtgctgagcctgatcgcggtgctgtggacggtggtgtggcagaacctgcagcacctgcagctgcagcagttcttcgcgcggcacctgagccggcacgcgcggcggctggcggccatggtggacccgtacctgtcggtgaccatctccgagtacgagggcggtcggatgaagcgcancgacgcgtacgaggaggtcaaggcctacctcancgacgccagcgcccgcggcgtgcgccacctccgcgccgagggcgcc

SEQ ID NO: 30453 - DNA, 468 bp, Sorghum bicolor
  Clone ID: 9855164
gcacgagggaggaggtcgaatccgggggtcctctctcgcagtccaacgaaaccctcagaggcacgggtcggttcgccgacatgctgtctggcgtgaagctggttcctcgagagcagatccagtctgatcagaggcgtagaggtgaccggggctccgattccgactcctccgacggcaagaggccgtcgaagcacagtaaaagagggcgggacaagaaggagaagaagaagagaaaaagtagccggcggcagcggaggcggagcaagaggtactcgtcggaagagttttcggcgtcagacaccgacgattcaatcggggaggaagaggaggaggatgtcagtcggagtaagcgtcgggggaaggacaggaggcggcggcgcaacttctctgacgacgatgaatccgaatccagtgaatctgataggggaagagcccctcgcagggggaagcagagacgcaatgacgaag

SEQ ID NO: 30454 - DNA, 134 bp, Sorghum bicolor
  Clone ID: 9855184
tgaagaaatggagttccaaggtattttccgaaatctgaaaacatctaacattctgttggatgaaaactgggatgctaaattatcagactttggtttggctaggcatggaccggcacaagggctgacccatgtcg

SEQ ID NO: 30455 - DNA, 487 bp, Sorghum bicolor
  Clone ID: 9855192
gcacgaggcttcccttcgccccctccccacctaacgttaccggccggtcagcctccagtccacccgcgcgtccgtccgccgcacggccgcagcagagcctctagttagttacttcacccttcatcggacgcgggcgggcgctgtcgtctgtcgagtcgcgcgcggccctttccgcccgccgagcgccgagccgagagctgcggtgcgcgcgcgtcgacgcccgccgcgccgaggatcgacgagcgagctccggcggcgcggcggaggaatgcggatggggaagtacgagatggggcggacgctcggggaaggccacttcggcaaggtgaagctggcgcggcacgcggacacgggcaggaccttcgccatcaagatcctcgaccgccagcgcatcctcgccatgaagatcaacgagcagatcaagagggagatcgccacgctgaagctgctcaagcaccccaacgtcgtccgcctctacgaggtttca

SEQ ID NO: 30456 - DNA, 252 bp, Sorghum bicolor
  Clone ID: 9855229
gtttttttgtctcccgcggtctttcccaggcggcgacgggcgtggccacggtgtggcaccggtggccccctccccctctgcccacgtccccgtcctcgccctggcccctgcccgcgcctccccttgctctccctctctgcatctctgtcgacgtggtggcacaccggcctggcacggtcgcggccatgctgatgctacacctctccgccccttcccatcgctgacgcacgggggaacactggagccgcggga

SEQ ID NO: 30457 - DNA, 419 bp, Sorghum bicolor
  Clone ID: 9855238
gcacgaggcatgcttgtactgttttacttttggtcacagttacatgcgtgcccgtgcataggtaccaaacttacaacactgcttggagcaaaactaagattgcctggctctgtaatctaccacactggttccataaacaacattggcagctcggttgagattcaggtaatcctcatcagaatgggcagacgccctgtttcggttggcctaaactctcctaaagccctacttagacagacaataatgttatatgtaaccatcagcccgtattccccataactccaaaagtgatactaatttcctaacgtatgtacaacaaagaaggcatgcactatagacttatacagcttcctctgcagtggacggatcactgatgagctgatcccgttttcaagtttctatgaccttttgcatggcat

SEQ ID NO: 30458 - DNA, 461 bp, Sorghum bicolor
  Clone ID: 9855249
agtaccagaaaaatatcaaaaatacccctcccatccgcagccctaacaaaccgatccccttcttcctcctgcccctgcgccgccgccggcgccccctaccgcgcccgcctcctcaccccgtccgatccagttggggcggcgattggtgtctcgtcctcctccttgtgctgggagcatggcggatggggctattgtggtagccatttgccagtacggcggagagttcgcttctggccccagtggcaacctgatatacagaggtggagaagcgcatgctgttgatgttactcgtgattcgtcgctggagggcttcaaggatgagctgtccaaggtgttccatgttgatgtcactgacatgtcactcaagtactttcttcccaataatatgaaaacactgataactatatcatgtgaccgggatttgcaaaggatggttgattttactgccaatgctgcacatg

SEQ ID NO: 30459 - DNA, 454 bp, Sorghum bicolor
  Clone ID: 9855260
caaggtgcggcatccaaaccttgttactcttataggagcatgcaaagatgctcaaactcttgtctatgagtacatgccaaatgggagcctggatgatcgcctggcttgcaaagacaattccaagcctcttagttggcaattacggacccgtattgcttctaacatttgctccgcactcattttcctccattctaataagcctcatagcattggtcacagtgacctaaaagcatctaacattcttctcgatggaaacaatatagctaaactcagcggctttggtgtatgccaaatattatctgatcagttcaaggccacaacgactctatatcgttatacccacccaaagggttcttttgggtatattgatcctgaataccttatctctggtgacctgacacccctatctgatgtatattcttttggcatcgtactcctgcgtcttctcactgga

SEQ ID NO: 30460 - DNA, 311 bp, Sorghum bicolor
  Clone ID: 9855271
gaggattctgtacattcttctttgtggtgtccccccattctgggcacaaacggaacagggtgttgctcaggcaattatccgatctgccattgatttcaagagggatccatggccaagggtgtctgataatgccaaagaccttgtcagaggaatgctcaatccggatccaaaacgacgattgacagctcatcaagtgcttgatcacccatggttgcagaacattaagaacgctccaaatgtcaatctgggtgaaactgttaaggctagacttcaacaattctctgtgatgaacaagttcaagaagcatgcac

SEQ ID NO: 30461 - DNA, 108 bp, Sorghum bicolor
  Clone ID: 9855280
gcacgaggagcgacactatctcgccaccgcacgcaccttgaccgaagctcatcaccgatctatggcggctaaggctctcctctaccgcccggccgtgcagtcggccgt

SEQ ID NO: 30462 - DNA, 124 bp, Sorghum bicolor
  Clone ID: 9855289
tcaatctatcttaacatctatgtttcctaactgttaaactgcatcatctgccactgtggaaccaatgccacatccgatccctaccaaagcagatgtccccatattcattgggccacatggtgac

SEQ ID NO: 30463 - DNA, 452 bp, Sorghum bicolor
  Clone ID: 9855292
gcacgagggcctggccaaggtggccggcggcgtgctcatgtggccgggccgccgcagggctgagaaactcagggaccggtgggatgaggtccttgataaggtgatcgaccatcacgcgagcatggcggccgatggtgcaccagcaccagatgagagtgattttaccgacgtgctgctatccgtgcaagaggagtacgggctcaccagagacagcatcaaagcaatcttggctgatatgtttgcagcaggcgcatatgcaccatacttggtactagaattcgccatggctcagctgatgctgcatcaagatgtcatggcaaggctacaggcagaggtgagaagtatcatgatgcctactaataagggccaacaagtcatcacagaagagcacctcactggaatgtcgtatttaaaagctgtcatcaaagaaacgctccgtttgcacccaccgt

SEQ ID NO: 30464 - DNA, 575 bp, Sorghum bicolor
  Clone ID: 9855304
gcacgaggctcatgcctcatggtagggcagcctattatgctcactgtttgtcccgcagcataatactatttcatagctgacactgctcgagagttaagactggactcttatgtggcttttgttctaggcacacttgtctgatttctgttcatgccattggattctttttcctaactatttagtagtctttgtcgttcagatggtcttgtaatttcttcaagtgacagctagtttttgtcgcataatataagaatgcaaattcgtttttgtttcgcatgattgtgcctgtcaattttacgtggggcatggctgcaaggtgtgtgtgtggacagtgcttatttggaccggttggtcaatgatagaaattattaattatatccttttcaaatcaatgaatgggttattgatattgtttatccttgcaaaaacaattcaagttattattgttctaaagggcctaactgattgatcaacagccgacagatctagttgtttagatctcagacattcccacatgttccttttgtcatacaagggtttctagccaccccagttcctttctctacaattttttc

SEQ ID NO: 30465 - DNA, 681 bp, Sorghum bicolor
  unsure (1)..(681): unsure at all n locations
  Clone ID: 9855326
gatatctaatgtcataatgttcaagtgcaggttatgtccaacaggatgaatgacctggttcaggctgcgcacatagcattgacgaaatacaaaggctagattgtttgctaagacggcctgaatcctatgacgcagattcattttctttatatgtagtacattgctcctcttttatgggaaagctgatggtttgaatgtcgctatgggcatcagattgcaaccattgtactatagggcataggcatgcatattacatcaatattatttgaatcacttaatagttttgtcaggctgcaaaagctgtagctttgaatggtagtatatatatgcatatacctggctcaatggacttgcagtaccgtgtacacgggaactacagttgtacatggactgagtgagttgtgtgtaatctaaaagtattcagcttgtaatgcgttggaatctctaatcaactatgtgtaacttgaattctaagttgtttttaggggatccattatagcagtcgctgctgccactgcctttgcggcatcgcccaacatgtatagcagtggttaaatatgaggcggaacccattggacttgcgtcttgggagtgcttatgatagctgtttgcaccagagttgtttgtatataatgtacatataatctgtatataattggnctcgtatatagcgtttttaaa

SEQ ID NO: 30466 - DNA, 475 bp, Sorghum bicolor
  Clone ID: 9855356
gtctggcagccagtgccaaaacccgctgctcatggacctcatggccagcatctgtaacatgccagtgctggtaccgcggtacaccaacgcggccgtcgtccacggcgcggccatgctaggtgccaaggcggccacagcggccgaggacggctccacggaggacctgtggtccatcatggaccgcatgagcaagcctggcaggctcgtcaaaccgggcacgctcaagggagagaagttcttgttcgacgccaagtatcgtgtgttcctggaccagtgcaagacgcagcaggagtacaggaagcaggttgacgccgctgtggaccaatggctcaagaagtgaagcgtatcaggccgggatacatggccgatggacggtttagatggctgatgacattatacggggttttagacgtgcgggtttatggttgctataccggatagttttatacgaggagtttacacatgtggtttataa

SEQ ID NO: 30467 - DNA, 595 bp, Sorghum bicolor
  Clone ID: 9855363
gccctatctgagagccgtggtaaaggagacgctaagggtacacccacctgtcccgctcctcgtgcctcaccaatccatggcggactgcgacgtcgacggctacacgatccctgccggaacgagggtcatcatcaacgcgtgggctatctctagagacccaaggtcatgggggaagccggaggagtttgtgccggagagattcatggacggcggtgccgccgcggacgtggatttcaggggaaatgacttccagttcacgccgttcggggccggccggaggatgtgccctggtatcaactttgggttggctacgatctacatcatgttggccaacctcgtgtattgttttgattggaagctgccggccggcgtggagaaggaggatattgatatgatggaggtgtttggattgacggtccaccggaaagacaagctcgttcttgtccccagaccacatgtataatactatatattgcaaacgccatgcgattggtgatggaaatttaactatcacatgtttcaccatataatgaggccgtggcatgattagttgaagtttatgcagaataccacaaattgcgtgggactacaggcc

SEQ ID NO: 30468 - DNA, 608 bp, Sorghum bicolor
  Clone ID: 9855366
ggcctcttcataaaacatgtacagacatgtgcagtcaccggtaaagggatttctgatttggagagcgctgtaatagaggtcaggggtattgagcatgtaccttctgagggacgaaggtggactgtaaaccagaggcaatttgaacagctgttgaggactaaagaagctttcctacgtctagagtcatcaatcaacgagcagttaccaatggacttttggactgtggacttgagggaagctgcgcttgctcttgcaacgatcagcggggaggacatctctgaagaagttttgagtagcatattcagcaaattctgcatcgggaaatgatcccgcgagatggtgcatccaatagtttggagccaaatcttctttttctcgactcagaacaggaaccaacatgctgagtggcacttggaatggtgaacaggcgtgcttgttctctgaagtgccagatgaagaacgtgagggaagtgaagccatgtccatcttagtgcacaccacatacatggtgagggtagaacccccgaggccccgagttcccgtcttggcgtcggatatgaatcatgtatactagtggagtattggttgttatgagagaacttttataa

SEQ ID NO: 30469 - DNA, 505 bp, Sorghum bicolor
  Clone ID: 9855378
ttgctccagaagtattttctagaggttttggagttgtgtcgactaaatcagatgtttacagctatggaatggtgttgttagaaatggtagttggaaggaagaatattaaagaaaccactgggaattctagtgaagcttatttccccgactggatttacgaccgtttagcaaaagatttccaaagtcaggatgttgcatgtgtgagtgatgagactgcaagacatatgactctagtcgccttgtggtgcatacaaacaagcccaggaaatcgtccttctattaggtgtgtaatagaaatgttggagaagaacataactgaactggaaatgccccccaagccatttctatcgtgtccctctccgccatcacatttttcttcttgactgaaaatctctctctctctctctctctctctctctctctctctctctctctctctatctatctatctatctatctatgtgtgtgtgtgtgtgtttgatactccaactcaaaactgaagatt

SEQ ID NO: 30470 - DNA, 411 bp, Sorghum bicolor
  Clone ID: 9855386
cgaatccccacggttatatgtaccgactcctactccctctacgagtgtctcgtgaaactcggcaccacgaaggagaaacgcctcatgatcgatataatggcgttacggcagtcatacgagcgccgggagatacacgagattcgatggatccatggcaacgataacccagcggacggattcacgaagtcgtcgcccaacaaggcgctggaggagctcgtcagcaacggcgcagcgaggatacggatgaatggatgggtttcacgcacgtgacggattcgtcacgtgaaaaagaatgcaatacttttggatttttgtttttattgcgtatttgggcccttcgcagtcaaccagcgaagtgccacgaatccacggcgaatttctccttaagagaaagttgccagtgttgcgata

SEQ ID NO: 30471 - DNA, 667 bp, Sorghum bicolor
  unsure (1)..(667): unsure at all n locations
  Clone ID: 9855391
gatgagctggaagaagccaagaaagaactgattactggcctagttaatatgtcatcagctcgatccactgttggtgtcaaaagaatgggtgagcttgatgagaaaactttccttgctgcttgcaaagagaaaattgcagatgaggaggagttggcaattctgtgctcgaaatgggaagatgagatcaggcatccagaatggcatcctttcaaagttatacatgttggtggagaggcaaaggaaataattatggaggatgatgagaagctgcaagctttgaaggctgaactgggtgtgaaggcacacgatgtggtggtcaaggccctccgtgagatgaacgagtataatccaagcggcaggtaccccataccagagctgtggaacttcagggaggaccagagagcaccaatgggcgaggcagtagcctacatagtgaagcggtggaaggcgaacaagaagaaacacacctactactgatgaagtagcgcctgatggccccttggcttgctggactgcgttgtgccattggttcctgggtggctgggtcgatgtctctgagaagtgagaactaggagcctgagaccctctactgatgaaacctagtaccagtagtactactaaatttgtccgattttttggacggttggatttgcaatgcaaggtntat

SEQ ID NO: 30472 - DNA, 569 bp, Sorghum bicolor
  Clone ID: 9855392
tagctctatttacatcattggcagtggtcgtagttcaaataacagttgtcaggggagaaaccaagtctgagcgaagggttgttgaggtgatcaacaaacttatgtggatagcatcggtttgtactacaatatctttcattgcctcctgctatattgtgctaggccgccatttccagtgggcagcaatattggtatctttgataggtggtgtcacaatggctggtgtacttggtactatgacatactatgtggtgaaatcaaagcgccaaaggaagattagaaaaaaggagaagatgtcaagaagaagtggctcaagctcttggtatgatcatactgagctctcagatactgaacttaacccagtatatgccttgtaaagagtgtttgtctctggagtcgagtatgtactaacagatacaatagcttgcttacattatttgttgattgtacaatttctccagtaacaacaaaaccacacagaacttgcccattgtgcaaggctcctgcagttgacgaatttgatggcacccaatgtgctcaatctgttgtacatgtgagttacagaattt

SEQ ID NO: 30473 - DNA, 552 bp, Sorghum bicolor
  Clone ID: 9855395
tgagttcctttctgctcttcatgacagctcctacatgcataggcaaaaggcaaatgatcatgttttgcactcttctttggaatcctccattgataagagtccgtatgttaatctcatggaagatggaatggtagctgcagtaacagaagatggccctggcaatgatggctcacctttgaaccatgcagttgatgaagaacaattaagtaacgaggtgggcggtagacgacagaatgtggtatctgcgttgaaccacaatgaaaaggccagtggagtggggaacgaatgccctgcagcggcaacaaaacagcaaggtgatgacgtccacagcaataagcttcatgagatcattgctcctgtcaagagatctataaaccaactgactcgataccaagggaggtcagtctggttgcttgcctatattgcttttgtaacatcctggccgctccttggctccctagctttcatcacctttcggaaaaagttcaggaatccgttgcgagataaatgaaccctacatgtatatatattattacagttacatcatgcaat

SEQ ID NO: 30474 - DNA, 656 bp, Sorghum bicolor
  Clone ID: 9855412
gacaaggtatcagttcttgcaagtaaatttccagatttgaagacattcagaagttgtgacctcctgccaaccagttggatgtctgttgcatggtaccctatctatagaatcccaactggaccaacactcaaggatttggatgcatgtttcttgacatttcattacttatcaacaccttccaaggatacggatcccagcacaccagcatgccccagttttgggggccttaattgctgtatgaacgccgctggtaaactaacattgcccgtctttggactggcatcatacaaattgaagagctctatttggtcctcaaataggcctgaggagcagcagcttgcagcttcgttgatgcagacagcagatgactggctacgccatcgccaagtgtaccatccagacttccgattctttctcacccactacaacacagcattgagatgacacgagatggctgcatctcgctgtaaattgtctttattattagtatgttatatgttgttggctgagccgggctacctgtaacactatgttgttgatcgcgtaacatagcgcttctctgaacttttttggtatggttcagtagttcaagccagacagctaatttgtaacttctgcaataatattttgatgtaggtaaaattttgagaagtaaa

SEQ ID NO: 30475 - DNA, 716 bp, Sorghum bicolor
  Clone ID: 9855448
tgggaagggagctgatcagtcaggtgggtactactcgcagttgatgaaagaatatgatggcgtcataatttcaagtgacctggccaagatgtcaagcttacctttatctcgcgaagctggtgcaaaccaacctctctatatcatcatagcacagggtgaaaattcccgactacacatcccatctctcagcgaagagcatgcatcgaaggtgatagtccttgctgatagccctgtcaccgcggcgccagcaggagttgaagttgcagtccttcgtcagatagacttggagtctattctccaacttcttgcacagcgagggctctgcagcgtgctggtggatttcagagaggccacagaaagcttcgcgtcgcttctgaacgacttccaggaggacaagctggtgcagaaggtcgtcgtggagatcctgcctttttggttcgcgagtgaagggctcagcaacctggcatttggtggcagccaatcgttcccgttgaagaacttggagcacagggaggtgaatgggggcgtgctgatggagggctatgtgtaatctctcttctagtcggagattggtagttcctgcacttgaaccattacctgcagagccatgagtcatctggggttttgttttaggccttgtttagttggcaaaaactttggtttttgactactgtagcactttcgtttttatttgacaaacatgtccaatcaggagt

SEQ ID NO: 30476 - DNA, 606 bp, Sorghum bicolor
  Clone ID: 9855449
tgacctaataaataggttcatttacatgtaggtttcagtgatacacttttactgtcccagcaattcagacatgtatggaattagttgttccaattcaagatggtttctgttacccagaaccgtgatttgtgaacctcagttgaccaccaacagattagtttgaataactgaagccgttcagggacaaaatactcatgattatccatgttctagaggaagagcattagttgttcatggggatgtcactcacactgattaagtagaacaatttcggcagatgctgaaataccatgtggcctgcgcattcattgcctgcagacaatcataaggtgctgatggtcttgcaataaattgcagtatctgaaatctgcatcatcatcactgcctttttcaacagagtcgaagatcgaagcttcacgctgcagaagtggtcattatgattaaatctgacagtgattttgagtgatgctagaattttgaagacaaatatgtatactacaaaacctctatgacgttaatacactgacatgtgtataggaaaacattgtaacattcacttggtgtaaattagttgattaaccatgtacatgtatgtggcattcattg

SEQ ID NO: 30477 - DNA, 610 bp, Sorghum bicolor
  Clone ID: 9855475
gcgggcctcgggattacgctgttcggcatggcatacatgttcgtccacgacggcctggtccaccgccgcttcccggtcggccccatcgccaacgtgccctacttccgccgagtggctgccgctcacaagatacaccacatggacaagttcgagggcgtcccgtatgggctcttcctgggaccaaaggagctggaggaggttggtggcctggacgagctggaaaaggagctcgcgcgaatcggccggaccatctgatgatgggttcgtccgcattccgccgcggcgagctccgctgtgcaaagctccgtggttttcgtttttgctcggttttgttgagttcattgtcggtaccggatgcttggtggagcagacgaccagaaggggccgatttggatgcacgggcgttgatcttctcctgcatttcgaatgggctgggaggcacagttcgtacatggagatgtccggtgccatggaattacttttttttttcctttttgctttgctgccattgtcacgtcggcgtctttgtggagacgtcgcacgttctggtccccctgtgttgctgtttcttgggctaggattctgtgtatataacttgtagagaccatgt

SEQ ID NO: 30478 - DNA, 700 bp, Sorghum bicolor
  Clone ID: 9855489
ttaatgaaatagaagaatacacctggtgccaactggtggtggatagattggttaatgggattcaggactttaagactggaaagaagaaatctatttgtggttgcctttttccctcacagaagaatctggaattatctatgatgagaagcaattagagagggagaaaggttcttttctgaatgctgttgatgtacctggatcatcacaagcaagaagatatgactgtgaactcaagaacaagcacagagatttatcgcatttaactacagtcccaccactacatgagttgcttcaatcccactctaaagaagattatccaaattatcttcttgaagcaaatgttattcttcaatcacctctcaagtcaagagtaaaacaaataattcacaaaattgttgatgatgaggagtgtctagcctctcacaatggtaatttggaattatgtttgccatcaaaagaggtattggagtgtgatctgcttggacctttgtttcaaacaaatgtttcagccgcagacaaatcttcagatgcagaaggccttgtcactgccaaaagaccagcaagtaatgtttatgttagaaggcccaaagacaacacaacactgtagcaagctactcatgataaaactgatgttaaagacgaacatgtacttggccaatttagttgtacttgcagcttgtaattttagtcttataatttt

SEQ ID NO: 30479 - DNA, 519 bp, Sorghum bicolor
  Clone ID: 9855498
gactgctccaagatgggcaactgtaatggcaaacctgtttgcagtcattcagatagcaggttgctttcagatatactgcaggccgacatttgcgcacttcgaggagcgggttcaggcgaagaagaacaggagctgcagatcctgcctgtgccggctgacatacacgtctgcatacatggccatgatcaccctcgtctccgctgcaatgcccttctttggggactttgtatcagtctgcggagcagttgggttcacccctctggacttcgtgctgcctgcactggcccttctcaagaccaggacgatgcctgataacccaggattgcagtgtgctgtgaagatgatcagcgctgctgtcgcgatcttgttctcgatcataggtgcgctggcatgcatcggcgcaatcaggtccatcgcgctcgatgtcaaaacctacaagttcttccatgatatgtgatgtgatgatggttttgcagcaccaagttaccttgtttccagacatcacaacaaagtgtaatg

SEQ ID NO: 30480 - DNA, 613 bp, Sorghum bicolor
  Clone ID: 9855526
atgaacagaaaaatacaatgactcaaagaagttcctaccacgaactttgtaccgcgcatattacttagaacaactaggaaagtaggataagcaagaataaaaaaaatattcttcggaatagcggcatacaaaattaataagaaatgcaaaatgaagaaaagggcacctaatctcacctctttctataccataaagaaaagaaccagagatttgaacccttttttatttttaaaagaaaaagaagtgtttagagatttatctacttactctagacatttatctacttactctagactaagtagatttttaatgaatatttatcccaatccatctcaaaatatttgtatcaatatctattcggtagatcctttttttctgtgccaggaaccagatttgaactggtgacacgaggattttcagtcctctgctctaccaactgagctatcctgaccctttcttgtgcatcatcttagtaaagtatttgcatctatgtcaattaaagggactaaaaaatcaataaagtattccattcaaaattaggaaatggggaggggtagtcctatgcattgtggatggcttacttaataatacttaaaaaaatcgaattaataat

SEQ ID NO: 30481 - DNA, 359 bp, Sorghum bicolor
  Clone ID: 9855530
tttggtgcaagtttcacaagttatctgttgtacataggtcgtgctagttcttccaagtttcacaatttgatgttcaaataattatagaatcaatggtcttggatcacgaagtagatcaacgtacatgcttttatttggtcactgatgtagaagcataagatgtttgaatatgaatcattgaagatatgtgcaaggttgcacctgctgaactcgtgctgaagcttggagtgataattgaattatcgtttgtatagaatggattgtgaccaataagaggtaaagtcatttttttagtttaaacagatcattcggaggtgtagaactgcattcttggccctaatgcttgtcctaacttgatt

SEQ ID NO: 30482 - DNA, 649 bp, Sorghum bicolor
  Clone ID: 9855539
ctgctactgaagaaataagttatcaaatttgatttctctgatccaggtggacactaagactataaaagctcaaatttgggacactgctgggcaggagaggtatcgagcaattacaagtgcttactaccgaggagctgtaggggcattgctagtgtatgatgttactaaagtaatgacgtttgagaatgtgaagaggtggctgaaggagctccgagaccatgctgactcgaacatagttgtcatgctcattggcaacaagatcgaccttagacacctgcgttctgtcgcggttgaggatgctgcaagctttgcagagagcgaaggtttgttcttcatcgagacctctgcacttgatgcaacaaacgtcgagaaggctttccagactgttctagctgagatctacagaataatcagcaagaagcccctatcttccgaggagtctggttcagggtctggtaacctcagagaggggcaatccattcaagtgtcagccacaaattctagtgctcttacgtcacggtgctgctcttcttagagcttctcacctggatcatctaaagaacaatttgtcgaaaaggtcctctttcgagacatacttcgtcgaaatatttactctgtgtgaacaataagtgtagattttaaaaatgtc

SEQ ID NO: 30483 - DNA, 648 bp, Sorghum bicolor
  Clone ID: 9855544
agcaagacccatgtcatctaccgtacatatgctcctgtgcatttcagaggtggtgactggaagactggtgggagctgtcacttagaaactcttccagatgtgatgccagtgaagtccctggatgaatgggctgacttgcttcagcccgtgaatgattttctagggagcaacctcagatccaagttggttggattagacctgcttaatgtgacgagaatgacagctcagagaaaagacggccacctctcagtatacctgagcccttcaggacctgtccctcgctacaaacaggattgcagccactggtgccttcctggagttcctgatacctggaatgagcttctctacgcccttgtcatgagaaagcatgagaagatgggtcagaatgcttcccttgctagcactaggacactgcacactgaagatggaaatgtcttcagctgatcatcatgacaaaacaagtttcatagtcatcctgcgcgatgagtcgataatagctgctgtttcacataccaattaggataggatgccagagtggcgaaacacatttttggatcatgggcgtttgcaggaagctgcgtaccgccctgctgtgctgtgtttgcatatggtgatgttagtgaatagatgagctagaggtcagttgta

SEQ ID NO: 30484 - DNA, 497 bp, Sorghum bicolor
  Clone ID: 9855554
gacattatttgtgaacacaagatcaggtggattttgtgctatcattttttgtgaaccgactgccctgcgcctgtgtctgcctgcctaccttggatggtgccagcccaatccgttgaaagggtcacataggaagggagagaaggggaacctgctacagtgctgcccttgcattgggagaagccgcaacagcggagttttttgagcggctgagaaggtttgcgaagaagacgtcctgggagtttttcagttcgagacgggtggatgctgtttgctgtccactggtagacttttttttttcctttttttgttcaacatttcacggcagaagggagtggagtctggagtccatctggccattggtactttattttcttctttttttattaagcaactccaagccaatgatttgattgacagtgaggtaatggctgatggtaaattggattagggacctactatgttgtgctttagtattacctttgtgatgacgaaattta

SEQ ID NO: 30485 - DNA, 487 bp, Sorghum bicolor
  Clone ID: 9855574
gcacgagggcgcactcgccgatgccactggtggtggtgctcccgacaacggtggcggcggcgcccacggtgctttagatagctagtgcgtgggcggtgcttgggttggggctggcgatggggggtgcggctcagttggtggtggtgactgtgctcttggccactgccgccgcggcgtcggcggcggggccgcggccgagcgaggtggccgtgggcgcgctcttcacgtacgactccacgattggccgcgccgcgcagctcgccatcgagctcgccgtcgacgacgtcaacgcggacgccaaggtgctcaagggaaccaagctcaacttgattcccatggacaccaactgcagcggcttccttggcaccatcaaagctttggagctaatggagaaaaatgtagttgctgtgattggcccacaatcctctgagataggccatgtcatctctcaagttgtcaatgagttacatgttcctcttctatcatt

SEQ ID NO: 30486 - DNA, 502 bp, Sorghum bicolor
  Clone ID: 9855589
gcacgaggccaatgtggagatggcatgcggctcaagaaccattgcttatgaaatctaaggatgaattagaagagcaaactgtagaaacaattgttgccgccaaaagcattaaccgtcactttcataaaatatataggtctataatgattcaagctgggaaggtaaaacttgttaaaatatgcataaataacacataggaatgcaaaatttgcaacaaaaaatcctttgagcatttcgtcaaacaattgaaggtaagtgcaggtaagtgcaatagaaacaacagctaggtacttcactgtgcttacagaggaagtagaactgaggaagacttgagcacagggcctctagaggcgaggatgagcaaccggtcaaagcggctcccacggtagtggcggcgtgcccatcgcacgaagcagatgatgcgctaacacagctggcacagcatcagaggcacaccgttccaggcagatgatggtgtggcggcaaggcagccaaagacacg

SEQ ID NO: 30487 - DNA, 519 bp, Sorghum bicolor
  Clone ID: 9855598
gcacgagggtcacctcctcacgagaaggctccagccctcgccgccccgcgcttgtcccccctgcccacaacccgcccgcccccttcgtgcttgcggcccgccgatcgccggcgctcctcaggtgtgtgcgtctggcatggcaagggacctatctactggccctgccttctcttttcacgaatgatgtccttcctttcgaaggacacacatgcacaaacaagacttaactggccatggagaagccaatcgccgttatcagcgcagctgcttgttgatatcccacctgaaatagagttatctgattaccggagattgccaagttctggaagtgagagcccatctggacttctccatggcgaaggcatcaaggaagaacatatccctgatttggacattttctttgaaaggctttacgaatatttctgtgcaaaagggctcaggtgtatcattaccaaatggataatagaggtccttaatgtactttttatggtatgctgtatcgggttctttttcttattt

SEQ ID NO: 30488 - DNA, 527 bp, Sorghum bicolor
  Clone ID: 9855621
gcacgaggctggatcagccagagcatgcatcattgacgaaacgggcgacatcaagggccttgccagcgagcccattaagctgtggcagcccgagactgggtactatgaacaatcgacttcggacatctggtcgtgcatctgcaactgcgtgaagcaggtcctcaatgaatccaaggtcgacccggataagatcaagggcatcggcttcgacgccacatgctccctcgccgtcttcagccacgatacagacgagcccgttgccgtgacggggcccgactttgataacgccgacggcaacgaccgcaatgtcatcctctggctcgaccaccggcccattgaagagacggagaagatcaacgccaccaagcacaacttgctcaagtacgttggcggcaccatgagtattgagatggagatccccaaggttctctggcttaagaacaacatgcccaaggaactcttcgaccgctgcaagttctacgatctcgccgacgccctcacccacatggctactggcaacgaaacgc

SEQ ID NO: 30489 - DNA, 227 bp, Sorghum bicolor
  Clone ID: 9855624
gcacgaggctctcttttccctggcactttgtcacgggacacccgggaggatggacaagagcggggcggcagccgacgacgtcgagcggggcgactacgagcaggagcacgacaggagagggacggtatggacggcgacggcgcacattgtgacggcggtgatcggctccggcgttctggcgctggcctggagtgtggcgcagctgggctgggtcgcggggcccctcg

SEQ ID NO: 30490 - DNA, 487 bp, Sorghum bicolor
  Clone ID: 9855628
gcacgagggaacctcgtggtgtcctctgcgcgcgcggcggaggcgatcctgcggacgcacgaccacgtcttcgcctcgcggccggcgtccgcgctcttcgacgacctcgtgtacgggtcctccaacgtcgccttcgccccctacggcgagcactggcggcaggtcaggaagctcgtcaccgcccacctgctcaccgtcaagaaggtcaactcctaccaccatgcccgccaggaagaggtgtgtctagtgctggataagctccgggaagcagcgaccatggacgcggaggtggatctcagtgagatgatgaacgcgttcgccaacgacatcatctgccgtgctgtgtgtggcaagttctccagggaagaaggccggaacaggctcttccgcgagctgaatcacaccaccactcttctggtggcaggattcgatttggaaagctacttcccagggcttgcgagatcgctaggtcgtttgttcgtgagca

SEQ ID NO: 30491 - DNA, 534 bp, Sorghum bicolor
  Clone ID: 9855631
gcacgaggctcccaggccagctgcggccggactacggcggcggaggcgggggcggcgctcccggtaccatcgcggccatcgtcacctcactcggcggcggcccggcagcggtggggatcgtgcggctctccggccccgacgccgtcgccgtcgccgaccgcgttttccgtccggccggggcccggagggcgtcggcgccgtggcagccgcgcagccacttcgtggagtacggactcgcactcgacgcggacggcagcgttattgacgaggttttggtggtgccaatgctcgccccgaggtcgtacacgcgggaggatgtggtggagctccagtgtcatggcaacgacctctgcttgcgccgtgtgctcagggcttgcttggaggctggagccaggcttgctgatcctggtgagttcacccttcgtgcattcctgaatgggaggttggacttggcccaagcggagaatgtgtctaggcttatttcagcaaagtcagcagctgtggcggactcagctttggctggcattcagggag

SEQ ID NO: 30492 - DNA, 544 bp, Sorghum bicolor
  Clone ID: 9855643
gcacgagggggacggcgacgagcgggacgtcttcgagaagtacatcctcacctcccccgagatgtgcacggagcagatgcagaagctgcggatcgccatgcaggaggaggccgccaagcaggagaaagcggcggcggccgctgggaacggcaaggccaagggccggcgcggtgggagggatgtggtggacctgcgcacgctgcttgtccactgtgcgcaggccgtcgcctctgacgaccgccgcagcgccaccgagctgctcaggcagatcaagcagcacgccagcccgcagggggacgccacgcagcgcctcgcccactgcttcgccgagggactccaggcccgccttgctggcactggcagcatggtgtaccagtcgctcatggccaagcgcacgtccgcagctgacatactccaggcgtaccagctgtacatggctgccatctgcttcaagaaggtcgtctttgtgttctcgaatcacaccatctacaatgccgcgctgggcaagaagaagatacatattgtcgagtatgggatacagtac

SEQ ID NO: 30493 - DNA, 371 bp, Sorghum bicolor
  Clone ID: 9855647
gcacgagggcgacagcacatcgctaacaatttataccactcttgtagctgcagacaacaagacatcacgatgccagaatgtttctgctggtccattgatagatctttctggtggttcacggagacagaacaagttaattttaaaagttgcactatctgtttcaatctgcttcattcttacgtgccttgcttgcataatgtaccgttggaagaaaatttaccaagtatcctttcaaatggttaattcaaagaaaaggtacgatggcaatgaatcaaacatagaggacatactgaaaggatatgattcgctcatcccaaagaggtacaaatactcagaggtaaagaaaataacgggatccttcaagcatatac

SEQ ID NO: 30494 - DNA, 385 bp, Sorghum bicolor
  Clone ID: 9855655
gcacgaggccattcctcttttgcttgaaggatatggatcgccacggagtgaaattcgacaacctcaccaatacgctggtgaagggcgatacgatcgtacccgttgtgcgaaaatggggccacgcatggatgctactggagcaacccgagcgcaccgttgcccaacaccacctaaccgatggcgaattacggcaaatacaccgccgattcggccacccctcggttcagcgccttcacaaggtgctccaacgcgctggccacgagacggcaatctccgatatcgaggagatcaataagttctgccgcagctgccagttgaattcaaaggcgccaggaaggttcaaattcacccttcacgacgatcacgagttcaaccatgagatcat

SEQ ID NO: 30495 - DNA, 566 bp, Sorghum bicolor
  Clone ID: 9855658
gcacgagggaaaacaagcaaccaaacgcgcctctctgtgtctctgctctgccttggaaaccaagaccagagaccggagcaaacgagggcggccagccggactccggagcggaggaaagcgtccaatcccaacagcccccaatcccaagctcgccccctccccattcctgcttgtccctccaagtaccctccgccgaggcctccgtctccctccgagtcgggccatcatcctctgatcctactaccgcaaccgggatccatggcgcgtggcggcgggagaagaagaagatcggcggcggcggcggcggtggctgtgggagaggccgtggagggctcgcgcagtagatgactgtctgatttcccacagccttcagcgagtgtttgagcccgtccgtgccaatacactgtttggtgctgaatcagattcattgaagatgccaaggtctgaatcagacagtgatgatgttttcttcgatgcatttgaagatgttagatctccaggggaaccttcatgttcagaggattgcagcacaagtcatgaagtttcaccagtgccaatgaagtttg

SEQ ID NO: 30496 - DNA, 461 bp, Sorghum bicolor
  Clone ID: 9855694
gcacgaggacaagtttatctccaggtcgctagcccgtgtttattcagattctgctctaatcagggattttgatctgcgggtagaccgtgtacagcacctggctgctgaagcatcaacctcacctcctttcctttctccaagctccttgtcatcggattcaagcgtcagctcgaagtatagttcagactcaccctccttatcacctacaactagctccccaccatcattaggtccctcgcctgcttcatctaatccgcctcatgctttggtgccatcgtccaggtctcccctttctcatcaatcatctaatgagggaccttcaaagccttctggcatggaatcaatacgatctccttccaagacctcttctatagcagaaagaagaggaggcttcacacgtctaaagctaccatctctccaaaaggatcttgtattgccgccaagggtaccgtctagtattc

SEQ ID NO: 30497 - DNA, 300 bp, Sorghum bicolor
  Clone ID: 9855697
gcacgaggcagcatttctgctgccactgttttatgtggagccacccttttacgaggttggaattttcaggaacatactgttcggttagttgttaaactgctctcaccatctgatccaatcgattattctggaagagagagccaattgataaagcttggtccaatgctcaatgttattctttcaggaatatcagccgtggactacgcgccaatattctcattccatggcctgattccagagcttgctgctgctcttatggcaatctgtgaagtatttgggtctctttctccaagtgtttgc

SEQ ID NO: 30498 - DNA, 477 bp, Sorghum bicolor
  Clone ID: 9855706
gcacgaggcaggaaacggcgccgcgtcgcggagcggggcgactggaagatgacgcctttcgttgtggatctgggattcggggaggagcccatactccgggggctgacggaggagaacatcatcggccgcggcgggtccggccgcgtgtaccgcgtcaccttcaccaaccggctcaacgggagcgccggcgcggtggccgtgaagcagatacggacctccgggaaactggacgggaagctggagcgcgagttcgagtcggaggctggcatcctcggcaacctgcggcacaacaacatcgtcaggctgctgtgctgcctctccggcgccgagtccaagctcatcgtgtacgactacttggagaacggaagcctggacaagtggctccacggcgacgctctagacaccggcggcgggcacccgatggggagagcgcggtccgcacggcgcgcaccgctggactggctcaccaggctcaag

SEQ ID NO: 30499 - DNA, 413 bp, Sorghum bicolor
  Clone ID: 9855707
gcacgagggcactgtcaaccaatcaagctgatagtgcctctggagttccaggaattactgttgacaaatcagtagagttctcgtatgaagaacttttcaatgccacagagggatttagcatgagtaacaaaatcgggcaaggtggttttggcgctgtctattatgctgagctcaggggcgagaaagctgctataaagaaaatggatatgcaggcttctcatgagttccttgctgagttaaaggttttgacgcatgttcatcatctgaatctggtgcgattgattggtttttgcaccgaaagttccttgtttcttgtatatgagtttatcgagaatggaaacttaagccagcatttacgtggaactggttatgagcctctgtcttgggctgccagggttcagattgcactagat

SEQ ID NO: 30500 - DNA, 319 bp, Sorghum bicolor
  Clone ID: 9855708
gcacgagggatccgcccgccccccatcgcaacccccgtcgcgcggcccccgcccgtgcaccccaaccaccacgccgtcccccacaaccctaaccacaacaaccccgtcttccaccgtccgccgccgccgcagccccagccgcagcacatgcccgctcccggacccgcctgggctgattccccggtctccgcgtacatgcgcatcctcgagaactccctcttcagcgccacaccgcctggcgccgccgccgctgccgctgccgctgcggctgcagcagctgcgggacaggggccgacgccgccgcaccctcaccaccccc

SEQ ID NO: 30501 - DNA, 344 bp, Sorghum bicolor
  Clone ID: 9855725
gcacgaggcgaacacagaggctgctccggcgggcggcggcggcgcggcgagatggctgacgaagcggagaccgagaaagccacgctggcagcggaagacgggggcaatcccccggagctctcgaagagcgcgaggaagaagctgcagaagcaggagcggcaggcggaacgtaaggcagcccggaaggcggcggagaaggagcgccggcgcgccgacgtggagcggcggaggcgtgagtgggaggacgctctcgccgccgcgccgtcggatgaggcccgggccgagatggtggcggcgcggcgggagacgcggcgcgagcgggtgggccagcgggcggaggagcg

SEQ ID NO: 30502 - DNA, 447 bp, Sorghum bicolor
  Clone ID: 9855734
gcacgagggagaaagcgaaggggcccgaaaaaaaaagccgcaccggcttcccttcctttttccaccacccggagagatggagctgttgtacgagctgctcctcacggcggcggtcaccctcctcgccgccttcctgctcgccacgctcttcgccgccaatgatcccccgcgccggaccaccgatcgcgccgcagccgcgatcgccgaggaggtggcggcggaggaggagaggatcatcgaggtcgacgaggtgatgcgtagcgaagggagggcggcggctgtggcgccgccggaggcggacgggtgggtcgaggcggagaaggcgccggcggtggtcgtcaaggaggtgaaggagccggagagcttgcccgaggaggaggtgggggttcccgtgaaggctgttcgggagttgcgccttgctgctgaagtggaggagggggaggacgg

SEQ ID NO: 30503 - DNA, 377 bp, Sorghum bicolor
  Clone ID: 9855736
gcacgaggatccgccggaggtggaggagacagcagcagcccggtcggtgattgggtccgtctctcgtctcggtcgatggcgtcgctgttcggcaacggcggctacagctactcgtcggggtcggagggggaggacgaggacgagggcacggaggggtaccggaagggcgggtaccacgccgcccgccccggggatcgcttcgccggggggaggttcgtcgcgcatcggaagatcggctggggcaacttctccaccgtctggctagcctacgacaccctccacagcagatttgtcgccctgaagatccagaatagcgcgagggattacgcgcacgcggctctccacgaaatcgatttgctgtcggctgtagccaaagg

SEQ ID NO: 30504 - DNA, 573 bp, Sorghum bicolor
  Clone ID: 9855738
gcacgaggccacacctcaatccctcactgcgcagccgtcacatagccatccctccaggccgcgcgagatctcgtggtccggcggagccgcttgagatcccgtggttcgcaatcggtcagacctcatctcccctacggtgtacgatcaaggaacttgttcttccttctccttacctcaagctcccttggtgcgggatggagggcaggtcctccgcgtggatctcggtgccggctgtcaggttcgtcttgcctcggccccccacactcgtctgcgtggtggcgtgccttgtccagtaccattggctctactatatcctcctcctgtcttgactcgaccttggctctcctcgcctctagatccaagaccaggtgtgttgcgcaatgcaacgtatgcaaaattacagaccctagcttgctgtactatttttcaattaaaataatgtactacgatttatacaatttgtgagatgaataaatattattttgcgttggtgtatagtgttttctagaaaatatataataacctgtatagatttgtacatttggtttcccaatcgtacaaaccgaacttttt

SEQ ID NO: 30505 - DNA, 364 bp, Sorghum bicolor
  Clone ID: 9855743
gcacgaggatgcatctggaggggttacatgagctatttctgtcaaaatttgtcctatccacgacagattttccagctagggtaaaggttcacttttcaatgaagcttagctacaggactccagaatatgatcatgataatgaaactttagattccgaagctactgagccattgactgaaaatgaagttgcaaaccaccctagaaaactatgggacgatgattgctcttgggcagagtggtactctgctgaggatcctgttaaaggttttgagctgactgccatctggggagagaggacatttgaagagacccttgagatggctgaagtggaaaatgcttcgtgctttgatgctgatagctggtt

SEQ ID NO: 30506 - DNA, 496 bp, Sorghum bicolor
  Clone ID: 9855744
gcacgagggctatcatctgctaccctgctgctagtgctactattcttgcccgcccgattgctacttgcaacgcatcttatttgacttaattagcttgcttctgttttcttcctttctttctcattatatacaatatatattttctctggaatatcagtgtctccgtgtgtatgtgttcctctcgatgatgatgcttgtcgtctgggctgctggtcgatgagctagctagtatcagtagctagctagcgccatggatcactgctgtccggccggtggtctctgctgctgctgctgagcactaactacctctcccacttcttgtagctatgtcaggaaagatttatctggtcggccgagcgctccttctctgaaacactgaagaagctccagctagctgcctgacaacagccactttgcacgacaacacaaaaccaagagaagctagaggccgatcgaccgagacgatggcgcacgatcccagtctgggcttcgcgga

SEQ ID NO: 30507 - DNA, 425 bp, Sorghum bicolor
  Clone ID: 9855746
gcacgaggcagccgctcaccatctccgggatcctcgcacagatcctcgtgctccccgccggccgcttcatggccgccgtgctgcccaaccgcgaggtcaggctcctcggcggcaggctcggcagcttcaacctcaacccggggccattcaacgtcaaggagcacgtcatcatcaccatcttcgccaactgcggcgtctcctacggcggcggcgacgcctactccatcggcgccatcaccgtcatgaaggcctactacaagcagacgctcagcttcgcctgcgccctactcatcgtgctcacgacacagatactggggtacggctgggctgggatgctgaggaggtacctggtcgaccctgccgagatgtggtggccttctaatcttgcccaggtctcactcttcagggcgctgcacgagaaagaa

SEQ ID NO: 30508 - DNA, 488 bp, Sorghum bicolor
  Clone ID: 9855755
gcacgagggcggcaccctgctagcccactctcgccctaaccccgagatttgagtgcagcagaaggcagagcagggaaggaatttcggaaggggacagcccgcagcgccatcagaagggaaggagcaccaggagcctccaagcgcaagcaaccaagcgcagacagagcacaaccaagacgccccacagcaaggccaaggcataaagcaatgcagtccgggggcacggtttccaataccgccaccaccggtggacggaggcgtgtctcggtgcagtccaccaggagcgccgccgtcaccacttcggcgtcctccgtgtgggaggcgcggatgaagatggacgaggtcaagggcggcgtcaaggtcttcagcgccggcgccgccgacgagccggcggacgaggagggcatgcgggtctaccgccgcctgcgccgcaaccagagcgagggcaacggcaccggtgccgcgggcgccgccagcgccgcggccgc

SEQ ID NO: 30509 - DNA, 546 bp, Sorghum bicolor
  Clone ID: 9855772
gcacgaggggatcgcccgctacaacatctccatcaacgccaccgccaactccacgctgccgccgatcatcaacgccgtcgaggtgttctccgtcatctccaccaccaacgtccccacggactcccaggacgtatctgccatcacggcgatcaaggccaagtatcatgtgcagaagaattggatgggtgacccgtgcgttcccaagactcttgcgtgggatgggttgacgtgcagctatgccatttcaagccctccaagaatcactggcttgaacctatccttcagtggtcttagcggcgacatatcatcttcttttgcaaacctgaaagccgtccaaaacttggatctgtcgcacaacaacttgacaggctcaattcctgaatccctttcgcaactatcttcactgacagttctagatttgaccagcaaccagctcaatggaacaattccctctggacttctccaaaggattcaagatggctccctaaacctaaaatatggaaacaatccaagcctttgctccaatggcaactcgtgtcagacaac

SEQ ID NO: 30510 - DNA, 551 bp, Sorghum bicolor
  Clone ID: 9855776
gcacgaggctcggccgtacgcccgggcccggcgaccggctccgttccgcgcggggatttaaacgcgggagtgagcacgcagcaggcgcaggcagcaagcaacgaacgcgcgcgcgccgccggaaccatctcgatcgcgggcaagggcgacgacggtgccgtggattccgcttgatcgttcggcttattcgtcgtcgtcatgggtggtggccggctgccggtggcgtgctccgccgtcctcgtcctcctcgccgcggcgggatgcgtgtgggcgccgcgggcggcggcggcgcgggagtacgcggccatcttcaacttcggggactccctggtggacgccggcaacctggtggtggacggcatcccggactacctcgccacggcgcgcctgccctacggcatgaactacttcggctaccccaccggccgctgctccgacggccgcctcgtcgttgacttcatcgcgcaggagctgggcgtgccgctgctgccgccatccaaggcgaagaacgcgacgttccaccgtggcgccaacttcgccatcaccggcgc

SEQ ID NO: 30511 - DNA, 463 bp, Sorghum bicolor
  Clone ID: 9855808
gcacgaggctgctccgcatctcctcgcctggcgccaccggcgacggggacgacgactcgctcctcggcctccccaacatcgcgcagaacgagcccatcctcttcttcatctgggaccatgtcgcgcgcctgcacacgggctcccccgccgcccgcgctgactcggccgccaacctcgcctcgctcgcccgcgacagccagcacttcgccaagctcatcattgaggaggacggcgtgccgccgctgctcaagctgctcaaggacgggaccgacgagggccaggaggccgccgcacgcgccctcggcctcctgggctgtgacgccgagagcgtggacaagctcgtgcaggccggggtttgctcctccttcgccgcagcgctcaaggagccgcccatgcgcgtgcaggctgctgtggcggaggccatcgcgtccctggctgaccggagctccacctgccaggacct

SEQ ID NO: 30512 - DNA, 164 bp, Sorghum bicolor
  Clone ID: 9855817
cagaccttggacttctcctacaacaaggacttgggtggtcctcttcctgcatgcatcggaagcttgagtaacctcaaaaacctcttttctggagaaataccgaaagaattaggacagctctgcaagcttatatttttatctatgaactcaaacaagttcagtgg

SEQ ID NO: 30513 - DNA, 415 bp, Sorghum bicolor
  Clone ID: 9855843
gcacgagggcagcagcaggcagagtcatccgtcgtctgccatggactggtcctcagggctccttctgatcatctcatgccttccggcggccgcgtgggtgctcgccgccgcagcgcggagtcccggctgcccaacgatggcgaggtgcggcgccatcgacgtcccgtacccgttcagcttggacccgcagtgcgcgatccacgccggcttttggctcaactgcagcaccgccgcggatggcgccaccacgctgctcgacaagaactcggaggtgaccaagatctccgtggaggatggcaaggcctggttcaagactccgatctctcggcagtgctacgactcaacctcgggtgacatgttctacaacaacgcgtgggtcaactataccaccgagccctacgttctgtcggcggac

SEQ ID NO: 30514 - DNA, 545 bp, Sorghum bicolor
  Clone ID: 9855847
gcacgagggttagcccgttttctacctctccactcccctctccaccggaatcgtctccccacgcaggcccgcactcgcaaatctcctcccctctccccgcgcggcgcgcctgcacctcccggtccggcgagaggccaccgcccgcgccgccgcgctcctcacactcccacccgccccctcgctacgcaagccctagaagcgccgcctccacggccgcacctccgccagtcgcgctcctcgcttcgccgctgcctccgtagccgtcgcgggcgccaccatgccgctccggttggatatcaagaggaagctcgcgcagaggtccgagagggtgaagtccgtggatctgcatccgacagagccatggattttgtcgagtctgtactcgggaagcgtttgtgtatggaactaccagactcagacaatggtgaaatcatttgaagtcacggatttaccagttcgttcggctaaatttattgcacgtaagcaatgggttgttgctggtgctgacgatatgttcatccgtgtgtacaactataacacaatgg

SEQ ID NO: 30515 - DNA, 312 bp, Sorghum bicolor
  Clone ID: 9855859
gcacgaggactccgcacacgaatcagccatgcaggcctagatccccagcccttccttccttccggcggcagttcctcgccggcgtcgtgccctcccctgccctccctccaccttctgctcaggactcagaacttatggacgaacaggtggaaaactttgtggggcatgacaaaggtggattggcccaagttccttatgacggagagcagccaaacccgtatgatgatgttgcgaagcagtacagtgaagagctaggtgaccagtacaatgagcaacctggtgcccaatatgatgaagggtctgcgaatccgt

SEQ ID NO: 30516 - DNA, 564 bp, Sorghum bicolor
  Clone ID: 9855865
gcacgagggcggttatcgcgcccacgccgtccacccgaggcctgagctccaagccacgaagaaaccgtggcccctgcgcccttgccgtcgccgtcgcccagctccgcagctgcccgcgccgtcgccctctccgttggccgcgcgcccagctaagagctccaaggaaatcatggcccctgcccctacccctgtgccttcgccctcgccgtcaccgacgcccagcttccccacgctgcccagctcggcagctccccacgcgagtccccggggcgcaatcgctgcccgcgccgtcgacctcgccattgggtgcgcgcctccaggtgcggccatcgagcttcttcaagttcttcctcgcgtgcctccaggtgcggccatcgagcttctttaagttcttcctcgtgcgccaggtgagtccaggtgcgcctccaggtgcggccaaccccttgaattccctccgtctgtgcaaaaccgatcccttctttaatttgtagtatgtgatgacacatccttctgttgtaagggatttccttgcatcagcttttctgtcttgcatctgcacaagga

SEQ ID NO: 30517 - DNA, 533 bp, Sorghum bicolor
  Clone ID: 9855869
gcacgaggccgggaccacgcccgccgaggcctcgcctccgcctcatccaggccccggtccctccgcggcctcggcggccgcccgtctcgcccccgcgccgcgcccctcggccacggaggtgcgtatacgtacataccttcccaccccagcatctgtgcgatccctagcctcgccggcaggccacgcgtaggcgtagcaatccggacgccccgtcgggtagcatttcgcggcttcaaaatccaacaccctctctagttctgcctcgatcgatccattggtacctcctctttctatctctctactatgcgagaagccgcgctgtgcgtcgattctgttgaatcatcgatgtgggagcttcctctgatcctgcacgcgcgtcctgctcatctgatccttagaatctgatacccgaccagctccgcacgcgaactggaaacagtggaccggtgtatggtacggatgagctgcagacgtgggccgtgcccattcccatgttctcggataccgcggggtttttttttttataagatcta

SEQ ID NO: 30518 - DNA, 514 bp, Sorghum bicolor
  Clone ID: 9855875
gcacgaggctccctcaaccctattatgcggccgacgccggcgcttgccgccggcggacgcacggtcgcaagcttcctatccgccacggaatggatgcttccgtctccggccacccaagtccacaccatctccgtccttccctctcgtctcgagttcgccttctccaacctcacgacgtcgctcaggaatggcggcggcaacggtagtgagactggcaatcctaagttccagatagtacgggacgacctcctccacccgctcgccaacggcaacaaggcgcgcaagctcgacgccctcctgcccgtcctccgccactgcggcgctactgacatcgttacatgtgggggttgccagagcgctcatgccgcagcagttgcggttcattgtgccgagtggggaatcaggccacatatactgctgagaggcgagcaactggatgttcccacagggtataatctgatctcattgatgtttggcaatgtgacatatgcctctcggtctttgtatgcccaaa

SEQ ID NO: 30519 - DNA, 478 bp, Sorghum bicolor
  Clone ID: 9855880
gcacgagggttttgtgatgaacctgggttagggaagacagtaaccacactctctctgattctaaaaacccaaggaacaatggcgtatgctccacaaggggtcgatgtgagttggtgcatgcataagccagataaaaaatgtggttactatgaattaagtgccagctgctcttctaatagaaacagctcttcgtctgcgtcaagaaagcttttgggggaggatgtgataacagattatcaaagtccagatgattctgtctgcagtaccagatattcaagaaagagaggtaggttactgagccctgatccaactaaggtaatgttgcatgctgcgattgagaattccccatcgtcatcacacagcaaagagcattcaatgccagctacgcatatactgaagttcactaaaaactcgagacaagttaggaaaaacctcatggatgcatacagcgacgtttcagttggcaataaaaggaaga

SEQ ID NO: 30520 - DNA, 477 bp, Sorghum bicolor
  Clone ID: 9855884
gcacgaggcttggtcccctatctgatgttgatttgactaaatcgtctatcaaaccccactacaatccatttgcatcaacctttgataaaacagatccaagtctagatattggggatcctgtaagccctaatgcaattggttctgtttccacaacagaacacatgaatacagtgtccccttttggtcgatccagaacacatgcccatgaaagttctgcagaacctgtgcccattaaacaaaagttattccgtcaggagtttgcttctggtgctccatatgatccattgcttgacagtattgaaccatcgagcagttcaatcaacaaggtagatcttcgtaaagagaagaactggagtgctgctgatagtcgtgatgcatcaaaacttatgaacctagaagtggacagtgaaaatatgtatggactgggggttgttgctgagtcagaagttgagggacttggagaggtggcagaagata

SEQ ID NO: 30521 - DNA, 498 bp, Sorghum bicolor
  Clone ID: 9855887
gcacgagggccatttctctctccctccctcgtcaatcaattcctcacaacccaacagaaccacaggagaacagcctgctcggagctcggagtcgagttgagaagaagaagaagaattgaaaacaagacagtttgcagcagcctctgggtcgtctcctcgggctccggccggcgacccctcgccccgacgaggaagcagtgtgctgcattgccattgcatcaggcgacctagaggaagcagttaatggtccagaggaggggccataacctccagccgtttcagtttttgacttgagagttgcttgggtttcctcaacaaacacactggtggagtgccgtgccatacgcagacaactaacttagccctgccaaataaaacaagagacggagcttcctgtaatcctgcacctatggtgatagcatccggagccgttgacaggagccacctgtccccgtttgttcccctgtcagaatcctcatcttcatcattcttctccca

SEQ ID NO: 30522 - DNA, 494 bp, Sorghum bicolor
  Clone ID: 9855889
gcacgaggcggaaggggtcagtcaagctttctgttcttgattatctacaccgcggccgccggctctcagcccaatgccaccggtgtgaggaacaaggacctcgggagcggagaaggagccgactcgtgaagatcacgcgccgatcttagtccgtgtccgtgcgcgagctcggcgtatggttggtggcgcttggtggtgctcgtagtgcgccgccgccgccatgggctgcgtcgcgtccaagaacgccgtctcggtcacgccggcggccgactcgtccggcgggctcagggaccggagccagccgcgcgctcaggagtctgctgctccggtgccgttgccggtgcccgtgtcttcttccctgcggagcacgtcgtccgcggcgaggaggtcggagaaggtcaaggaggaagcggaggagccaggaaaggccgccgtcgtcgtgccggccgcgtcccggagcttccggctgcggagcctgcggaagagccttgagg

SEQ ID NO: 30523 - DNA, 126 bp, Sorghum bicolor
  Clone ID: 9855895
cgcctacactatggggaagcgctggatcccgctggaggccaacccggacgtcatgaaccagttcatatgggggctgggagtccccgagggggatgtgcagttctgcgacgactacggcctgaacga

SEQ ID NO: 30524 - DNA, 614 bp, Sorghum bicolor
  Clone ID: 9855901
gcacgagggcagaactagcggagaactcaaaatacttggttacaaatgaaaatactttctgggaatatataaggggatggggaaaccagcaagggtgccttgattgaaggaatttacaagcttgtaagttcgaagcccccagcagttttagttgtatcaagttttatgtgttttctacaggattttttttaggtaaggaggtgatgctgacagcagcagtggtatttagaccacttctgtttctgcttttggatatatctattcgtggatctccttttgctacttgtgttagtatacctgtaagaacaccttccggcttactacctccatattgatgaccctgaggtctcgtggaaactgcaaaggtattatactcctgttcctgtagtgaataagaagggacttcacatggtgattatcggataaggtggctgtaccaaggagctcatttgtgtgtggcaggactgcgacctgatgtagttcatttttttttttgccaggcaggattgattcagtggatgactaacaaattatcgtagtttcaagacttttctgcgcgtgttatggtgatggttgcatttgacttaatttgcttattgctgctattttctaat

SEQ ID NO: 30525 - DNA, 506 bp, Sorghum bicolor
  Clone ID: 9855915
gcacgaggcggcggcggtggagcccctgcgctgggaccaggtggtgaaggtggtaccgtcgatggacgccgtggtgaaggtgttctgcgtccacaccgagcccaacttctccctgccgtggcagcggaagcggcagtacagctccagcagcagcgggtttatcattgggggacgcagggtgctcaccaacgcccactcggttgagcattacacacaggtcaagctcaagaagcgtggctccgacaccaagtaccttgcgactgtccttgccataggcaccgagtgtgacattgcaatgttgactgtggaggatgatgaattctggaaaggtgtttcacctgtagagtttgggtcgctgccagcactccaggatgccgtcactgttgttggttacccaattggaggcgatactatctcagtgactagtggtgtagtttctaggatagaaatactgtcatatgttcatggttctacagagcttcttgggttacagatagatgcagcta

SEQ ID NO: 30526 - DNA, 157 bp, Sorghum bicolor
  Clone ID: 9855936
gcacgagggtctctgctggtaaaagcatggctcatcttggtggccaccgccggctgttgggaacggccccggctccggccggggacggggcgtcccacggctcgagctccagccctgacgcgatgcggatcatggtgggcgtgctggtgacggtgat

SEQ ID NO: 30527 - DNA, 129 bp, Sorghum bicolor
  Clone ID: 9855937
gcacgagggtcccccactaggagcggggaccaagaactccgaatgtggcttcgtggcgcccgcctgtggatgtggatggtctccgtccacctcgccgtccgcccctcacttggttttggcttcctagtt

SEQ ID NO: 30528 - DNA, 347 bp, Sorghum bicolor
  Clone ID: 9855939
gcacgagggtggattttcttgtgatccttctatggttcatgctggctgtggtggcctattaggaacatgccattcaaaggattgcgctggtgttgatttagttgatccactttctgctgaggtttccgagtcatccatgattagcttgttgcagtcagatataaggcaagctcttaaagctgcctttgcaaacatggatggcccattatcagtaattgattggtgcaggggtcgaggcaatgcagctgagtcagttactgcagatgcatactcttttcagtactccactggtgataccctggagccgtcaagttcactgcccattggtggagattctttgagcccac

SEQ ID NO: 30529 - DNA, 491 bp, Sorghum bicolor
  Clone ID: 9855940
gcacgagggccgcaccaccgcctcgccctcgcttcctccatcctccagccggtggccaaggtccacgggcgagcagctcggcgcgctgtccaccgcgcgtgtacgtgctcccgccgcccgctgcggccccggcatccacgcgcgcgtgtcgcaccgcccgctctgggcaccgcagtaggccgccgcggtccgcgggtctttctgtgaccccgctcttcccgcctgctccggtccagggcgccgcggccccggcctcctcctccgaatcccgtcggtgagctgccgtctggtgtggcgggacacgccgacgatgctgccaacgagggaacctccttctggatccatgcccttgagccagggccactttctcctggagccggagccgctgccggttgcggtacctgctgccaacgcgaacacctctaatacaggtgacactagatttgatgcatcacagtatgctttttttggcaacaatgtgctggaggaca

SEQ ID NO: 30530 - DNA, 503 bp, Sorghum bicolor
  Clone ID: 9855994
gcacgaggggaagcttttaccttctctagcaaatgatggtcacagagtactcatatttagtcagtggaccacaatgctcgatatccttgaatgggcactggaagtaataggagttacatatagacgccttgatggagggaccgctgtaacagaaagacagactatagtggacacgttcaacaacgatctttctatatttgcatgtttactttctacaagagctggaggccaggggctgaaccttgtaggagctgacacagtcattatacatgatatggattttaacccccagatggatcggcaagctgaggaccgttgccatcgcattggacaacagaaacctgtcactatctataggcaaacacatattcgacattttctgttgagtttactcaaagctcatttgtgccaataatgatctcttttactatgtgccatttaattttcattggacttcgaaaatgggaaatgcccttataatccaaacaatcataatgtctcac

SEQ ID NO: 30531 - DNA, 506 bp, Sorghum bicolor
  Clone ID: 9855995
gaccaagggcacaccaactgaagcaacattattggagttaggcttgatcttgcaaggagacctgtatggtgagtacaataagttggcaagagtcaaagtaaagccttttaactctgttaagaaaaagatgtctgtgctaatacagttacctaatggaggcctccggtccttctgtaaaggtgcattggaacttattttagggcagtgtgatactttcctcaatagtgaaggaaatttagcaccactgtcagaaatgcaaaagcaaaatgtcttaaatataataaactcatttgcttctgaggcattaaaaacgctttgtattgcatttaaggatctgagtgaaattcctgatgaccatacaataccataggatggttacacactaatagcactttttggcataaaggatccagtccgtcccggtgtaagggatgcattaatgacctgcatggctgctggaatcaaagtaaaaatggtgactggagacaacatcaatactgctaaac

SEQ ID NO: 30532 - DNA, 325 bp, Sorghum bicolor
  Clone ID: 9855999
gcacgaggcttttctggaaaaaagaaaagaaaaaaagaaagaaaaaaaaaagatgccgttgtctcagctgtcgctgtcgctcgcgatcctggcctccacggccgggacctacgtcggcctgcgcaaccccaacccggaaccctcctcgccgaagccaggcggctcggagccgccgaagaagcacgcggactcgatccgctggatgaacctcacccaccggcacacctccaaggccatcctcctcccgctcgccttcctgtccttccacctcgccgccctcgccctgtactacccggacgtcccggccgccctcctccggcacggc

SEQ ID NO: 30533 - DNA, 332 bp, Sorghum bicolor
  Clone ID: 9856005
aggcaacttgttggcttgattagaggaaagaacactgtacatgatattattttatgggtggaggaacaaataattcccacaaatggtactgaatttgcacttgatgttgttagccacacgctacttgacatgggttcaaaaagtttcacccatcttatcactgtttcggagagatataataagataatctctaagctatgtccaaatgaggaaatgcagctactgttaatgaatggagtcagtgcttattggaagaacagtacccagatgactgctatagctattgatagaatgatgggttatcgcttgatatccaatttggctatagtcaa

SEQ ID NO: 30534 - DNA, 484 bp, Sorghum bicolor
  Clone ID: 9856006
gcacgaggatctttttgtgtcgccatggatgggcattgtggttaacttacagtgtgagttgatgaaaggcaaagaattttccagggaaagtgaagaaagactaacagcgcagctctcgcggttcagacccctccaagccacgattcttggggatgagaaggaccaaccgttttgcgctatcatcgagtttgctaagtacttgagtggatttaaggatgcaatggcttttgaaaaccatttcatactcgagcactacagtaagcctgattggaaaaaacgaaattgcagaaaggacgatctttatggatggattgcaaaaacagatgatttcaactcccctgggccaattggggagtatctacggaaaaatggaaatcttaaaagtgtcgctgacctggaacgagagggactgaaagaaactggcaagcgtgtagttcattatgctctccaaattgaggacacaaatgaacacatgcttgaactg

SEQ ID NO: 30535 - DNA, 279 bp, Sorghum bicolor
  Clone ID: 9856007
gcacgaggcaccgacatccacgtggccgcgcggggcggggacgccgtggcgctacgccgcgcgctgtctgtggccgcggcggccgtggccgccacgggggagggacccgaggacctcgaggcggcgcggcgcgcggtggccgcagagcccaacgaggccggggagacgccgctcgtcgccgccgcggagaggggccacctcgaggtggtggtggagctgctgcggcacctcgacgccgagggcctggccgcgaagaacaggtgcgggtacgacgcgctg

SEQ ID NO: 30536 - DNA, 259 bp, Sorghum bicolor
  Clone ID: 9856010
gcacgagggtcgcctctccgcgccggcgaggtgacccgcgcgacgttgaccggggcgtgcgtccggccgcatcttgtcctccttcctcacggagcggagcgccgctcccaaatcgcagaacccgaaggcctcaaggcgggcgtagcgattagcgaagggatgtcggaggccgtcgccgagggcgagtcggccgtcgagctgctgctccgcgcggcggcgatggtgcccgcggagcgctacgcgctggccggcatcatcg

SEQ ID NO: 30537 - DNA, 514 bp, Sorghum bicolor
  Clone ID: 9856023
gcacgaggggttcacgacgaacctgatctcgtacctcaccctgcagctgcacctgccgctcgtccaggcctccaacatcatcaccaactacaacggcaccgccaacctcactccgctcatcggcggtctcatcgccgactcctttgccggccgcttctggaccatcacattcggctccatcatctaccagctcggcatggtctgcctcaccctctccgccgcgctcccgtcgctgcacccgccaccctgcgccaagcacgccgcagactgccagcgcgcgtcctcctaccagatttccgtgctctacctgtctctgctctgcacctcgattggcaccggcggcacgcgcccctgcaccatggcgttcggcgccgaccagctcgagctgaacgacgcgcacagcaggcacaagcccaagtggagcttctttaacctctacttcttcgccgtcgagctcgcgaagctcgcggcggtgaccgccgtggtgtacatccaggacaacgtcgggtggggt

SEQ ID NO: 30538 - DNA, 437 bp, Sorghum bicolor
  Clone ID: 9856028
gcacgagggccgccgccgccgccaggcagcagaagacgccaccggccgagacgcccacgcccgccccggtcaacgagcccgagaggcgggccgccgacgcgccctccaagccgcggcccgtgtccgcgccgccgccggcctccaccgccaaggcggcggatgcggtcaccgccgctccccccgcggcggcgctggatgaggcggggaatctcgacaggttcctcagctccaccacgccatctgtgcccgtgcactacttgcccaagaccagcatgaggggatggaggattgctgatgttacgaattctcgaccatatttctgccttggagatctctgggaggctttcaaggagtggagcttttacggggctggtgtcccccttgtcttaagtggaagtgaatctgtgattcagtattatgtgccgtacctttctggt

SEQ ID NO: 30539 - DNA, 285 bp, Sorghum bicolor
  Clone ID: 9856036
gcacgagggggagttcctcttctccggcctgggctacctccggtcgcgcatgtcgtcgcagcacacggtggtgatcgaggagacggaagggtgggcgagcaaccagctgtacgacgcggcgcgcacgtacctggcgacgcggatcaacaccgacatgcagcgcctccgcgtgagccgcgtcgacgagggcaagagcctcatgttcagcatggaggaaggcgaggagatggccgacgtccacgccggcgccgagttcaggtggcgcctcgtctgccgcgacggcgg

SEQ ID NO: 30540 - DNA, 550 bp, Sorghum bicolor
  Clone ID: 9856064
gcacgagggttggctgtatttaccatcacaagctattgcttggcctcttttaaatctgcaggcgcaccaataagcatacggtggggcagctatcccatggttgggaaaagtgatcttgacaactataccttttgtgcatactgtaataaaccaaagccccccagagcacatcactgccgatcttgtaaaatgtgtgtggtggacatggatcatcattgcccatttgtaagtatgatatctgcattctgctgcgttagtattttttgttgattgttagttggcttgtttattcattccccccttctgttcaagtgcagattggcaactgtgtgggagcatcaaaccatcaagtgtttgtcatttttcttatatctgtggttattagttgttcttatgctgctgggatgaccatatatgcgagttataagatatggccctctgttgattttccaaacctagcatcaaaccgtcactcaatgagtttttggaaaatattgttggagattattactacagttgcaggctctgccttcttcttgtcagcaagggg

SEQ ID NO: 30541 - DNA, 526 bp, Sorghum bicolor
  Clone ID: 9856089
gcacgagggtcacgtgcttcgtgccgccagacacggagcacccggcggcccgggccccggctgctccggtgccggtgccggtgccggagacggcgctggacgaggaggccagggccgcggcggcgcggcgcatcgcggagaagaaggcgcggaagcggtccgagcgtcggacgtacctggtggccgccatgatgtccagcctcgggttcacgtccatggccgtcgccgccgtgtactctcgcttcagctggcaaatggagggcggcgaggtgccggtgagcgagatgttgggcacgttcgcgctctccgtcggcgcggcggtcgggatggagttctgggcgcggtgggcgcaccgggcgctgtggcacgcctccctgtggcacatgcacgagtcgcaccaccggccgcgggagggccccttcgagctcaacgacgtgttcgccatcatcaacgccgtgccggccatctgtctcctcgcctacggcttcttccaccgggggctcgtgcccggcctatgcttcggcgc

SEQ ID NO: 30542 - DNA, 138 bp, Sorghum bicolor
  Clone ID: 9856102
gcacgaggcagaagcacaccgtccagttcgtcctcaccctttgttctccacacttgcagataagctgcctggtgcttttcgaagaaaaaaagaggggaggtggataggcacccatggctgggttgcaaagatcggcga

SEQ ID NO: 30543 - DNA, 136 bp, Sorghum bicolor
  Clone ID: 9856103
gcacgaggagacgctccatcgactccgcgctcacttgttcattccacgggaccatgtgctggtccaggacttggtacgctcccgtgctacatgctaggacaacaaaacggagacggtgccatgccagcgcaacaaa

SEQ ID NO: 30544 - DNA, 396 bp, Sorghum bicolor
  Clone ID: 9856106
gcacgaggctgacatcgttccatcagcaactccagccgatcaacccatagtgccatcggcctcaactagccagaggcgagaaatcgctctgaagcaagtaagttatttgattatcattctgtattttactaatatttcgtcatcaaataacccatctcctgtcctctttcaggaacaagattctcctgacagtctgttctccttcgctattgaaatctctaatgatgaaggcgaagaagcaagttcttcccaagcgattgggatctcatcggcagagatcagagcaaagctggaggatctgtcatccctgcttcatcaagatacagcgcaatgggtcgatgattctgatccagccaaggctctgtttaaggctctcagaggtcaaatacctgccga

SEQ ID NO: 30545 - DNA, 512 bp, Sorghum bicolor
  Clone ID: 9856113
gcacgaggctaacagcaggcatctctgcctctgccggtctgccctgccctctggtgcaccacgtgctcgtctcgtcttcctgaagcagcttggtgaagagagcagcagcagcagcctgcagcttcacagtcacacatgtcgtcaccggcgagagccggcggcgcaccggaggatcaggcggaggcggacgtggaggaggagactgggagaggcacgtggcggcacgcggccttccacgtggcgacgacgatcgccacgccggcggcctacgcccccttgccgtttgctgttgcctcccttggctggcctcttgtacaggtgtctgcagcttggttattgggacactggttacatggtgctcaagcttggttgtggcctcgctatggcggtggaacggggagaaacacaccaactaccggctcctggcagagagcatctttggtccttggggctactggtatgtctccttcttccagcaggtggcatcggtaggcaacaacattgcaatccag

SEQ ID NO: 30546 - DNA, 493 bp, Sorghum bicolor
  Clone ID: 9856140
gcacgaggaatgttcagtgtcctcgtgacactcatttttgggtttatgatgatggtcgttatgaggaagaaggacaaaacaacataaaaggaaaaatatgggaatcagctctgacacgttttgcatgcacattattttcactgccggtgcctccggggaattcaaatggaaccagagatgaaattccatatactgcaagaactgttcctgattatttggaccaaaaaagaatacaaaagcttcttctccttggaccacctggtgctggtacgagcactatttttaagcaggtatgttctgattctgttcattgatgcctttagctctataacacatcttgcaatgtaactttctgtaactggccctatgtgagagattgcactgttatttagtaattcatttattttagaattcaagggcaagacgccctggcctttcaattaatatcaaaagaccatgagttcatcagttcagaacattcccagaaacctga

SEQ ID NO: 30547 - DNA, 207 bp, Sorghum bicolor
  unsure (1)..(207): unsure at all n locations
  Clone ID: 9856144
gcacgaggcaaatgcggcgaaggcactgaggaagccataccgcgcgccgctgtagcctgcaggctgtcgccacgacgacccacgcccgcgcgcgcactgctgttgtctgcggtgtgtggtctgccactgccacacacctgacctcgccatttcgccagtcaccagtcagcagcagccgccgccgctaggtgggaggagggcggangg

SEQ ID NO: 30548 - DNA, 334 bp, Sorghum bicolor
  Clone ID: 9856158
gcacgaggctacttcccggcaccgcaccgcctctcccggtcccagcaccgcaccgcgctcctcggaccaaccactgggctcgccagtcgccgacgctccaggcaggggcccgtcgagggcgagagaaatccgcgcctcggcccccctcctgccgcgggatttcagttaccgcccgctgccgcttcatccgcgaaggcaggcaggcaggcaggcaggcaggcaggcaggcggcggcaatgccgctgggctcgcccgtgaagcgcctgctgcggcgtgcggccaaggggaggctagacaaggccgagctggcggtggcggggctggccgcggcggc

SEQ ID NO: 30549 - DNA, 243 bp, Sorghum bicolor
  Clone ID: 9856165
gcacgaggctctcccctaaactttgaaatatcttgaagaactaatctttgttctcattatcgatctttgctaatttataatcttttaccataagtctcataaatcttgaatcaaaaaaaaattgtgagcatgatgtatctttatcttttatattatctcttgctaatcttcactctttgtgtgtaaacctcataatatgaagatctggtgatcaacctttatctatctttctaaccttcattg

SEQ ID NO: 30550 - DNA, 118 bp, Sorghum bicolor
  Clone ID: 9856193
cgtacttcattttttcatcatgtgtatttctttgcatgaaacatttgcccaactgagtaggcaatggtaattctaattatttccgccactgaatggaaggctaagagaggattccaat

SEQ ID NO: 30551 - DNA, 372 bp, Sorghum bicolor
  Clone ID: 9856223
accggatcttaaggaaggtcttcaaagactgattgatccagcgttaggcgaggattaccccatggactcaatcctcaaaatgacagttctcgcaagggcgtgcacgcaggaagaccccaaggcgaggcccacaatgagatccatagtcgtggcgctgatgacactctcatcgacgagcgaattctgggatatgaacgcgatccaggagaaccaaggtctggtgaacctaatgtctgggagatgactctcttgtgatattctacctgcctgcctgctcctgggtaattgtacattagggctcatttgtgccgcctgttgatgaccagagagggagggtagcattgctcagcaccactgtaggtatttacaatg

SEQ ID NO: 30552 - DNA, 169 bp, Sorghum bicolor
  Clone ID: 9856227
tcaactcctggcatgtgcatttgacaagattggttcaatgacaacaaacacaatcacaaaggaaaggaaaaagcaggagactgttgtcatggctgagcttgatcaaagaacaagacggctgagttcactcaagatggatgaatagtttgtaaaagaacaaaagttaatg

SEQ ID NO: 30553 - DNA, 277 bp, Sorghum bicolor
  Clone ID: 9856243
ctcttacagatcgctgggcacaaggacattcttgaaggcgatccttacctgaagcaggggctgcgtgtgcgcaatccctacatcaccaccgtgaacgtgttccaggcttacacgatgaagcggataagggaccccagcttcaaggtgacgccgcagccgccgctgtccaaggagttcgccgacgagaacaagcccgccggactggtgaagctgaacccggcgagcgagtacccgccggggctggaagacacgctcatcctcaccatgaagggtatcg

SEQ ID NO: 30554 - DNA, 452 bp, Sorghum bicolor
  Clone ID: 9856252
acatagtcctgtggatgtacatcctgacattgctgccatgataggttttggtgggttaacacataggcaaggttcatttatataattggagcttgcacttttacactcagttatatatatatccttcactttagttacaataaaatattggctttctagcataatctgatggaggtggctatcggctttacctttggtcttccattatctttttagcaagaatacttttgcggctaaagcgaaggatcaccttatgtttggatcagcatttctaagctaccggctatagtgttcggttgttatgaattctaaggtgtttctaaggtgtaatagttgggtatgtaatgtatgacataatagctattctagcatgcatgtaatgaaggatcttgtaatttatggctaaacagaaccataacaactgtgatggccatacaacttgtttttatatt

SEQ ID NO: 30555 - DNA, 459 bp, Sorghum bicolor
  Clone ID: 9856268
gcacgcgtatgggcggtgttcatgctggtggtggccatcaagtgctatcagcagcgcatggtggagttcggctggagcagcagcacggtggaggacgcacaggaatcagcagtcaacgaagcaattggcgaggagccgcgggcgaaacatagggctcaggtgcaggagtttggggcgccggtggtgccgcgacacaggcgagggccagtctccagcgagttcgccagggagaggctgagggtcaggggtggcatccagcctaggtgatggatacggattggatttattagaggctggctgagaatgactagctttgttgttctgtttttgtgttccggtgatcacgtcttgccaggcaataacaacggaacacatagcgtgttcatgtagagccccggattcctcgaatttaccattcacacatcaccgtttttttttgagacgcacacatcacagatt

SEQ ID NO: 30556 - DNA, 339 bp, Sorghum bicolor
  Clone ID: 9856352
tctattctggacccacttcttactagcatggtggggtctgactttgacgtaggacagatcaactcccctcagtacaacctccagtttattctcactgcgccaactcgctctgtccatcgcctttggcgcaagtttgatgatcggttcatgcgcccaatgtttggggggagaggtttcgttccctttgtgcctggttcgccggtggagcggagcgtccctgaacctcacctgggcactgtgacagaggctgagcatagttgaaataaggcaagagagatgtagacaattttctgtagatcttcagacagataccactcatactcctattttgttatcaga

SEQ ID NO: 30557 - DNA, 333 bp, Sorghum bicolor
  Clone ID: 9856360
tccgggacaagagcgtcgtctggtcgtggtccgacgtcggcacgccggcgtcgctagaggacaagcacgcggtgcatgccgtcgtgatgcagcacgggaggtccgtgtgcgtgatcaaccagtacgacgacctcgggttcctcgacctccggagcaccgccggcggcgtgcggtggcgatcgaggagcaagctgctggcgacgggcgggaagacgaaggcgctcgtcagcgaggaggtttgctacccgaagctcgccacgtacggcggtcagctgttcgcgtcgacgggagacaccgtctcggtgttcagcggacccgaccacgtgctcacgt

SEQ ID NO: 30558 - DNA, 446 bp, Sorghum bicolor
  Clone ID: 9856370
tacagggaatcaaccactctctcatgcaggttctcaggtgactcataacatgcacattccccttaactatgctgatgctgtgattggggcagctggtgctagtatcagttatatccgtagacacagtggcgcaacagtaactatttaagaaagcagaggtgcacctggagagatggctgtggagataattgggactgcagcccaagttcaaactgctcagcaactgatccagaatttcatggcagaggctgctgccccaggcccggcgccagcttctaaccctcccgctccaccagttgatccgagctacggctcttacccaccaccatatggagcacctccttatggttcttctgtggccgccaggcctcctctgcagtacaatggtgggagctatggtggtccgacctaccctcccagatatggttattagtattcaagtagca

SEQ ID NO: 30559 - DNA, 481 bp, Sorghum bicolor
  Clone ID: 9856394
tgtttgctgtgaagaattttgctcttcttgtgctcgcattaccgaatcacatactcttcaatcgcttcatgtgggactatgtcagacagacagacgccaagctactgctgacactacctctcaacttgccttcgattataatgacagacatacttgctattcgggtgttaggattgctaggagctatgtactctcttgcccagtacatgatatcaaggcgtataagaattgctgggatgagatacatttgaaataggacatgtaacttccaaggctgtcaccatacatcaaattgtttcaaagctcaggaacagatgcatcattgcctggtcggctcggagcaaaattgtgccatgtagcagagtagggtcgaatgactttgcttttttgtactgaatgatctgtacactgagcgtacgctaaaggtgttgtcacatatatagatatgttttaactgcacatatgataccatcaccttggg

SEQ ID NO: 30560 - DNA, 363 bp, Sorghum bicolor
  Clone ID: 9856413
gtcattgttagccactttcctggtgcagatagtgaacagggccacgaggcatgggcaccaggcaggatggctcgaagctacaagcttgaacagcagccgtcttgatctgttctattgggttgtggctgttgtcggattccttgccttcttgaactacatgttctgggccaagaggtatgtgtaccggcacaatccacgcatcgtcgttcgctgatgagccaccagttgatcaggatccacgttgaaatatctcgctaggatcgtcctccagttcagcaaagcaggataagtgtggtctggtttaccatgacatggattagagcctgttgtcgtattcagatgcctgattgtatgcagatacat

SEQ ID NO: 30561 - DNA, 480 bp, Sorghum bicolor
  Clone ID: 9856445
acttggtcactttgcagctaagtatcacagtaccaagcacaccatctgcattgaaaatacacacactatggatctagacgagtagtagttgattgtatcttatgaagctgattgaggtctgcaaatagttcaattgggagattgagctgatgatattcctctcagtgattagttacgttgctgacagtgcacacgagtttcgagaagccaagcatgcaaacaattacttactgctgcatagatggattgtaggctaatccacgttcaaatttgatactcaagttctgcgaggtgatactggtcattgagcacttacatggatgcacatccagaatgtgagaaatgcaatgatttgacagtgtcatggttccttgaagatattatgtgtatcagcacttttcgagtttttgtagcttcctttttccctctgtgaatcattaacaggatccttatccagtaagtaacttgttggtttcacgc

SEQ ID NO: 30562 - DNA, 382 bp, Sorghum bicolor
  Clone ID: 9856446
gctaataaacgtggccgacaagtccccttcgattgttgctttggttgctgcaggggtatgacggcggaggaggaggaggaggagcaggaggaagcgaggacggcttgattccccgatggctgccacgccgccgccgccaccaccaccaccaccatcattgtcccccgctgtagtctgacgtttacaaaagacccggagggtgatttcttgcgcatttctgtcctcttcctcgcgtttcctcattagattggcgtgggcggttcataagggaaattcttcatttgctgatggcacacaatgggctggtcattggaagggggagaaaaaaaagatgatttttggggggggtgttcccggagcggagagattccatgttggcttt

SEQ ID NO: 30563 - DNA, 321 bp, Sorghum bicolor
  Clone ID: 9856451
tgataaagtaccagagctgatcagtcccgatgagaatgtatttgataccaaatcgactgccacatgaaacctttttttgtgtttttgtttggggttgctgaagatacagtagctctgttcaggagaaaacagaagtttgaattcgcaaaacatggccttcaagaatagaaaaactcttacagtgtttcagtagaatgtagatcacgcttcaattgaactctctgtacatcttcgaatgagaagatcactgtaaaaacaaaactgatagcttgttatgttaccaatttaccatactttagagcaaaaataaaactgtaacct

SEQ ID NO: 30564 - DNA, 585 bp, Sorghum bicolor
  unsure (1)..(585): unsure at all n locations
  Clone ID: 9921261
gcacgaggcgcagggcagggccggggcggggcggggcgggcggcgatccgaatcngaatccaatcgccgggagggaggaagccaccggcggcggtagaggcggagggatgacgcgcgggaagcagaagatcgacgcacagcggcgtaacgcggagcggaaccagaaatccaaggggtcccagctcgaggcccgcgccgtcggcctcaaggtcgtctgccccatctgcaaggtacaattggcaaatgaaaaacagctgatcgatcactacggatcaaagcatccaaaggagaaacctccaagcacatcgaccacggaataaccatgactggtggtgatgcaggaacatagatcctgcttggctggtttgaggatctttaagtctgatccatggcctggagttggatcttaacgtcggctatactctatagtgtgtcttatttcctcttgtttcaggcaacacccttgatacgagtgtgcatttctgctagtatgttctgttatcgtactgccgatgtatctccaaactgtatgtgatcgccccgtggcattgggatgatgcgaaaaaaaaattatgatcatgaact

SEQ ID NO: 30565 - DNA, 662 bp, Sorghum bicolor
  unsure (1)..(662): unsure at all n locations
  Clone ID: 9921270
cagcggtggggaggcgcgtccacgcgagccgcgccatcccgatgccgtcggggacgtcgtggtcgacgccggagagcatcggatcgggctgcggcagcgccggatcccgaccgagacgcgcgattccacaacggctcgatcggggtaggggaagggttgctgcgagactggccgggaaagctttggagccaagagttcgccaagttggtcccgtcaactggcgtaggttactggttaggttgtatgtggcatacgggcctttgctgggagagtgcctgcgactgcgtacgcgtgaacgtgaacgtgattccttggcggtcggtcagtcgtcgcggtaggggagcgccctggcgcggcgctggaatctgagccggagctcgccgctgcgctgtttgactgcgccacgggggatcgacggcgcagcgcccgggggagatgctaccggcggaggagatgccggagcacgtgctcgactggtcgtagactcgtggtgggcctcgacttggggagagtggctgcgacacggcccaaagtccaattaaactccacgtagtgaaaaggattgtcctcgcagcccgcagagcgacggggcgtgttatagaatgggcgatgttgagaattgatagagttttttnccggncttatatagatttcggttaaac

SEQ ID NO: 30566 - DNA, 386 bp, Sorghum bicolor
  Clone ID: 9921286
tggcggtcctcatctatgcttcgtttgtaatgtatctcatactgcggggcaccgagctgtccgagaagattgtcaaagcagtccacagcagtttttcatgacaacagtcaccagttttggtcttttattacatcttgacaacaagtttctcagacacaagagacgtatagagagatatatactacctgcctctgtccggtgactgcggactgaatactacacagcacaccggtgtacactgtacagtgactacttgaaagggccatcagttgctgcaagcctgcagcagcagctgctgcccgttgcatctgtttattaacatagagatgagtgaattgctgatgttgttgaacttgaacattcagagaagacccagttctctttgc

SEQ ID NO: 30567 - DNA, 659 bp, Sorghum bicolor
  unsure (1)..(659): unsure at all n locations
  Clone ID: 9921309
aaggggaaggggaaagagaaggagaaggaggtcggcgtcgttgaccccctgccgccgcttccgctgntgcatcccgcgggcgatccccctgctgccccagaggaggcctcgaaggcggaggacggcgcggagtacctgtccgcggaggacgagaaggaggaggaggcttcgaccgcggccgccggcggtgacgacgagaagcggcggcgcgggtggggctccgtgctgagctggaaggcatggggcctgtgggggtcccactagtcagtcagtcagctccggctcggtattttatttcttttctgttcataagttaggtttggtggtgctttatttggtgcggggttctgatgctctcgttgctactgcgactactggacaccactggggggtttagcttgcttagctgctgcaggtcgatttggtttggttggttacactaggcagtgagaattactagtgttgacagtcagtctcatatgccaaagcaccatgataataatggcgatgtcatgtattcgaaatgtttgttttgttgatgcggtgggtcacgtgttaggctcttgtgtactgtacatatactactacgcaggcaggcagggagtgtgtggttggtgtaaattaatgattgtaatatactgtagtagtactaatgtaaa

SEQ ID NO: 30568 - DNA, 605 bp, Sorghum bicolor
  unsure (1)..(605): unsure at all n locations
  Clone ID: 18065185
gcacgaggccaatgccatgcaagcaaatgcgaactcattgcagcagctaaagcagcaacatcaggagcatcagatgatgcaaagtcagcaaatgaagcagcgtcagcagatgatgcatcagatacagcaaaagcaaatgcttcaacagcagctcccaatacagcaactacagaaacaacagcagcaagggcagatgccggttccacagcttcattctggaaatgatgtgaatgagctaaaggttaggcaaggagctgcaatcaaatctggaatgtatcaacagctgagccagcgtaactattatcatcagcagataaaacagggtggtgtctttccaatttcttctccgcaaaaccttcaagcatcgtccccacaaatttcacaccattctcctcaggttgatcagcacagtctgttgcaatctcaagtgaagaccgggacaccattgcattcagctaactcaccatttgtcccatctccatcccctcctgttgccccatcaccgatgccagtggattcagataaaccactctccaacttatcttcgctcactagtgcggggcaagcacatcagcanacatcccttgcacctcagacacaatcta

SEQ ID NO: 30569 - DNA, 618 bp, Sorghum bicolor
  Clone ID: 18060869
ggcacgaggctcttttacacgtgcgaagaaatgggttcaagaacttcaagcacaaggtaacatagtactcctttgcacttattacatcagtgctctccatattggaacttgcacttatacggtgaaggttgcttcaaaagaaatgatattgatattttggatattatgaacgagctgtcttattgtacagctgtataaaaaattgattcagcaagtatgatgggaatttactggaaaggattatgtgtggatgtgttacaacaatgagtggtctgatctacaagtttttattctcatttccttcttttaatgcaggaaactcaaatacaatagtggctcttgctgggaacaaggctgatttgttagaggcaaggcaggtgccagcagaagtatgttaacgtgcttcttatgttccactttcatggtctaccacatttattttagtacctggtgtcttcattctttagtgatttcttatcctagaagcttttgcattcaatcactgcatctttattggccaacaatatggtacagagtggtagggaacagaggatgtatggtacagagtggtagggaacagaggatgttgagtatctactgatttctgacacagccttg

SEQ ID NO: 30570 - DNA, 444 bp, Sorghum bicolor
  Clone ID: 15724432
gccggccgggggacggaccgggaacggttccttcgggggccttccccgggcgtcgaacaaccgactcagaactggtacggacaaggggaatccgactgtttaattaaaacaaagcattgcgatggtccccacggaagacattgtcaggtggggagtttggctggggcggcacatctgttaaaagataacgcaagtggtcactagatgatgtctttgttgtcatctcaaaaggtgactaattttcaggagcgtcactttttttgtgtaagtgtatattctaatgctaatctgtgctaattgaaatcataaccgcacaaacatactgtaaagtacagtcctcatccaaacagtcagctatgtacatgttaatttgtactccctccattccaaattataagatattttgttttttttagattcatagcttttgttatgcacatagat

SEQ ID NO: 30571 - DNA, 345 bp, Sorghum bicolor
  Clone ID: 15724461
tagcctctacacaggacaggtgatgcaagaggagccaaacaagaactacttctcggtgctgacggtggcgcccaaggtcgtgaacgcggcgtgggagctcatccggagcttcctcatcggctacctcgccgggccggagtacgcagaggggtggctgatgcgcctcgccagggtcgccgggctcgtgctgccggggctgcccccgcactcgccgcgagattacgttaactccaccacgctcggagcacgtttgctcaggactcaggcagatgagctaaacctcaacagtcacagtacaggaccatcatagacggctacaaggaactgagcatgatagtatactgt

SEQ ID NO: 30572 - DNA, 309 bp, Sorghum bicolor
  Clone ID: 15724472
acctggactacagaaacatactgggatcaacaaaaaagttatttgcaagtatctatcctgatgaagagttcttacctaaaaagtcagctcctgtatatgccgatgatgactctgattctgcagagtaaaaccatctttctagagggcctatcatttggttggagaataccgtcactgaagatgcatgaaggcatggtcctctatgtcgtggtgttccttgaagttcagagggcaaaagagcgtcacaaggggtgcctgtgggcttgatgttgatgagcagttgcgctggatttccaaatgtaacaaggt

SEQ ID NO: 30573 - DNA, 156 bp, Sorghum bicolor
  Clone ID: 15724478
ccacctttactggcgacaagagcgctgctaccagcaagagcgccgctgttgccggccgccccagtgcctctctcctgagcattggtgagctgtccgtcgccctatacatgggtgtcgccatgcttgccgacggtgccatgattgccctgtaaattt

SEQ ID NO: 30574 - DNA, 584 bp, Sorghum bicolor
  Clone ID: 17886467
gtttcatcattcattatgtacatcagttagtgactactgaaagactttttttttcaggaaacacttatcctatgtactgacaagaacatccatccactggagaacataccgagtcctgtatcagtccttgatgccacattctatcaagatgtgatgtcgccttctctgaggggcatatcaaattctttcaaaagtgagaactttatctgtcaagcaattcttcacacgactctgagcactatccttgggttccaatcaatctaggaaaccatattgtttggtacatgacaagcatacttaactgtagtatgtcaaacaaacatgacaagcaactggtaatcaatgcaaccaaatgtagctcgttgtctagcaagctgggaagaaccacagtaaattggcagcgactgtagaaatgcaagtgcttgcttgtgccaaccagttaaagagcatcaattcttcactgccagtagtagttcatgtctgcacctaacatcttcatggagctcccacatgttacaattgcccatacagggatgtagatgagcccaaaacgtataactgattttcttagttggattggttgc

SEQ ID NO: 30575 - DNA, 251 bp, Sorghum bicolor
  Clone ID: 17886473
ggaggcgtggaaggcccctttgaatgagacggtggtccctgaggggtcccatgagtccctccggcccttgttcaagcagcagctcaagttttccaggttttgatttgtttggttaccccctgcaattttccatgggggttgcccttttcagagaatttgatacggtgccccccctttttgaatgaaagaatgaaataaacttctaacgattcctgttaaacccaaggaagagggggataaatataaatgta

SEQ ID NO: 30576 - DNA, 522 bp, Sorghum bicolor
  Clone ID: 17886491
tatgaaagcaagtttctatttcagacacattttcctttgtcagcgacgaagcagagaagcactcagaaaggtggtgggtgagccgtatcgccaggttgaagcgcggtcggtgtctcgggagcgagtgcagatatggttccttttatcaaaaaagaagaagacatggatgataccaccacgcttagcacgctacagtctgttttttttttattcacttttcttctggtcgttaatcaaatctttgttgactggccccttttcacatgatgcttcgtttttgtcatatacttattgtactttcttggtttctcatcagctggcagggcttgcacaggcagcggcttaggtagtagggatagatagatttggtaggataaagatttgagttagctcattgggaggagtgggtgcggcgtgtgatgtgaaggtggtacagtgagtgcaattgcagttgtgactgtaccttttggggtgtgagttggtgatattgtggtagtttacaatgatataatacaaatatgt

SEQ ID NO: 30577 - DNA, 148 bp, Sorghum bicolor
  Clone ID: 17886526
ttggggacattcccctagggaagaacctgaaggggattcctttcattgccgctttggggtttgagatcattgccgcatacctcatgccccccatggagtttgggtcagttgattttggtgaatttgagccccagcttgttttctgatt

SEQ ID NO: 30578 - DNA, 621 bp, Sorghum bicolor
  Clone ID: 17886528
atcatgaagcagtacccaaggtctcaaacttcagcagtagtaatgggcagggccattctgcgaagaagaaacccatgagaagtgaggtaacagactccgataagaccaaccaagccacaatgaagaacaaggcagcaatgctagcatcaaaaatcacctgtttcaactgccatgaagaagggcactatgcacatgggtgtcctagaaagaaatcttctggagaattagggctacatgatgtcgcctgtccaaagaaaaaaccagccagagaattggagctatgtgatatcacctgcttcacatgccataagaaaggccacaaatcaaatacctgtcccaagaattgtcccaagaaggggagatgtggagaattgaaactatctgatgtcatctgcttcaaatgccataacaaaggccattatatgaatggttgccccgagaagaagccacttggagaattggagctatctgatgtcatctgcttgaaatgccatgagaaagggcattatacatatagctgtcctcaattgttgtttttgtagctctatggagacaatataacatcttttctttgattgccactttgcaaggtttatttggaataccgtttatatcccctgg

SEQ ID NO: 30579 - DNA, 513 bp, Sorghum bicolor
  Clone ID: 17886533
cttggacggtagagcagtctcctcggcaattccctggttttttgcgaattggactgtgcaataatactgttttgcactgtcaattgatgacggtttcttctttgctctaacggtcgcctcatgattcgtcgtcttcagcattgtttggctcatcgaccttagtacttatagacttgtgactggagttttggatctttttatctaaatggcatgcgctgcacaaaggcacctttatattttcgcaattttcttcttttcttgatattcacaaatatttgtcttcttctctattcctcggcaattcttgatctcaagccgagataatttggccgagagatcagattatgcttggaaggattgttgagattctacttgtccatagtcatggacttttagttccttttcgcttctttttttcagggtctgatattcgacacctaatgtacataatgtgctgtgtacgctatcgtcgttttggactacatgcaggggaccatcacctgatctgacttt

SEQ ID NO: 30580 - DNA, 565 bp, Sorghum bicolor
  Clone ID: 17886544
ggacggcgtagacagagccacgcacctgagccggacaacggacagaacgtattcgtcgttgccgccccagaggactctcagcccgctacaccatcgggtgatgacccttcaaaccatcaagtgtgggcttccagcgatgagcagacagtgacagatagcggaacatctcatcctccctcgatgatcaccaacgaatcctcactcgtgcaagatgaaaagtcagccagccctatagaggcaaaacctgccgctccagcagcagcagcagcagacgacgacgacgacgacttttctggatggatggacaacgaaccgttagatatggaaatcaatgaccctgtacagccaactgcacaggaagtcaagtaacacacaaagagaaagagaatcaggcgttctggactatgcaggctggggatgactacaagttcctgatggagcaagcttccttcagacttacttttcttataattattgttggatcggcgttgctggacggtgcatgggctctcgtttataggtgctacatcacatatacctcaataattgagtagtaattacacgc

SEQ ID NO: 30581 - DNA, 595 bp, Sorghum bicolor
  Clone ID: 17886555
cttccattggttaagtgtccagttttggtagcatggggggagaaggacccatgggagcctgttgagcttggaagagcttatgcatcttttgatacagttgaagattttgttgttttgccagatgttggacactgccctcaggatgaagcacctgaccttgtaaatccgcttgtcgaatcatttgtccagcgccatacttagcacatgggtgagcatctttctatgtttattaatgccctttcccagtagggcctcaatttgctggaacatgggaatgcacggctatgttattaacaaatgagtcctgttataggctatgtactttcatctgagagccaagggcaaacatcatttgattggattataattcaaatataagaaatcatgaagaaatatctgattttattacagaagaacctgtcttctcagagcagagaggttagtaccaggagcatagtggttctttctagttgaagttcctacatgtatatttgtcctttgtttccttatagaattcttatacagagataacatttaatttggacacttgacactggaagcatctatttcagttatacatcacgaaagagtaaag

SEQ ID NO: 30582 - DNA, 329 bp, Sorghum bicolor
  Clone ID: 17886561
catttaggagaacaaggagttggtgtcgcccaaccagatccgttccgccctgagaaagtccaaggccagcaggttcaacaagcgaaccgaggcgcagagggatattttgttcaagccccaggagctgggactgacgtcgcatggcggccgcaagaaggagaaggatccgttcagggacaatgtgttttttgcataacttgtgcgcaattttgttttggagggcaaaaaaagcggcgtttatgggatgctttttacttaggattggcgtcgatttgttggtattggcatacccctgcatgtatagcgatatccccaatagctatcaactc

SEQ ID NO: 30583 - DNA, 280 bp, Sorghum bicolor
  Clone ID: 17886570
caatgtcagggttttgaaggaacatgttttgaactgggaatgggtttggggggaaccaacatttcctgcaaccgcaggatgcatgccctgaaatgaaactgaaaggcagatgtttggatgggcatgttccccggttgatgtgttgggggtttcatggggaaagggtaccccccccatgaataaatggatgaaaggggggaaaacgtcagaaaatcaaaattttttgtccagcttgtgagctgtttgtaaaagaactttagttaataaatatataataggg

SEQ ID NO: 30584 - DNA, 639 bp, Sorghum bicolor
  Clone ID: 17886572
aagaaagtccagcagtctcatcttgaatctattcaagctgatggaacgatcaggcattccagatatctctgctgatgaaagcggaggtctcaagcttcaggagaaattccggttggatctggacgatgaggaggctatacatttcttccaggatcttatcaatgaaagtgtcagtgctctgttccctcaaatggttgagaccatccatagatgggctcagtattggcggtaggctgacgttgcggaagcaagtgtaaatttgtacatgctgactgtaacgacactaatgggagtctggcattgggggttgaagctgcggcacacgctgctatctacggatgctactagtactaggggctattttttttccttcttttttttccctcaaagtacaaggtgtggcgaattgggcagaagtagggcagggacaagcctttctcgtgccggtgtctaccaggaattcagtttgtcacctgtgatgtgtagagttccgttgcgcactgctgtagtactcgtgcattcctcaaatgtatatgtcaaaattaatgatgtatatatcaacatcaatagcaaatttgtgaatgcgggatgatcttttgtactccctccattccaaattataagatgtttgcctttttt

SEQ ID NO: 30585 - DNA, 395 bp, Sorghum bicolor
  Clone ID: 17886574
gcggtagcaacaacggcaacaaccagcccgcctgttttgctcagagccagaacgtttgctgtaacggtttcggctgcctcgtccaggttttcggtgccggttgctccaccccctcttactgctgggagtttgatgctcctctggcagttggtgctttcatcaacatcaacgccctcaactgtgtcaaggttttttaagtgacacgccgcggcgacttgacctactccttggagtagcctgttggattgttggatattggggcacatatggtgtgaggaatttgatggagaaagcctatgccagctactccgcatgttaataggcagtgttgatgtttgtatttacttcgatgcccttaatatgaggttgaatatacatacaaggggttattcttt

SEQ ID NO: 30586 - DNA, 512 bp, Sorghum bicolor
  Clone ID: 17886584
cgtcctccaaggcgccgcggctggtgtacgggagcaaggccggggaggtgttcgcggccaagtacctggccgtgtcgctctgcttcatgctcgccttcgtctgcaacgtgcaggccatccggctgtacgcgcacgccagcttcctcctgggcggcctgccgccggggctcggcggcgacggcgacgaggcggaggcgcaggcgcgcggggaggagttcgcgtgctacgtggcgcggacggtgaaccgcggcagctacgcctggtcgctcggcctgcgcgccttctacgtctccctcgcgctcttcctctggacgttcggacccataccgatgctggcctgcagcgtcctcatgtgcggcctgctctacttcctcgacaccaccagcagcggcgaccacggccacgtgcacggccagcaagggactgccggcgccggcgcccgaaaggatagcacagtctgatctcagtcttctactaaatgtcatcagtaattaaaatgagttttttatggt

SEQ ID NO: 30587 - DNA, 462 bp, Sorghum bicolor
  Clone ID: 17886591
tcgtcttcctactcctcgttcggacgcgtctccccgacggcggcgggcgcccgcgctctgtcgtcgtcgccgacgatggtcgtcgcgacgaacgccgggccgggccgccggccgccggccgagtatgccgtggcgatggccgaggcgccgccgccgttccagggcatgtatgatcagactgccgggagcttgctttacggccaggactactggtaggaacgtatcgtatgctgtgtacgggattaatttgtagtcacctagctacgatattatttccgatttgattatttcacatgccatgcctatgaaaacacatgtcaagcacgccgtgtatatttgtagcgtgtatttacataaggtttctgtgcgtgcatacacatgcatggttcttgttctttataggctgcaccgatccatcatcttgtacttgatctgaacagtatgttaatattggctagatgt

SEQ ID NO: 30588 - DNA, 634 bp, Sorghum bicolor
  Clone ID: 17886610
tggataatcatgatggcagtattgatgttccagttgaagatggtgatactttgctccacctggcatgcttatatggtcatcttccttgtgttcagctattgttggaacgtggagctagcttggaatgcaaagatgaagaaggtgctattcctcttcacgatgcttgtgctggaggcttcactgagatggtccaatatattctcaactttgctgccaacaaggatggttgcgtagcgagaatgctcgacactgttgattctgaaggcgatacaccgctccatcatgctgctagaggagaacatttggatgttgtcaagcttcttatcgaggctggggcatcccccaagaaggagaacacttatgggcagacacctgctgatatggctgaccaagacaccgaagttcgaaccctgttgactgccaagcaaattgaggcaagcacacacatgagtggtaattaagcggcagtggaatccttggtaatgtgagagaagtagccgtaatatcttatctgccatccaaaattcatttgaactaaagtaatattgtaatcagaatagtatggaggggttagctcagctacatgatcgatgctccttttccttatcgctgcattatataaaagataaagttg

SEQ ID NO: 30589 - DNA, 141 bp, Sorghum bicolor
  Clone ID: 17886623
ccctggggatattgtgggctattcagtccattcttctttcttttttcttggaggaattgggtgctttccttccgccagctatagagcatttcgcaatgtatttaatagaaatagagaagcttaaaagggcagtttttcact

SEQ ID NO: 30590 - DNA, 610 bp, Sorghum bicolor
  unsure (1)..(610): unsure at all n locations
  Clone ID: 17886657
cgagcggcggcgcgggcgacgcggcggcggaggcgtacctggagcgcgagatctgcgacatcgtgtgcggcgagggcgcggaccgcagggaacggcacgagccgctgtggcggtggcgggacaggctgggtcgggcggggctggccgccgtgccgctgggcgccaacgcgctgcggcaggcgcggatgctggtggggctcttctccggggaagggcactgcgtggaggaggccgaagggtgcctgacactgggctggcacgggcggccgctcttctcggcgtccgcgtggcgcgccgcggaagagaacaatcagagtgacagctgcaacgcggacggcagcaggagcagcggcagcggcagcggcagcggcagtgaggagagcaatatcagctgcagcagctagggctaggtatcccaattcccgtcgtagtttttactgtaaattcggtgagggtagcgcggttggttattactgtaaaatcgcggtgcgtgcgcgcggtccaaatggtttgcatcggtcgtaaatggtagactgaaatgacatgaaattctgttaagcgtgtcgtcatagttgaataaacgacggcactgatcgaaangcgcccctgg

SEQ ID NO: 30591 - DNA, 591 bp, Sorghum bicolor
  Clone ID: 17886662
gcgctggccgtggcggccgcgccccacggccgccgcggagtccgcgctgcggctgctggcggaggcggcgcggtgcggcgacggcaaggcggccatcgcggccgacgccgcggaggtggcggccgccgtgatggggcggatgatccgggtgggcccgacggggcgggaggccgccgtggtggcgctgtggctgtgctgctgcgcgggcggcggggaccggaggatgcgggaggccgtggcgtccgcgccggaggcggtggggaagctgctggttgtgatgcagggggactgcgccccgaccacgtcgcggatggccggcgagctgctgcgggcggtgcggatggagcaggagaagaagggcatggccgccgcctacgacagccgcaccatccatgtcatgccgtactgatggtggatggatccggcaggaacgcgccgtcgccctctgcagtcacctagctcgcagctgttgtaatactacaatctgtagcggtgtaagtataaattgtaggggatcggagtggaacgaatcatgtgttggctgcttgcaaatatgctgcttgcatcagggaattgagaaagaatcattgt

SEQ ID NO: 30592 - DNA, 499 bp, Sorghum bicolor
  Clone ID: 17886684
accagacctattttgggaataaagtttgcccctgatcaatctgtagagcagcttggattaagtggagtgcttgtcttggatgctcctccaaacggaccagctggcaaagcgggtctgcaatcaaccaaacgagatccctatggccggcttatcctgggtgatataattccctctgtgaatggtacaaaggtaacaaacggaagcgacttgtatcggatattggatcagtgtaaagttggggaaacggtgaccgtggaagtcttgcgtggcgatcataaagagaagatccctgtggtcctggaaccgaaggctgacgaatcctagtaaacccaggttcttctgtaccatagcctcagtttctcacttaggtgcagaggcgcaaatacacaaggcgtcttagcattttcgcctgccacgggattcgttcgttgtacataattcatgcctgtagatctcactctctctttgtctggtggaaaatgggtgtccaggttgccgt

SEQ ID NO: 30593 - DNA, 208 bp, Sorghum bicolor
  Clone ID: 17886701
gcagatcaaaacccctccgggagcccaaaagggggcccagaaacgatgaaaaaaataacgggatttgcatagctgtaacagttttggtcccttgaactgttaactttggcagagtttttgtgaacagagtggcatcccccatgcattaattgtccctgatccctttgtatgtcgctgtcatgtgtacaatgttcaatagtacccccgt

SEQ ID NO: 30594 - DNA, 107 bp, Sorghum bicolor
  Clone ID: 17886703
ctgaacccttccaagagcaaattttgtactgatgactgatgagcaatggggttgatgtttgatgtccccttatgcccgggtaaatttccagttcccaaattggtttc

SEQ ID NO: 30595 - DNA, 645 bp, Sorghum bicolor
  Clone ID: 17886719
atgatgggttgaagtacactcagtctcatgaatgggtcaagacagccgacggcgtggctactgttggcatcacggaccatgctcaggaccaccttggagaggtggtgttcgtggagctgccggagcccggcacgacggtctccgcgggagcatccttcggcaacgtggagagtgtgaaggccaccagcgacgtcaactccccaatctccggcgaggtcgttgaggtcaattccaaactgtcagagacgcccggcctgatcaacacgagcccttacgaggatgggtggatgatcaaggtgaagccgagcagcccgggggaggcggacgtcctgctggacgccgccaagtacaccaagcactgcgaggaggaagacgctcactagagccagcagcaaagcgtacgcgtgcatgcttatgacgcagtgtttctgagagcatgtttggatgggattctaaaatccgaattgtggataaaaataatgtctgatgtttcttggattccatgcctgtgtgtgtggtagaatcgtctagaattttagagtatttgaatgaagttttaggattttcagattttttttcttcctatccagattcttaaaatccccatgcatggatccaaatgctaccttagtttttctttgttgc

SEQ ID NO: 30596 - DNA, 500 bp, Sorghum bicolor
  Clone ID: 17886725
ggcccggggaggaggaggaggaggacgtgtgcgccatctgcctcggcgagttcgcggacggcgagaaggtgcgcgtcctgccgcggtgcgggcacgggttccacgtcccgtgcgtcgacgcctggctgctgtcccgcggctcgtgcccgacgtgccgccgccccgtgatggacggcaagcccaagcccgccaaaggcggcggcaggggcggcggccagagccggcggccgccggatagcgacaccatcgccgtggtcatcgcgtgagggacggggtggagcatgtgtggccatcgcccattgggaagcagacctagtggtaggcgcacacgcaacggagcaaggtgtatagctctgtactgttctgtcgccgtggataagctcatgtaaaaatatctccgtagcctggtagccgcatcgtcgtccgatattatccggcgacggctgtcccacttgcactagatgacgatacttggagtgaactgctagcatcttgccgtc

SEQ ID NO: 30597 - DNA, 332 bp, Sorghum bicolor
  Clone ID: 17886770
acacagttaaaggcacgcaggcccaaaccacaaccgattccctaaagctattacaggcccagggccaggtcgtgacagcggtctgagaattttctggcccaagcaactgatctcaggcattcattttgctctggatgtggccaacgttgctgcctggcatctatcagtatattcctcgtgggtttgttgtaagatatacagaggaattttaattctagtccgtttatatgtatgttcttatcaaaactcttagaccttggtagagctatatatagagagctttatgttgtaatcaccaatattcatagggataaagaataatctctgtatct

SEQ ID NO: 30598 - DNA, 547 bp, Sorghum bicolor
  Clone ID: 17886775
gctgaagaagccaagtcaagcctcgagtccgagaaagagaaagagatcccacagacagcttgatcaatgccacgcacacggcattacttacaaatttctttttaattggtgtgaggcgtatctggtccttctctaacaaaacttcccttacacattttcctacccccttctcatatagaagtttaatccttttatttttacttgatacctcgggcgcaggggaaaactggaaatctcaataagatatggtgatgaaacagacagacgtggatggaatgctatgcaatggaaagtggaggagaatctcagctcatccctttggtagtggatatgcatgggccgcgactggcgaacaagaacgaacaagaatgtcatgttacaagagacaatgatgatgaggacggcttttgttactggcatttttagaaacatgaagcctaaggatgatttgctgagctggagaaaatgagcgtccctctgaatggagtacgtactagtggcttgaaatcttgtttttctcgtggtcgtaatgtgaacgaagatcttt

SEQ ID NO: 30599 - DNA, 257 bp, Sorghum bicolor
  Clone ID: 17886778
catggtcggggtaagtatgctcctcgccggaacatgacccatgacagggttggacccttttggggggagtggatccttttttaaataagccagtagggagtcaacattttttcagactgttggaggggatgctataatatgtaaatcattattaataggttgatttattttagcattccaactgattactttcaattttccgcccaagtcaaacccaacgctcacatatttgattcattaaaatagttttgtttttt

SEQ ID NO: 30600 - DNA, 583 bp, Sorghum bicolor
  Clone ID: 18051743
cggaaccgcttattgatgctgcgttcgttgcgcatccgacctatatcaaggttccggatgacatcgaagccatcggaatcggtatttcctggtctgtcggcgaagaagatttgcaaatgaagggacctgacatcaaaagagtgaaggacattcttgagagcaagaaggatgtcaagcatgaagtccggcttattcctggtgctaagcatggctttgcaacccggacccatccagaggatgaagagcaaatggtagcggccgagcaggcggaggagcaggctgtgtcgtggttctcgatgcatttctcgtgagattctgtgcagagcccctggtgcgagcaatctcgtcttttcactcagtccaataccgttaactctcgacgcgtttatgcggtcgtttacaagacaggactgtgcgaggggcgtaataaagctctttttgtacctcgcccagagtagcatcgtgatccgagattgcggccacatcaacaaggcccaatagaccttcccgcacgatgtaggtaagtggctgtaacaagtattcaataaaacgaataaatagtgcagttccttgcacctttgcg

SEQ ID NO: 30601 - DNA, 673 bp, Sorghum bicolor
  Clone ID: 18051753
cggcactagcgcttttaagctgtggacagacaatgctcctgtgaagactatcaacaccgccacccgtgcccccgccaagggtgcctctcgagaacttcttcctttctgtggaatcaacagagttggaggtcttgacactcagcctgactttgagcgggaggatgaggtcccagacatcgatgctattcccgagcttaccatgtcgcaagagagcaacgacagtgctgagtcatatgacgggtctcgcaagcgaatcttcgacgaggaggaagacgaactggttgaaagccgtgccatggatgtccagagcacccgagtcatggctattccagtatcccgaaagggcgccggcttgaggggctttgtttcagagaaccaaaactctggtacggattttgacgaggccgatttccttgtccctgagatggacatggccaactaagccacaatctctgatgagagactctagccgagtcttttcacattatcatgtcactatgcgttatgtttgggttttgcaacattgggtcggcgttcaggtttatattaatgctccagagcggttgtaaatttatcatgtgttagaaagacacactggggcttgctgtatgttacaaggaatattacaaggtcgcaaatagacctacaattattaccgaatttcctccaattt

SEQ ID NO: 30602 - DNA, 403 bp, Sorghum bicolor
  Clone ID: 18051758
aattatctcgcgtttcgcagctcccctcttcctttatccgtggtgtttatggctcaccctctatttcctcccccgtcccgtcttcgcccaggcaaatttctcccccctctcgcgtgcgagagagtacagtccgacgacttgtatgaacccgggtttcttttgttgttgaccagtcgggtgtcattgcagctttgtagaatgagacgggggttcaggagagctctgttttcagtgtatggttctgtgatggttgttatggaaggctggcccgcttttactagtagggcccttgaaggttgcgaacgggaagcggcaagattgttctcagctgagcccgcaaggatggaagaatggcgatggatgatgagtttagcggcgagtaatgagaaacccagtccccgct

SEQ ID NO: 30603 - DNA, 569 bp, Sorghum bicolor
  Clone ID: 18051770
aaccatacaggcccagaagcaggaggaacttccagagcatgtcctttgcagtgtaaggctaaacaaagttgattttgtcgataacgggcaaataccaacactactgccatgtgacgacgactaaaagttcagccagcaccaagttaactgaaactgatgtttgcgccaaggacattagcatgtgctcggagtccattacttgaagaattgtgggttttccttggtcttggaagttgaagggtgtaggcatggcggttcccgctctgtgagatgaatagaagtggggatctgcgtgtatagtcatgttctttggcactctggtgttgcgagtcaaattctgttggaacttggaagttgatttgcgaacccggaattgagaatgccagcaagacgtcttatcaatgatctatttattcaatatatatgttctcaatctgttgaggtagagagattgctgaaatcagggttacctactttcgtcgtacttttttgtttttcgaaactcagattggctctaaggcattgtattactaccagtagactcagccaaaatggtgagtcacttggcc

SEQ ID NO: 30604 - DNA, 451 bp, Sorghum bicolor
  Clone ID: 18051780
agtattctccccaaactgctgctctgaccagaagcacagcagcgccagcggtggaggtgacagagagagcacacgctccctgtttctcactgctcctcagtcctctctctctctctctctctctctctccaagatgcaacagcagcaactggcagcggtggcaggcaccatgtctctgtaagaaaaacaggcaggcatgctttcttctcctcttctcaacagatatattagatgtttctcctgcagattcgttagtttaccttttctccatatgttggtaagcatataattctgggtaaataagccaaagacaaatggttcaaaatttctctgtgcaatatccaattagcgaatagaattgagatagtatccatgtatgtatagacttgtagagttgatgcaccaagtagtaagataaatatatgctttttactacctctgtttagggtgc

SEQ ID NO: 30605 - DNA, 583 bp, Sorghum bicolor
  Clone ID: 18051782
tggtccgctcccggaagccaccaccggcgcgcgccgcggaggggcagccggacatcgtgaccgggctcgccgccgagctcaccaacgtcaggaagacggcgaccgtcgacctggacgtgctcaccacctcggtgtcgagcctctcgcacggcctgtcccggatcaaggcgctactggggaccgaccagctggcggcaggcgacgataagggccagcgcttcgtcgccgtcatggccccgttcgtgtgccaggccgaggaggtgatccgggagctggaggacggcgagcgccgggtcctggcgcacgtcagggacatcaccgagtactaccacggcgacgtcggcaaggaggaggccagcccgctccggatcttcgtcatcgtcagggacttcttggcgatgctggagagggtgtccaaggaggtgaggggagccaggggttgccacggatcaaaccaaacgctaccctgaacagattgtgactggtcgatactgcagaaactggaagagaacgacactgtaatttcttggttttgcgttgttctcggtcttgtgaagttagaaatgcattcgttgtagttcag

SEQ ID NO: 30606 - DNA, 205 bp, Sorghum bicolor
  Clone ID: 18051785
gagggaaattggcatcctttgtttttaatggggtgctaaaagcttacggggaggaggccaaattttttccattcggtagggaagccggaccaatgcctccaaaaccagtagttttgtcaaatgtgggggtcgtggcttaaagggaaaggtcggtgttatttaaatcagtcgctcgatcaaatgaaaaacccatccatactgcccg

SEQ ID NO: 30607 - DNA, 363 bp, Sorghum bicolor
  Clone ID: 18051786
tttcgccaacatcaagaaggaggcgccccttatcgactacctcagctccactttcagcctccgcagttcggacaggccacacgcgatggttttttaggccaggggtagatgggcatttggcgtttagtgcatgggatgaggaacgactccggcacgccgcaaccgtaatagcaggcaaatctttttcatggagggtccagtttgcattttcctatacgatcttgtaacagacaaagcgaatttgaaacggtccaaaaatgaacgtggacttcgtgtgatgtcaaattcagaaacgttgtgtggaaaggcaaaatactggcccctaagagagctgatgcacccaaatagacattatcgccctgg

SEQ ID NO: 30608 - DNA, 639 bp, Sorghum bicolor
  Clone ID: 18051804
caagggtaacgaggagattggtgtggcagtcaacactgcccgcaagacacgcaagaagaagtggatctgcttgggtatctgtgttgctatcattgttgttattgtcattattgttcttatctacatcttcgtcatcaagggacagaacaacaacaataacaagaagcgaagtatcgaggcagccattggcagcttgcctgttatgcacacagctgtcctacctgctcgtttagcccgtcgtgttgctgccgacaacacagcatctctgctcaacagtgttggcggagggcgattccatctacctcagctaccgcggaactaggtagaagtcgaacgatgagagaatggttcggaggcgattgtcttcaaatgacgacgaggcgatacttggactcattgagggacatatacgcattctagagaggtgagctaggattatgtggaggtaaaagcagtgtcagctgtatttgtgtttttgcgtattcccattggatttggaacatcactgttgctatagcccgatagcccgtctttttttttctttatgtttgtacaaccgggtttgactctgcccccgttctggcggttgatttccttttctctttgcattagttcgaggcgtttatagtatgaactttt

SEQ ID NO: 30609 - DNA, 397 bp, Sorghum bicolor
  Clone ID: 18051808
gcacgaggctcacaccggtcgcctgtcccgtcctctcctcccctccctcctccatccctccccctccctcttcttctgccccatcctctcatctgccgtcagccagcagcccacccctctccgtcccctccccacccgcccacacagccatggcgaccggcacagcgcccgtagcgttcgaccacctcttcaagatcgtcctcgtcggcgacagcggcgtgggcaagtccaacctcctctctcgcttcactcgcgacaacttcactacggaggagaagagtaccatcggcgtcgagttcgccacgcgcatcatcaccatgcccgacggaaagaagatcaaggcgcagatatgggacacggccggacaggtcacacacacagcgggttgcacacacat

SEQ ID NO: 30610 - DNA, 566 bp, Sorghum bicolor
  Clone ID: 18051817
taacattcttgtcgagctcttccatcatttcatttacttggtcgcattatcgacccgattgtccattatgaagggcgctcttctcactgctgccgcgcttctgggctctgcccaggccggtgttcacaagatgaagctcaacaaggttcctcttgccgaccagcttgctaccaactccgtcgaggaccacctccagagcctcggccagaagtacctcggtgcctcccgccccaagaatgttgccgattacgccttcgctaccaacaccgtcaacgtcgagggtggccaccccgtccccgtctccaacttcatgaacgctcagtacttctccgagatcaccatcggtactcctccccagagcttcaaggtcgtcctcgacactggtagctccaacctctgggttccttcccagcagtgtggcagcattgcctgctacctccactccaagtacgactcgtccgcttcctcgacctacaaggaaaatggcaccgagttcgagatccactacggatccggcagcttgtctggtttcgtctccaatgatgttgtctccatcggcgacctcg

SEQ ID NO: 30611 - DNA, 510 bp, Sorghum bicolor
  Clone ID: 18051828
gcacgaggcggaggccaagtctcccgggtcaccaaggggatggccgtgctcgacgcgggtggtgccgggatgatcctcgccaacgacaggatggacggcgaggacatcgtcgccgacgcgcacgtgctcccggccaccatgatcacctacagcgaggccgtctccctgtacgcctacatggcgtccacggccaaccccgtcgccaacatctcgccctccaagacggaggtcggcgtcaagaactcgccgtccgtggcgggattctcctcccgcgggcccagcgggactctcccctacgtcctcaagcccgacatcgccgcgccgggggtcgacatcctggccgccttcaccgagtacgtcggccccacggagctcgcctccgacaagcgccgctccgagtacgccatcctgtccggcacctccatgtcctgccctcacgtctccggcatcatcgcgctcctcaaggcggcgcgcccggagtggagccccgccgcgatgcgctccgcgatc

SEQ ID NO: 30612 - DNA, 112 bp, Sorghum bicolor
  Clone ID: 18051841
gcacgaggatggaagacgaatttcaagcccttgttgttgataacggatcaggaatgtgcaaagccggtttcgctggagatgatgcttcacgtgctgtctttccattcatcgt

SEQ ID NO: 30613 - DNA, 559 bp, Sorghum bicolor
  Clone ID: 18051842
tttgaacgtccaagagtcgaatctcacattcattacacccaataaccgtgcaacatggcggacagctttaggaatgccatgatcaaccgatcactcggcgacatcaggaacaacctgcaattcctcgtcgaatccaacgtcattaccacggcacaacacgatgctattgccgcccaactgcccgtctcagccgagaacagcaatcgcacgcttcccgccgtgccgacccagcaactctctcagatgaacatccagagtgagcctacgccgcctccagagaagaaagcctccaatgttgggtactacgccgatgcgccggtcaacgcgcccccgccagcctatccctctgcgcccgccgcgcccgccggaccccccgtgctctgctacgcctcagccatgtaccagtacaacgcccaagacgccggcgacctcgctctgatgcccaacgacaaggtcgccgtaactgaatacatgaacaatgaatggtggaagggacgcaacgagcgcaccggcatggaaggcatcttccccgccagctacgtgcgcaaagaagaaaagt

SEQ ID NO: 30614 - DNA, 578 bp, Sorghum bicolor
  Clone ID: 18051849
gcacgaggcttatatttacaagtataatatcatatttgcctgcgtcattcgggaggacagttgcacaggcatttcaagatgggaattatgttggacttctcacaattatattgtcattctttctattagtccttgggattgtctatgtccaagaagctgagcgcaaaatacccctcaactatgcttctcgttacagcagtcgaactgggggacttcagcgatctgcatatctgccatttaaggtcaacagttctggtgtcatgcctatcatattttctacatcttcactggctttgcctggtactttggcacggttcgctggcttagactttcttaagaaggctgcgatagcccttaatccaggaggtgctctctatcttccaactaatgtattacttatagccttcttcaactattattacacgtttctccaattggatcctgatgatcttagtgagcaattgaagcggcaaggtgcttcgataccgcttgtgaggccaggaaaaagtacagctgcttatattaaaacagttcttagtcgcatatctgtcctgggatctgcatttctggctgtgcta

SEQ ID NO: 30615 - DNA, 568 bp, Sorghum bicolor
  unsure (1)..(568): unsure at all n locations
  Clone ID: 18051857
gcacgaggctcccatcacccgttcttctcgtcgctcgtttgactacttcgatacaaacaactcatccttcccctgcgcaacctgcgacgccggccgttccgccgtaccatactcatatacacccctacctgtccctttctttgaatgccgttcgttggttagtttcagggtctcgccatcttcgatgggaacgtggagatatggtgttattctggacgctgggtcctcagggacgcgggtccatatctaccgatggctgaacagtgacacggcgcgaaagtcggcaagcaaagcccagctgcaaagcctacccgagatcgaaaccgacaaacaatggaccaagaagatacatccaggcatatccacttttggcgaacatccccacgacgtcggtcccgaacacctcgagaagctcctcggccatgccctgagcgtagttccggccgccgaagttccgaacacgccgctattcctgcttgccacagctggcatgcggatactccctcctctgcagcgcanaaccattttgaaagaagtctgtgatttcgctcgcaaaacgacaaagttc

SEQ ID NO: 30616 - DNA, 600 bp, Sorghum bicolor
  Clone ID: 18051859
ttctcatctaaacccaacaactgtcaacaatggcggcccaaaagcataccatcgttgtcactggcgcaatcctccgaccgaaagacaacatagacccaacgtctccacctccccgcctcaacatcgttgacctgattaagaacgatattcaatggtctctctacctcagagcactcctacatttacagagtttgaatggccgtcagaaagatggatcagttgagcccatgtcctggtttggtctggccagtatccatggaagccctcgtgtaccctgggacaatgcggaacttcggcgacataacaacgaggaagtgaattactgcgctcacggggtggtaactttcccaacctggcatagggcctacatggctgtgtttgagcaagctatccagcaggcggccgtggaaatagcacatgacctctcatctgaatggaaagaggccgctcttgagctgcgtgcacccttctgggattgggctcttcagcccgtgccacctgaagaagtattccaagacttggagattacgattgctcgggatgggggtgatcctgaagttgtccgcaacccgttgtatctttatgaattccatgatggag

SEQ ID NO: 30617 - DNA, 315 bp, Sorghum bicolor
  Clone ID: 18051867
ctgatgctggtgttcgcatggaactgccgtaacttctctggttatacacatgcaagtttatatagaacaatcaacttcatattcttgtggcagaaggcctgttttcttggttatacatactgctacaaatatatggtgaatataacatgggccttaaagcttcattgaaagttatggcattttcctttatattctggttgagctggtcaaatttgtgaacctgctggaacaccctggatatgtatctgctgttggatgagtgctatttttggacaccagcattaactgcctttgagggttacattagtgttattg

SEQ ID NO: 30618 - DNA, 461 bp, Sorghum bicolor
  Clone ID: 18051870
gcacgaggaatcacatcattcaccatggtctcccaaggttgctatcgtctactactcgatgtacggccacatccagaagttggccgaggcggagaagaagggtattgaggccgccggtggccaggtcaagatcttccagatcgccgagacactctctgaggaggtcctggccaagatgcacgcccctcccaagtccgactaccccatcgccgagcctaccgacctattggagtacgatgccgtcctgttcggtatccccacccgttacggtaacttccctgctcagtggaagaccttctgggacaagactggctccatctgggcctccggtggttactggggcaagtatgccggtgtcttcgtctctaccggcactctcggtggtggccaggagtccaccgtcattgcctccatgagcactctcgctcaccacggcttcatctacgtgcctctcggttaca

SEQ ID NO: 30619 - DNA, 544 bp, Sorghum bicolor
  Clone ID: 18051872
gcacgaggctcgcgcgctcccgcgccagtcccgccgctctctctcgtgggtggcaagcgaccgccgcccgcgcacatgtcgcgcaatttcactcgtcccgccttctccaagcggagacggtgaaggtcccccagatggccgagtctatctcggagggcaccctcaagagctggacaaagcaggttggggacagtgtttctgccgatgaggaggttgcgacgattgagaccgacaagatcgatgtccaagttaacgcgccaatggcaggcaagatcgtcgagctcctcgccagcgaggaagacactgtgaccgttggtcaagacctgttccgaatcgagcccggtgaaggcggcgagtcttcttcttcttcttccagcgagcccaaggaagagtccacacccaaggaggaggagagcaaacctgaaaagagcgacaagaccgagcctgcagaccaacagggtgtggacaagtcggttccagaggcacctaaaccctccaaggcagacaagaaggcgccacctcccccagacgctccgtcagcgtc

SEQ ID NO: 30620 - DNA, 478 bp, Sorghum bicolor
  Clone ID: 18051876
gcacgaggcctcgtgccgcgcaagtgcggcgtgaaccgatacgagaagacgggcgtctgcttgattggcgctgaaaccgtcaaggtcaacaccatcgccccacactttggagaggagccgtgcctccaaggccattcgggctcgggcgccgtcttcttcagcggctgcaatctgcggtgtgtcttttgccagaaccacgacattgcacaccaacgcaacggcttcgacctcacgcccgaacagcttggcgaatggtatatgaagctgcaggaggttggccgctgccacaacatcaacctcgtcacgcccgagcacgtcgtcccgcaagtggttctgtcgattctgcatgcccgcgaactgggtctccggctgcccatcatatacaacacatcgtcgttcgattccctcgagagcctgcagctgctggacggactcgtcgacatctatctccccgacttcaaggtgtggggcaacgaga

SEQ ID NO: 30621 - DNA, 621 bp, Sorghum bicolor
  Clone ID: 18051880
gcacgaggcagagttcgagcacgccatgaagtacggaactggtgatcgacagctcatgtcttcgcgccatcgctatcctgtgccagcttcaggacaacttgctacgggcagctcaagttatactgctaactccagtgtccagtcataccacgccatgggctccagtcgctcgccctacgttgcacctggttctatatcttcactcaaatttcattccagcccgaatctgccttcgcaagccgccggaactcatttccacatcttttcttctgggtgtatgctggactttgtcacgcctgctgagttgagctgcgaaaccagcctttcgagcttggaactcgacacgctgaggtggcaaaagctagctgaaggaagggatctatatagccccaactaccgttggcattactgcaccatgaatccggaaggcacccacgcctggttgttaggcagcccagtcgagtcagcgaacgatggaaatcacaatggtgaatacctcagtgatgtgctggccatcgacctgcgtaaatacggcatcttgggcaatgagctagcctcggatacgcgttccaagatgatgccctcttcagacgccaatgtttcatctcatctcagcggtat

SEQ ID NO: 30622 - DNA, 609 bp, Sorghum bicolor
  Clone ID: 18051885
gcacgaggcatagatattgttactattttctataaagttagttaaacttaaaaaaatttaaccggcacgggttctaggaattgattctttcgtggacagagggagtacatactagtgacttctaaatagttaatctagcacaatctcccacgaagctgtccacaaagaattttattggttatcaaggagcgagatcaaatatatactagtgattcctaaatagttagtctaacacgatctcccataaacaactctctcacaactcacataactctctactatagtgttctttgtttattatttctgagtctcatctagctagttatttacaatttaccattaaggatacccttggatggcgaaatttatgttgagagaagaaatactactacataattgataatcaacaccggtttgtattaggaatcgttggtaaaatgattttcaccgtcagttcgtcttatgaaccgtttgcaaaaatgggagtgattattaccaccggcacaaatcagtggtgacaacataacattatcaccagtttgtgttaccaaccagcactgatggagacctatttttcaccactggtttgtgttacaaaccggcagtaaa

SEQ ID NO: 30623 - DNA, 329 bp, Sorghum bicolor
  Clone ID: 18051889
gcacgaggccggctcttcaagaccgcaagacggcgaacctcctggcctggaagagccccggcaaaagtcttccaaggaggacgcggtgccagacgatgcttctaatgcagcggattataacaacacggactatagtgccacaaattatgtggcacaaaccatgcaaaagagactcgatactgagaacgtcattgaccctctagagggtatgccagcatctgacaagtggggtctcaagggcttgacaacggtgatgaacaactatcctgactaccacgcgatggttgagggaatggatcccaactcgctgggacttgacatcaattctc

SEQ ID NO: 30624 - DNA, 418 bp, Sorghum bicolor
  Clone ID: 18051890
gcacgaggcatgcatgcactctctcgacatctggaagtagcaagctatatagctagatatatagaacgatctcacacactaacactgacagttcacgcttgtagaagtcgtagcagcagctagctaggctagcagcactcagcgacccgtgctcgacctagctagaatcaacagaacacaagctagcaaatggcttccggcgggtcgtcgtcgtcgtcgtcccgggcgtggacgcagcggcagaacaagcagttcgagtgcgcgctggcggtgtatgaccgggagacaccggaccggtggcacaacatcgcccgctacatgggcggcaccaagtccgccgacgaggtgcgccgccacttcgagcagctcgtccacgacgtcacccagatcgaggccggccgcgtccccttcccccgct

SEQ ID NO: 30625 - DNA, 546 bp, Sorghum bicolor
  Clone ID: 18051896
gcacgaggcggggcgatgcgctgctcgcctcagctatcccaccgcgacttcgtcgccgtgctctcccgctgctcaacccgcgcgcacctcgagcagctccacgcccacgccttcgtcgcggggcgcgccgccgcgcagaccaccaccttccacctcatccgcttcgcagccttccgcctttcctgcctcacctatgcccgccacctcttcgacgccacgcctcaccccagcgtcttcctctactccgctattctttctgcatatgtctccgccgcagccaccgcttcatcctacgcccacgcccacgcccacgcccgcgacgcgctcgcgctcttccttcgcatgcttcgtcacggccgcccagcgcctaaccagttcgtgtacccgctcgtgctccgcgctgcctccggcgtcggcgtcggcattgtcaagtcgatccactcccacgcctgcaagagcggcttctgtggacacgatatcataaggacctcagtcctcgatggttattcgaggcacggtatgatggccgacgcgcgcaagctgttt

SEQ ID NO: 30626 - DNA, 113 bp, Sorghum bicolor
  Clone ID: 18051897
gcacgagggtcggtcaacacgatccggttcctggccatcgacgccgtcgagaaggccaactccggtcacccgggcctccccatgggctgcgcgcccatgggccacatcctcta

SEQ ID NO: 30627 - DNA, 513 bp, Sorghum bicolor
  Clone ID: 18051898
gcacgaggttcaatttctctccacttctctctatacacattttcaattcccatcaccttagaccatggagcgcttcaggaacttgttgggcggaggtggcatgggcttgggaggagttacgcctggcacagacaacaccagcctaattgataactcggaaaccgtctacatctcatccttggccctgctgaaaatgctccggcacggccgcgccggtgtgccgatggaagtcatgggcctgatgctgggcgagttcgtcgacgatttcacagtcaaggtcatggacgtgtttgccatgccacagagcggtacaggcgttagtgtcgaggctgtcgaccctgtgttccagaccaagatgatggatatgttgagacaaactggaagaccggaatcagtcgtcggatggtaccattctcaccctggctttggctgctggctgtcatcggttgatatcaacacccagcaatcgtttgagcaactgaacccgcgtgcggtggcagtagtcgtcgaccc

SEQ ID NO: 30628 - DNA, 488 bp, Sorghum bicolor
  Clone ID: 18051901
gcacgaggcgggaacgactacaactcgccgctgttcgcgttccggcccatctccgaggcgcacgacttcgtgccccacgtggtggagtccatcggcagcggcgtcgagaagctgatcgccgagggcgccgtggagctcgtggtgcccggcgtgctccccatcggctgcttccccgtctacctctccatcttccggaagcaggccgacgggtacggcggccggagtgggtgcatcagggacctcaacacgctgtcgtgggtgcacaacgccgcgctccggcggaaggtggaggagctccggggaaggtaccccgacgtgcgcatcgtgtacgctgactactacacgccggccatccagttcgtcctccacgccgagaaatacgggatgctgaagcagacgccgcgggcctgctgcggtgcgccgggcgtgggggtgtacaacttcaacctgacgtccaagtgcggggagccgggggcgtacgcgtgccc

SEQ ID NO: 30629 - DNA, 287 bp, Sorghum bicolor
  Clone ID: 18051912
gcacgaggaaaggacatggcattgctgcacctccaaaggaaaattcgagctatctaccacctgcaaatcatagacaccagcgcctagtcaatcgctgctacctccaccgacaaattcatactgcacctgctcagatcctctgacaaatagtcctccaggaatgacatgcctctgcgtgttgccaataaaagtcgagcttcgctttggtatagcattgtacacgttctttacacttgtgcctgaacttgcacaagatattgcatgtggagtggtcatgaatcaaaggc

SEQ ID NO: 30630 - DNA, 514 bp, Sorghum bicolor
  Clone ID: 18051913
gcacgaggcaccaattgaaacgagtcaaaaattcgctcctcatcaaaaagccaaactcccagagccttacgatttcagagtccctgagaaagtagaagttgaaaaacttaacggcaaatacaaaaaagctgctgattttgctgaaaagagactccatgtcctcaataaaatcgcaagtgagcttctcgatggagaagagaagttccttgatgaagaaaataaattaatcgaaagagctatcgagtttattgttgagagtgaacacaaattcaaagagttgattgagaaagaagaagaccagaaagccaagttggaagtcgctcttaacagccgtatctatgagttccaagatgctcagggcaaggctgatgtggcacgtgaaggcatcaaaaaagttgaagatgaaattaaacaagaagcaaatgaactagttgggctgaataaagagaaagaaaatgctgctggtgagatcgaaaaaatcatgacccaattcaaaaatatcaaactcagagaa

SEQ ID NO: 30631 - DNA, 510 bp, Sorghum bicolor
  Clone ID: 18051923
gcacgaggcttggattgcacatcaccttaattttgaacactaacttatcggtttccaaagctgtcaccttcctaagaaatgagaaggcgtgccaatttcgccaatctccagcatcgggagcgcgtgcagcgactttgtcattccgccaactgatcttcatcagccgccagacttagcaagcccgagaccttgtatgctactccaccgtcatggccgcaaagaccacagttacgatcacctaccgtcgcccgggtacccagcccccaatcttcattgccggtgaattctccgatccgccatggagcccacaagagatggactataccacggatgaggatggcgagcatacattcaagaaggacatcgaagcttacgctggttccagcgtccagtacaagttccgagtcggccttggcgactggtgggttcttaatgaaaacgccccaaccgccaccgattctgccggttttctcaacaatgtcgccgaaatgcccgcagtgatcgatgcag

SEQ ID NO: 30632 - DNA, 450 bp, Sorghum bicolor
  Clone ID: 18051924
tttgtggcagagttgctgcttcacttggcatctgatgcttggaatggtcttgtgttcacctgtggagtcaggcgctcgagagagcacaaaaaccttctacatgcagactgagtacatctgtaaagtagttaagtgtcgtgcaatgcattggagccgaaaaacgcttaagacgagtgctgctatgccaagtgccttcttgttgtaggcatccgcctttctcgttaggcgtccaaggcgtcgccaaggaggctgcggtggtcgccttactcgcgaagagcctcccgcggtcacgcgaggggaaaaggaagcgcccacgcccgcacgggaagcaatcaatctggcgcaataaaatcatgccttctgccgttgcctatctgtggcaggaaggaaatcatgcgggaataaggcaatttctgcgcgggagtcagggaaagcacctttttttaagtg

SEQ ID NO: 30633 - DNA, 427 bp, Sorghum bicolor
  Clone ID: 18051933
gcacgaggacaagccgaaacccgcgccccccccgccgccgccagagcgcccgcgccgccgcgccgcggcggcgggcggcggcggcggcggcgcggacgagacgccgcaatgccgcgtggtcacgccgctcgtgtcggagcccgaggcgcccgcggagctgccccgctggcagctccgctgcatgtgggagctcggctccgtcctcaacttcctccacgtgttccggcctctgctgaacatcactgcggagttcacggcggaggagctcgaggcggcgcttatcactcccaacgaaattctagacgatgtgcatatgccgctgctaaagtcaattcctcctgtaactcgcatggctatgggacgtggaacctgggtgaccgtcctatgcagaaagctgaaggattggtggcattgggttgcagaaggt

SEQ ID NO: 30634 - DNA, 575 bp, Sorghum bicolor
  Clone ID: 18051935
gcacgagggcgtttcgtctctacgtgttcaacctatacttggcccaagtcatattacagcgatctataagagcacccaacatgagcaaaccattggccttcggcctcaactttagcaagaagccaggcgcgtcgaagccccctccaccaaaacgaagaccgatgtttggcggcgatgatgattccgacgacgaaggcacagtcagggagggcaaagctgaagaaattggagagttcgataaccttagtcgcgctcaagccgcaaaagccaacatcaccaaattaggcaaattgaagagtggtcctccgactcaacccccgaagctcaaatctaagggtcagccaaatgtaatgtttggtgatctctctagctctctggcgtcacgaagaaacgctgaggctgctacagaagtcgatgctagcgtctacgagtacgattcagtttacgattctctcaagccaaagaaactggtcacgaaggaggatcaagaaaaacagccaaaatatatgaaaaacatcctgcaggcagccgatgtacggaagcgcgacgcattgattgcagaggagaagaaaatt

SEQ ID NO: 30635 - DNA, 549 bp, Sorghum bicolor
  Clone ID: 18051942
ttttttagatgattttaaggaagactcgtactcatcatacaggaaactctaaccttgcctccagaccagaaactgctaggccgatgacccaatctggccaaaacagactggatttcttatccaccgccaaaggaaaattttttgatgcaacaacaacaaaaactcccagaaatgcccaaactccttttgaacaaacaagaactttctatgaccagcatggaaagccacaaagagtcaaaactcaagtcagcttccctcgtaatcttctgcttgaggacccagaaaaaatgaaaatgccttttactggtgaatcacatctcatccatgacaaaaacttggaaaaatacagagactatgattctcctgcttttgtcgacaaaatcaaaaaagaagttctaggtacggcataatttcaaattaaactcaaattcctcttccctagctaaagagcatcttgctaaagaaaagcatgaggcccatgcacaagctattcaagaaactcaacttgttggttatgataaatatagcgctgatactctcaagaataat

SEQ ID NO: 30636 - DNA, 527 bp, Sorghum bicolor
  Clone ID: 18051944
gcacgaggggagaatcgccccaacaaacccatctatcactgcagtgactgtggaatatgccgccggggcatgggtcttggaaaggacttcttccactgcaagacatgccgagcatgcatcactacatcgatcgagagctcacacaagtgtatcgagcgatcaactgactgtgactgcccgatttgcggcgaatacatgttcacatcaccgaaacgggtagtcttcatggtatgcggccatagtatacataaaaagtgctatgagcagcacatgaaatcctcatataaatgcccgatttgcaacaaaagtctcgtcaacatggaaacgcagtttcgcaacttggaccttgccattatgagccagcctatgccacccgactttcgtgacacaaaagccaagattctatgcaacgattgctccgccagaagcactgtggcatatcattggctgggactcaaatgttcaatttgtcggtcgtataacacggtagagctgcagataatgggccggaatattgagggactcca

SEQ ID NO: 30637 - DNA, 450 bp, Sorghum bicolor
  Clone ID: 18051945
gcacgagggtctggacaaaacttggtggaaaagctttttctagaataaatcgcagtgttgtcgcactggcttcattcaatggagaaaaaagaaattttgcatgcacgggtttttttattggatggaatggatctacaaagattttgacatcggcaagcttgattagaaattctgttgatgagaacaacattgttgaaaacttgaggattgaagtgttgcttccaagcagcaccgaaatcataaatgggacgttagagcattatgatctacattacaatgttgctctagtcagtgtcaagaatcgccataatcttcgtccagcaaatactctgccttcttggtctatgtgttctgatgtagcagctgtagggcgttgtttcaaatcacatgcattaatggctatgaatgggaagctgatttcctcaacaagcgcacttgattgttgcttac

SEQ ID NO: 30638 - DNA, 419 bp, Sorghum bicolor
  Clone ID: 18051948
gcacgaggctcatctcttccacctaaggaatatacgttaacagcgcatcttcttgcactctctacgaatctcccagcggccaaagcttaatccgccaccatgcaaatcttcgtcaagaccctcaccggcaagaccatcaccctcgaggtcgagtcttccgataccatcgacaatgtgaagtccaagatccaggacaaggagggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatcca

SEQ ID NO: 30639 - DNA, 412 bp, Sorghum bicolor
  Clone ID: 18051959
gcacgaggcgcaatctccccgcgcccgcgccagtgtcagctttattagacaccaattgcgccccatccaccttgagactttgcatctccattcctcaccgcgcctcaatcaaagctctaagctccaaccatcctcaaaatgctcagtcgtcgatttgcacgcgccgctgccgtcactcctctcgcaggcgtgcgagctctgagctcgactgctatccttaacggtcgcacaccttcactgggagatgtcaaccctacacatgcagaggtcgataagttcagtcagaagcagaaggaattccgcgatcacctggtcgaggcacagaagaagcgagaagccagacgctctgaggaggtgaaggagcctgaaccttcccgtaaggcgggtcctttgacgaacctcatttacggta

SEQ ID NO: 30640 - DNA, 549 bp, Sorghum bicolor
  Clone ID: 18051975
gcacgaggcacaacatcatcatggcggacgcccctcaagcagccgaggcaccatccaagaacgccttgaagaaggcccagaaggagaaggaaaaagccgagaaaaaggcagcagccaaagcccgcgagctcgctgaacgccagaagaaagaggcagccgacgccgaagatgtttccaaggacctctacggcgagcttcctctcaacaactccaaggactccgatgtcacgggcatcccccgcgtcgacctctcgacggccagcgagcacgaagacaaggagatcaccttccgatgctgggtggagaacgcacgcgtgcagtcagccaagctcgccttcctgaacctgcgacagaatctcgaaaccgtgcaagcagtcatcgctgccaatgacaagatcagcaagcagatggtcaagttctgcggcagcgtgagcacagagagcttgctcgtcgtgacggggctcgtcaagcgcgtcaaggagcccatcaagagcgcgaccatcaaggactttgaaatacacatccagaagctcttcgtcgaggcggtag

SEQ ID NO: 30641 - DNA, 463 bp, Sorghum bicolor
  unsure (1)..(463): unsure at all n locations
  Clone ID: 18051976
gcacgaggggcgactccacctgacctggcctcctgcgtccagcctcctcccgatttgcagccagcaagccaggccccgcccgtctccgatcgtccggtttcgggcagatccgggcggtacgggctgcgcggaggctctagatcgcgtcgcgcgcgagcgatgccgcgcgacctgtcgcggtcgcggtcgaggtcgaggtctccgcggcgccggcgccggcggtcgccgtcccccgcgcggtaccgcggccggagggggcgcagggaccgaagccgcagccccatccgtagcaggtccccctatcgcccctcgtatagaaggaggagcccttcgccttccccaagaaggcgtaagagccgttctctgtctcctaggaggcgcaaaagtccgtctccatcacaaaagcgttacagaagaaagagaagtccgagtgtcactagctctcctgtcactgcatctcana

SEQ ID NO: 30642 - DNA, 417 bp, Sorghum bicolor
  Clone ID: 18051983
gcacgaggctagatcgaactatcgaagtcgaaaccccggagagccagacaaccatggaccgcagcggcgaggcgagccaccggggccggagctcctacagcggccgtggctggcgaggacgcggacgcggcggcggccgtccctccccatcaccaccttcctccaccggctctcctgcggcgctcaaccccaccccgaccccggccgttcctgtcgacgacgcagcgccgatcgtgggcacctgccccgacatgtgcccagcgagggaacgagcgcagagagagcggctgagggacctggccgtgcttgagcgggtgggtggcgaccccacgcgcacgtctccttccctcgccgtcaagaagttttgcagaactatatcttccactaatatactgccatcagatatacgtccactgc

SEQ ID NO: 30643 - DNA, 371 bp, Sorghum bicolor
  Clone ID: 18051989
gcacgaggctaagcggggtaacgacagtttatggccctctgatccgagccctgccgagattgagcaagcaaaaattgtgctacataagtgcggtggactccccaaagtgatagttgctgtagctgactttttcgccgctggatggagattcaacccaattcatctaatgaaggtgttggagaccaacccagcgtttacttgtttaagggatatgtttgcctgggtgaattcctacttcgtatcctgcccagattcgctcaagccatgcatcttctatctatcaatattccccgtgaaccataagattcgtcggaggcgtctggtgcgtcggtggatcgccgagggctactctacggacaccaaggaaagca

SEQ ID NO: 30644 - DNA, 395 bp, Sorghum bicolor
  Clone ID: 18051990
gcacgagggtccgtcgtcgcagttgagttgacgattccacaccgcttctacatttcttccccaccccacgcacgcacaccggtgcgtcgccgtcgcaatcatactcgggacctcttcggttcccctcccccctccaccttccctccccggctattccaccccccgcaccatacgtcttccgacgcccgacgcggacggcgagccgctgctgctgcttccgctgccggaggaggaggagcaggggcaccggggccagcgggaggacgagcaacagcgggaagccggtcgcttggggctgtgccacatgccgctctgggggtccgccgcgtccgcgccgccggcagccgagggcgacgccgcccgcgcaccatccgggtccgccggcggcagcggcg

SEQ ID NO: 30645 - DNA, 319 bp, Sorghum bicolor
  Clone ID: 18051993
tgctgactgagccgcccatgaacccgctcgccaaccgcgagaagatggttcaggtcatgttcgagaagtatggcttcaaggccgcttacattgccattcaggccgtccttacgctctacgcccagggtctgttgactggtgtggtcgtcgattctggtgacggtgtgacccacatggtgcctgtctacgagggtttctcgctcccccacttgacccgccgtctcaacgttgctggccgcgacgtcacccgctacctcatcaagctccttctcctccgcggctatgtcttcaacaggactgccgatttcgagactgtccg

SEQ ID NO: 30646 - DNA, 479 bp, Sorghum bicolor
  Clone ID: 18051994
gcacgaggcaaacatcgccatattcagctatcataacagaatgactgaatcttcatcggctaatggccatgatgcccttgaggagaagctcggccgattgtcaaagaaacctggtgttaaagccagcatcattcttgaccgaaccaccggcgctatcctgaaaaccagcgggcaaatcgacgctctccagacctctaagacgcgaaccacatctactgcaacatcgttttccaatgaaggtcctgcactagaggagagcgaaacgaaaggagtcgagcaattcgccgcgaacgtctggaactatgtgaatagctccggaagcttggttcaggagctggatggcgaagatgagctgaagcttctccgcttacggacaaggaagcaagaattggtcgttgtacccgatcccaagtatttactcgtggttgtgcatgacacgcctccagcttgaactacgaaacacgctcatctatgtctta

SEQ ID NO: 30647 - DNA, 474 bp, Sorghum bicolor
  Clone ID: 18052040
actattttcatgccaccactaatggtttgcccctgttagtataagatacctatttcgcaggtttgttcatacacttcacatgttagtcttttggttcctgtagttactttgctttaagacttcatcagataagaaatatacttgcatagctatctttcatattcttcaactaatggttgccgtattatacaagtggttgaattgtgggtacactcaatggaaaatagtgcctctcatacaccattgggtgacaagactaacactactaatagaggaagcgatgttgcccaacgcaggaaagaaagagataaggcctgatggcacacaatgtcgcaagagaaaagggacgaaaaaaataaaaaacatcgagaagcatataaaagaagaaaggagcaacaactatgtatcaaaactaccgatggttgtatattataaatgttggtgaataataatatagatactattgtttttctc

SEQ ID NO: 30648 - DNA, 614 bp, Sorghum bicolor
  Clone ID: 18052043
gcattcggtctcctcatccgataccgcggcaaccccagctccgacaacaaatccggcgtcatcggcgcgcagatcctcctcggtatcgcgggcggtatgtttccctaccccgcgcaggcctcgctccaggcctacgttacccacgagcgactcgccgtcatgacgggtctgtacctcgcgctgtaccaggtcggctcggcctttggaaatgccgtctccggcgccatctggacccaggttctccccgtgcgacttgcacagagcttctccagcttcggaaacgagaccctcgctgtgtacgcctactctcagcctctgtctgccattatcgacttccctgttggttcgcccgagcgcgatgccatgattgatgcgtacaagcacgttcagcgcctgcttaccatcactggtatctgtctttgtgttcctcttatcgcgttctcgctgtgcttgcgtaaccccaagctcaccgatcagcagaacttggttgaggatgagaagcctggtgctgctactgagcgctcctccgcgtctgcttagaaaagtcaaaggtattcaaaagttgtatgtaatgtcgtaatatggtaattgatctagcctagggctatttgttt

SEQ ID NO: 30649 - DNA, 573 bp, Sorghum bicolor
  Clone ID: 18052045
gctgcctacctggcccgctggatcgccaagtcgctcgtcaacgccaagttggcccgccgtgcgctcgtccagctgtcttacgccattggtgttgccgagcccctctccctcttcgtcgagacctacggaacctcggagaagtcttctgacgagctggtcgagattatccacaagaacttcgacctccgtcccggtgtcattgtcaaggagctgaacctcattgaccccatctacttccaaaccgctaagaacggtcacttcaccaaccagagcttcacttgggagaagcccaaggagctcaagttttaatttttttatcacttttcttcttgataatgcttagacgcatagaagtgggattgaatcaacttcatcccacaaaagaacctttgagatttatgatgacgaacgacatcgcatgagagaaagagaaaaagatttgcatatcttttcttttttgggaggcgggttaacagagccttttcaacaagtgtttcacggcgtccagggggcaagtgtttttttccaaaacccatgataccaacccgtttttccaagttttctttccaaaag

SEQ ID NO: 30650 - DNA, 557 bp, Sorghum bicolor
  Clone ID: 18052046
cctgctgcgacgcttccggtgccatcattgagacctgcaagactgcctacaccacctgcttcggcttcaacccttgggacgtcactccctatgttgagcccaccgtttgcaagaagggtggcaagccttctggtgatgatgttgtcatcgtctctgtcggtgagcgtgtccgccccgtcctggctctccttgccatgggtgctattgctctcctctaaacgattagcgaccaccagtatgtagacgcataatctttgcttcgttcttctatttccactccgttgttgctctggggcacccgcaccttgccttcttactttctcagtgggatgtctgtttctgtgcagtggatgcttaacattcttatcttttgatgatcttatggttttatgggtgttgccgcatactcggcctaaaatagtgcacgatagacacgtatgtaatattaacgactggatggagattctccggatgacggccctgggctgttggggcgattacatgtatccatagtctacattagactctgtgtccagagatcaattgacttctctgtc

SEQ ID NO: 30651 - DNA, 506 bp, Sorghum bicolor
  Clone ID: 18052047
ccacgtcacctggtcaacaacgccaacttgggccgtctgattaactcggatgagatccagtcggttgtgcgcgccggcaagtacgtgagctaccgtcgccaccacaagaagaacccgctcaagaaccttggtgccatggtcaagctcaacccgtacacgctcgtggcgcgtcgtgccgagctccgcgccgaggctctccgcaaggagaagaaggcgtcggtcgtctccaagaagcgcaacacggtcaagtcggacccaaagcgcaaggagcagagccgcgctctcttcgccaagaacgcctcggactaagtctgcggtgcattggcatctccagcgcggacggacttctctggtggacgcgtcgtgtagtagaaactagtagcagaggcctttggtcgctggtagtaggtagtcgctggacgacgtagacacaaacacacagataaggacaacgtgaatcaaacatgagcgagatggatcacaacaccatcgagctctatgaggct

SEQ ID NO: 30652 - DNA, 635 bp, Sorghum bicolor
  Clone ID: 18052050
agaggagagtttgaaagttccatagaagctggccttgatggcattacttttaatgcgaaatctaattcaagagaaacgttaaaaagttccatggaagctcgcctcgctcgcatggaagctcgccttgccgacacagaaactagcctcgccgacacgaaagctcgccttgtcaatacggaagctcgcctcgaaaaggtgataaactgggttgaaacaatggaaacaaaattcatgagcgatttacaggctgttcgcgaacaattcagagaaagaacaaaaaagagatttaactattttttggaacaatttttaaactcgactaggttggatgatgcgattgatgggcgcttggaggatagaatcgatgatctccgtactgaaattctcgaactttttcatgacaaagaacgtgatttcgaaaagggtttggaagagcttttcgaaaataaatttagtgaagttcgagagttctttgaagataaattgagtggagttgaagagacgtttggcatgaaactggaggaatgtgtggcagatacaacatgggaagttaggtttaataagaagaaataattatatgtattaatatacctataagaaaaaattatagaaaaattaatgcaggtcctttatgg

SEQ ID NO: 30653 - DNA, 561 bp, Sorghum bicolor
  unsure (1)..(561): unsure at all n locations
  Clone ID: 18052052
tcgccgaaggtgattatgtgggcgagtacgcgggcgagtgcatagcggcgaaagaggtcagcgcacgagagagggtggttgtggccgccgggacgtcgtcctatctcttcaacctgaatgccgggaccgatggcctggacgccgaccggctgggcaacaagctcaggttcgtcaaccacggcggcgacaggtccaacctgcatgtcacgacgcgcatcgtgaacggggtgcaacgcatcgccttcttcgccctgtgcgacattcctctcggcacggagctgctgttcgattacggcaagcattacccgaagttgacacccctgtcgccacaagtgatccgcggcatgaagacgaaggaggaggtctagctcatgaagcgtttggcgccttttctccgtatctgcaactgtcgcacatctgccccaatagggttgcgccacatcaccggttaaccgctctccaatgggagaagcaatcacgtaatatgcgcatgtcgccttattggcatctgaggtgctttttcggggtatgctgcgacaacgaagatgttcccngagcttg

SEQ ID NO: 30654 - DNA, 165 bp, Sorghum bicolor
  Clone ID: 18052053
tggaccaggagtgggggggcgcccccccctccccccggaagtttgtgttcaaggggttcatgctccccgggaggcccaagtgctgaagcgatcatcccggggttgttaatccctgcttttcgtttccagtttgttcggggttaggaaaaagtgttgcttgtcagt

SEQ ID NO: 30655 - DNA, 160 bp, Sorghum bicolor
  Clone ID: 18052054
tctgctaaaaagtgaccctgttcagaattcagagtacattgagtcctgtaataataataaactgaagcagaaatctcaagaggatcattttgtacctgtaatgaagattatacctttgtaaatctgtcatttaccagctatcggtaacaggatttcatca

SEQ ID NO: 30656 - DNA, 530 bp, Sorghum bicolor
  Clone ID: 18052060
ccttcctgcgaatggttacctggtccttgctttcgaatctgacaatcctggtgcatggctcatgcactgccacattcccttccatgttgctgctggtctcggcgtgcagttcctcgaacgcgagtccgaaatcaaggccagggacggcttcgcagagatgaagagaacctgtgacaactggagctcttggcgctaccagttccaccccaacggcattctattccccggtgactccggccttcgtcgtcgccactaaaatcggaagggaaaaggaaaagaaaagaaagcgttttgccgttgttgttttgggtgggtccatgtcgttgaaatttgagagtcccagcaatattattcccccattctttgtcattgatcaggatctctcattatactcctggtcttgcatcatgttctgttcagcgaggcgtgtttttttgtttctcgctcagtgtagatagtggtaatgattggaatgaagagagagactgtgtctcttccacactatagaatctagttcaatcactctctcc

SEQ ID NO: 30657 - DNA, 507 bp, Sorghum bicolor
  Clone ID: 18052061
cacctggacaaccatctgtgccaacccttctgtcgccgccttgtgcaacagaacaactcaacaaccttcttcctttctttcctgtgcatattatgataacgactctctcatttctttctctcatcttgttcatcaatccacgcgcgcacgcacgcacgcacctcatactcgaggtcgtcttccgctcactttctcaatggatccttcttttaacgattgatggttattgctgctggttaatggggctgcccccatgggtttcacgacatatgtacgcttgggaggattataacgagcctttgtttttttgtttcttttaccaactctctcgcgcgtcttatgcggacgacaactacgaacacctcttccacgcataagatgctgcgttcaagcggacatcacttaacgatttttagccccagatgttcaaacaatgtgccaatgcacgctcatgtagatttatatagtctaacgtcaatctattgattcgcatgggctcgtgcgcgg

SEQ ID NO: 30658 - DNA, 568 bp, Sorghum bicolor
  Clone ID: 18052063
cgccgcgctgacgagccagggccaaggaaccatgcccttccatgcctccgaaacgcagcttgctatctgcttgagcgtctatgcggcgttggtcagcctcgtcgtggttcttctgagcgacgatcaagtggttccgctggtgcccatgtttggtgcgctcaccatcgcagggctcgggctgcagtgcgcgaggctttacagcgagcaccgacatgcgctggacgaagctggagtggctccgctggggcaggcttcgctgggcattttcttgctcgcccttgtgtgctggctggtggagagtcactattgcacgagcatcggagtgtggaacttccacgcgctgtggcacgtgctggaaggcgtggcgggctacctcttgtgcctgctcctctccgcgtgtcgcgccctcagtgtcgggtgggacgttagcatccactactggcactctctggtgccggtcatcaccatcgaccaaaaccccgtggccttctcctgcgagttctgagagtgttcattctctctttgtagctctccctttctttgtacatacatgacacagtctactttc

SEQ ID NO: 30659 - DNA, 405 bp, Sorghum bicolor
  Clone ID: 18052107
cagccccgtcccggccgtccaacacctctcccatctgctctccctccctctccatggccaccacgctgacggcgctgctcaaggaggcggcggccgccttcccggcccgccgcgccgtcgccgtcccgggtaagctggagctcacgcacgccgccctcgacgcgctcgtcgacgcggcggccgcgcgactcgccgtcgacgccggagtcctcccgggccacgtcgtcgcgctcgctttccccaacaccgtcgagctggtgatcatgttcctggcggtcatccgcgcgcgcgccgtggcggcaccgctcaacccggcctacacgcaggaggagttcgagttctacctctccgactcggaggcgcgcctcctgatcaccaacgccgagggcaacgcggcggcgcagg

SEQ ID NO: 30660 - DNA, 505 bp, Sorghum bicolor
  Clone ID: 18052159
gcacgagggccgtatcatctgtggagcaaacaaagcgcacggaggcgcgttcttgtggcgtagtacagcttctcctcctcccacactatacctgtacctttaactcttgtttgttagcggctaatttcagagcttctgttgggaactggggggaccatttagatttagtgcgggggtttcctcggccccctctttccatgggagcttggaagctgctggatctctgcaagtgaccatgagccagagtgagtgctttttcttgcgatttctcatcgtttagttggtgattcttgattgccgcggagaaggcatcatctttattacttcctgggagttgacctgggttgggcgaatgggtgatcagagcagcggttcttgtttcttggccatgggtctcttgattccttctgaatttctgatgatgttaggcggatgcttttttatcgagagaatcgagaaaataaaacatcggattacaattgttaaaaaaaaaaaaaaaaaaaaa

SEQ ID NO: 30661 - DNA, 534 bp, Sorghum bicolor
  Clone ID: 18052165
gcacgagggatgatgtagcgataaagatcctgttctgtgggatgtgccactctgacctgcacagcatcaagaacgagtggggcaacgccatgtaccccatggtccctggccacgagatcgccggagtggtgacggaggtgggcaagaacgtgacgaggttcaaccccggcgaccgcgtcggcgtgggctgcatggtgaactcgtgccagtcgtgcgacggctgcgccgagggcttcgagaacacctgcggcggcggcatcatcttcacctacaactccgtcgaccgcgacggcaccgtgacctacggcggctactcgagcagcgtcacggtgcacgagcggttcgtggtgcggttccccgacgggatgccgctggaccgcggcgcgccgctgctgtgcgccggcatcaccgtgtacagccccatgaagtaccacggcctgaacaagcccgggaagcacgtcggcgtgctggggctgggcggccttggccacgtcgccgtcaagctcgccaaggcggcgttcgggatgaaagtca

SEQ ID NO: 30662 - DNA, 163 bp, Sorghum bicolor
  Clone ID: 18052171
gacgacaccatgagggagtgcatctcgatccacatcggccaggccggtatccaggttggaaacgcgtgctgggagctctactgactcgagcatggcattcaggctgatggccacatgcctggagacaagaccgttgggggaggtgatgatgctttcaagacct

SEQ ID NO: 30663 - DNA, 478 bp, Sorghum bicolor
  Clone ID: 18052222
gcacgaggcatgtgcagggtctggattgagtgatgcaatttccttgttggagcctcttacatcagatgttgttgactttgtgcgtcagggagctctcattgccatggcaatggtaatgatccaaacaaatgaatcctttgattctcgtgttggggcatttaggcgtcagttggagaagatcattcttgacaaacatgaggacaccatgagcaagatgggtgccatactagcttctggtatcctcgatgctggtggtaggaatgttacaatcaagctcctctcaagaaacaagcatgacaaactcactgctgtggttggtcttgctgttttcagtcagttctggtactggtatcccctcttgtatttcatcagcctggccttctcgccaacagccttcattgggctcaactctgatttgaaagtgccaaagtttgagttcctatcacatgctaaaccgtctctctttgagtatcccaaa

SEQ ID NO: 30664 - DNA, 637 bp, Sorghum bicolor
  Clone ID: 18052255
ctgttacaaaaagaaacagagcgtcatcaaggaggaggaaatcagctaatttgccaacagagggtgtgccgaatgcggccactgatttgaaccttccttgtgcaatttctgaagcaagagttgttgatgctggaagtatggataaagggagaagaaaatcaaccccgagacccaagcagctaatcatgtctgaaggggatgctgataaaaactccacattcacacgacttgccaattgcctgtcgtttgcccgtatgaaaggaatcaacaggaacaaaagataattgaagttgagaaaccaatgcttgaaaagggtttagtttcacctgtgaagatgattttgcctgtggagattacagtcagtacgtggaatgcccaaaggatggtgctcaataagctggagtgttatcaggcacagtgccttgtatgtgagcagctccacagcagattcccttacacaaggaatcttttttaaacagaaccaaggtcatctcgatgccatctgttgatgccaaaactggcacaccatatacaggtagtagtaacttgtaagtgcatgcaaagagtatcatataagctttgaattggacccaattgatataagttctccctaaatatcgctgtcctttttttggtg

SEQ ID NO: 30665 - DNA, 234 bp, Sorghum bicolor
  Clone ID: 18052257
tggtggattgggatcattaacagttgggttggtatccagggctatccattgggggattgtaaaggcggggtttagggttttttatttgtttattaagttgccgggaattttgtatttgggggggttcaaggagccccggctcccgggtaaaccgttgggttttgtagcaaagttacttgaaaaactgtcatgatttgtttagtcccgaaaggaatgagaacgctaatcccctcg

SEQ ID NO: 30666 - DNA, 384 bp, Sorghum bicolor
  Clone ID: 18052284
acaagacagaaagcccggccgctaagagtccaagtcaacaacagataggtagctgcagcggtgagacatcaaatcaacagattgcccaggtagagggctccccctccactggtgagatatcagataaaccccctgcggaggaggaaagttagttcgtttttgaccatgagtatggtgagcatttgttgagaagctatagatcgagaattatgcataccctgacgagatagataggcatatacttctggattctttatcctgttggcacaaactgctggtgccaataggatagtggatgatcagtagttgctcctccttttttctgtgacaaggctgaaaacttggttctgtagctcggttaaaaggtctccggcttggtccctt

SEQ ID NO: 30667 - DNA, 588 bp, Sorghum bicolor
  Clone ID: 18052302
agccatggtgatggcagtgggagagatgatactgagaagggaaaacaaatgtacccatacctgtgggaggctgttgaggagctgtcgaaggagcatccgagtgggccaatattcaggaaggcgtttggtgtacttgaaaaatcaaaggcaagagcagtggaggagaagctcaggaagttcagaatgtcagagataaggcagcagctgcagcggatggacctgatgaaggagacagtggggatggtgcttgatgctctggagggtgcatattgattaggttgaaactgatgcgctgctgggttttcgattctgtggccagtcttttggtaagatgttgctcaaaaagggtgacctaagtcttctagttgtctggaatagtcttgttctaatgctatggacatatggttggctgtgtctacttttgtggtgaaggatattgtctttgatccgaactagacctagatcaaggagttatgaccggtgcttgttatcgttcccgaaaatattatgctttatgtgcttaggtgctaacttatgcctatttgtcatgccattgctatgttcctgcttaatgttagttactttgtt

SEQ ID NO: 30668 - DNA, 534 bp, Sorghum bicolor
  unsure (1)..(534): unsure at all n locations
  Clone ID: 18052303
tccttggcggccaggttcccgaacagcgcgttcgtgaacaaatcctacgccgtgaaggtgcccggcgtgccggcgtcgtggagctacaggctgaacctgcagcgggtgtgcttccggacggcgtacgtggcgagcacaacggggctggccttgctctttccctacttcaacgaggtgctgggcgtgctgggcgccgtcgtcttctggccactcgccatctacctccccgtcgagatgtactgcgtccagcgcggggtccggccgtggacgcggacgtgggtcgcgctccaggcattcagcgccgtctgcttcgtcgtcggcaccttcgccttcgtcggctccgtcgagggcgtcatccgcaagaggctcggctagtgttgtgtgtgctagtagtgcctcaccatcgaagtgtaaagagggcaaactgtacctaagttttttttttatttccctgtgttgtgtgttcgttttagctatgatgattgatgaatatatatctaaccgtgattgtttagatccaanaagctcttgttt

SEQ ID NO: 30669 - DNA, 640 bp, Sorghum bicolor
  Clone ID: 18052333
tacagcacagtgattgatgggcttggcaaggctggcaagacagatgaagcactggagctgttaaatgtgatggtcaacaaagggatgagcccaaacacaatcatttattcgtcaatagcttctgctctctccaaagaaggtagaattaacagggtaattcagatgtttgataacatccaagatgtcacaataaggtccgatgcagtgctctacaatgcggttatttcttcgctttgcaaaagaggggggactgaccgtgctattgagtttttggcatatatggtgtccagtggatgcatgcccaatgaatcgacctacactatacttattcggggcttagcaagtgagggatttgtaaaggaggcacaagagatgttgactgagttgtgctccaaaggtgctctaagaaagcacttcatgaagcattttggtattgtatgaagtataaactgatactagttactgtttgcaagtgctggtgttatcaggattagtttctaattagcctgaaggtgtcatccacattattttgctcctccacccaacccgtggtggttaggtatgatgtatcacactgtttaaatacaggctttgatagatggacacacaaagtcaggatgaaagactgtctcatattcct

SEQ ID NO: 30670 - DNA, 233 bp, Sorghum bicolor
  Clone ID: 18052345
ttctcgtacggaaccttacttgtgatcaaacatgcttagaaacatgtaaggagcattactattttacattatacccatgtcaatacagtatattgattcttcaaaaaaatagaacttttattgtacacgctggaggtggggttacatcatgcagctaattgtactaaaatattggatcttacttttctttctcaacatatcatcatttcatactaacccatcattagaaactt

SEQ ID NO: 30671 - DNA, 520 bp, Sorghum bicolor
  Clone ID: 18052366
ggcggcggcggcggggaggcccacgctggcgagcaccgtccgcgggctgctcaaggagggcggctgggcggcgtgctaccgtgggctggggccgaggtgggggtccatgtcgctgtccgcggccaccatggtgaccacctacgagttcctcaaacggctctccgccaaggacggctccttgggctagatccatccttccttcgccgtccttgttaattaaccgtaacgatcgtcaagcgactgcgtgtccccgccgtcgtcctcgaagtcgaagaacgaagcgatcgatccatggggatgggggggttaattaggtgtcctctcttctctcttgtacatattgctcatcaggttatttgccgtccttcttgttttcttgatccggcgctatagagggtgggcaggaagaagacgaagaactagaaggggttttaggatgcaaaaattttgctgtgggctgtggccaaggcgccatgctgctgcttttgatgatgatgatgaaaacatgtgtgaaatgaag

SEQ ID NO: 30672 - DNA, 605 bp, Sorghum bicolor
  Clone ID: 18052377
atgtgatagccaaggtgttcgtgacatttatgaggcagatggagctgatacaattgctgcatcagaacctttggtggtgctggtaaacaaaggaactgcgagtgcaagtgagatccttgctggagcattgaaagacaataaaagggcagtcgtatatggggaaccaacatatggaaaagggaagattcagtcggtttttggattatctgatggatctggcttagctgtgactgtagcacgctatgaaactcctgcacataccgacattgacaaggttggtgtgattccagaccgaccattgccagcgtcattccctacagatgaagatggcttctgcagctgccttagggattcgacggctgcttgcaatctgaatgctgctcagctgtttgcaagatcatgaccaagcccttcactcagcattttgggtcttatggattgtacaaataaccatggtgtttcctaggagctgcttgtgcgtggtgtgtggatggttcagcatccacaattcatttcattagcattgatttttgttccagttttactgggtgaagtcacggtcgtgtgaacagatccttacttcaacaattttgaatggaagcact

SEQ ID NO: 30673 - DNA, 291 bp, Sorghum bicolor
  Clone ID: 18052399
cttgaaggcgaccaaggagtcgatggccggcgggtggctgcacaccggggacctcgccgtgcggcaccccgacgggtacatcgagctcaaggaccgggccaaggacatcatcatctcgggcggcgagaacatcagctccatcgaggtggagtcagtgatcttcagccaccctgccgtcctcgaggcggcggtcgtggcgcggccagacgaccactggggcgagacgccgtgcgcgttcgtcaagctcaaggacggcgccagcgccacggaagcggagatcataagcttctg

SEQ ID NO: 30674 - DNA, 627 bp, Sorghum bicolor
  Clone ID: 18052406
cgtatgcacgaagacagtcagtgttagtctgatgatccattgctgcgtgcagaaactaatcgacggcggcggcaagacggtggtggtgtcggggctgacgccgatggggtgcgccacggggaacctcgtgctcttcgcgggccagaacgccaccgccgactacgagccggccacggggtgcctcaacgacctgaaccttctctccaaggagcacaaccagcagctccgtcaggcgctggcgcggctcagggccaggcgctccggcgtgagggtcaggatcatctacgccgacttctacgcgccgatcgaggacttcgcgacgtctcccgatagctacgggttcaacggcaccgacggcgccctgaacgcttgctgcggcggcggcggcgggcggtacaacttcaacctcacagcggcgtgcggcatgcccggcgtgagcgcgtgctcggacccgtcggcgtacgtgaactgggacggcatccacctcaccgaggcggcgaaccgccgcgtcgccgatggctggctcagggggccctacgctcacccgcccatcctcgacacccactgctagcacttgtggactatgttttttttttcctactttgaaatgtaccagtgcgttatacg

SEQ ID NO: 30675 - DNA, 472 bp, Sorghum bicolor
  Clone ID: 18052408
gagccgtgggacgatcgccacggaggcggcagtggcgacggccgaggagggtgcgtgctggccgggctcgccgtcgggaacaaatggacgcgctgcccgagctgccgcgccatgatcgacaagatcgacgggtgcaggcgcatggtgtgcaggtgtggcactagcttctgctacgtctgcggctcccctgtgtcagagaaaggttcccgttgcaggtgctttttcggcaaaagagaggaccctgctcttactctgcagaaagcaggattggaatgcaagtcaggcgtgtcgatcgacaaatgttaatcggcggagttatagttatccattgcttatgatggttcttcttggtagggagagcaagagcaagactgcagatttacagccatagatgtctgaaacaggtttcagaactacagtagtattgaggacagcttgtgttgtgtgtgacatgttctgtgaattgtatttg

SEQ ID NO: 30676 - DNA, 482 bp, Sorghum bicolor
  Clone ID: 18052426
tctgatgtaaaggaattctccgaggttttggcatcaaaaagcggtggtgtatacgaagtagcgtgtgagcatgctcattcatgctgtgtcctacttgcaaaggtagataagttcaagatcaacggcaaatggcatacctggatagattatgatcgtttccatgaactggtgacatctggaaagcctttcaagagccgagattacatggccatgacgccctcatgggctgtctatggagcagaggaaggtggattcgatccggatcaatctcgtttcaagaaggaaaggcgccatggaactgctgcacacaaaagtttatcttgagaagaaaacacttacatattttactgctttctagaggctaacattttggaagcaagatttttgaaatgttagcttccaaacaataattttctgtttgtcatgtgaatcagtttttgaaaattcatttttgatagtttttattggaacatgcattttat

SEQ ID NO: 30677 - DNA, 577 bp, Sorghum bicolor
  Clone ID: 18052443
acatcccgtgttcatcaacgtctgggcgatttgcagggacgccaagtactgggaagatgcagaggaattcaggccagagcggttcgagaacaccaaccttgactacaaggggacaaactacgagtttcttccgttcggatccggccgccgtatgtgcccgggagcaaaccttggactggctaacattgaactcgctctggcgagccttctgtatcactatgattggaagttgcctgatggagtgaagccagaggatgttcaggtttgtgagggtccaggattgatagcaaagaagaaaacaggcctgattttgcacccggttacctgtatcgctccagccgatgcgtaaacaagcccgttaacatatatgcttcttgggccagtatggtactgcatgggccatgattgagcgatataaggttcgatggaaaaataagttggaggatttggatggctcttgtcgctttcaaggatactgtaaaatgtttataaatacactactattcccttcaagcagcagaaggtgacctttgggacggcgttgttgtttagtcaatgtttctagatgctaccttta

SEQ ID NO: 30678 - DNA, 640 bp, Sorghum bicolor
  Clone ID: 18052449
gtacagctcgggtgatctgccaaccagtcagagcaaccttttctctgggcaagaactgcttccccttgatcacattgtggttccaagtcaataccttgaagcaatcatcagatctgttgctcatgtcatgacgggatgaaccgctaacaacccaatggtttgtcaaagctgaagccattgacatcattgaactaaaacagaaaggaacatttaacaagtcagcaccttaatgaaaaaatgctacagaaaagggcgcatttaaaaagcacaacatgcctcaaactaactggacaggctctaacaagatctggaattgttgtgatggtgaaatgggatggcccatgctgaggtatttatagctgaagaaaattttctttcagaaggaaagtatgcctcatcatcctttcgttttaatgtttatcattctaaagagtggttcttttgcttgtcgaaatgcgcataggtacaatcagaagaagtgttgtttcttgtggtcatttttgtctttgttaggggctttgtttcttctgttacatatctccaagctttagctttggtgcttgttacaccctctgccaacttttatctgaggcggcacggcaatgctccagaatggagaagctgatgtgtatttggaata

SEQ ID NO: 30679 - DNA, 577 bp, Sorghum bicolor
  Clone ID: 18052541
ccttacccaataagtattataagattaattgtagaatatatttttataataaacttggccaaatttcatatagtttgactcatataaatatcatagatgcatggttgaaaagccgtgactgaaagtattgtttgttgatttgttataagagaacacttatttattgtcgaagaatcaattgaacacttatttatcggctgccaatttgcatttgaagcttggcaatccatcaacctatctgtcaattctgggatgcaaccaatgcaaaacctagaattcctcagagcacagatcaaccagagtttctttatggaaagcatcattcttttttgctgggcaatctggatgagcagaaacacccacatatcccaccttctgttcaagggtgtaaaacaattttcagagctgagttcctatgcagggtaaagagtaaatacttctccagaatccaagaatggatagacaatctaccttaacttggaggcctttagtttggtcatttctttttttcagttttccctttttagttccctagcctttttctttgctcactctaccaccgttttttagtatttta

SEQ ID NO: 30680 - DNA, 626 bp, Sorghum bicolor
  Clone ID: 18052560
tttctgctatattccaatgggatattctaagactcatcaatgattttgtaaagtttatgacagatccagacattctcagcccattcagcatatatttgaatttatgagattatatattcattcatgtttaaagcaataaggaataacttatggagtgattattatgacaatagtatcctcctgcttaatgaaaaacatgccacggcacgatcgctagtttttttgttgacaatagtacctttttttttttcctactatttacttgtttgcaggtggatatggctgcattgaagcaaatgggggagagtgacctcaaagacatgggggtaccaatgggcccgaggaagaagattctccttgcagttggtcctcagttgaaacaacggcataaatgagagcaacaaggtgtgggactagaaaccatttgttggcaactgaaaatattggtgtaagaacgccagatagcagatatcgtatatccaattatgcatagtggctgtcttaatccacccttttgttgctgatggccttgtttcccgtagttgacacgtgtaaagtcgattcggtcagctgttaatccaggtttaacggcctgtccgcccactgttattgtttcgaaaggatgg

SEQ ID NO: 30681 - DNA, 656 bp, Sorghum bicolor
  Clone ID: 18052570
atgtgctatttttaaatatttggtgatgatgcgtgggtaccattgcacttatcaattcatctctactaacgtcctcatttttaaagtcgaatcacttatatgatacactttgtgttgcctgagcctagaggttaagaagccaattgcagaactacagtgtagtaggcaggtacctatcgcataagccggctgtaagtgcacgcctcggtactcaagcaaggcagtttactgcccagcagaactgttgtaataccaagatatttttgtttccttccactccatgtttatttgccaacatcattggggattctagaactgtagttgcttcacttctgatattaattattttctgttttagctaacttaaacctttttctttacatatagctcagattcagtttatacttatttatttactgagattattcagaaaaattaagtacaccacacttatttgtaagtatttcccaatttaattatgcttcttttgttatcaacatccatcttcctaccatcctttcaatctctgcaactttttaatctctctgctacatggtacatatgcattctctgaacaaataaataatctacgagcataattgaatgagttggtatgtcattgtactcagtgcaggccttagacaaaaaatattggt

SEQ ID NO: 30682 - DNA, 440 bp, Sorghum bicolor
  Clone ID: 18052600
ggctataagggaatggctggacagtggccaccgtacatcacccatgacaaaccttgagctatcccaccgtgatcttttgcctagccatgctctccgctctgcaattcaagaatggctgcagacaaatggggattaatacgtctgctttcttatcagggaacacaaaagtgtttggatgagggtgattcgggaattttcaggatttagtttagattttcaggaattagttcagatctaaactacatcatgagaatttgaatttgactccctcctttccaaccatggccttaggaaggatactattgcccatgtatgttatgctgaagatgtgtttcagttttatagcatgtttataggcactagtacaagaagaaagaaaaaaaaactttcctgtgacttccagaaagacaggataccaggatagagccatatacgcaggt

SEQ ID NO: 30683 - DNA, 218 bp, Sorghum bicolor
  Clone ID: 18052611
gtggacacggcacctcctatcgctcgcttgtgcacgcgaggtggtgctattgtgctgcagttttattgatcactgtgggctgcagtgggccgttggtcagcagctccacaacgcgcacaacaggaaaaggcctatgctctgtgcgcccaggctggccatgcatgctaggaatgctagcctgtgctccataaatattgtacgtttacatattattgttg

SEQ ID NO: 30684 - DNA, 513 bp, Sorghum bicolor
  Clone ID: 18052628
ggattacctgtgcaccgaaaagagaagctcattctcactccaaggttacaatcttatgttgctcaaccacgtactggactggagggctaggtcaaccagaagaataataatgcatggtatctacatgcctcacatgcatatatatacgactacatgttgctatgtctgcctacgtacaataaagtgatggtttatgtaaaatatgcatgtgcagacatgttgttattgtttgtacttaatcccagaaggtttgttttggtccgtgttgggacagcagcagccagttgctcatcacggcatcatcaaatagtagttgtgtggtctacattgagccggcagtgatcagttggtcatgacgggttcaaacccttacgcacaccggttggctccctcctccatctctacgatgctcttgcacctctgagatcctactcgaatgggtgctagaagtatgtttgtgaggtggttttgcattgtactcaatccatcccaaattgtaagtcgtttgacttt

SEQ ID NO: 30685 - DNA, 623 bp, Sorghum bicolor
  Clone ID: 18052644
cttggcttgcaggttgtggtgacagagggtgtgaaatcactttataaagggtgagaaccgcatgtaccgcatttataagttttaaattgttatgacaatggttgtttactcatcagcttgatttgttaaccatgctatcagcaaagtaatgctccacacattatcagccacagtttgcgtcagaatattcaaagctttatatttggagttcaaaattcatgctgtcttttgttgttataaatgtctatattggaagtgctttagtgcatgattcgtcatggcacatgctatttcagctaatacaaatcttgacttactcaacttgcattaattttacatctttcccctcctaacaagcttgtatattttcagcggatttgccacatttgcgagattaggccctcagacaacgatcaccttcgtcgtgtgcgagaaactgcgtgaacttgcaggaatgactgctatctagtaccaccccaaattgcataggcatactctagccgaattttcacatcatttttcattcatcattcttgatgagaagggagaaataagcacccactgggatgtttaaggattgggaagctgaagcttctgcagatttgccgtaccacattctaaat

SEQ ID NO: 30686 - DNA, 637 bp, Sorghum bicolor
  Clone ID: 18052649
ctccatgtaccaaccatacaatgctagatatggcccatacaatggctacatgccacaacctgttcctgcccagccctactttcctgccccctattttgctgtgggggcctatccctatgggagtggatacccaagccaaggcgtcatgacaaacgttcctggcatgatgtcaaggcggattcctccggcctatggaacatatcctcaaatgtatccagggtttaaccttctatacagagctggttatggtggtgcagccacttcttttcagcatggaattaatggtggaagtgataacaaaaaggatcaaacgagtgtagatatgcagcaagttgacaacacttctagtgttgcgacaatgttggaacatatgaagctaggttcacaatgactttcaggactattacttctacaatgatgacagtggagtacaacaattgtttgggaacccgcaactgtgaagacttgagctgagattctttggttgacaagtatatcattagaattcttcaacaacttacctaccattcctcttcctcctgcctgtaaactgaaagcatgcaagttgctggctgttgacctcacccctctcctcttgtaccaatgtttaaattcttattacgtcatttaatgtaac

SEQ ID NO: 30687 - DNA, 415 bp, Sorghum bicolor
  Clone ID: 18052657
tacgtcggcggcacagtggttcgcgcgatgccccacgtctacgacgtgataaggagacagggttacgtgccgagcttgaagccgtcgaacgtgtacgcgagccctctggacgaccggtttggcgtcgcatgggacatcgttgtgccgtgcggagcagcgttgctggccgtgctgctgttccttcagcaaaggcttcgtagcagtgacaccttgttgtttcgttcgcggagaacaggtgaataccagatggtctctacctagaaaactggagcatttcggatgaaggttgggagagatcggtctcgatttgcatttaaaattatcttgtcaccgcagaaggcggcatttctttgtcgatatcggtttcattagtggtgtaggaaaattatatgataaccgataaatttgcacacgt

SEQ ID NO: 30688 - DNA, 453 bp, Sorghum bicolor
  Clone ID: 18052667
ccacgagcttgtcctgaccaccaaggagtacatgcagtgtgtcaccgcagttgatccgcagtggctagcagagatgggccccatgttcttctcagtgaaggagacagacacctctcttgtggaccacaagaagaggcagaaggaagagaagacggcgatggaggaggagatggagaagctgaggcaggagcaagcagaggccgcgcgcatggagaaggagaaggagcgggagaagagagctaagcagcagcagcaggttgctatgccaggcctgaagaagggagcgacttatctgaggcccaggaagatgggtttgtagattagtcctgataaaacttcaacagtccggtggtttttgttgctaggctgaggaatttgtaacgtagcctgcgcaagcagcatgtaaaacaacacgtgaatgtgaatgtatacagcatcgatatgtcaaaaaaa

SEQ ID NO: 30689 - DNA, 483 bp, Sorghum bicolor
  unsure (1)..(483): unsure at all n locations
  Clone ID: 18052711
gagcgggccaggtcacgcccagctattcatagtgagcaacagactccatggctctcaagcagcagcagatcaaatggaaatgcaggctattcaaatcccactaggcggcaccttccaccaccggttgacatgtcgcccaccaatgccaatcatagcaaccatggggtccctctgctgaatgcagagagggtacaagcttcgctgcgcaagtcattgtcgttcctggttcacttgactgccaagtttccccttgtgttcatcttcctcctcatagtgctctatgcgatccctgccagcgcagcagtcttgttattgtatgtccttatcactgtgttgtttgcgcttccctcgttcctaatattgtattttgcgtacccgagcctagactggctagttagggaaatctttgcctgagattatttccttgtttggggaaaattntcaagtgctgttgttgtgtctgtgtaactgaactctcctaga

SEQ ID NO: 30690 - DNA, 489 bp, Sorghum bicolor
  Clone ID: 18052733
gtggtgaggccactgtaagtggtaggtctaaaaagcaaggcgaagagaacctagctgtgtccaatattgccaacatttcagctggtcttgattgtgtttctgctaatactgatttgagcaccggctcaaggaggtcaaggagagtatcgtcgggacgtagatcaaaacagcatactgaagggaataatattgctgtgcctgatgatctcaatgcttcatccagcgcccctagcagttccagaaagaggaaatctactactggcaacagtgtagctgcaaaaaagagattgagggtatctatcagtgtcagtgctgataatgaggtagagacaaataaaataacgaactctgtggctgttggtgaagagggagtagtcaaaaagagaagaaggcgttcgaaacttgtttgcaatgagggtgctgataatgaggtaggggcaaataaaataatggactctgtggctgttggtgaagagggagcagtcaaga

SEQ ID NO: 30691 - DNA, 351 bp, Sorghum bicolor
  Clone ID: 18052738
gcacgaggagacggcagacgacgctgccgcctgcctgtcggagcgcacgcacggccatggccatggccgccccgccgccgcccacggctgtctgcgctcgccacttccggctccacctcccctgctcctcccgcctgcccatggccgccgcctctgcctcctcctcttcaccgctccggcgccgccgccggctcgccgtctccccgcgcgccgaagctggtacagggactgggacggggaccgggaccggggacgtggaggcgctcagggccggggtgtccgtgtacaagccgcgctcctacgacgtgctcgtcactgacgccgcgcgctccctcgcctgcgccatcgacg

SEQ ID NO: 30692 - DNA, 468 bp, Sorghum bicolor
  Clone ID: 18052748
gcacgagagcttgcaggtacggtaaataaaaattctaaaatcacaatgtcccaaggttctgcaccagctaatatttgtgtccgaattccgaaaccgaggaaatgctttacttattatatagggtattattcaacttgtggatcgatttgggtggacattgcatttgtgatctacaggtactacgggcagtgatggtactaatcctagccgataagaggggaaaagggcattgtcaatgcagtctctgaaccgaacctatatgaaacctaactgtatgttttagacgatggaacagatgatgatcgtgtctgttctgcactcgtgaatcgaacgtgcattcgaatgctactatagaagacaatccctcttttttttgtctgagatgtgtttggttgttttaatcctgaacttatctttactgtttctataaactgttgttttgatacaggtagtctctgtaagggatat

SEQ ID NO: 30693 - DNA, 613 bp, Sorghum bicolor
  Clone ID: 18052762
gcacgaggtaagcttgttgtttcgtcaattcaagatgtggcgcgtaaacttggtgattatgctaaaattgtatcagtgtcaacaaattatggtaccaaagacccagctaactcgacggagatgctgtcatcagatagtagaaatgatgtgtttgtgcctgaggatctcttccttcctgggactctgtattacctgcagagggatattgaggatataaacggcgttgaagatgagtcatacatgctctggaaaggtgatccaggggaaaattttcagaggatattgctgtctggtaatttgatatctgatcacagatgcgaaagcatatactacgctctgagagatgtgctcaagacactgcccccatcccaggcccaggatgaatgatcttattttctgttccctcctgagctttactctgtagcggctggatgtttggattctgtagttttctgttttctgatgtgcacacttactggcggttcctttgatctttttgtattactcaaaggactgacctgcctgtcatggcttgtgtatgttgtacagtttaagctgctgtgccaagaaagtaataataagataaaatgtctttggagttcaaaaaaaaaaa

SEQ ID NO: 30694 - DNA, 465 bp, Sorghum bicolor
  Clone ID: 18052770
gcacgaggtctaactccacttcaccttttcttgttcttgatgagtagaggctccccgtctcggccgtcctgccggttgaggccggcagagtgatgagtgaacggagtcatgcttgtgagattaggctttgtcgttgtagcctctgtcgcagctttaactcttcagagagctaacaatgggggcaggcacaacaaggacaatgaccaagcaaggaaaagggaggataaggctcgcaattctgaacatggggagagagaagaagaggatggggagaaagaagaggaggaagaggtcaaaacaatcagtggcataattaactcagcccgttcactagacgatgacgatgatgatatgctttccgagatcgagagcctcctgtcaggagacattgacatccctataccacgtgatcggtttgatgtcaatggacggccacggtacaatgcttacatggctaacgaggcc

SEQ ID NO: 30695 - DNA, 575 bp, Sorghum bicolor
  Clone ID: 18052776
gcacgaggggattcttcacctccgtgagatggaattgaaaagacaggctgtggacagttcttatggaagaaaaacatatatggcttatatcgcagaagggttaggaagcatggtggactgggatgaagttatgaagttccagaggaagaatggatcattgttcagctctccttccacaactgctgttgcattaatccacaaatacaatgatccagcccttcaatacctaaatttgcttgtcagtgaatttggcagttcagtaccggcaatgtatcctttaaaaatacattgtcagctttcaatggtagatgcacttgaaagaatgggaatttctcagcactttgtcagtgaaatagaaagcatcctggacatggcatacagcttgcagttgctggttacagaaagacgaggaaatcatgatggacaaagcaacatgtgcaatggcatttcgccttttgaggatgaatggttatgatgtttcctcagatgtgctgtctcatgttgctggaccttccactttccatgattcactacaaggatatttaaatgatacaaaatccctactggaattgtac

SEQ ID NO: 30696 - DNA, 477 bp, Sorghum bicolor
  Clone ID: 18052781
gcacgaggcgaggcggagcaatccccgcaaagggattcaaatccaaaaccctaaaccaactcctccccaccctcgccggcatggccccgaagcgcccggccgccgccgccggctcggggtcggcgtctgacgcctccgacggcgaggcgggcgcggcccccaacagccaccgccgccgagcttccccctctccctcccgctcccgatcccgatcccgctccaagtcccctcgctccaacgcccgccctagcgtcgccgcatccgactccgacgccgatgcccgcgccccgtccccgaggcgcgccaaccgcgagcgttccccccgcgaccacctcgactccgacgcggacgcggacgccggcgccggcaccggccgccgcgccccttccccgaggcgtcgcggcgaacgttccccaagcttccactccgactccgactcggacgctgacgccgctggccgctctccgtccccgaggc

SEQ ID NO: 30697 - DNA, 496 bp, Sorghum bicolor
  Clone ID: 18052782
gcacgagggttgggcggcgcgcggcaggcaacatatggacctgcttcgcgcacatcatcaccgccataatcggcgccggcgtgctggcgctctcgtggagcgtcgcgcagctcggctgggtgggcggccccatcgccatgctctgcttcgccttcgtcacctacctctccgccttcctcctctcccactgctacaggtcccctgtccactctgatgatggctcccagaaacgccagaggaactacacctacatggacgccgtcaggacgcacctgggggagaagcgcacctggctctgcggactgttgcagtacctcaacctgtacgggacggcgatcgcctacaccatcaccacggcaacatgcctcagggcgatcgtgagggccaactgctaccacagccgagggcacgacgcaccctgcggcgccggcggtgaccacctctacatgctgctgtttggggcggcccaggtggtgctgtccttcattcccaactt

SEQ ID NO: 30698 - DNA, 593 bp, Sorghum bicolor
  Clone ID: 18052787
gcacgagggaaaggtgataggaaaccagatgttagtgacttgccacattacactcttggtggcggagtctgcaccttcccagactttctaaaagctgagctaaaatcatcgcttgatcacctgaataatccttgtattgcagactccagggagggttggtatcatccaaggagtatcaaagagtattatgagttaataaattcttgtttttttagtgactcagtcaaagtggttgttgggaatactagtagtggtgtaccaggatacaaggatcaagacctctataataagtatattgacataggagggattccagaactatcaaatattgtaaggagggagtctggctttgaaattggagcagctacaccaatcgctaggaccattgagatacttgaggaagaatgtgaatctatatcctctccaaacggaagtgtggttttcagaaaacttgcgaaccacatgagcaaagttgctacaccttttgttcgtaacacagctagtattggaggaaacatagttttggcacaaaaatacccatttccatcagatattgcaaccatactccttggtgctggtgcaactgtttgtct

SEQ ID NO: 30699 - DNA, 436 bp, Sorghum bicolor
  Clone ID: 18052792
gcacgaggcatttccagagcccgtccgtgacaccagcatccagcaggcagcagcatctctctcgtctcgtgacgcccggagcagacagcagaggcatggacaccgcggtggagctggagctggagcagaagccggcggtgggttactggagcgtggtgggcgcccggccctgcgacgcgtgcgccgcggagccggcgcggctgcactgccgcgaggacggcgcgttcctgtgccccggctgcgacgcccgggcgcacggcgccgggtcccgccacgcgcgcgtctggctgtgcgaggtctgcgagcacgcccccgccgccgtcacctgccgcgccgacgccgccgcgctctgcgccgcctgcgacgccgacatccactcggccaacccgctcgcgcgccgccacgagcgcctccccgtcgcgcccttcttcggcgc

SEQ ID NO: 30700 - DNA, 562 bp, Sorghum bicolor
  Clone ID: 18052808
gcacgagggtgagcttgaggccggccgccgcgcgcccccagccacaacaactggcagctgtggcacgccgcccgctgcgactccgcccgccgcccaccgcgactccgcccgctagctgccggccgcgactccggctgcaacatggccggggcatgacgcgacgctgctgcaagacaccaccgccgcccaccgcggctcccccagccaccacctctgccaaccactagaacaccgcaggctgcgggtgcctacacgtagccaccaccaacccctcccatcgccccgaggcacgagcccaccacggtgtcgtccgaatcgacttcgatgctgccggccatccctcaacaacagccaacagcgctgccgcacaccgacctgaagggcagcagcagccccctccacatccgtaagcacctgacgagccagagcagcaatagcttctgaaccaataactctagcagaacaatttgactctcactgacggacagcaaggtttctcactgtgatctggttggctgttgctgcttcacttggttctctggtttgtgaagcgaccttgaag

SEQ ID NO: 30701 - DNA, 573 bp, Sorghum bicolor
  Clone ID: 18052812
gcacgaggccccagcccccgccgcgacgtccgacgatgcgccgcccggcggaggcggcgagggcgccggcgccggccgcctctccgcgctcatccgctcgctctgcgccgcggggcgcaccgcggaggccgcgcgggcgctgtcagccgcggccgcgcgcggcggcgcgggcgtcgtcgcctacaacgccatggtctccggctactgccgcgcggggcagctggcctccgcgcgccgcctcgccgcgtcggtgcccgtcccgcccaacgcctacacctacttccccgtcgtgcgcgcgctctgcgcgcggggccggatcgccgacgcgctgtccgtgctcgacgagatgcgccgccgcgggtgcgcgcccatcccgcccatgtaccacgtcatcctcgaggccgcctgcagcaggggcggcggcggcgggttccggagcgccgtcagggtgctccaggacctccacggccggggctgcgcgctcgacgtcggcaactgcaacctcgtcctcaacgccgtctgcgaccaaggcgggtcggtggacgaggcgctccgcctgctgcgggacctgcc

SEQ ID NO: 30702 - DNA, 491 bp, Sorghum bicolor
  unsure (1)..(491): unsure at all n locations
  Clone ID: 18052827
gcacgaggcaaagactagatcacccagctgctttatttgattccaactaacccctcagcagcttaatttgattcgatcagccatcatcagtaatttgcggacgcacgtaggtacgttcaacggatagatagcacgtacgcaagctgagaacatggacagcaagctgggcgtgcagcacgggcaccaccgccaccacagccacaacaacggcatctccaagccgccggtgcaccaccaccaccacgccggggggaggaagggcagcgccgggtccgggaggcagggcggcggcggaggcaagggtatcaaggtggtgtacatatccagccccatgaagctcaccgccagcgccgaggagttccgcgccatcgtgcaggagctcaccggccgcgactccnacgtcgccgaccacgacctcgactgtggcgcctactacgccgccgcgggcgcgccgtcgtcgtcgtcgtcctcgtcttcctactcctcgttcg

SEQ ID NO: 30703 - DNA, 528 bp, Sorghum bicolor
  Clone ID: 18052848
gcacgaggcagcgccacttgatttgccgttgccatggcattggcacatgcataccataccaggcaggcaggcaccagcagttcagaactgcccggtgcccggtgtacagtgtgctgtgtcgtgccagaacgttggcttttacatgttcggcagctactatcctggccatttaaacaactttgagatatgtgcagcaggagagagagtgcaaaacactggaaagaaaagtgctgaatatagaagagagtgtactgcagcacgaatcttaaaacacttttgaatggtaggagataaacacaactgagcagacacatgctacaatacattatcgaccatgtaactgtcgaaactcacaagccatgacatgtctgacccaacctccaacaaagccacatggatgaacgctaacaacacgcagacatatatcagtgcagcgagctagtggcattggatcagatgtcggtttcagacgaattgctaataataataataataatatataccatttgatattggctgttgttgcag

SEQ ID NO: 30704 - DNA, 426 bp, Sorghum bicolor
  Clone ID: 18052880
gcacgaggctcaacttgtcttctgcttatggtgccacaccaacgtgcctagctagtagtaccaagagaaccgagatcgagcaagatccatggagctgcttcctcttctcacgtggctcctcctcgcgcacgccatggcgtaccttgcctggacggccgcggcgcgccgccggcagtcgcggtgctacctcctggactacgtctgccacaagccccgtgacgaccgcaagctgtcgacggagacggccggcgacgtgatccagcgcaacgcgcggctcggtctgaccgactaccgcttcctcctccgcgtcgtcgtccgctccggcatcggcgaggagacctacgccccgcgcagcatcctggagggccgcgaggacaccccgaccctcaaggactcgctggaggagatggacgccttcctcgacga

SEQ ID NO: 30705 - DNA, 541 bp, Sorghum bicolor
  unsure (1)..(541): unsure at all n locations
  Clone ID: 18052892
gcacgaggcagctgcgcgtgccggccgtggccatggcgttcgccggcggcgccaccctcaagctggcgacgcagaacgttctcatagacgtggacgactccacgacgtgcctggcgtttgcgcccaccgacagcacgaccatcatcggcaacacgcagcagcagacgttcagcgtcgtgtatgacgtcgcgcaatccaggatcggttttgcggcaggcggttgcagctgattatatatagctgacacgggtgaactcacgtgacctctactatgcacggcgggcagctcaagcttggtaattgaaaatgcatacaaaatacatgtgtattcactgaagtttatgaaacgataatgctacaagctactgtattgttgattttacgcaactggcaaattgtacatccttttacaggtaaaattggagtgtgtataggtttttacaggtgtaaggtcaaaaacaaaaatgtaatgcttggatgatttggtctattatttctattcttgccctgcctntatcattgtgataatgagaataacgag

SEQ ID NO: 30706 - DNA, 518 bp, Sorghum bicolor
  Clone ID: 18052893
gcacgaggaacctaccagccctacgacgggatacttgccttgaagatggctcttgctgaattcatgcggcaaatcatgcatggatcagtatcctttgatccatctcaaatggtgattacatctggggcaactcctgcaatggaaatactgagtttctgtattgctgatccaggaaatgcatttcttgtgccatcaccttactacccgggttgggatagggacataaaatggcgaactggtgttgagttgatacctgttccttgtcgcagcactgataactttaacatcagtatcactgctcttgaaatagcttacaaacaggcaaaaaaacgaggagttagagttcgtggggttctcatatctaacccttcgaacccaacaggaggcattgtgccaagggaaacactgcatgatcttctagtgtttgctgcagacaagaacatacacttaatttctgatgagatatttgctggttcaacatatggaagtgacaagtttgtcagcgtggcagacgtggt

SEQ ID NO: 30707 - DNA, 578 bp, Sorghum bicolor
  Clone ID: 18052908
gcacgagggcgctgcggaacaagctcgaggccaggggatccatcttcaacacgtcctcggacacggaggtcatcctccacctcatcgcgacgtcgctgtcgcggcccctgctcgcccgcgtctgcgacgcctgcgagcgcctcgcgggggcctactcgctcctgttcctcacggccgacaagctcttcgccgtgcgcgacccgcacgggttccgcccgctggtgatgggccgccgccggaacggcgccgtcgtcttcgcgtcggagacctgcgcgctggacctcatcgacgccacctacgagcgcgaggtccagcccggggaggtggtcgtggtcgaccgccgcgacatgtcggtggcctcggcctgcctcgtcccgcaccgcccgcgccgctcctgcgtcttcgagcacatctacttcgcgctgcccaactcggtggtgttctcccacgccgtccacgagcgccgcaccgccttcgggcaggcgctggccgaggagtcccccgccccgggcgccgacgtcgtcatcccggtgcctgactcgggcttctacgccgcgctcgggttcgcgcgcgcgtcg

SEQ ID NO: 30708 - DNA, 608 bp, Sorghum bicolor
  Clone ID: 18052910
gcacgaggcgtgagcggcataacaaagctctcaaaacaccactcaaggagatggtggttgtgcatccagacaatgactttcttgaagacatcactggcaaactaaaagagtatgtcatggaggaaatcaatgttaagactgtcactccatgtaatgaccccttggtgtatgcttctctgcgagccgagcctaatttcagcgtgctaggaaaaagacttggaaaagacatgggcaaagtatcaaatgtggtgaagaagatgactcaggaagagatcttagcctttgaaaaaagtggagagatttcattctttggtcattgcttgaagctagatgatatcaaggtcgtccgacaattcaagcgtcctgaaaatgtgtcagagaaggagattgatgctgcaggagatggtgatgttttagtcattttagatctacgagctgaccagtcattgtttgaagctggagtggcccgagaggttgtgaacaggatccagaaattgcggaagactgctcagcttgaacctgctgatccagttgatgtgtattatgaatctgtgggtaatgacaaaaacacactgggagagattttgaagtcacaggatcagtatatc

SEQ ID NO: 30709 - DNA, 455 bp, Sorghum bicolor
  Clone ID: 18052921
gcacgaggctcaacagcagcactcatcatcatacctttgctagcctacccatggacgcggcggccatcgccgggcagcaggcgaggcgccggatccggccgccggagccactcgtgatggccgcggcgccgccgacgcccgcggcgttccggtgcccgatctcgctggaggtgatgcggtcgcccgtcagcctccccaccggcgccacgtacgaccgcgcgtccatacagcgctggctggactccggccaccgcacctgcccggccacgcggctgccgctggcgtccaccgacctggtcccgaacctgctgctgcgccgcctcatccacctgcacgccgccacgctgccgccctccccgtcgcccgaggaggtgctgtcgcagctcgctgccgcggacgcggacggggagcccgcggccgcggagaaggccgtgcgctcgctcgcggccaagatc

SEQ ID NO: 30710 - DNA, 541 bp, Sorghum bicolor
  Clone ID: 18052935
gcacgaggttctttttgaagatttttatcaacactggggtgatgctgagctacgtgtcgaacctcgccttctcggggctgccggtgcacctgtcgtggcgggtgatgttcgcggcgggcgtggtgcccaccgtgttcctggcggccggggtgctcaccatgccggagtcgccgcggtggctggccatgaagggccgcgtcgccgaggcgaaggccgtgctcgacaggacgtcggacacgcccgccgaggccgagcagcggctgctcgagatccaggacgtcgtgacgaacagcagcagcggcgtcggcggcggcggcgcgtggaaggaggtggcgacgaaggccggcgtccggcgcgtgctggccatggtgctgacgctgcagttcttccagcaggcgtcggggatcgactcggtggtgctgtacggcccgcgcgtgctggccatggccggcgtcacgtccaacaccttgctcctgagcctcaacgtcctgttcggcgtcgccaaggcaggctccatcctcgtcgccatggcgctggcgga

SEQ ID NO: 30711 - DNA, 499 bp, Sorghum bicolor
  Clone ID: 18052942
gcacgaggtggagttcagtggagctggaactggagctgtaacaattcgccacagcctcctccctccccccttctcttcttgcatgccgatcgcctccaagctcgtctacttccagcgccgcccctcgccggcgccgccggacgacccgggccccgagccgcccgacccgcgacgccgaccctgccgcgaccaccaccgccgccgccgccgcagctccctctcctcctcccaccacaagccgggccaggaccatgttcccggacaccaaagggatgctgctgccaagcctctgggatcagttggaaacatagcagagcatgcagcgggcatgtcctccagcacaaggcttcaccgcagcatatcagaccatggccggcttcctgatgccgttcatcaggccagggaaaggctccttcagaggctcaacagtgtggatctgtcaggaagaaagcaaaagacatggccctcagaatcattctgggctggactaactcgcacc

SEQ ID NO: 30712 - DNA, 411 bp, Sorghum bicolor
  unsure (1)..(411): unsure at all n locations
  Clone ID: 18052943
gcacgagggctccatgcagggtgatgagattggctggtctctccttcaacttggctgctgcactggcgttggatctgaccacgccacgatccaagtcgccccacaacgtacgccgccgtgctctctagctgggcgatagctgggataactaggctcgagaagcatccacagcgacaaagacgcgcagacggtgccggtggccgcaagatgcgcagcacgctcaatccaaagcaggctatgctaaacatgtgctgctccagtaacctctgatgatggaagcttgcaagatgcaaaggctaatttagtggcgttgtgtgttgattcacaggagtgtatccctgttttgtgaagaaaacatatgataaatgtatgtgtaactgatggatatcaatgtgaattttaatacnntnn

SEQ ID NO: 30713 - DNA, 595 bp, Sorghum bicolor
  Clone ID: 18052949
gcacgaggcacaagcaacagcagcccaatggccgccgccgccgccgccgcgtcctcctctgccgccgcctgcttcctctccccgctcccgccgccacgtcgcccgcgtcatttcctcaggcacctcgcgcgcgccgcggccaccaagccggcgcccgcgcccgcgcccgcctccgcctcctcgccgtggccgtgggcgcggcggctcggctcgctggtccccggagagaccgcgggccggctgctgtcgtcggccgcgggctccctcatcgtcgcgctcgcctccgcgtcgctcgtcctcggcgacgccggcgcggcatccgcgttcgtggtctccacgccccggaagctgcaggcggacgagctcgccaccgtgcgcctcttccaagagaacacgccctccgtcgtctacatcaccaacctcgccgtcaggcaggacgcgttcaccctcgacgtgctagaggtgccacaggggtccgggtcgggctttgtctgggataagagtggccacatcgtcaccaatttccatgtcattcgtggcgcgtcagacctcagggtcacacttgctgatcagtcagtgtatgaagcgcaagttg

SEQ ID NO: 30714 - DNA, 493 bp, Sorghum bicolor
  Clone ID: 18052964
gcacgaggaacatacagttaggaatgctattagatccaaatctggtgctattgctgcattgcgcgagctattatcacataacttgctcagatcaactcttcttctttggtttgtttactatgcatgttccttcgcttattatgggatagcattgctgtcatcacaactaagtgatgtgaatagaagctgtaaatctggtctgatctttgaagtgcaccaaaacgatggcaatctttataaagatacttttatcactagtttagcagagattccaggcttaattttgtccgctctgcttgttgatcggtttggccggaaagctactatgtggagcctgatgtttgcatgctgtgctttccttgggccactcgtacttcatcagaatgagttgttgacaactactcttctattcggagctcgtgcttgtggcaccggtaccacaacgattttatgtctatatgccccagaggtgtatccgacatctgtacgctca

SEQ ID NO: 30715 - DNA, 537 bp, Sorghum bicolor
  Clone ID: 18052968
gcacgaggagcagatgaagctaggtccatggatcttgctgatcgttatttaaacagcgagtgtgttatgcagatgcttcaggctgaccaggttggccttgctgagaagactgctgtcttgtttacaaaagatggtgatcaacacaataatctccatgacatgcagtgcatgtggtatgagcttgcttctggggagagctattaccgtcaaggtgatcttggccgggccctaaaaaatttcttggcagttgaaaagcattacgctgatatgactgaagatcaatttgacttccattcgtattgcttgcggaaaatgacacttagagcatatgtttctatgctgaagtttcaagatcgtttgcatgctcatgaatacttccacaaggctgctgctggagctatccggtgctatatgaaactacatgattctccaacaaaatcttctacggaggagaatgatgagatgtcaaaactgccacctgctcagaggaagaagttgaggcaaaagcagaagaaagcagaagcgcgtgctaaaagg

SEQ ID NO: 30716 - DNA, 519 bp, Sorghum bicolor
  Clone ID: 18052980
gcacgaggggttgaagaacgcttgttacgatgcaggtttcccaaggcctgatggttatccatgtccgacattatttgcaaattggtttccggtgtacctttcaattgtgtcagatgattcaggaacagatgagctagaggtagcattttggaggggagggcaagtcagtgaggagggactggcatggctactacaaaagggattcaaaactattgttgatctccgggaagaagatgttaaagatgatttgtacctttcagcagttcaggaagctgtctcatctgggaagatagaggtggtgaatatgccagttgagattggaactgcaccatcagctgaacaggttcagcaatttgcagctcttgtgtcagatggcgcaaggaagcccatttatctccatagcaaagaaggtgtttctaggacgtctgcaatggtctcaagatggaaacagtatgttactcgttcagagagattggctgtccaaaatcactctctaaatgggaatggtaaggtcctgac

SEQ ID NO: 30717 - DNA, 332 bp, Sorghum bicolor
  Clone ID: 18052984
gcacgaggccaccctgccggcgtcgtcgtcgctactcgcatcgagattcgcgcggccgtgtcttgctctgttctgcttggtcccccccttccctcctccctcggtcgcgtcagcgccccagatctctcgctcgccggcgcccgggctagatctgggcgggagctcggaggcggagccggagccggagccggccgggcgcaagtttggtgagacacaaggggggaggagtaggaggaggcgagggaagaccgccgcggacgttgcgccatggagctggctgtcggcggcgggatgcggcggtcggcgtcgcacacctcgctgtcggagtcgga

SEQ ID NO: 30718 - DNA, 531 bp, Sorghum bicolor
  Clone ID: 18052988
gcacgaggggtctctttgcaaaagataataagaaaaaacttgtcctatgtgatgacaagctcaagaatttgtttaggaggtcaaaagtgaggtacaacaggatatttagcttgttaggaaagcatattgctgtggatatgacatcagaggatgaaacttttgtgaactccgacaataacaatgaaacatttgtgagaaagaagactcgtattgggaactacagttccaatactccagaaataaacaagaaatgttttgctgctcttgttcgtcataacattgatttaatctacttgaagaaatctttggttgtggatctactaaaggagccagatacatttgacagcaaagttattggttgttttgtgaaagtaaagatcgatccctacgattatagtttctacatgcataaaacattgcgccagcataaaaagctgcaccagcttggactagtaacaggcacaaggaaatcctctgaagaatacaagataaacaacgtatcgacagatgttattttatgtatttccagca

SEQ ID NO: 30719 - DNA, 381 bp, Sorghum bicolor
  Clone ID: 18053005
gcacgagggtaggagctagcattcgcgcgcgagagcagctggtggcatggaccgtcgggacggatccaaggcgccagcgctggcggccgtgaacggtactggcggcggagtcgagcgcgggggggtcgacgcgacgttcgacaccaacacggtcatcctcctggcggcggggttcctagcgctgctgttcgccatcgcgctcaactcgctggccaggtgcgcgctctggtgcgggggccgggccgcggacggcggcggcggcggcggcgagggtgcgtcgtcgtcgagcgtcggcggcgcgtcgtcttgcgcgggcgtccgaggcgggatcaagaagcgcgcgctgaggagcatccccgtggaggtttacgtcggcaggga

SEQ ID NO: 30720 - DNA, 417 bp, Sorghum bicolor
  Clone ID: 18053032
gcacgaggcccaaatcacccaccaatggcgaccaacaaggacctgtgcaccgtcgagaggcgaggccgcgtgcacctcatcaccatcaccggcgccggcgagcaccgcctcaacccggacctcctcgcggccctccgctccgccgtggccgcctccgcgggcgcgggcgcgctggtgctcgccgcggaggggaagttcttctccaacgggttcgaccaggcgtgggcgcgcacggcgccgccccacctccacagcaccatggacggcgggctcctcgcgctggtggccgacctcctggcgctgcgcatgcccacggtggcggcggtgacggggcacgcggcggcggccgggtgcgcgctggctttggcgcacgacgccgtgctcatgcgccgcacccgcgggttcctgtacatgagc

SEQ ID NO: 30721 - DNA, 571 bp, Sorghum bicolor
  Clone ID: 18053084
gctacttgatgaggtcgatgctttctgcaatgacgggtggtgggttggtgtggtgtccaaggtccttggcgagaagaggtgcatggtctacttcaggccttggaaggaagagaatgaattcgagcatgcacagctgaggttgcactctgactggatgggtggaaggtggatgcgggcttccccggctctggagatgtgaaggctgaagaaccacacaatgacgttagaataggagcttgagggtaatacccgacgttgaagtgtgtcctcactaacttaccacattttgtcggcctctgcacgaagttgcccctgtgccatctgcataggaaggtcagcaagttgggtgatgatcatagtgcagttgttgcaagttgccacaccatcaggtctgattctgaatgcttgccgatggttgaccccattgtcttgtactaggaactagtaagcacattctgccagtgttaaggggtggaagaaccggaagctgggaactgcagtgctaatgtttagaggtgtcatcaagtgaaccccttcatgattgcgtggggtatcctatttctttcgcgtt

SEQ ID NO: 30722 - DNA, 540 bp, Sorghum bicolor
  Clone ID: 18058928
gcacgaggctggaatacattgtgagaagctagcaattgcttttgcagtttcaaattcccctcctttcagaaacatacggataataaagaccttaaggatgtgtagcctttgtcacgtctttgccaagctagtttcagaaaaatatgagcggcaaatactgatcaaggattcaaattgtttgcacaagtttaagaatggaaagtgctcatgtgaagattattggtgaatacaactaatattagtgtaccaatggttctgttcatgtatgcgtcatccggactggttttttcatgtatgagtgtagtgtcattcagttcatggttgtattggtacagaaaattactgtagctggttttgctcataaaaaaagcctattgttgtcttattgctactttttagctggaagtagtagatacctttatcttctttgactgggcttactatactttagttaatgtctctcaagcttgaatttattggtgttcaaatgctatctgctacggacagaggtggagctccccctatggtttctggcaactc

SEQ ID NO: 30723 - DNA, 512 bp, Sorghum bicolor
  Clone ID: 18058931
gcacgagggcttgggtcatctcgcaaggggttgcacagggcttgagaagttgagtctggtgtggtgttctgccatatcctcaacaggcttagtgaggatagctgagcattgcaagaagttgacttctttggatctccaggcctgctttattggagatccaggacttactgctatcggggtaggatgcaagctgcttaggaaattgaacttgcgatttgttgaaggcaccacagatgaaggcttgattggattagtaaagaactgtgggcaatcgctggtctcacttgctgttgcaaattgtcaatggttgactgatgcatctttatatgctgttggatcccattgccctaacctagaaattctatcggtggaatcagattgtgttcgaagtttcggaataatatctgttgctaaaggatgccgacaattaaaaactttgaagctacaatgtattggtgctggggatgacgccctagatgctgtcggttcattttgtccgcttttagaaatct

SEQ ID NO: 30724 - DNA, 490 bp, Sorghum bicolor
  Clone ID: 18058953
gcacgagggattcctggtcagcgacatatctgagtggctggacaagtacagggtgttcaaggtggaggagctggagcgtggcaccgggggattcgacgacgcgcacctcgtcaacggcagcgtgtacaaggccaacatcgacggcgtggtgttcgccgtgaagaagatgaagtgggacgcctgcgaggagctcaagatcctgcaaaaggtgaaccacagcaacctggtgaagctagaggggttctgcatcaactcggcgacgggcgactgctacctggtgtacgaatacgtggagaacgggtcgcttgacctgtggctgctggaccgcgaccgcgcgcagcgcctgaactggcgcgcgcgcctgcacatcgcgctcgacctcgcccacggcctgcagtacatccacgagcacacctggccgcgcgtggtgcacaaggacatcaagagcagcaacgtcctcctggacgcccgcatgcgcgccaagatcgcc

SEQ ID NO: 30725 - DNA, 522 bp, Sorghum bicolor
  unsure (1)..(522): unsure at all n locations
  Clone ID: 18058988
gcacgaggggagatcgaagagctggaccatcacttagcgcctttaactatgacagtaattatggaaagaaagccctgacaatgatgtacagaggaataatggaacaggttaccaggatgcctttcctgttgtgccttttggatgctctgagaatcaagctacccttgaagagttcatcactaaagcaaaagctgctttagtgtcggttggaattattagggatcctataatgtgcaatggaaaaaatggtggaaagcttactggtaggattcttgattctgatatgcatgatgttgcccgtttccttaatcgtattctgggattgtttccagacatccagaatagattatttgatcttttcacaagcatacttgatatagtgattcagaatgcacgaattgaagggcaacttgactctggtattgttgatatcaaagctaanagtgttgaaatgaaagaatcaccaaagactgttcatgttgatactgtgtctggtgctagtacagtattatatacttttac

SEQ ID NO: 30726 - DNA, 607 bp, Sorghum bicolor
  Clone ID: 18058991
gcacgaggaacctttgagcctgtgccggagtcaagtgtctccacggtggatgacagaactcctgaggacaaagaaaggtggtggaggaggggcttgagagccatttcagaggggaagttagctgttgttttgttggctggtggccaggggactaggcttggcagttctgaccctaagggatgtttcagtatcgggcttccatctaggaagtcacttttccaactacaagctgaacggattttgtgtattcagaagctggctgctcaatgcactgacgccccaggtagcacagtgccaattcactggtatataatgactagtccctttaccgatgaagcgacccgaaagttctttgaaacccacagatattttggtttagagcctaatcaagtgacatttttccagcagggtactgttccatgtgtatctcatgatggaagatttattatggagacaccatacaaggtagcaaaggctcccgatggcaatggtggagtatatgctgctctaaaatctaaaaggttgctcgatgatatggctgcaaaaggtgttaagtatgtagattgctatggagttgataatgtattggtccgtgttgcagatccaa

SEQ ID NO: 30727 - DNA, 586 bp, Sorghum bicolor
  Clone ID: 18058992
gcacgaggccgtgctcctccgactcggcccgcgacgtcgtccgccagaagatctcgccggtgtcgccctccatgtgactcggcctgcaccatcgtccaccggatctgaagaaggccgcgccgggaagaaagccgcgcccttgctcctcaccggcgccgcacttcatccctcctgtgcccctgctcctcaccggcgcatccttcctccctctgtgcccttgccctgagctccaccacctccagaccaagcacaagatggttttgtttgatgacgatgaagataacattatgaaccaattcttcgaagacgatgatgagtctgatgatgatgctcttatcttgagcttgattgcaattgatgaggaagatgagagaaggaagaagaggcgacgtggatcagtccatggacgtgaggttgtttacagagacatacatggtggcaatttgagacttgttgccgactattttgcagatgtactagtgtacaatgataaatttttcaggagaaggtttcggatgtcaagaaatctatttttgcggattgttgaaggtgtagaagctcatgatgactatttcaggcaaaggcc

SEQ ID NO: 30728 - DNA, 591 bp, Sorghum bicolor
  unsure (1)..(591): unsure at all n locations
  Clone ID: 18058994
gcacgaggtccgcatccgctagtagggggaacagccggcagcgcgaagcaaggatttggaggatgacagaagctgcagttacaaggtactggtgccatggatgtgagaaggccattgaggaggccatgggggaggagatcaagtgcccattctgtgatggtggattcattgaagagatgatcggggaggaatttgaggggttggtcagtcagcagtcagagcgggatttatcacaatggggaacgtcaaacaacccttttgagcagccaggatcggcagcagacagtgaggatgaagatgacgacgatgatgatataggccgtgaatttgagggtttcatcaggaggcatggacgagcatcagctctgcgtcgtgtgcttgacagcatccaggatgaccttagagctgacagggaaagggaccactccgttctgatcaatgccttcaaccaagccctcgctctgcaaggctcggtacttgacgctgatgaggctcgagatgaccaaggtggatctaacaatgatgatggcttgcttgaagaatatgtcctgngggctgggctgagcctgctgcttcaacatttggctgaga

SEQ ID NO: 30729 - DNA, 573 bp, Sorghum bicolor
  Clone ID: 18059020
gcacgaggtgcttatttctcatatttttatagtcaatgttgtcatatatgctgataagattcttaggtgcttatttgatagcatcatagcaactcttttggatttttgtacggtaccctataattgttgtgctgcaaactttctgtgccacactatacaaagtgatttgttttctgttttccaagtaactaaataattcaaggttaaatacgcatgcatattcagaccaggaaagaacatagcttgctgatcatttcaagtaattttgattcttaatattttctcatccaaatacctccagacctagctgatacatattgatattgttccctgagtgagttcacatgtattatatagatcaatttgcagtttagcactgtgccattgcacttgatatcagcttcaatgtgtttcatggtctacagctctactatttgtcagtatgcacgataatggttcctctcttctgtgacatcttttttaaaaaaaaagttagaacattttaatagtttcctattcttggatttgatcatggtaacttatagttgagttcctgcacctatgtgatctatc

SEQ ID NO: 30730 - DNA, 514 bp, Sorghum bicolor
  Clone ID: 18059032
gcacgagggcttctcaaggagggagtttcgggaagctctcgggcactattcgcaggcattgcgtcatgtcccgattacttcagatgacatggatgtgaagttggtatctgcaatatatgtcaatcgagcctccaccatgcataaattaggtctgttcaaagaatctctaagggattgtgacagggccatatccatttcacctaattattctaaggcatggtacaggaagggaatggtaaaaacagcgcttaagaattattcatctgcagtacatgatttagaggttgcattgagcctggaggtgacttcttcagggaagaataatatagaacaagagctaaagttaattttgcataagcatgaatgtatcaatgaagctgggacatcaaactgtgatagcaaggatgaagatttgcctcttgcaggacaacctcataaggttgttatagagagtatctcaacaccaaataaagggagaggaatggcttctacagatgatatccccccagcttcg

SEQ ID NO: 30731 - DNA, 448 bp, Sorghum bicolor
  Clone ID: 18059038
gcacgagggcaaggcgtaccgcgtagaccgcactctcccacaagcttggcagccagcggccaccgccagacgtaagatggcggcggaggccaaaccggctgcggccagcggggttgccggcgagatggaggtggaagcgtaccgccgcctattcccggtggccttcctggagcgccacctcggcgagtccgtccgcatcgatgcccgccgcctcagagaggcccgccccaccaccatcgccctcggcgccgtctcctccgcgcatggttctgctctcgtccgccttggcgacaccgccatgctcgcgtcggtcaagctcgaggtgatgtcgcccccggctgagcacccagacgaaggatccgtcgctgttgagttccacatgccacccatctgctccccgctggttaggccaggccgatccgctggggttgcaccagtcatctccaag

SEQ ID NO: 30732 - DNA, 485 bp, Sorghum bicolor
  unsure (1)..(485): unsure at all n locations
  Clone ID: 18059048
gcacgaggattttgcacttagtgggtttatgcactcttccctttatcttctgctccgtgaacttatcagttcaagtgctcagataagaactgcgtctgatgctgtcctaagagcccttgctactgctggcggttattgttcggttggccagtttgttgttgcgaatgcagactacattattgattctctttgcaggcaattgcgtcacctggacctgaacccccatgtccctgatgttcttgcttccatgctgtgttacattggtgcttctcgtgatatcttgccattcttggaagaaccgatgcaagcagtttcttctgagctagaggttcttggcaggcatgatcacccacatttaactgttccatttctgaaggcagtttctgagatttccaaggcatgtagacatgaatctacttgtttgccagatgaggctcaatcattttatgtgaaggtcagttctgagggtcaagaagtanaaaata

SEQ ID NO: 30733 - DNA, 589 bp, Sorghum bicolor
  Clone ID: 18059055
gcacgaggaaatcatctaaacgcatggttcaaaaattagcaacaagctcaaaattagattttatttttgaaactaaatataaagcattagaaacaagctcaaaatttgtaatacgtgtctagtaatttcaaagtagagcctaatttccaccatgtgttttgttaagaaaaaacaaattttactcgagcatgtatgctaaaaagttaaatggcaaaatacttcttgaaccatgaatttggatgtctttctggacttgtaagaaacattgttgaggccaaacaagttaaccataaactaaaataggtatagaatgacttataaaaagtcttattttttttttgttaagataaaattgtattacaagtgtaagtctttttccagaagaaatttttttggaagtcgttcaatcacgagaagacattgtatattttgtttatttagtgcatacaaggtatagttttgtaattactatacaaaatagagtttaaaaataaaaagtttattataatgtcacgttcagtctactaaaaattacatgttcaaacaatcaagtatggaaccttacatcaatagatctaattatgtatat

SEQ ID NO: 30734 - DNA, 304 bp, Sorghum bicolor
  Clone ID: 18059069
gcacgaggggaggtcttactccatgttgtttcaaagattggtgccacattaacggaggaaaccacaaaggctgtgatagccaagctatcagacaaagttaagaaccttaaggaattgccagagaaagttgaggaaatagggaaagaatttaaggcgatgagtattgttgtaaagcaatttattacaccaggtcatagcgatgagcttgttaaagactggattggagaggtgcgggatatggcccaccgtgttgaggatgtaatggataaatattcatatcatgctcttaaattggatgaagaaa

SEQ ID NO: 30735 - DNA, 477 bp, Sorghum bicolor
  Clone ID: 18059118
gcacgagggtcacttaaagctaaaatatcaaagctgcaaagcaacttaaggatgggccttgagattgaacagcatttgcaaagaaatgcacgcatattagagaaaagacaggcactgtatgatggatttctaagaaatggattgtcagaacttcaaaagttctacacatatcaaaaggctgaaattatgaaaatattggaagaagaatcatcgcagttgatcaaagttgttgcagggattcaggataagctaactgaaatttgcatcaacactgaagttaatgaacatcctgccaatgagattcaatgttgtgacagcagttgtaaagatgtgcatgttactacagatatcagtcctagcacatgtcctaagagtgattctcctgctgatcttaactccgtgtcgtttgatgaatctaaagcacttgcacaagccttacaggagaagatggaagcacttatgctcttctcacaggaa

SEQ ID NO: 30736 - DNA, 475 bp, Sorghum bicolor
  Clone ID: 18059136
gcacgagggacgcgcgtacaggagctggaggcagagaaccagaggctggccaggattgcttcgagctgtacatgcggattcaaggagagcaatgttggatccattactgcacagcataatgcaaaatttcgtcaaagtagcactttggagaaagacttgagctttcaatttgatcacacagtagtatccactgcaaatgaagtacagtgcaatgtaaatgcagaaggcaatggtttgccagatgattcaagcaaacgtacaaaaagaacaggtcgacatgtggggaatttaagtcactgcccaaagcgactagttgctctcaaagtcatgtacttcggacagagattctatggtttttcttcggaaggtaacactgagccaacagttgagtctgagatatttaaagcactggaaagagcaaaacttatggttggcagtaggagagaatcatgctattcgaggtgtggaagaactg

SEQ ID NO: 30737 - DNA, 533 bp, Sorghum bicolor
  Clone ID: 18059143
gcacgaggcgaatgcgcatgtggtagctgatcatacttttgttcttgtgaggaagcatggttctcctactaaatacagagcagaagtccaagctgttggtcatgaatgtgacttggctctgttgacagttgagagtgaggagttttgggatggggtgaacagtttggagcttggtgacatcccctttttgcaagaagccgtcgctgtggttggctaccctcaaggtggagataatatttctgtcaccaagggggttgtatctagagttgaaccaacacaatatgcccatggtgctacgcagcttatggctatacagatagacgcagccataaatccaggtaatagtggagggcctgccattatgggtgataaagtagccggagttgctttccagaatttgtcaggggcggaaaacattggttatatcataccggtgcccgtaattaagcgtttcatttctggagtagaagagagcggtagatattctgggttttgtactcttggagtatcttgccaggctactgaaaatattc

SEQ ID NO: 30738 - DNA, 507 bp, Sorghum bicolor
  unsure (1)..(507): unsure at all n locations
  Clone ID: 18059169
gcacgaggcccttgtgtatattctagagaaagatcttgaatcagagttatttgacttggcaacttcatgtaaagtcgtcatctgttgtcgtgttgctcctctgcaaaaggctggcattgttgatttgattaaaagcagaacgagtgacatgaccctggcaattggtgatggggcaaatgatgtttcaatgatacagatggcagacgttggtgttggcatatgcggtcaagaaggtcgtcaggcggtgatggcttcagactttgctatgggtcaattccgctttctgaagagattacttcttgtacatgggcactggaattatcagcgtatcgcatacatgatcctgtacaacttctaccggaatgctgtcttcgtgctaatgcttttctggtatatcctatatacggcttattctgcaactctggcattaacagattggagcagtgttttctattcccttatatacacatcagttccaacggtagtagttggcattctcgacnagaa

SEQ ID NO: 30739 - DNA, 510 bp, Sorghum bicolor
  Clone ID: 18059197
gcacgaggctatgatgatcaaggctgtatgcctagattttatgctcgaatcacaagggtaaaagttattccaaagtttctgctgcattttgtttggctggagtttgatcctgcaaataaagcggaggaggcatggtcttgcaggggtctgcctgttgcctgtggacactttaagcatggacagtcagagacaactaaagaaactagtatgttctctcggactatatcttttgagacaagcaagggaaaaaactgctatgaaatatatccaaggaaaggtgaagtttgggccctttttaagggatgggatattggttggagctcaggtgctggcaatcacaaaaatttgaaccatcagtatgaagttgttcaagtcctgtctgatctcaccacgagcactagcattattgtcatgccgcttgtgaagataaaaggctttgttagcttatttatgcagtccagagaggcagctccatatgtgatacctcatggtgacacactaaggttctct

SEQ ID NO: 30740 - DNA, 148 bp, Sorghum bicolor
  Clone ID: 18059206
cacccaggaatccgaaactaatgtgaatgccaccaaacatggtacaatacaggatcgtaccatactaaatggtgatgctaaggtatttgcggacatactaccagtctcagcggctcatggtacagagagcgctcgtcatgttcagaat

SEQ ID NO: 30741 - DNA, 486 bp, Sorghum bicolor
  Clone ID: 18059222
gcacgaggtgcaggcgcacagcggccccgcctacgacgtcaggttctaccccgatccgcagcaaccgctgctcttcagctgcggggacgatggacgcatcaggggctggaggtggcatgagatgcagagctgccttgtcccgctctccctgcaaggggatcatctagaaccagcacttgacttggtgaaccctcagcacgagggtccttggggtgctcggtctccgatacctgaaaataatgccattgcaattaataaacaggatggatccattttggcagcagcgggtgatgcatgtgcttactgctgggatgtggtatgtattttcttaaggagactggtaaatgtaaaatcacattcaaggggcatgctgattatttgcacagcgttgcagttcgtgagtcaaaccgccaggttgtaacaggatcagaggatgggacagctcgtatctgggattgcagaagtgggaagtgcatgcaggttata

SEQ ID NO: 30742 - DNA, 526 bp, Sorghum bicolor
  Clone ID: 18059247
gcacgaggccaccatgtcgcaggctccgggggtcgccggaagcccgtacgccgccgagctcgccgcagccaagaaggccgtcgcccttgcggcccgcctctgccagagagtgcagcggggcatcttgcaatctgacattcaatcgaaggcagacaagactcctgttacagtcgcggattatggatcacaagtattggtatgtctggtcctgaagaaggaattgccttctcactctttctcaatcgtagctgaagaggattcaaaagacttgagagaagatggtgcccaagaaattctagaacacattactacccttgtaaatgaaaccattgtaaatgatggttcgtacaacatgtcgttatctaaggaagacgtgcttgctgcaattgatggtggtaaatctgagggaggtccatctgggcgacattggatattggacccaatagatggcactaaaggtttcataaggggagatcagtatgcagttgcacttggactgcttgatgagggcaaagttgttctgggt

SEQ ID NO: 30743 - DNA, 554 bp, Sorghum bicolor
  unsure (1)..(554): unsure at all n locations
  Clone ID: 18059251
gcacgaggctcaaatggagaaggagcctcagctgttgaaaaacacagtgctgaaatgacagaatgcttcttaggcatgggaactttgacccctgcgctgcataatgtccaggctttaaacccctcgacaccaaaagaatgcttggtttctaacgcagacaactcagatcaagcaaataggtcatatgaggttcattgcagtcacaatgattttaacgtaagttactatcccaatccagtgctcaagggaagaatctccaaaatgatgtacccaagacattggtttcaactgccaaaaatgtggcttgtaggcaaatgtctcaaatggaagatgtcattgccttccaagcatgttagtccacgtaaggcaagaaaaaagaccttcagaaagcaatataaagggccaaacagacatattccacatcgtactaaacatcagaaaaccaagctcattatgaaggacagaaatacagatcctgcacatatgagaagtagtaagacatcanagcaatttgatcatacttgctcaagtgcttccttgggttcatctccaaa

SEQ ID NO: 30744 - DNA, 507 bp, Sorghum bicolor
  Clone ID: 18059263
gcacgaggctggcctcgacgccctcaccgtcactgcttccgcggtacgctccccagtccccacctcacctcgcgatcctaatccagcatgtaggttcaagtatccacttgatgactaactaccgtatgaacgaacatcgttcagcttcagacacctagaactgaaaatatgaaggcgggtttagttgtgcgtgaaagggttgtggagacgagtgtctgcccaatttatgctgttgaacaactgtccgggtagacatagatcggattttacatgataggtcaaattttggcatgtttaatatctgtgaattgttgggacttatcatccacatgacacgaagcggtaagttctcacttttgtaaattcaacttcaataacacgtggaaggtgcagttgcagaaactcaataatattgtttcacacagtgatggacggtatttcatagtctgcattctgctgcattcatatatgtatgagtactattaggttgcatatgcataattgaga

SEQ ID NO: 30745 - DNA, 514 bp, Sorghum bicolor
  unsure (1)..(514): unsure at all n locations
  Clone ID: 18059269
gcacgagggataacacagcggagaaggggtctgttggaggttcggcttcagtgccaaaaccttccaaatcagattcgtgcagaacttcatctcaaaaatcgtttacttctcttcttgatagtattttgcaaggagagcttccctgtgatttagagaaatcaaaccaaacctacaatatcttatcactattacgtgtgttggagggcttgaatcagttatctcctcgtctgaaactgcaggcaacacgtgatgattttgctgaaggaaaagttgctacattggatgggctttatgatgttggagtcaaggtaccctcagaggagtttgtcaacagtaagatgaccccaaaacttgctcggcaaattcaggatgttcttgcactgtgtagtggcagtttaccatcttggtgttatcagctgacgaaagcttgtcctttcctgtttccttttgaaacacgaagacnatacttctattccacagcttttgggttgtctcgtgcactgcatcgtcttca

SEQ ID NO: 30746 - DNA, 606 bp, Sorghum bicolor
  Clone ID: 18059280
gcacgaggatcgactctattttatgcggttcattgttcccaccagagtttccaatgaagggaagagtgaaacattgggttacagctgcgacatactttgataaagttgagatgaaagctcttgaacaaattctcctgcaaaagcaaagactgcaacaagaaatgctgaaatacatatcgcttcggcaactaagtcaggaagatgcccctgatctgcaaaaaagaatctctggatgtttccggagcatctctcgcttattcagtgactctgcaaagtgtgaggagaacttgaacatgcttcatcagctaaaagatgccgatatctggaatatattctctagcctgcttaattgttcaactgcatttgagaaagcttggtctcttcgggcagagtttcttaagatacttggtgaaaaacatgtgctttataattttgttggcacattaacaatgagatgttcatatttacttgtaaacaaggagtatgcaaaagagatcctttcagaagcatctgaaaataagacttctgggaatacaaaactcatctcatcatgcatgaatcttctaacggcaatatctagtttttttccgtctcttttgtcgggac

SEQ ID NO: 30747 - DNA, 475 bp, Sorghum bicolor
  Clone ID: 18059295
gcacgaggataatgtctttgaactaaagcagaaggaagccattaagcagttgaacagaatggtaactgaaccacaggctgctcgtgaagcagttgaacttatgcccatgggagaagtaaccaatgtagttaaagaattgttgtcatgtggctaccagcctgatcatgagccgtatctttccatgctgctacaaacttttagagcatccaagcttctagaattgaaaacaaagtcaaggatattcatcacacaagggcgagcaatgatgggttgcttggatgaaacccgcacactaaagtatggccaggtattcatccaagcttcttactgtgcagatgaccatcacaagatcgttgtaactggaaaagtagttgttgccaaaaatccttgtctccaccctggtgacatacgggttctccaggctgtagatgttccttctctgcaccacatgtttgattgtgttgtctttccacag

SEQ ID NO: 30748 - DNA, 518 bp, Sorghum bicolor
  unsure (1)..(518): unsure at all n locations
  Clone ID: 18059308
gcacgaggggaaggagtgggaggtggtccggatgatacagcgcgggctcaaggagttcgagcgccggagcctgtccagcgacatgtttgctggattccgtgcccgtggcgagtttgtggagaaatttaagttgagcacgaaatcactgaacaaagactatcaggaatccaaggaagttccaccactgcatctaactgaaattctggcatatctggttcggcaatctgggccatttttagatcaactttgcatacggagagacctttgtgacaaactagtggagatgttatacagtaaacgaaatggtcggctcatgtatcattctctttcacaggatagacccttagctgagaacatgactgatgagcttgatctaagaatagctagggtattagaaagtactggttatcacacagatgaaggtttttggaatgaccctgcanagtacaagatctcagacaacagacggcatgttgctattgtcaccacagcaagccttccatggatgacaggaaaca

SEQ ID NO: 30749 - DNA, 310 bp, Sorghum bicolor
  Clone ID: 18059315
gcacgagggcgcccagccgaggacgccgacaccggggaacgccgctgccgtcacgcgcccagccgaggacgccgacaccggggaacgctgctgccgtcacgcgcccagccgaggacgccgacaccggggaacgccgctgccgtcacgcgcccagccgaggacgccggcaccggggaacgccgtcgccgtcacgcgcctagacgaggacgccggcacctgaacatccctgcaggtctgcgatgggtgatccgcgagaagcccgccctgcgtttggcgacatatcaaacactatcagtcgtaaaagcgccga

SEQ ID NO: 30750 - DNA, 477 bp, Sorghum bicolor
  Clone ID: 18059330
gcacgaggagattaccagcactgtgtagagacacaaagctggtatctctgcttgccgatgaattggcaataacgccgagagaaatgaggagaatgcaaaatttggaggaactatcaaaagttcttatgggtcctgatgggtcgcttgcttcggaactagcagtgcatgttactaagttgggacctttgaggatgcttgggataagatttagtcatatgcagcgtcatagcgcaggtgatcgacagggagtgatgcgtctccttgaggagctgaggaaatcaaacctgcagtccctgttacttgataattaccctcatcctctgcttggcttactggttgatttgtcaacccacaacctgcgaaaatttgagctgagaatacgtggctgcctcccgcaagttccacaggagatagcatctctcacagccgtcacacacctgcatatcaatgttgaagcagtagaagcacaaggtgtcc

SEQ ID NO: 30751 - DNA, 370 bp, Sorghum bicolor
  Clone ID: 18059344
gcacgaggccagccccccggacgggcaacccccccgtggcgcgacagttcgtcgccggatcccatggcggcagcggaggtgtactcgccgaccgctgcggcggcggcgcagcagcagcagcgggggaaggcggcgtcgcaagcgtggcgagcggtggtggggtggatcggcttcctcctccaggtcctgctccagatcctccgaggcacgccctcctgcgcccagctcctgtccttcatcggcttccgctaccctctcctttccgggcccgcggcttctgagccgtcgccggaggtggccttcatgccgctccactccgagatcccagctgacacagacgcggcgcctgccccgatacctgcgcctgagc

SEQ ID NO: 30752 - DNA, 605 bp, Sorghum bicolor
  unsure (1)..(605): unsure at all n locations
  Clone ID: 18059348
gcacgaggctgatcttttcaaaggaggacttctgaagccctgcggagggattttgctgtttgggccacctggaaccgggaagaccatgcttgcaaaggctatagcaaatgacgccggggccagcttcatcaatgtatcgatgtccaccatcacatccaaatggtttggggaggatgagaaaaatgtccgggcattgttcagtttggctgccaaggtagctcccactatcatttttgtggatgaggtagacagcatgttggggcagcgcgctcgctacggtgaacatgaggccatgcggaagatcaagaacgagttcatgagtcactgggatggtctcttgtcaaaaacaggtgaaagaattcttgttcttgccgcgacaaataggccgtttgaccttgatgaagccatcatcaggagatttgagcgcagaatcatggttgggcttccaactcaagagagcagagagctgatcttgaggacactactgtcaaaagagaaaattgaggaaaatattgatttcaaggaacttgcgaccatgacggagggatacagtggcagtgatctcaagaatctctgtgtcactgctgcttaccgccctgttangg

SEQ ID NO: 30753 - DNA, 511 bp, Sorghum bicolor
  unsure (1)..(511): unsure at all n locations
  Clone ID: 18059356
gcacgagggcttaagtcacgcataagcagccaattgactgctgttgctaaggagcttgctgtgtatggtgatcctgttgattcaaaggctggtcaaggtgctaagcttttgaacatactagctaaatactgtgaagctttctcttcaatggtggaaggaaaaaatgaagatatatcgacaattgaactttctggtggagcgaggatccattacattttccagtctatctttgtcaaaagtttagaggaggttgatccttgcgaggatgttacagatgaagatatccgcatggctattcaaaatgcaactggtcctagaagtgctctgtttgtaccagaagttccatttgaagtccttgtacgtaggcagatcagcagattgcttgatccaagtcttcagtgtgcacagttcatatatgatgaacttgtaaagatgagtcatcgctgccttgcaaccgagttgcagcagtttcctatactccgcagaagcatggatgaagtcattgngaagt

SEQ ID NO: 30754 - DNA, 443 bp, Sorghum bicolor
  Clone ID: 18059383
gcacgaggccaaacagaggtcttgatgctcctcggaacatgttctcagcatttccagctgctgttatggagaaccagagcattccatcagctccagtggctcaatcttggatctcatttggtgctactaccgagaacaaaccaaccattgtcagcccaactttccttgacaataattgtggctggaaaatgccatttgctaacgtccagccttctgatgataccaaaataagtgctgttcctcagttctttaggcatcctgttcaggtagttagagagaactcggttcaaaacaagggtttggtaatatttccccagttggtgcagccagatttcgtgagatcacaagggcaaccacaatggcaggggctggttccccacatgcaacagaaggatgtactccgcccggacttgaacattgggtttccttctccaggttcacca

SEQ ID NO: 30755 - DNA, 353 bp, Sorghum bicolor
  Clone ID: 18059407
gcacgaggggttcataccctagtctgaataattcaaagacagcttctgcagtggtaaaagccaatagccaggaaactggaatgggttcatttatgtatggtggcgcccaagttattggggccgctgggctttcccagggcgatcaaaattttcctggcactccagctctgctgccagtgatgcaatttgggggtcagcatcctggtggtcttggagttcctaccgttggtatggccctccctggttatgtagctcaacagcagatgggaatgggaaacaacgaaatggcatggttgccattattggctggtgcaactggtgcttttggaggatcatatccaccctacatagcc

SEQ ID NO: 30756 - DNA, 510 bp, Sorghum bicolor
  Clone ID: 18059415
gcacgaggcttttcaaggttaactatggtgctgaggttgcccagctcaagcactcgcttcggacgttggaattggcaagccaggagctgaggacaaagggcctgttcttcaagctgctcgaggccgtgctcaaggcaggaaacaggatgaatgccggaacagcacgtggcaacgctcaggccttcaaccttacagcgctccgcaagctctctgacgtgaagagcactgatgggagcaccacattgctgcacttcgtcgttgaggaggttgttcgctccgagggaaagcggcttgccatcaatcgtaaccacagcatccgccgctcaggcagtctcgcaaggtctggccacgagggaggcagttcagcagcaggctttgcaagccaggggccatcacgggaggaaagacagaacgaatacatgaacttggggctaccaattgttggtggtctcagcacagagtttgccaacgtgaagagagccgcactggtcgactacgatgcagttgtca

SEQ ID NO: 30757 - DNA, 424 bp, Sorghum bicolor
  Clone ID: 18059417
gcacgagggtttattcctcgccggagcatagcggggcgaagcatccgaactccgaaaaccccagggcagcgaacgcagcggccaaccgtcccctccgccccgccccgcagccatggctgccaccggcgtggtcgccgagcccaagaccaagtacgatcgccagctcaggatatggggtgaccaaggccaggctgcactggaaaaggctagcatatgcttgcttaactgtggtcctactggaacagaagctttgaagaatcttgttcttggaggaataggaagtgtgactgttgttgatggctccaaagttgaagcatctgatctggggaacaattttctgttggatgaaggatgtttggggcaaccaagagctaaatctatatgttctttcctacaagagcttaatgacgctgttaaagccaag

SEQ ID NO: 30758 - DNA, 394 bp, Sorghum bicolor
  Clone ID: 18059428
gcacgagggcgacgacgaatcggtgtgacagcaaccggcgagcgtgcgaccatcactctggaaaggtcggatcggaggcgccggacgcagacatggatcctcatctatctcgaaaggacacggtttgcagactgcgaggcccagagcagcaagtcgtcgggggggggcctccgttgcgcggtacgcctagctgcggtgggctgccctacttgccttccacgtgaggactggggccatctggcccggcggccgccgcactagccgctcccggcagtggcccaggttgtgccgcatcgcccacacgctagcgcccgagtcaacgtttccatgttgaacacggcctcgcagcctcctcgacgctgtagccaccatcctgtggcctgccctccgggcc

SEQ ID NO: 30759 - DNA, 470 bp, Sorghum bicolor
  Clone ID: 18059435
gcacgaggcattcctcaactcggttatcatgcggtcttctgtacctcgcctcttcatcactcagcctgaggcatacctccaagatctgccagcctacgagagtggctggaactggcaacggctccgagaaatcagccgtttttaccctgactcccaagcaactgtacccgaggccgatgcgcgagaggactattggatgtggaatgaccagcttgacgaaactccaagtgcgcagtcatctttgagtatacgacaggctggtcagcgcgtgtcagcctccccttctttacaccaaattgcgatgcaatcttcgatgcgatcctccagtcctatgatgatacgtggtcaaacacctgcacgggagcgaagatcatccaaacccccgtacatccgcaccacttccttacctccggcagttcctgcgaatatctcgccttcacaacgaatcagacgtcgtgtatcctccttcg

SEQ ID NO: 30760 - DNA, 455 bp, Sorghum bicolor
  Clone ID: 18059442
gcacgaggccacaagtatcagctccgcgacgctggtggggttgactgcgccaagtgtgctcggagcacccgtgctgccatggcaccaccgagtccagtatggaccgcccctattcatacttctcaaaatgtatctgatagaagagacattcctgtgaagagctggagacctcctgccgggcaaatttcaagtcagtggagacagactaacctgtggagcatgtccagtgtacagtcagacttgcagcagcgtctagcttttgagtttgataggcctagtggtagtgaaaagttacttcctgggcgcacttttattcatgcccaggaaaggaaatttgatgacatgcatgacagaccaacaactcctgtgggcatgaaccacattataagggagagagatcccaatgggcatggccagcccaccaatatggatccagcatactcttataccctcta

SEQ ID NO: 30761 - DNA, 512 bp, Sorghum bicolor
  unsure (1)..(512): unsure at all n locations
  Clone ID: 18059457
gcacgaggctgaaattcgctcccacggggagtcgaactcaggacctgagaggtgccgccgtaattccctaaccacttgggctagagtcctttggcgcactgcgcatgccatgtcttagctctcatttatgcgcttctaggctcccaggcgcatataacccgtccgttactctgtgacacaatatttagtgtttttctccatctgcatgtatgggtgcatggtgctgtgtgcccgagaaaaatgagtgcacaaggttggcagttaatttctcatatgaaaggtaggactggggcagtttctgcatatgacatggaggaacacggtaaattagactagtccatatagatgggccatgcatgctaatatggattaagttagtatttttcttttaagccatgctttggtcactaagctaaatcaggtatgtaacatcgtanacagaatcatttagtgacgaattgctctattgtcatgccatattcgttataaaagaccatgcatatattgtaaat

SEQ ID NO: 30762 - DNA, 577 bp, Sorghum bicolor
  Clone ID: 18059462
atcagtggagagaattctgcagtacataagcattcctacagaacccccgcttgtcatgtcagaaaataagttggctcataactggccttcaaatggagaaattcagcttcataatctccatgtgaaatatgcaccacagttgccctttgttctgaagggccttacagtcacttttccgggtggcatgaagaccggtatagttggaagaacaggaagtggcaaatcaaccctcattcagtccctcttccgtattgttgaccctactgtcggtcagatactaatcgatggcgtcgacatctgcacaattggactacatgatctgagatccagactgagcatcattccacaagagccgacgatgttcgaaggaactgtcagaagcaaccttgatcccctaggggagtactctgatgatcaaatctgggaggctttggattgctgtcagctaggggacgaagttaggaagcaggagctgaagcttgactcaccagttatagagaatggcgagaactggagtgtgggccagcgtcagctcgtgtgtcttggtagggtaattctgaaacggagcaaggttctt

SEQ ID NO: 30763 - DNA, 396 bp, Sorghum bicolor
  Clone ID: 18059474
gcacgaggctgaaaaagcctcaaacaggtagtagcgctgaactgctgaagacgagacggttgtgctcaggcacttcggatctgaaatcttgaggcgcccaatcggtgttccaccacatctcccgtcggtaccatgtccgccggaagcgagaggccgtacaccttcgcgaccccctcggtggtcccgggccccttctcccgcggctccggctccgcgcccacccccaccgcggccgcgacagatagcactgggaggagctcgtcctccggggcgccgacgaagagccgaaagccgccgttccggctcgccgtggacgacacaaagcccgtcctccgcgatccgatatcacggtcggacctggcggataccgagcaggtcgtgctgcggctgccgccc

SEQ ID NO: 30764 - DNA, 425 bp, Sorghum bicolor
  Clone ID: 18059478
gcacgaggcccacaggatggatccagtttttgctgatctcgccaagaagaacccaaatgtggttttcctcaaggttgatgttgatgttggtgaaatgagcattattgctaagcagttgagtgttaatggcgtaccaacattcctcttcatgagggagggcacagttaaggacagggttcttggcgcagacaaggaagagctggaggagaagcttttggagcagttgtccctgatgccttggctgcgcctctatgtttgatggcaccgcatatgcagtattaattccatcttctgctattaggttcctgcaaactaatgacataatgccccccctttttttggcaaaatgcatgtttttgtttataaaagaaatggttgaagcacaacatttctaaggttgatgataatggaaacttcagtttttg

SEQ ID NO: 30765 - DNA, 532 bp, Sorghum bicolor
  Clone ID: 18059502
gcacgaggatcaagctgagaggtttaaggttctatcgtacaatatacttgcggactatctggcccaggagcaccagtttctgtatgaacgaataccatctttcatcctggattggaactggcgcaaggataagttactgtttgagtttggcctgtggtctccagacattctatgtcttcaggaggttgacaaatttacagaccttgaacaagaaatggcaagccgaggatataacggcacatggaagatacggactggagatgcagctgatggatgtgctattttttggagaacaacaaggttccagttacgctacgaagaggacattgaattcaacaagcttggacttcgtgataatgttgcgcagctctgtgttttagagtcggtggtccctcaaaatgtgcaaactgactctactagtttatctacaagctctaacgatccacaacaagctaaacaagttgttatatgtaatattcatgttctttataatccgaagagaggggacatcaaacttggtcaggtcaggaca

SEQ ID NO: 30766 - DNA, 400 bp, Sorghum bicolor
  unsure (1)..(400): unsure at all n locations
  Clone ID: 18059505
gcacgaggagatgacatgtgcttatctcctgagcctgatgggaccgttggtaagcccacctttgaggataatttcgaagagcaaaatattcagaaaggcagctcatgggaaaatggcataacaatgaagtcaagttgggaacaagatgctagtgctgcgaatgattctggtgactggggaggctggagtagtggaggtggagcttctgcaaagccagcagatcaagataattcatgggaagtgcatgctaaggtgcaggacaattccactgattggggaggctggagtagtggagttggagctgccgcaaagccagcagatcaagataattcatgggaagtgcatgctaaggcgcaggacaattgcactgattgnggaggctggagcactgataagccaa

SEQ ID NO: 30767 - DNA, 428 bp, Sorghum bicolor
  Clone ID: 18059528
gcacgaggataaccctcaagaaatttttcatccctagtctaaaatcttggacccgtagagttgttgctgaaggagatgaaaatgcaaacgatgaacttgcttccaaactttgtgaagaaattagggaagccataaaagtttctacgtcagccttttctgatattgctagaacaaaccaagaagtgcttgcttcaaaagatgaagataggaaggtgcttatgaagttaacagaaacatttgagtcacaagcaaatgtgtttaaatcattgaatgagaccttaaatcatatcagggagaatcagttttcacggcgcaaccaattggaagagcatgttcagcctgcaccatggaatgggccaattgactatcaagggagagcttttcagcaaactaatatgtatgcaacgccaccaaacaacagttttgac

SEQ ID NO: 30768 - DNA, 444 bp, Sorghum bicolor
  Clone ID: 18059532
gcacgaggatatctgattctattgccaagcagctcgaggatgtagttttggaagagagaaaaggcagtaagaaaaataaagtgagtaaagcatcatcgaggacacataagagtaagtctagaaaaaggcctgctggaagcgatggccacgaggtggacttcacgagtaccatcattattggggatgcttcgacaaacagggaggaaagtgctatgaatcagtataactatttgtcaagttctgtattggtagacaatcatccctcgtcatctcaatcttcagcaaaagattcaacgcaagcttatgctgaacaactgtgcgaagaattcagtgaagcagtgaacataggaaatgatgagacaactgatgaaaagatgaggcctgcattgaagccttcgttgaaagttactgggtctaagagcggtagacagtctgttacgtggg

SEQ ID NO: 30769 - DNA, 562 bp, Sorghum bicolor
  unsure (1)..(562): unsure at all n locations
  Clone ID: 18059575
gcacgaggcttcttcgaaacaaggttctcagtcattgaaaaactactatgctcctaggattggtatccccaaggcgccaaaggattacttgcagcaagaacaattgcctatgttggtgctagttcatgccaaggacaccagtgatagatcaacctcatattcaagttcacctgatgaagttggtctaactggagttggcagcaactacccaactgagggaaatgagggttcacaacctggtattgagatagcagcatcagtatcttgcaacttggttccagatttggccccacaagctgcttctgatgattcccacgtatcagatcctcactctttatgtcctgaaaacaagggtgtatccaccagtcggagctccaagaacctgtgcactgatccttttgctgcagaaacaaaggaagctcgatgtgtgaagttactgacagagaataattctcaagaatgctgtaagtggtattctggtgctggacacttgtcacagaagtgggttcctgttggtaagaaggaatcttgcaatgnggtctatttagatgtctcagctaat

SEQ ID NO: 30770 - DNA, 527 bp, Sorghum bicolor
  Clone ID: 18059577
gcacgagggttcgcaccagccagcgccggcacaggcaaacgcaacaccgcaccgagccgagccacttagcgagggagcagcctccacctccacctccacggcgacgagagaatggggagaggagggatcggaggcgcggtgggcatggccatggagaacgccgattccgcccgcgcattcgtcaaggacgtcaagcgaatcattatcaaggtgggcacagctgttgtcactgggcagaatggccgattggcaatgggcaggctcggttctctctgtgaacaggtgaagcaactgaattttcaagggtatgaggtgattctggtaacctcaggagctgttggtgttgggaggcagaggctccaataccgtaagcttatccatagcagctttgcagatctgcaaaatcctcagatgaactttgatggaaaggcctgtgctgctgtgggtcaaagtggcctgatggctatctatgacacattatttagccaacttgatgtaacatcatctcaacttcttgtaacggatcg

SEQ ID NO: 30771 - DNA, 425 bp, Sorghum bicolor
  unsure (1)..(425): unsure at all n locations
  Clone ID: 18059595
gcacgaggtggattagtgtgcctgctgttctgtttctgctaggctttctgtattctggaatctggaaggcaacacgctatcgtatatacacctttacagttctgttttataaattgttaatgtgatgatgcatcatctatccacccctgctcatcgactacctctatttttttttaactaccagttgactttcatgtgtaatgctagttcatttagtgcaatgatgttatcagaactgttttaggccgatgaggatcggcgtggattaacttattgcttgttgcataacctgaggttgcgtgacatggtttctgttctcccgtggaaccctgtcattggcttatgattacatgtggtaattcagtgatattcttctgcacttgatccagaacgcatccgccacgcanaaccgtgcagttttaggc

SEQ ID NO: 30772 - DNA, 496 bp, Sorghum bicolor
  Clone ID: 18059599
gcacgaggcctcgtctggctctgccactgcttccaccatgagaactactccgcatactgcacgtcgaggtttggacgcctcatcaaccgtccatcaatccttgatgtggagaatgaggagtatgccgaggaccgttgtcgagatgtctgggctactcatttcccatccgagccatttgatcttgacactaatgagattgatggaaacagtgttgataacataacctgtgacaatgtcgatggtgaaattgtcaaaatggtgagacggtacgctgacctagcagaccgctttgcgtcaccctttgtgtgggaaggtgtctaccatgttgctgctaggcggcgatatgtgcgtttcctggaccttatcaagaaggttgtgtgcggaacctaagtattcacacggcttgtgcctagcctagacatgttactgatgtggcttgctcaccagagttttcctgtgtgttatgccacggatatgctagcgatgggcattaggg

SEQ ID NO: 30773 - DNA, 401 bp, Sorghum bicolor
  Clone ID: 18059615
gcacgaggctggcattctgcagcaattgtggaggccactgttcagacaggcatgaatatggtgtctaagaagctgtatacctggggtgatggagataagaatcgtttaggccaaggggacaaagaagctaggttgattcctacttgtgttcaagctcttcttgagcacaattttcatcagctggcctgtggacaaaacatgactgttgcccttgctacatctggtcatgtgtataccatgggtagttctgacaatggtcagctcggaaatccaaaatctgatggtaaacaaccttgcttggtcaaagataaactagctcacgagttggttgaagagatctcatgtggagcggcccatgttgcagttctgacatcaagaagcgaagtctacacatggggaat

SEQ ID NO: 30774 - DNA, 456 bp, Sorghum bicolor
  Clone ID: 18059629
gcacgaggatttgaaccatatatagatgttctagagctcaatcgcctgaggagagagcttgtacttgatattcacgtatgggatcgcagactgtacatgatgcactccctcacaaaagaaaactgtcgtactgtgccaaatgatgcagaatgttctgagaagcttactgaaagcttattagaacagtcaaaggatgtgacatctggtaaacatttgaatgttgagaattctctagaacagaatcaaccaagtatgttggaagtggctgcagtttcagtgaaatcatcatcccctatgatggaacaaaccaacacttgtgtttcacgtttggaaaccaacattatgggtgatctatccatgcattctggctcaactgttatcagctttgccccaggcccatgtgaaatgcagagtgaaggagtgctggctgaactagaagctggaaaatttttgcag

SEQ ID NO: 30775 - DNA, 456 bp, Sorghum bicolor
  Clone ID: 18059644
gcacgagggacgccattgccgccctcctcctcgctccatctcctcctcctccttggcttcaactccactcctcctcgcatgcttgctttccaaaccaagggataacagataacataaccgccgcccgtctacgcgcccgcctccacgtacgccggccggcccatcccaactgcacccagcaacagctagtggaagacgaaagggcttgctcggttgctccgtccatcatccatgggcaagcttagctgtaggagcctctgtgcctgctgcatgggccctccgcgggcggcctcgccggccggcgcggccgtcgacgccaccgccggcgtcacggtcaaggtcaccgacagatatgtcgagataaaaaatggcatctttgagctgacgctgtccaacccggacggcatcgtcaccggcgtgcgctacaatggtgtggataatctcatggagattctt

SEQ ID NO: 30776 - DNA, 610 bp, Sorghum bicolor
  Clone ID: 18059702
gcacgaggggcgggcggcgggggagcgtcctcgctgccgcccttcctgagcaagacgtacgagatggtggacgacccggccacggacgccgtcgtggcgtggacgccgccggggaccagcttcgtcgtcgccaaccaggcagagttctgcagggatctgctccccaagtacttcaagcacaacaatttctccagcttcgtgcggcagctaaacacctacggctttaggaaaattgatcctgaacaatgggagtttgcaaatgaggatttcattaggggacaacagcaccgactgaaaaatatacacaggcgcaagcctatattcagccattcatcgcacactggttctggaccgttagcagatactgaaaggagggattatgaggaggagatcgaaaggcttaagtctgacaatgcagctctcacctcagagcttgaaaacaatgcacaaaagaaacttgttacagagaaacgaatgcaggacctagaagataaattgatctttttggaggatcggcagaagaatctgatggcatatgtcagggatattgtacaagcaccaggatttttagctagctttgtgcagcaacctgatcatcatggaaagaaag

SEQ ID NO: 30777 - DNA, 389 bp, Sorghum bicolor
  Clone ID: 18059734
gcacgaggcctttgatgaaaagtttgttaggatagaaacagaaagactctgtgaattgacttctgcagctgacagtctacagttaaagccacttgttgatcttactagtcgagcacttgctcgaatcattgaaggaaagacacctgaggaaattcgtgacattttccatttaccagatgacttaacagaggaagagaaattggagcccctaaaaaatataaatgatgatcctaggatacgcctattgaaccgattgtacgcgaagaagcggaaagagctccaggagcgccaccagcgccagaagctgaagggtgttcaagtacaaaaagagcaaaaagatgagagatctttggatgagttactttgttttattaatggggatggaggtt

SEQ ID NO: 30778 - DNA, 492 bp, Sorghum bicolor
  Clone ID: 18059746
gcacgagggtgaagaggtgcttttgacctcatccggagctgttctgtctgcgcttccttcagctttacttgctgaagctcaaatgctacgggacagagagttgagtcgctatcgtgctagagggagcctttttggtggaagctacaggcttggagggaggaggctgccaactgataatcagacaattatagacagagctgttggtgttactgtgggtagaagggttatttctactacaccaggcggttcaaagggtaaagatgtggaggggaccccgcttctggactcagaagctctgcgggcacttattcgccttctgcagcttgctccgccactcagcaaaggccttcttcaaaggcttatgttcaatttatgcgcacatagtgtcacacgtgttaccttggttggccatctgctcgacatgattaaacctgaatctgaggggcttagtgtatctgattgcatggctacatatagattacatggatgtca

SEQ ID NO: 30779 - DNA, 567 bp, Sorghum bicolor
  Clone ID: 18059759
gcacgagggcggttatcaagtgccactaggtgtcattgttcttgtgcatgcatttagaacctagtgagctaacttatctccttcgaagaaaatatttgtgaaaatgctaacacacgtgcacaagttggtttacacattgtggtgttggcacactttgggaaggaggtggagtttgaagggtagagagaagatgggttcctctctccctcccgcctcgcaagcttggcgggattcgacgctttctgagaaaatgaagtgcatattttctattgcgctagtgggacgtttagagaaatcgcgggctggcttttgaggcacaggaaatgctgattctgtgcgtccggtgtagttagtgtctggcccagctagggtaaggcaccggacgataggcaccgaacgtaggcttgtgcgtccggtggtacgtgtccggtgtgaggtccattttgcattgctctttgggtttaagtccggtgagcaccagacggtccagtgctcagcatccggtgccctgcgcgttttgcgaacctccctgcgtttaagaccggtgtgcaccgaacgcgtccggtg

SEQ ID NO: 30780 - DNA, 400 bp, Sorghum bicolor
  Clone ID: 18059767
gcacgaggcccaaggaccttaaccggtcatgggaggatcccatgtcaagtggtggaaggtatctgatgcaggagctggtgggcactggactatcagcacagagtgtgccggaatggaagatgacatatgggaaggccggaacatatgggcagaagtcgaggctttcgattcaggagcagagacaaagccttccaatattcaagctgaaaaaggagctgatcaatgctgttaatgacaaccaagtcttggtggttatcggtgagactggctcagggaaaacaacccaggttacgcagtacctcgccgaggcagggtatactacaaagggaaagattgcatgtactcaacctcgcagggttgctgcagagtcgattgcaaagcgagtagcagaggaggttgg

SEQ ID NO: 30781 - DNA, 453 bp, Sorghum bicolor
  Clone ID: 18059788
gcacgagggtcctgcagcctctacctcgtcttcgactacatggtccacgacctcgccggcctcgccgccagccccgacatcaagttcacgctgccccaggtcaagtgctatgtgcatcagctcttgtcagggctcgagcactgccacaaccggggagtgctacatcgcgacatcaaggggtcgaatctgcttttggacaacaatggtgtgctgaagattggtgatttcggtctggcgtccttcttcgaccccaaccataaacagccaatgacgagtcgggtggtgacactatggtaccgccctccagagttgctgctgggtgcgaccgattatggagttggcattgacttgtggagtgcaggatgtatactggctgaattgctggctggaaacctattatgcctggacggactgaggtggacagctgcataaaatttttaaactatgtggctc

SEQ ID NO: 30782 - DNA, 607 bp, Sorghum bicolor
  unsure (1)..(607): unsure at all n locations
  Clone ID: 18059795
gcacgaggattaaatgactgagtgcatgatttgctcagtttatgttatatttctacttttgataacttaagatacaggtacgtcatgattttaattaactcatggcaatctttcttattagattcagtcatttgtcttccatgaatccctgtttacaaatagtatcctctttagtacatctaggaagtaggaagctaagacaagcaaatttcactgaatggtgccaattcaatttagtagtagtagcctctcattacttgatagtatcaagttattttgaataacaaatagttgcttcgtcctgtttgtgttaaaattttgtttgatgagccattctttaaaacagcataatggattctatcaaatacatgtgacaccatgcaactgacaaaagtatatatttattcttttgtatcctatgctttgtaaatgatgcttctagtcacaaagtttctatatctcatgcatatgggtagctcctcttcttgtacttatatcctttctttttgtaatagagagttaacgtaataaacgtgttaggatgagattacaaaaggcttttaagttggtacaaacctatctagatnacatgagactaaacctagta

SEQ ID NO: 30783 - DNA, 451 bp, Sorghum bicolor
  Clone ID: 18059803
gcacgaggcgatttgattgttcagagggtggagtttgtccttgattcagacaaacgaagctacctcatggaccttcttcatgcacaaaaggctaatggcacacatggaaagcacgctcttactttggtctttgtggagacaaagaggggggctgatgctctggaggactggctttttagaaatggattccctgcaactagcattcatggagacaggacacagcaggaaagggagcatgcacttaggtccttcaagagtggagcaactcccatccttgtggcgactgatgttgctgctcgtggtcttgacataccgcatgttgcccatgtgattaattttgacctccctaatgatatagatgattatgttcatcggattggaaggaccggacgtgctgggaaatctggtctggcgactgcattcttcaacgagagcaacactacacttgcaa

SEQ ID NO: 30784 - DNA, 374 bp, Sorghum bicolor
  Clone ID: 18059811
gcacgaggcaccagcggagtcttccaagtagaacccaaaagctgccctggctttatcttcagacgctctgtgtgtgtgggtacaactcatatgtcccgctcccaagtccacacttccatagaggacctcgccgaggattatcatggggacacttatcatctgattgtcaagaactgcaatcatttcacagctgatgtctgcaagcgtttgaccgggaagccagtacctggatgggtgaatcgacttgccagattgggttccttcttcaattgcgtattgcctgacagcatcaaggtttcagcagtcagagatgtaaacacgcacccagatttttctgatgatgacttggggtccaatgcttcgatccttgaagg

SEQ ID NO: 30785 - DNA, 460 bp, Sorghum bicolor
  Clone ID: 18059843
gcacgaggggcggctggtgcggaggggcggccggcgcttcttggtgccgtccgtctctacttcgggcggggtggtttcattcattcgtaacccgacaaggcgcggtgtgcggtgctctcttgcgacttgcctcgtcttgttgactctcgcggcggctgggtgggttactgggctcggttcatcctccctggtcacggcgggcgattcagcacatgttagaagccagggaaggtcggtgaatgcaaatgcttgcattgatattataagtacaggctgaagttattgagctgacagcattaagatataatagtttgagaatctcaatgagttgctgttctatattttgcaagaaaagaagggcaacgcggcaaccaagttcccaccataatgaagacgtacctggtggtacaaatataacaaaatacacttataaggagctagcaagggcaacagataactt

SEQ ID NO: 30786 - DNA, 397 bp, Sorghum bicolor
  Clone ID: 18059847
gcacgaggacaaccaccacatcctgctgctgctgctgctcgctcgccgtgccgcaatggctacggccgtcgcctcccctacgttcctctcctccgccttcgccccgcggcagcaccgccgcctgacccggctcgcgggcccgcgccgggccgccccggtgggactggccgtgcgatgcgagaagagcgacaagcagaagaggcagccgctctccgcgctcgtgccccgcgagcagcgcttcatgttcgagggagacgagctctgcggccccgacatatggaatacaacctggtatcctaaggctgcagatcatgtaaccacagagaagacatggtatgttgttgatgcaacagacaagattctaggcaggctagcatccaccattgcagtacatatc

SEQ ID NO: 30787 - DNA, 424 bp, Sorghum bicolor
  Clone ID: 18059853
gcacgaggaaacagtggtaatctttatagagatgtgctggtaaccagtttggcaggtataattgctctaagatttttttacttcattcttctgctgttgattcacctcatcacctgagtgaagtacatgattaccagtctagaggaaggtacttatttgtatgttgcttctttttgaagaaaatatttgcttgctacttaagattttttttcttcagacatggttgtgcccaagaaaaaaggtatgggaggttttgtggtagataaaatgaatggtagcagacaaaaaaaatgttaacccaaatatttctggcttctgcttttggaggattgggatagggtgtgttctgtgaacctggtgttagtaaaatcatgtcaaacgggcctgctatctaactggttagctggactcaagtggcaccctg

SEQ ID NO: 30788 - DNA, 532 bp, Sorghum bicolor
  unsure (1)..(532): unsure at all n locations
  Clone ID: 18059866
gcacgaggtgctggatcacatccagggagaggatttggtggtccgctgctactacattgactctgctatgaaggccttcgcgatatctcctgcgcagctatattccaacacgccttcggattttgacttcaaacttgaaagtttagcccaaggatttgactccttatctgactttgcggagcatcttgccatcaatgttgacattgtcttcccagtgatccatgggaaatttggtgaagatggtggcattcaggagcttttggagaaagcaaatgttccatttgttgggacaccctctaaggaatgcgagcgtgcttttgacaagcataatgcgtcgctcgagctcaatgcacaaggtttcttaacagtgccaaactttcttgtggagaaggacaagttggccaagccagagttagaggcatggttcaaaactgtcaatctgaacaaagaanatggcaaagtgattgtcaaacctacnagggctgggtcaagcattggcgtggttgttgcttatggtgtgaatgacgctgcc

SEQ ID NO: 30789 - DNA, 567 bp, Sorghum bicolor
  Clone ID: 18059872
gcacgagggacaaggggaaaggtaaaatgcgtgtcaaagattctggatgcagcatgagatcacctttgcttgattgcagcctatgtggagctacagtgagaatctgggacttcagatcagtgccacggccttctcattttagtctgaataacattgacatgcctgatactggaaggaagcctgtgttgatccgcggaattagtgctacaagtggtatcaatggactggttgctgaaggagcagagagagaaaatgttgagggacgtggtgaagcaggtattgatgagggtaagtctctgtcgaatgctcaagttgacttaaacctgacaatggcaggaggtttgccatcaaactattctgcattgccgccgatgcctggacatctcaattatggaggaatgggaagagatctagttattgggcaacccactggaagtgagcttggtggccatgcagcctcatttgaatctcggggccccagttcgagaaagcgtaacctggaggagggtgggagcacagctgacaagccaataaacaggcttcagcctgctgacagcattgagggaa

SEQ ID NO: 30790 - DNA, 479 bp, Sorghum bicolor
  Clone ID: 18059887
gcacgaggctcgacgctgtcagagacgctgcggttcacgtactcggaaacccttgggaagtggccgatcggtgacctggcgttcgggatcagtttcctcctcaagagacagggaaacttatctgtagcaagcatatacgctggaaatgatagtgtggagctcaaaggagctgaagtaattgctgacttaaagtatcttctcaatttgctgacactttgctggcatttctccaaaaagccattcccgttgtttttggaggcgactggctactctgtggaggatgttcttatgcaagagcctaaagcaggaattttgaagccagctttcaccattttgcttgatagagacaaaaaatccatacttctattaataaggggtactcatagcatcagagatacattaacagctgccactggtgctgtggttccattccaccatacaattgtacaggaaggtggtgttagcgacttagtactagg

SEQ ID NO: 30791 - DNA, 536 bp, Sorghum bicolor
  Clone ID: 18059891
gcacgagggataaaggtaaagatgatggatcatggagatggtgatcgtggctgggatgtcttctctttggagtatgatgctagggtccccctagacacagtgttcacagcttcagttatgaagatgtatctcaaggttttcaacttcttatggaagctcaagcgtgtggatcactcccttactggagtgtggaagacaatgaaacctaactgcattgtttcttctccattttacaaggaaggaacaagcatcagagctcagtttgtttcagttcttcgtaaatgccaagttctgtttaatgagatgaatcactttgtgaccaatttccaatactacattatgtttgaggtcctggaggtttcgtgggcccgtttctctgatgagatggatgcagcaaaggatttagatgaccttctcttggcgcatgataagtatctcaactcgatactggagaaggccctgctcggtgagcgttcccaaggacttttgagaaatctgtttgaattgtttgacatcatcttacagtttcggagcca

SEQ ID NO: 30792 - DNA, 414 bp, Sorghum bicolor
  Clone ID: 18059899
gcacgaggcttgatcgtgaggttgctgaatcgcttccaatttccaatgctacagaaggagaggatgctggtgctgaactttgcagcgatgattctgatgcaaaaggttccactgaagtcggtggtcataataaggaagatgaggaagctgacggttaccacgatgcttctaatgatctcaaatccatcccgatctcttcaagtgatgatgccgtggaatttattgcaaaagaattggaggacaacgtgcctacttccagaggcgcacgctttggtgtggaggattcggatgatgcagagatcaatggcgatgatgaatatgaagaggagatgaatgtaaaggaggccgagctttttgattatgcagctttaattgagcttctaagggctgcaagcagctcacctgaacaaggca

SEQ ID NO: 30793 - DNA, 153 bp, Sorghum bicolor
  unsure (1)..(153): unsure at all n locations
  Clone ID: 18059949
gcacgaggtctacatgcagtttataaacatctgaaatgtctaaattggttccgtactacagtaaatactaagtaagtgaataaaatgccaagaaccatcatgttattcaaattgtcaattccaaaccacatagatnatggatgcgttaagttt

SEQ ID NO: 30794 - DNA, 395 bp, Sorghum bicolor
  Clone ID: 18059999
gcacgaggcggtcttaatgttctttcacttgccttttaaaataaaaaagctatgcagattctaaactgtaaaaattaaatataagtaaaagctatgcagattctaatctgtaaaaattaaatataagtattttccatgatgaatctagtaacatcaaccatgctttgtgaatctgaccgatagaatcctagaatgacctacatttgggattggggtagtactttggctgtttactgtagaacccctgggttgcatgcgtgctttatcacagttagcttatttctttccagggaactgacattttttattatatctcatagtttgtgtgttttgtaacctttgtaatcctgttttgcagattgcttggggaggcgaatagggcctagtttccttgg

SEQ ID NO: 30795 - DNA, 527 bp, Sorghum bicolor
  Clone ID: 18060001
gcacgaggctattgagaatgtgaacaatcttattggtttcaagtgccatagatgccgcctgagaagtctacctgtctgcccatatgctgagactgtaacaattctcaaaggtcagtcagataaggatcatggcatcaagtttgtagataacagtgttgacaagtttgtggaggatgaggatcccaattgtccaaaagatcttggtgctctgggtagtctgcaagagcttcatgatcatgacatcgagcgaaggctcaatggtcatattactgagatagaattcagttataataactgtctagaggagctgaatgatcatggcagtttgaaagagtttgatgctcatagcactgagaaagatctggaggatgatgagagtttgaaaaagttagacacccataatgagttgaaggagcttgatgatcctggctccaagaaagaacctggtgatcattattgtccaaaagatctcaacagtgacaccaatctgaaagatcttgacaactgtaggacggacaaagagatta

SEQ ID NO: 30796 - DNA, 451 bp, Sorghum bicolor
  Clone ID: 18060005
ggcacgaggttttgttccaggaaatggtggacatggtcggacctccgtgtcgcgttcgtgcgcgtaggacatgacgcgagtgttttttctatgtggttggtgcgtctgtgtagggcggttcaggcggcccgtccacgacaaatggtcggcgaatgttcgcatctctccgacctcttaccttgcctttccgcctctgttattttaaaacgttttcatctgggtagacaaatcgtgacctggaacaaagtttccaggccaggtcatgtttaagactcgagcgcctgggtttgacaaaagttagcggaatcttggtggctactcgatcagttccatctttcgacagtcttcaaccgtaggatttcaaaagtcgcacatggagaatatttcattcatcatgtttacgtttgttggacagttccacgatgcacgttttttttttgtaccgactacc

SEQ ID NO: 30797 - DNA, 513 bp, Sorghum bicolor
  Clone ID: 18060053
gcacgaggtggaaacatctgatcggagtcaaggagcaaaatcagctaatgaagttgctttgcatgattcaggcgcaaaggatcatgatacttctactctagggcattcttgtgctgataatgaaaacagtgtcgctgatgaggatagcaccataactgacatgtcacatatggacagcatcctcccgtcatgtgtgcccgatgatccatcaaataaccatgaaactgttgtgccacgtggtgcagttgttgctgagaaaaatggagaagaaaataaggttgagaatcatcagacggtgtatactgaggaaggaacaacttcaggtgtaagcacaaaagatgctgaaggatcaagcatttcaagatctgctgaggaagtccatgaagaggtccttgacaaagacaaattgatcatttcactagaagaagaggtgaaatgtcttaaggctagactagatcatcttgaacaacataatcatctagtgactgaaagcaccagtggtatcgagtatca

SEQ ID NO: 30798 - DNA, 360 bp, Sorghum bicolor
  Clone ID: 18060064
gcacgaggcttcagtttacctttcaagagttgaaatctgccacccttaacttcaggccagacagtattcttggggagggtgggttcggatatgtcttcaaggggtggattgagccaaacagcactgctcctgcaaaacctggcacaggggttactgtggcagtccaaagtttaaagccagatgcgcttcaaggtcatagagaatgggtggcagaagttgactttctgggacagttgcatcataaacaccttgttaagttgattggatattgcattgaggatgatcaaaggttacttgtatatgaattcatggcacgaggaagtcttgaaaatcatcttgtcagaacggctcttcccctac

SEQ ID NO: 30799 - DNA, 565 bp, Sorghum bicolor
  Clone ID: 18060067
gcacgaggatagaactgtctcaaagcgttcattgtcaaggttttctgtcaaaattgatggcgttagatgcttcgcatttgaagaaatggctatagccacaaataattttgatctatcagcccaagttggccaaggaggttatggaaaagtctacaaggggattctagccgatggagcagttgttgcaatcaaacgagcacatgaggattctcttcaaggttcaagggagttctgcacagagatagagttattatcaagattgcatcatcgcaatttggtttcattggttggctactgtgatgaaaaggatgagcagatgctggtttatgaattcatgtcaaatggcactttacgtgatcatctttctgccaagtccaagagacctctaagttttggtttgaggttgaaaatcgcattgggtgctgcaaaaggaattttgtatctacatactgaagcagatccacctatattccaccgtgatgttaaggccagcaacattctgttggactccaaattcgtcgcgaaggtagctgattttggtctctcaaggcttgctccagtgcca

SEQ ID NO: 30800 - DNA, 574 bp, Sorghum bicolor
  Clone ID: 18060079
gcacgaggctgaagcaatctctaggattcgaaatgagaaggccaagcgctacctgagcagtatgaggcggaaaaggcctataccacttactcagaaatttccaaatgcagatccacttgcattacgtttattggagaagatgctagcttttgatccaaaagataggccaagcgcagaggaggcccttgctgatccatatttcaagaacatagccaatgtggatagagaaccatcagcacagcctgtgacaaagctggaatttgagtttgagaggcggaggattaccaaagaagatataagggaactcatttacagagaaattctggagtatcatccaaatatgttgagagaattccttgaggggacagagtcaactggtttcatgtacccaagtgctgtggatcattttaagaagcaatttgcatatcttgaagaacactatgcaaagggatcaacagcagctccacctgagaggcaacacaactctcttccaaggccttgtgtgttatattcggataatctaactaaaagcacagcccatgtcatggaggatctttccaagtgtgtaatcaga

SEQ ID NO: 30801 - DNA, 435 bp, Sorghum bicolor
  Clone ID: 18060088
gcacgaggcccgaatgttagggctaagggtgtggcgtcaaccaaagctgcagagttgttgaataatatgcaactagaggatccagtcaacatggatgatatggggattccggagataaacactgttattctgctagacagagaggtggacatggtgacaccaatgtgctctcagttgacgtatgaaggcttgttggatgagatgctacaaattaataacggttcagtggaagttgatgcaagcattattggagctcaacaagatgggaaaaaggttaaggttccactgaattcaagcgataagttgtacaaggagatccgagacctcaattttgaagttgtagttcaggttttacgtcaaaaagcaacatctattcagcaagattatgcggaagtgaaatccacaaacactcagtccgtttcggagctcaaggat

SEQ ID NO: 30802 - DNA, 405 bp, Sorghum bicolor
  Clone ID: 18060104
gcacgaggaaacttcttgcgctgctcgttccttcgttcttcagagaacgaacgaagtcgtcgggaaatggaggcggcgccggcggctctgcgtcgtccggccggctcggacgatgctgcggatcctccgaggtgcccgccggccccggcggcggcggggagcggcgcgatgagtggcggcgcggcgaccaagctgcagaaggtgtaccgcagctaccggaccaggcggaggctcgccgactccgccgtcgtcgtcgaggagctctggtggaaagcactggactttgcccgacttaactacaacactatctccttcttcgacgaacccaagcctaagactgctgcctcacattggaatcgtattagccaaaatgcattgaaggtgggtcacggtctctctagggat

SEQ ID NO: 30803 - DNA, 220 bp, Sorghum bicolor
  Clone ID: 18060111
gcacgaggccgtctccggcgaggccatcgacagatggaccccgcgccgcgccgactccttcgagaagattgacaagatcggtcagggcacgtacagcaacgtgtacaaggcgcgcgacacggtgagcggtcaagatcgtggcgctcaagaaggtgcgcttcgacaacctcgagcccgagagcgtccgcttcatggcccgcgagatcctcatcctccggtg

SEQ ID NO: 30804 - DNA, 108 bp, Sorghum bicolor
  Clone ID: 18060126
gcacgaggggcggaactcctccggctccggcggtcgtcaccagcggcctgacgtccttgagcagaccgaccacctgctgcgtggtgggcctcttctccggcgcgccgg

SEQ ID NO: 30805 - DNA, 415 bp, Sorghum bicolor
  Clone ID: 18060131
gcacgaggggaagaacaggaggggagctggccagcgacctgcagctgctgcgatcactactggtactggagccggtgcgcaactctgaacttgctctggtcagctgcagcatggtcgatctggaagggggtggtaatagtgatctatctgagggcgcagagcagtgaggaaaggcaagggaagtggcaggcaggagaagttgcgggaagagcgagctataactataagcgagtggcaccagagagagagagagagagagagagagagctgaatgcctagatggttgatcgggaggggtatatgggctgactggtgggctgggccagatcctttatcgctcctccctttccttttctttcttttcttttttttccttttcctttgttccttcatgctgtagatttgcactttctta

SEQ ID NO: 30806 - DNA, 518 bp, Sorghum bicolor
  Clone ID: 18060173
gcacgagggagatggacgcgttcctgcagaggctcaagcggctggatgcgtaccccaaggtgaacgaggacttctacaagcggacgctctccggcggcatcgtcacgctcgtcgccgccgtcgtcatgctgctcctcttcatctccgagaccaggtcatatttttattcagcaacagagactaaattagttgtggacacatcaagaggagaaaggctacgagtaaattttgatattacttttccgagcattccttgcaccctcctcagcgttgatacaatggatattagtggagagcagcatcatgacattaggcatgacatcgagaagagaagattagattcacatggtaatgttattgaagcaagaaaagaaggcattggcggagcaaagatcgagagaccattgcaaaaacatggaggaaggcttgacaaaggcgaacaatattgtggcacgtgttatggtgccgaggagtcggatgagcaatgctgtaattcttgcgaagaagtcagggaggca

SEQ ID NO: 30807 - DNA, 584 bp, Sorghum bicolor
  Clone ID: 18060183
gcacgagggtaagaaggtgtcaggtgcctctattttcttcgagagcatgtcgtacaaggtgaacccacagactgggtatattgattacgacaagctcgaggagagagcaatggatttccacccgaaaattctcatctgtggtgggagctcttaccccagagagtgggactttgcacggatgagattgattgctgataaatgtggtgcagtgcttctttgcgacatggcacatatcagtgggcttgtcgcagcaaaggaatgccgtagcccttttgactactgtgatgttgttacgtcaactactcacaagaatcttaggggccctagaggtggtataatattcttcaggaaagggaaaaatttaaggaaacgagctggatctttttctcaaggagatgacaatgaatatgactttgaggataggataaattttggtgtttttccttcaatgcaaggaggaccccataataatcatattgctgccttggctataactctcaagcaggtagcaactcctgaatataaagcatacattcaacaagtcaagaaaaatgctcaggctttggcatcagctttgctcaaaa

SEQ ID NO: 30808 - DNA, 570 bp, Sorghum bicolor
  Clone ID: 18060185
gcacgaggaggttgtcatccctaattatattgctaaaaatttaatatagattcacatgctctactgtaaagctttacagagaataacaaatacaaacataattataaactaaatgggttctgcaagcggacagataattataccgttgtagcattttacctaggaaagtatccaggttgtcgatttatatttataccaccgggaaggctaagggttaaactatattctattatattgataagaatgaataaataatattacccaattcctataacctactcataacaggtagaggtcacaagataaatatagataaataataatgatagcataatcatcaagtatcatatataaggataatcatcagagcatctactagtcataataatagttagccaatggataaactaggaagttggatctaaggtaattctataactacgccaatgaataactctaattagtgcaattaaatctagaaatcatcgttaagtcaacattatatcataattacatgtaaagaggcatctgttgacggttattaagtaccaaatttaattatcaaataaa

SEQ ID NO: 30809 - DNA, 554 bp, Sorghum bicolor
  Clone ID: 18060192
taatggtcctctatcaaaaccagaaagattcttaccaagtatgccaagatcacaagagtgaaacaaggaaggcagattgtataagacgtgaatcagactgccgtagtacagattctgaggttcagagaagtaaacaaaaaactgaggtggcatcaaattctatatttgagcaccagtcactctgtaagaacatggctgaaatcatgaacgttagcaagacaaggctgtgtgggaaaattttgaagaagctcatggatcacaaaggtggttggctttttcataaaccagttgaccccgttctttatgggattcctgattacttttatgttatctgcaatccaatggacttgggcactgttaagaagaaactcacaaacaagcaatatgttacagccagtgaatttgcagcagatgtgaggcttacattctcaaatgcaatgaagtataatcctccaggaaatgatgtccatgcagttgctgaacagttgaatagaatatttgactcagaatggagaacagtggtaagaaaatggagcggcaggaaacccatacaa

SEQ ID NO: 30810 - DNA, 467 bp, Sorghum bicolor
  Clone ID: 18060195
gcacgagggtcgtgtcaatgctatgctggtccgacggctagagctgctcggtgaagtttctaaattggcgagatctcttcgtcttccagaagatgtgggctacacatgtgaaactgctgcatatttttggttattacatgtttatgcccgttgggaacaattcttagctgcctgtgctcaaaatcaagacaaaccctctttcgtcaaagatcgcttcccattttcagagttcttttcagatactccgcagcctatttttactggcgagtcatttgagatggatatgcatgcagcgaaaggttgtttcaaacatctttctataatattccaagagctggaagagtgtagggcttttgagctactcaagtcaacagtggagcgagcaaactatctaatgactaaacaggccaagatagttgctatgacttgtactcatgcagcattgaagaggagagactttcttcaat

SEQ ID NO: 30811 - DNA, 554 bp, Sorghum bicolor
  Clone ID: 18060227
gcacgaggcctcggtctcctccgtaataactctgcagcagtttaagtagtaccggtgcttctccagtggctgagtctgctcgcccctcagctggatccgtgtaaatccatcggtaccatcgtctggtaagtcttgattgattccacatgctctaagttgaatctgagtgtttgtcgggaggaattcctgatcacacgcagttctagcatgcctcactcattagcctgcagtgttattcagttttatttttttcaattaatgttgctatcgttatccttgtgactagatagttggatagttgaacatgggaacctacaaccatctttggtcaatagccaagaggaatgcaatggcggttgtaattggcatctccatttccgaccgctatgtggccttcacttcggtgaccggcgaatccatgtatcctacgtttacggcctccagcagcgtctggggaggtattatgattttaattcgtacatattaattgggctatggacaactaggctatgctgcagtccatattcaaatagtttggtcttctggtttgtgct

SEQ ID NO: 30812 - DNA, 412 bp, Sorghum bicolor
  Clone ID: 18060260
gcacgaggaagaaagactgttctattgctttcaactctgcttactagtggaatgggttttctaagtgctttatctcctaactacttgtgcttgctggttcttcggttttttgtcggcataggagtgggcagtggccatgtatttacatcttggttcttggagttcgttccagcaggaaatcgtggcacttggatggttattttttcctttttctggactattggcacagtcttggaggcttcacttgcatgggctgtactatccgcattaagttggaggtggttgctggcattgaccgccctgccatgcttcctcttgcttcctttcttcagaattacacctgagtcaccacgctatctttgtgcacaaaatagaatgactgatgcaaggcttgtcctggaaagaatagcca

SEQ ID NO: 30813 - DNA, 547 bp, Sorghum bicolor
  Clone ID: 18060268
gcacgagggacatctcgcgttgcatttctctaagaaaattacctcaaaccattctcaagttaccaaatcttgagtctttagttgtgagaggctgctttccacgcattgaagagcaaatcaaggaatcatcattggccaatggtttgctgtcactgccaaaatttttcgtatgtaccatgcctggtggtttgtctagcaacatcgtgcaacttgagggagtaaatcctggagagcttgagataaaatttcttgaaaatgtcgcaagtttagaagaagtgaagaaagttaacttggcatttaagtcaaggctctccaaattgtttctatcttggactggcagtgttaacgaccatcttttggatgacgaatctttgctcggggagcttgtacccccaaccactttggagcagtttattctccaaggctacatgggtatcagacttcctagttggactggctctgctacatatcttttaaatctttcccgaattgagctgctaaatttgccaagatgcacacagctaccatcacttggtcagttgcctaa

SEQ ID NO: 30814 - DNA, 476 bp, Sorghum bicolor
  Clone ID: 18060274
gcacgagggttcaaggaggccaaagaagctgccccgtcaatcatttttattgatgaacttgatgctgtgggtggaagtcgaggtagaagttttaatgatgagagggaccaaactctaaaccagctgcttactgaaatggatggttttgactcggacatgaaagttattgtcatggctgctactaacaggccaaaagcactggatgctgctctttgtcgacctggccgcttctccagaaaggttgttgttggtaggcctgatgtggagggccgtaaaaagattctggctgttcatctaagggatattcctttggaagagaatcccgaaataattagtgatctggttgctagagtaactccaggattggtcggtgcagatctagcaaacattgttaatgaggctgctctattagctgcacgaagaggtcggaatactgtgtcccgggaggatattatggatgcaattgagagggagaa

SEQ ID NO: 30815 - DNA, 557 bp, Sorghum bicolor
  Clone ID: 18060280
gcacgagggcgccccaagaatcgacgccgcggggacggctgtccctgccgccgacggctaaggggaccgagcccgtgacgcccgccgaggcgacggcaacggagaagaagtggagagtaagcctcgggcccgattcgtccagggcgttgtcgcggagcacacgccaggcgaagtaggtcgagcacgcagccgagatggaggagcacgaatgttggtcgtgcttcacccacagggaggccctcatggacatggagaagggcaggtcaacctgtatcctgcgtccccctcgcaggagaacctcaacggcactcctctctccatcgaaggctttctattcgcactatcgtctcgagcttttgaccgtaagatagacatgcctgtcgatactccatttttgtgaattttagctacgattttgtagattttcttggggcaaaatggtgccagaacatgtatgagaaatactagaatgatctcctactaaatatgccactcgaacaacacgaatttaaactttccccaatttggttcttcacctagggttctctgattttgtg

SEQ ID NO: 30816 - DNA, 299 bp, Sorghum bicolor
  Clone ID: 18060284
gcacgaggggcggcactcctccggctccggcggtcgtcgccggcggcctgacgtccttgagcagcccgaccacctgctgcatggtgggcctcttctccggcgcgccggcggtacagaggaacccgacctgcaggcactcggccatctccttctcggcgtccgtgcccgccgtctcgtcccggagccggtcgtccacgaggttgaggcccttgcggttccggatcacgccgcgcgcccagctcgtggtcgccgcgtcgccccacctcgactgccccgtcaccacctcgaacaccaccgtc

SEQ ID NO: 30817 - DNA, 513 bp, Sorghum bicolor
  unsure (1)..(513): unsure at all n locations
  Clone ID: 18060290
gcacgaggggaagaagggatctctgagaaagccaagagacaaatcgaggaggtctttgatgagctctgccctccgcttggcttagaaaaccttaacattgaagggtatttcggtgagcggctcccaagatggatgatgtcagcagcagcagttatgccgcttaggagcttgaggactgttacgatggacaacttggcctgctgcacagagcttcctagtggcttgagtcagctcccctgcttggagcttctgcagattgttcgtgccccagccatcaagtgtgttgggcatgaatggctacaaccaaacaatcaattaggttttgcgtttcccagactgcaggagctgcactttgagggaatggtcgaatgggaggaatgggagtgggaggaacaagtgaaaggcatgcctatcttggagttgcttaaactgaanatgtgcaagttgaggcgtgtgccaccaggcctggccttccacgcaagggctttgaagaagttatgtatatatggtgtg

SEQ ID NO: 30818 - DNA, 482 bp, Sorghum bicolor
  Clone ID: 18060294
gcacgagggttgcttcctccctacactccagccgcgccaacgccccaaatcccagcatatggagggggttgcgcccgccgtctcgctgttccgcccacgcgcttccgcacgccccaccattgtcctcgccgagaattccggcagcgcccggaggagccctggtgcaggcgggaggagcaggggggtttcaaggcttagtccggagatgtctcccggcggggccagtcggaggatgagtaagttacggaagcacggtagcagggaggcagaggctgcagctcgatcaggaatcactagagttccaaaccttggtactgcagtttctactaaaagagcagggatgagtaaggatacggttattaatttggacgtatctcatcacagagcggttgcagtggtgaggttgctaagaatcgagaagggaaaagcatttgtagaccttttgaatgagaaagcaaatgattctggagagaaagagatag

SEQ ID NO: 30819 - DNA, 528 bp, Sorghum bicolor
  Clone ID: 18060298
gcacgagggtcttttcggagcatggttcgtgatataagggaaagttttgggaatatatcgaggcggaactttgaggtgagaattcaccacagagggaagtctcttggatcttcaagtgacttgcaagacaagcctgctgaaattcagcaaagcaggtgggctagccttcctcctgagttactccgcgatgtgatgaaaagattggaggaagatgacagtagctggccggatcgcaaggatgttgtttgttgtgcctctgtttgtacaacctggagggatatgtgtaaggatatagtgagaagtccagaacattgtgcaaagctcacatttccaatatctcttaaacagcctggaccccgagacggagtaatccaatgtttcataaaaagggataaatcaaaactaacataccggctctacttgtcccttagctctggtaagtgtcaagctattgtcttcacttcagagtaacaaagtcaatagtcttttgtttgtttgttgaaactcctgtctgtcccatcagttttc

SEQ ID NO: 30820 - DNA, 588 bp, Sorghum bicolor
  Clone ID: 18060339
gcacgagggtcatattctatagtatagcatggcaaggacgctggcatcacataatcttgcagcaagaactgtggaatacaaaattattcttcttcaagctcatccagcagcctctccccatggatcgatccaaaaattggtccagaaatagacatgcatccctcctcctatatgatctaccactagaagttcataacaagatcatcaatgatcttcttctaatgctggtctgtttacttatccatttctaccttttcctttccatatcttctgctttctttctttctttctatactagctactacctactttactttatctaaaaaaaaagctactacctactttacaatggaccctgttgatagagggcatgcatctctctgctaatttacaatacatcatattcaacaccatatataagcagccaaaaacgattgtagtacgtcacacaagagattgttgcattctagaaccagtaaatcgacaagatgctaattggcccaatgtgtttagatcgcagcaaatactggtagcggacaagacacaactattcttgaatcggttcaatactatgactacgagcatggg

SEQ ID NO: 30821 - DNA, 534 bp, Sorghum bicolor
  unsure (1)..(534): unsure at all n locations
  Clone ID: 18060345
gcacgagggagagagagagagagaggaacagctagctagcgaagaaagaaaattgagatggagctggttgtatccgcagttgtaggtgaacttgttaaccggttcatgtccttcttattcaacaagtacaaaagtgaagagcagttggagaagaaggtgagaatgctgcaagatctagttgttagagctcatatgattgtggaggaggccgaggcgcgatacatcaccaactcaaagatgctgcttcagctcaagaagcttgtggaggtcatgtaccaaggctaccttgtcctggacaccaacaggtacacgactgtaaacgaggtcagcagcagcttcagtgagttgtccgtcaccacttatattaaacgactttttacttgtgtggatcatgagcttcagcctgcactggataatttggaatctcttctttcaaacatgaaagagtttgtatttcttctccatggatgcgaacgcatgttccgcggcccctatgactcgtatctgtacatagacnacttcatgtttggtcgt

SEQ ID NO: 30822 - DNA, 258 bp, Sorghum bicolor
  Clone ID: 18060347
gccggcaagtgaagcaaaagcgctgcgtgggcagatgaaaatttatgacctgacaaaggggcgtcaagtgggtggtctcctggctgagacacgtaaaccagaaaatatcgttgcaagtagttctggagaattcttgggcattgcaaataaaagaaagctccatatatggagcataccaacaaaagatttcaagcctgataagattaggaagataaagctccggcacaccaaaaacttgaccactctggctttccatcc

SEQ ID NO: 30823 - DNA, 474 bp, Sorghum bicolor
  Clone ID: 18060359
gcacgaggagctcgccgagcgcgacgccgaggccgaggacctccgggagcgcgtcgagcagctcgacgccgcgctcgccgtcgccaccggccgcctccgccgcgccgaggaggaaaagcaatgtagctgcgtgatatgtatgctgcgcaatttgggcaaccgaaaattacttaacagtcgaatgcttcttcatgttgtgatccgtggacgatggacgtacaggaggcactgcagcgggacaactctgcgctgtccaacaccgttaccaagttgaacagagatgtcgccaagttggaagttttcagaaagacacttgtgcagtcactccaggaagatgacagcagtgataatactgttcccggggcaagagttgcagcaacttcaaatttctcctctgcaccatcagatgaagattctgcatttccaacttccaaatcatcacagatttcagaaactgcgagttcagtttcagag

SEQ ID NO: 30824 - DNA, 579 bp, Sorghum bicolor
  Clone ID: 18060363
gcacgaggccgtgacagtaaaacgaaagaagggtagtcagacaccccatagtagtgacttggccggttatatgggaactaggaagccatctgttcatttaggtagtgtacttggcttatttaagagcattaccatagaaataaaccatgcagaaaattgctgagtgtaaggtattacctgttcatgcatatgacttttatcatggttttcaaggaatgaaatgaaagcatgatcgccaatctaatcctctttgatggtcttgtcaaagaaacagatacaactttgccctttggaaactaaatactcttagtatagctttagtgcagatagtcagggcagttcctgtgaaaatatgatcttgttgattctgttacagcattattcggtcatcacgaaaaaaagtagtgcagtttgtctctttaatggcttcagtagttcaataagaatacctgatggaaagctggataacattgtcttttgatcattgaagacattttcatgccatttgatgataccgtgcacttagatttcaggaatattgcccctgcttgctgctaaaggaaaagagcctttttagaa

SEQ ID NO: 30825 - DNA, 582 bp, Sorghum bicolor
  Clone ID: 18060369
tggtggacaacacaatcttcaacctcaggctgagcaaaaggaaatccgacatttaactactgaaaaccttgaagcaaaggatgatgattctaaaagtttgaaaagtttggaagctcctcaaggagcacaacctgtgacttctttgctgtcaaagaatggtgtggtcttttctaagaactatctatccaggatcagtgtttcacatgatcttgttgagtcagagttatacaaaaggtgcatatccttgctgggagatttaggcataagaaaagcctcccatttggttaggaatgaacttcaggataatggaaatattgaaaaaatgtctacaaaatatggaagctgcaaccctttcacttcacgttacctcaagggcgacagtgcaatctttcagagagctttggcccttcataagaaccagactcaaaagtgtttaattactgcctctgcatctgtaaaaatggaagagaacatggatgtaccagaagatgaccatgacgaggaaatgcttgaactagtggtgtgcaatcctgctctgcaatgtcacactgatgtcatggcggaaggatcactgtcaaatca

SEQ ID NO: 30826 - DNA, 533 bp, Sorghum bicolor
  Clone ID: 18060383
gcacgagggccgtggccggagatctcacaccagccaatttatcaagctcgctcgccgtcacactgcgccaccagcgggggatcctgccatggcctcctggctcaaggacgccgaagacttgctcgaagtcgtcgaccggagggccaagatcgtcgcaacagaactgtcggatgagcagtctacctctcagccttcaggaccaaacaaccaagaagtgcaggcaaagaagggaaagccgagagagaagggtccattgaagctcactaatgccgatggtggtaacaaggcatctgctcacaaggaaaggaggagtatgcaaccactgcgagagcggatgaagattgagaagatcatgccttcgccgccggcagattcatcaagtgttgatacaagtgctagtgaaccagaagtcactcaggtcaatgttaaggaagtcggtaacgaggttacattggagaaaggggagaaagctactgatgatcttaagactgataagtctgggactgttgttaattccacggttgaagttcaac

SEQ ID NO: 30827 - DNA, 419 bp, Sorghum bicolor
  Clone ID: 18060397
gcacgaggatcgactggtggcattgctggtgcatcctccctcgctgcctcgccatcaatatcagccgggttcaacccttcggcactcctcccgttcctgcaggcgaccaaatggctcccctgcagcgacatagtcactgccacgacgacgtctcgaagttcaggacgcccagcacgtgcgacagccgcgccttcaccgcgcacagctgcaccttcaccgcgcacagctgcaccttcgtcacgtcctgcaccacgggcagccgctctatctccctgtccatcacctgtgccatcacctgctgttgctgctccttccaaggtcggcatacaagcattggttggtagtgctagcatcgcctcaggttcagctgtgattggaaggggggctattgcctctggtgcggctggcatggtgaagaa

SEQ ID NO: 30828 - DNA, 502 bp, Sorghum bicolor
  Clone ID: 18060416
gcacgaggtagcccggctgccggagtgcggctccaccggtggactgctcatcagtgggaaggtccataatatgatggctgcagagttagttaagcagttttcaaacattactctgggagaagataatgagatatgtgatgttaaacaagcgcttaaggccttgagaaagaagattcttggtttggattttgacaactccatgcatgtccatgatccacaggactcatttcagtacttggaagtactgagcaaaatcaaacaactgtctgaaaagttaaggacattagaccctggtggagaagccaaacagctggatgaactcactgtgtatgcatatgacctttctgaaatggcaatggcaagactcgaagaggaatttgtttatcttcttacacattacaaacaaccattagaacaggaggttctctcttttcgctctacagaggatggtagtgcggaagacttttcaagcagctcatttagtgaggaacagtcggaaggg

SEQ ID NO: 30829 - DNA, 464 bp, Sorghum bicolor
  unsure (1)..(464): unsure at all n locations
  Clone ID: 18060430
gcacgaggattttcgtaccacagtcgccatgaatgtcatctgaaacaaaccattgattatctttcagcttttcctaagcatttgccacaacctgaaagctaaaataaattctgagatgaaactgttggagtgaagaacctgaaccttgtagttgtctgcatgcccatctcgtataccttgcctagggacaacttccttgatatctttgtgcttggcctagactctgaatttttggattttgcttttcattagttattaggaatatgagatttcttcctgcagtgtgatcagttattggcttattgtagcagatcgtccgaatctgcagtggtaaagtgcccacaacaacaggtatgtctgtcctttatcttccctttctttttgtgtaaaagcactgaaaangtatatcataagtatatttttctgaagtctgctcgtataggaaagttgcatcatatattttt

SEQ ID NO: 30830 - DNA, 604 bp, Sorghum bicolor
  Clone ID: 18060448
gcacgaggaatcgaaggccattctgttgtttcaaaagattgaaggtgtggatgtttgcctgttcgccatgtatgtacaagagtacggttcggattgcccatcaccaaatcagagacatgtttatcttgcgtatatcgattctgtcaaatatttccggcctgaaatcaaatctgcaagtggagaagctctccgcacctttgtgtatcatgaaattttgattggttatctggactactgcaagaaacgaggatttgtaagctgttccatatgggcttgcccatctacgaagcgtgatgattatgttttatattgtcatccaacagtacaaaagatgcccaagtctgacaagcttcgaagctggtaccagaacttggtcaagaaggccgttaaggagggcgtggttgtggagcgtaatacactctccgatttcttccttcagcctacaaatgagtgcaaggccaatatttcagcagcatgcttgccatattgtgagaatgatttctggcctggagaagcagagaggctccttgagaagaaagatgataatacttcacagaagaaagagacacaggtaggaaggctcttgcgtgttgccaaacgcgat

SEQ ID NO: 30831 - DNA, 455 bp, Sorghum bicolor
  Clone ID: 18060467
gcacgagggtcagtactcatgccaaagaagtttctttaaaaatatgcatataagtcatgcttagcaacttaggctcaatgtaagtcacaacttttacaggctcgattaagttgacacattctaacacactaagagtctatgggtgctaatgtactgatccttttgcagtcatggtacactattgccctcttagagtccttactggctgtatttttacatatacaatctatataaattgaatgaaccttttacagattaatttttttactgacaacagggccttcaaattcgagcaatgatcttcttaaatttttagaaactggactttctaggacatataatgactgctttgtagaagcactaacagcagaagcagagaatgacaagcgcattgtggtagttcatggcggcatgggaatggatcggtcactccgcttattccagtctaggttccc

SEQ ID NO: 30832 - DNA, 453 bp, Sorghum bicolor
  Clone ID: 18060511
gcacgagggctccttctccttgtctggtacattcagaactttcagggcgacggttagaaaaaactaccgtacaatcagcattcccatgtcaaatttggagtgcctctggatatcccagtttcaggtgggaacgcagaccttgcatgaaattctccgcctattttctcacattttaagtcaagattaagacctcccatcagatctgtactgttagaagaggctacaggtaatgattccagaaccagtgaccatttgtttcctcatggagaattatatgctactggcctggcttacctttcatgattaaagattgtttgactggtgcctgtctcgcatgaatcaggctgcctcttctgcgtccatacacttatatgatcatcatcaaagggaggctcttctgtagcatgcagactgcgatgatccacgtcagttagtgtgctggtcagagcctca

SEQ ID NO: 30833 - DNA, 480 bp, Sorghum bicolor
  unsure (1)..(480): unsure at all n locations
  Clone ID: 18060513
gcacgagggtcttcttgcccaggaatatgctctgataaggggcgtacgtggtgacatccagtacatcaacgatgagctcgccagcatgaaggccttccttcttgacctcacccaggatgaccacgataatcggaagaaggactggatgaagcagatccgtgacatggcctatgactgtgaggactgcatagatgactttgcccatcgcctccccaaggattcaaacttttctggcaagtgctgctgcccatggctggccgcactgctttatgacctctggacgtgctggcctcgccatgaaattgcttccaatattgcagagctcaaggtccgggctcaactaatcgcggaccgacgcatgagatacggagtggagagcccaaaaggcagagaaagcaatgactcgtctgatgatgtccctgngtacgacgaaattgctgaagatcagctcccaaggcgtgagatgactatgaaggagcc

SEQ ID NO: 30834 - DNA, 386 bp, Sorghum bicolor
  Clone ID: 18060553
gcacgagggaacaacaacccggagatgcttggggatgagatcgagcttgatattgatgagatggatgttgagacacagtgggagcttgatcgtttcgtaactaacttcaacaaggcgctctagaagtctcagcgagctgcgatgatgaatggtggcgctgctgatgtaaccagtgctgctgaggctgaggatgacactgcacctgtgggcgatgtgcctgcattggttgacaatgatgatgcggagagtgataaacctgtgaagagcactgctatggctgagcaggtggatgaatatgttgatattggggatgacatgcctacagccacttaccaagccatggagatccagaaggatgctgaaggtgtgactggctctggtggttc

SEQ ID NO: 30835 - DNA, 416 bp, Sorghum bicolor
  Clone ID: 18060558
gcacgagggtttggtccatccgcccacaggacaagtatggttagattctctagtatgtcgccaatgagaaacttctgaagatccataggtatataccttgttctgcttgatgaatagggtcggtgcttggaaggctagattccagagagatgggttctaatgtcgaagcctaactttgaacaaaaaagactctattaaattctgtggcccatagttcccgaactaagtatcacactgctgatcatccttactacatgggatggttcataaagttcactaaagtcaatcctgtgcctcacacattccccacttcatgcctgcatatgttattgacattttgttttatttaaggaagcataactgatttcatctctggtgtgacttcttataaatggaatctctggatggtcttgaga

SEQ ID NO: 30836 - DNA, 419 bp, Sorghum bicolor
  Clone ID: 18060582
gcacgaggtgccaagttaacctgcaacgtgttcagatgaaatataagaatgaggcccagcttgttgaggatgggactaccttgtctggcttccagcaaacttctagcagatttgaatcaagtgatgatgattatgcggattcagatgacaccacaactgaacagccatacatacgtccagctgttttccatcctaggttccctgctaacaagctatctgtgatccctccacttcgcataaagcgtgaaagagaacttaaaaggaggcctcagcagaatggctgggtatttaaaagggatcctgaggaaccagtattcttattcacaagaccgcttgatccggagaagttggtcgcagctggtatcaagccaccaccagatcctcctattgagaatggtgccgcatcaccaccatttcgg

SEQ ID NO: 30837 - DNA, 408 bp, Sorghum bicolor
  Clone ID: 18060634
gcacgaggctcaacaacctggctcaaattggaatgtctgttggtgctaatgacacaactattttgttgtgcctctttggcttctgcaactttgttggccgtatccttggtggatctgtctctgaacatttcgtaaggtcaaggatgctccctcgtcctttctggatgatgtgcacacaaataatcatggtggtaacgttcctgctcttcgcaactggccttcatagcttgatttatgtttcaactacactccttgggatctgctacggagtccaatttgctgtcatgataccaacggtctcggagctttttgggctgaaggacttcgggctaatgtacaacttcatgctgttagtgaatccacttggtgcattctttttctcagctcttcttgctggctacatctatg

SEQ ID NO: 30838 - DNA, 528 bp, Sorghum bicolor
  unsure (1)..(528): unsure at all n locations
  Clone ID: 18060674
gcacgaggcagatcatgaatcaacagaatctgatgaggacttctatatgtgtcagatttgcaacactgaggaggacaaaagcttgttgctttattgctctatttgtgcttcacgggttcaccctggttgcctcactccaccttggactgaaattgtgactgatgattggtcatgttatggttgcaaggagaaagtagaaagctacttgaaagaaagagatgcttacttgactgaactctcaaagaggtatgatgctgcattggacaggaagtcaaagattctcgacataatccgctccttggatttacctagtaatcctttagatgatatcatcgatcagcttggtggtcctgacaatgttgcagaaataactggacgacgtggtatgctaataagagcatcagatggaaaaggtgttatttaccaggcgcgaaacacgaaagaagttgcattggacatgatcaatatgcatganaaggagcagttcatggatggagaaaagaatgttgccataatatcagaagcang

SEQ ID NO: 30839 - DNA, 572 bp, Sorghum bicolor
  Clone ID: 18060683
gcacgagggtcgtcgccctaccgctcctgctccagctccagcccccgctccaatctaagccgccgtgggggacgaggacgacgacccggccgctctccctcatggaagaccaatcgcctgaccatatatcagttggttcagcaccaaagaagtctagtacttcctcacgaggccggcaccgtaatttctcatcatcgacatgcaaagattttctccggaagtttgtggacagtgaacttttaacttcaagcctagaggattggttctctggtcacagtgaagattgtggtttcaggaagccagcttttgatgttccttttgaccttacagaattacagaattttgattatgctctggagggtgttacttttcagcagctagtacggatgccaaatgctctatatgcatcgacatcagatgtttttgaagctactgcatatcttgctttagaggattttcttcatgcaggcattaaaggattgtggcaaactttctggggtcctgacgaagcatgccattctcagttgcctgtatacacagcacaggctccaaattttatcctgctgagaagg

SEQ ID NO: 30840 - DNA, 439 bp, Sorghum bicolor
  Clone ID: 18060691
gcacgaggcaatgccccaatggataagatactatgggatgctggtcaacatgcgtatgcgcacaagattctcacaggaaggcgctctcaatttcatactattaaacagaaaaatggcctttccgggttcacgtcgcgttttgagagcgagtatgatccctttggtgctggacatggatgcaatagtctatctgctggccttgggatggcggttgcaagggatataaatgggagaaaaaatcgaatagtgacagtaataagtaattggacaaccatggctggccaggtgtacgaggcaatgggtcatgctggattcctcgattccaacatggtagttattctaaatgatagctgccataccttgcttcctaaagccgatggccggccaaagatgtcagtcaatgccttctctagtgctctcagcaagattcaatccagca

SEQ ID NO: 30841 - DNA, 130 bp, Sorghum bicolor
  Clone ID: 18060701
gcacgaggcttcgctgctcatcggccttgtcctcctccttctgcatgctgcgctgcacaaggtcgacaacgccgccatcgcactaggaggaaatgccggatcttgagtcattgctagagtacaatgaaga

SEQ ID NO: 30842 - DNA, 559 bp, Sorghum bicolor
  Clone ID: 18060703
gcacgagggcacaactcctatttttcgtttgttggaggtataaaagtgtcattgacttcaaaatacaggtgattgatggcattttcaaaggactggtgagtgaggggctgaggacattgtgtttcttaaaatctcaatatttttcccttttaccttggcttttgcagtgagttcttgggagtttggcctatttaggatgagcttacaggttttctaggtccctatgttactttattcttctctgtatgtgtgtatagttttctagaaacatgccaatagggagactgctattattccccttatgcaaggctgctacaaaatttaatattgaatgcgcattactttgctcctctggtaattcctgtttactgaccacataaggatcagcttgaaaatgctctatacactcccttttggctagctaagagaaccacactaatctgctgtgagtcttctgattattgactgaggaaaaatacatggactataattcatttcaaatccatgttgtcataacaatgtatttcaaaaggtttgtagtaattttagtttagtaagg

SEQ ID NO: 30843 - DNA, 533 bp, Sorghum bicolor
  Clone ID: 18060723
gcacgaggccaacgagtttgatgtcagctaagggtgacagtggtgacaaggtagcagataagccggctgctcctctgaacgtgcagatttctcatgacgatgccagcataaaggataattcagttgcaaaaacagatgaaattccagcatctccagccgacaatcagagtatattagtttctctatcctctcgttgtgtttggaaagagactctgtgtgagcgaccacaccttcttcgcataaaatattatggtaactttgacaaacctttaggcaggtttttgcgtgaccagctatttgatcagagcaacctctgccaatcttgtgagctgccaccagaggcccatgtttattgctatgttcacccccaaggcagtttaacaatatcagtaaggaaactttcagtaaagttgcctggtgatggtgaaaatgatggtagaatttggatgtggcatagatgcttacgctgtcctcgagttaatgggctccctccagcaactaaaagagtagtgatgtctgatgctgcctggggc

SEQ ID NO: 30844 - DNA, 457 bp, Sorghum bicolor
  Clone ID: 18060725
gcacgaggggagtacaacaagcacagtggccttgcgcaagaagctcagtccatccagcaggatctgcgcatgatcggtgccgccatggacgaccaactccgcaccctggggaggcaccagcggcctgccatcgcgagggtgtacagcgaagagattcttgatctggcacatgacatcgaggactgcgttgaccgcttcacgcatcgcctcagctgcaagcagaagcgcggcggcagcggagcagcgtcttccttggcgcgtcgggtggctcacggcctgaggaaggttcaaagccgctctagctatgccgacgagatccagaagctcaagaggcggctcaaggaagcgcaccaacgggtcatcaacaactctgttcctcttcctgttggtcagcctcgacctcaacccaacggtggttcgccgccgccgtcgtctatggtgcaggctgctctcgatc

SEQ ID NO: 30845 - DNA, 479 bp, Sorghum bicolor
  Clone ID: 18060779
gcacgaggcagactgtgaatttgtgaacgcacaccccacctagcatatttcatcatgaccttaacattttagcttcaaatccatgccatctgtgagcattgtcttcagtcaaagttaacgctatgcatattattatagaatttcatcagtctcacctctcatggtttaaatttaaccatttacatagaggttggtgacttggtgttgattccgctccagaaggatttaaaggaacttctttgtgatgattaaagttatgcatgtttcatagtttgtttatgcggtagagctgggtaatacttattctgaataggggactcgcttcagtcttgtttttgcatggaacatatgctagtgttttttctcctgaaattgtcataataaaactcactgtagttgctcatatttaggaactacgtgattcccactgagagttgtataattttggttgatttacattcattctcctattgaaccct

SEQ ID NO: 30846 - DNA, 454 bp, Sorghum bicolor
  Clone ID: 18060808
gcacgaggagacatcttaagggggagagggacctgtgggaacgttatgggggagttgatatttctctggatccttgtagctttggccaggctaatactctgtcatttaactctttgttgcataagctgaacaagtatgtaccacgtggttcaacagttgttgatttgtattctggggctggcgttatcggcctatcagttgctgcttcaaggaaatgtaggtcagtgaaatgtgttgagattaacaaacagtcaaagatgtctttcgagacatcagcaagccgacttccagcgaacctgggttgcaccatcacttggcacaatactgacgcttcagttgaacctgttcactggcttgaagggtctagtgtcgttattgtggatcctcccaggaaaggattgcacccatctgttatcagcgctttacagaaagttgctttgtctgagcgcaaggc

SEQ ID NO: 30847 - DNA, 491 bp, Sorghum bicolor
  Clone ID: 18060812
gcacgagggaactcttcaatctagctctgctagcaaaacaagcgtggcgagtcttgcaagagccacggtctttgagtgggcagtttatttccctgatgcagactttcttgaagcagatttggggtcgtccccctcgagagtctggcgttcaataattgacgggcgtgaggttctcaaggaaggcttgatcaggaggataggcacaggacaactaacgtcgatctggacgatgaattggcaaccatcaggttcattacgaagacctattaggagagcacatccaaatccaccacagcgtgtttcagaactcataaaccattcagaggcagtgtggaagatggagttgctgaatcaatgttttactcccatggatgcgaggacgattgccagtataccaatctgtacgaggaatcaggatgatttctgggcgtggcatccagagaagaggggtctgttctcagttcggtctgcatacttcatgttggtccagc

SEQ ID NO: 30848 - DNA, 440 bp, Sorghum bicolor
  Clone ID: 18060848
gcacgaggatcaagttcaaggagggagcctgggtcccaatagtccttgctctgatcttcattttgataatgtgcatctggcactatggcaccattaagaagtatgagtttgacgttcagagcaaggtctccatcaactggctccttggtctcagcccaaacctcggtattgttcgtgtccgtggcattggcctcatccacactgagctcgaaaccggcatcccagctatcttctcgcattttgtcaccaacttaccggcctttcaccaggtactcatatttatgtgcatcaagaacgtgccaataccacatgtacggcctgaagagcggatcctcgttggaaggatcggtccgaagcagtacagaatctaccggtgcattgtcaggtacggataccacgacttccacaaagacgacattgagttctagaaggagctagtg

SEQ ID NO: 30849 - DNA, 587 bp, Sorghum bicolor
  Clone ID: 18060902
gcacgaggccgcggtcgccgcggcggacgcggggggcgacgccggcgaggcggctgcggcggcggtccagaagaacggcggctggttcggcttcatctccgaggccctcgaggtcgtgctcaaggtcctcaaggatggtctctctgcagttcatgtgccatatgcctacgggtttgccatcattctgctcactatcattgttaaggcggtgacgttgcctctaaccaaacagcaggtggagtcgactctggcaatgcagaatttacagccgcagcttaaggcaatccagcagagatatgcgggcaatcaggaaaggatacagctagagactgctcggttatacaagcaagctggtgtcaaccctttagcaggatgttttccaacattggcgacaatacctgtatggattggtctttaccaggcactttcaaatgtagcaaatgaggggctgttcacagaaggatttttctggattccgtcactgggaggtcctacaacaattgcagctcggcaaagtggttctgggatttcgtggctcttcccattgtggatggtcatcctccgctaggctggcatgacaccatatg

SEQ ID NO: 30850 - DNA, 521 bp, Sorghum bicolor
  Clone ID: 18060920
gcacgagggtcatgccagcctgccgccacagattctaccgcccccaatcacctcctttccttcccaatcctcctcgccgggtctctggtactggccaccatgaactcctactccggcgaccgctcctcctgctgccggtggatggggccccaccacgagccgatgggggtcgggtgcccccgcgcgctggtgaatgtggggcgtcgttgcctagccggtggtggtgcggcatcgtcgacatcgttgccttggaccggcagcggtgcttcctccgacgcggcggcgagcaggccacctaaggcttactttggcagcacagccaaggcccttctgatcagtctccaggcgaaggttttgatgagaggtggcatcttgggtgccttccagaccttgtggaggattgatttagcttgaggtgaaatgctcctagatcctgcatctggcagctgaatgatattttgattatacaggtacttgtatatttctttagtagtgcaaactctatttttagctgggttcca

SEQ ID NO: 30851 - DNA, 551 bp, Sorghum bicolor
  Clone ID: 18060930
gcacgaggcaatgtcgaagaaacaggattctgcatggttccaagattccaagcattctgatagatatgctggaaggaatgagtatgcaaaaccataccatggagaacccgggtttaaaaggagaaggtccagaagcagggatcatgatcgagaaagatacggcaggtctatctcaccaccactaagggaagaaaggtataactaccgtgggcgtgattttggcaattatcctccacactactctatggagaaatcaaggaggaagtatgctgaagttgataaacaaaaattgtctgggagtggaggatacattggtgggtcgcaccagaaatatgaaagccgtcttggtggatactcaccgaggaaaaagaaaacatcactgcaagctgagcaggcaactaccaagactccttccaaggtcattcagtccccagaaaagaaatcagccacatgggaccagcctcctgttaaagcaaaccaatctaacttccctaccactttcctgccaactgttggccagatggctcctattccattcagtttcagcacga

SEQ ID NO: 30852 - DNA, 556 bp, Sorghum bicolor
  unsure (1)..(556): unsure at all n locations
  Clone ID: 18060946
gcacgaggaaggagttgtcatccaaactgacagaatcctttgatgaagagctaattacatctgctgtgggtaaactagataaaggtctgagggatgctggtgtctcatatcacaatctttctgggaggcacaagagcctatacagtatccattccaagatgctaaagaagaacttgacaatggaggagatccatgatatacatggcctgcgtctcgtggttgacaccgtagaagattgttatgaagccctttgtgtggttcataaattgtggcctcgagttactggtcgattcaaggattacatatcacgtccaaaactaaatgggtatcgatcactgcacactgttgtcatgagtgaaggcgtccacccattcgaagttcagatccgcacaaaggagatgcatcttcaggctgagtatggatttgctgcacactggaggtacaaggaaggcacttgtaggcactcattcgtgctccaaatggtggaatgggcaagatgggtccttacatggcaatgcgaagcgatgaacaaagaacggactgcctccctangcaa

SEQ ID NO: 30853 - DNA, 533 bp, Sorghum bicolor
  Clone ID: 18060948
gcacgaggggggatccaatcattaactctgtttcctcttcttcatcacccgctggttctagtaaacagattgaagtgtccaactctggtagtgcattaagcatggctgaaacagtgatgcagtcgccgttaaagatttctaccacacctcagttatcaattgatgctcagaagattgaagaaagaactatgaggcagtgcattctaagaccccttacaccatcatcaaacaaaatatctgcatctaattctttggataagttattaaaatccaaaggtgcaagagctggagagtccaatggtccgatcaaggttgctccacaactgtcaatacagccatctagcagctctgttcgcactccagccaaaactgagctcgtaaagcaatctcaatcaggcagccttcaagtccttagtcgtgagcagaatggtactgtaaatactgctgccaaagacagcaccagcaatcccgtgagccctgttctgggtcgatcttcttcaatggaacctatgagagagtctattgtcaaccca

SEQ ID NO: 30854 - DNA, 587 bp, Sorghum bicolor
  Clone ID: 18060958
gcacgaggcagaaaggtggacagcgactgcctggcctcagtcccgtcacatgcccaggaacattctcagtccgccatgccggaggatttgggccaagtgaactgtgatctggtgggcacgcaggaatccagcaccttgcctccactgatgggtgagtcctctggcaatcttgcacagcaagagcagcagcagcaccaggaaggtgtttctagtggcagcgatgcagatgctgcttctcctgcccatacttctactccggagaaggtggagcccacatctcggaggtgggggaagaagtcgaccaagggggttcagcggctcaaagtggccaaagataaagtgatgaagcccaaggtgaccacgcccagtacagtcaagaagaataagaagatgccggaggatggtaatcaacgtgttcgtgctgccaggtctaatagtgcaagacgcaagttggatttggattcatcagaaagtaaaacatgtttcagcagagccgagctgatgggtaacttgaagtcccttgccaagattcatggtttggacagtgaaccgactacgcgcaagaggagcaagagagggaagaagag

SEQ ID NO: 30855 - DNA, 616 bp, Sorghum bicolor
  unsure (1)..(616): unsure at all n locations
  Clone ID: 18060975
gcacgaggagaatatcttaatggacctgcttgtgaggctatccatctaactgacattcagtcgagcattgagtgtgacactttcatccctccagttgacttctcagtgttccagccatgggagacatctttcccagtggtagagagcaacattaggcattcttttgtgactgagggtcgtgttagaaagtcagtggcagaaactcatgagtcaaatggcaaggaatcaactgaggttgataccaagaatgacaaatttgaaatagagaatttctcttttctccccgagatggtatatgaccgccatgaggagtatcaatatctcaatcttgttgaagatattataagatctggtgctcagaaaaatgacaggacaggaactggaacaatgtcaaaatttggatgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcacatctgggatggcaatgcttcaagagagtatcttgacagtgttggcttggcaccagggaggaaggtgatctang

SEQ ID NO: 30856 - DNA, 562 bp, Sorghum bicolor
  Clone ID: 18060976
gcacgaggggtgattgaaatatcggacaagcccaggcaaagagaagctgaaccagcattcaagttcattggaaatgttcatggtgacgagcctgttggcagagaggttcttatacatcttgcaaattggctgtgtgataactatctgaaggattcattgatggcgtggtaatgcaaacaatattgatctcaacagggattttcctgaccaattcttctccgttaacaacgatattgactacagacagcctgaaactagagccatcatgaattgggtaaagcaagaacacttcacagcttctgctagcttgcatgggggggctcttgttgccaactatccatgggatggaaccagagacacaatcaaacattactatggatgtcctgatgataagacattccggcacatggcatctgtgtatagtcggtcccactacaacatgtctttgagcaaagaatttgaaggagggataacaaatggagcattctggtatccaatatatggtggtatgcaagactggaactatatacatggaggctgctttgagttaactctggagatt

SEQ ID NO: 30857 - DNA, 561 bp, Sorghum bicolor
  Clone ID: 18060984
gcacgaggaaacatctcatctgggatgaaatttatgctgcattatttcctgacaagaagaggcgtgatgaaatgaagaatgggaccatccttaatcctgcgtctgctgaggctggtaaggacacaaggaaaggtctcactcaggaggagttagccaggatagttagtcattgctacaatgacatgcctgcagagatcatcacctgctccctgtatttgggtatatttcccaagggcagcagaattagcaggaagcgactcataagacgatggatagctgaaggctttgttagcgagaaggatgggatgagcgtggaggatgttgctgagacgtactttggtcatctggtaaggaggaaaatgatacgaccagtggagcacagtagcagcggcaggatcaagcaatgtgtagttcatgacatggttcttgagcacattgtatccaaggcaagtgaagagaatttcatcactgtggttggcggccactggcttaagaacacaccaagcagcaaggttcgtcggctgtccctccaagggagtgatcccaagcgtgcaaaggaca

SEQ ID NO: 30858 - DNA, 493 bp, Sorghum bicolor
  unsure (1)..(493): unsure at all n locations
  Clone ID: 18060991
gcacgagggtcctgtactatctatcatggtttttctcttcggcttctactcctatgctggcaaaaatgatgcccttcacagaaacagctatttctatagctaatgatacattgaagagcgcacttaatgttgtgaagaatttttcttccgacagtaataatgaaggtgttattgggcatgtgattgaggttgttactcaatccttgaagataaatgccactggtcttagtgtaattcaaggcactgggaagagcagtctgatgaaaggaacaacaattggctcatcttatctttcagatttgacaactcttgctgttggatacatgttcatcttctgtctggtatttttgtacattggatcactggccttacttcgatatgccaggggagaacgtttcaccattggaagactctatggtatagctactatattagaggccatcccttctctatgcaggcagntctttgctggaatgaagcaccttatgactat

SEQ ID NO: 30859 - DNA, 565 bp, Sorghum bicolor
  Clone ID: 18061001
gcacgagggccacgaggagggaacttgtcgacgacgaggaggacgaggaagatgaggctcttaagttgggagtggagaagaatggtggcgagacgggaggtgtggatggctcctacctcagtgagacacggtttgatcaatgtgctatttcccctttatcgttgaaagctgtcaaagatgctggatatgaaaggatgactgaggtgcaggcggcaactctgcccataattcttcaaggcaaggatgttcttgcaaaggcaaagacaggaactgggaaaacagttgcttttttgcttccagcgattgaggttctctccactctacctcgtgagcggaatcagttacggccacctataaatttgctggtgatgtgccctactagggagcttgcgaaccaagtggctgttgaggccaggaagcttctcaggtatcatcgctcgttgggtgtgcaggttgtaattggtggcacacgattaactcaagaacaacgaagcatgcaagctaacccatgtcagattcttgttgctacaccaggaaggctgaaggatcatcttgagaaccacct

SEQ ID NO: 30860 - DNA, 596 bp, Sorghum bicolor
  Clone ID: 18061007
gcacgagggtttgtttctttgatgttcaggatgaagaatcatcatcccacatatttgatgataccgatgcatctgccactatccaaaccaatagcgttagccaaccaacatctgattacctatcagatagacccttgtccaatgatgaaaacaggttggacagaaagctgagcaaagagagtaatgaaaaaatggataacaggaagttgcaacctgagagtaatttatctgatggtgccagacctcttatttctgaaggtgagtagtaaatttatttaagcatcaattggaaatttcatgtacttgtagacttggtgactcattttccatttatcttgatcatttggatgtatgtcagctctccttttctttgtgtgtaagcattgtttcttggatcattgttgttgttttgtcctctttgctatttatcaattgtatgaagataagattctaaattgatggtttcattacctacattacatttatggattgttcctgtgccatgtgtgtgtgttttacatgcaccattacatttattgattttttttaaacttcacgacatgttggatcaactgtatctaatcttatggggggta

SEQ ID NO: 30861 - DNA, 535 bp, Sorghum bicolor
  Clone ID: 18061017
gcacgaggccgacccagagcagcgccgccctctttatctctctcggcagtgaaggcagcgtgacggcccagcacagcagagcggcaccttcttggcttcttcaacctcccgtcatcgccgccgcatcggacctacacttcgacggacgccgtcgccggccggagaacaggggtactggtggtgctcgccggaggggacctagggcggcttcccgagctcgccttataggtcggtccgcttctggcagcgtcactctccgctcgccgccccgccccgcgccgccgctcctctacctcttcctggtggattgattattgtgaatttatccccgtccctatccatctgtccatggtccgcgtgaactcgtcttcctcggcgcccggggtcaatctgacagagcaaaccgagaatgtttttgagcaactgatcagcaagatagaacctgcagattttgatccgcggccctttttgaaacaattgaacgtgttaggccgctacgaaccaatcaagcggaatgtatattgcactaagagac

SEQ ID NO: 30862 - DNA, 510 bp, Sorghum bicolor
  Clone ID: 18061055
gcacgagggatcgttcggggagctcttcctcgctgtgaatgtgcagactggagaggaggtcgccgtcaagctggaaaatgtcaagacaaagcacccgcagcttcattatgagtcgaagctatacatgcttctccaaggaggaactggcattccacacctgaagtggttcggtgttgagggggagtataatgtgatggtgattgatcttcttggccctagccttgaggacttgttcaactattgcagtaggaagttctctctgaagactgtgctcatgcttgctgatcaaatgattaatcgggttgagtacatgcatcaaaaggggtttcttcatcgtgatataaagcctgataatttccttatggggcttggtaggaaagccaatcaggtatatataatagactatggacttgcgaagaaatatagggaccttcaaactcataagcacatcccatacagagagaacaagaacctcactggaactgcacgatatgcaagtgtcaataccca

SEQ ID NO: 30863 - DNA, 566 bp, Sorghum bicolor
  Clone ID: 18061095
gcacgagggtcatatgcacataccctcttgatctagtccgcacaaaattggcttatcaggtaaaaggtgcagtgaatgtgggtttcagagaatctaagccctctgaacaggtttataaagggatcatggattgtgtcaaaacaatatacagacaaaatggattgaaaggcatataccgtggcatggctccttcactatatggaatcttcccttactctggtcttaaattctacttctacgagaagatgaagagccacgttcctgaagagcacagaaaagatatcatagcaaagcttggttgtggatcagttgcaggtttgctaggtcagacaataacataccccctagatgttgttaggcggcaaatgcaggttcaagccctttcatcatccagcctcgtaggtagaggaacatttgaaagcctggttatgatagcgaaacagcaaggttggcgacaactattctcaggattatctatcaactatttaaaggtgagatatttccttaagttcatttagttgttttttctttctaaaatggattttttttggctgctagacaaatgt

SEQ ID NO: 30864 - DNA, 575 bp, Sorghum bicolor
  unsure (1)..(575): unsure at all n locations
  Clone ID: 18061123
gcacgagggaaaggcatgaggtttcattgattccttctgcacaggatacagttcaagagaaaatagttatcctcagtagttctgagactgtggagggttcactagatgcagttcaagagaagctagtcattctcagcagttctgagactgtggagagctcatatgctgtgtcgtgtattgtggatgacacagttcatgatgcttatgatatttcacaggctgacagtgtacaacatgaggagcactctggtatctctgatgggagcacagaaaagctagtttctgaggaaagttctttagtatactgtggtgctcccagcaacaaaaaggacttggttaatgtatctgttcaagaatgtgaagcttttatcttagaaaatcctgctccccaaatcttggaagagaatggtccagatatggatgtatctaccgacagtgtttccctttcccatgcagatgcagctcatgatttagcttgtcagcatgtttcttctagtgttgtagagacaccaagttatgagcctgacattggtcctgaagatgtaacanagaactcaattgtggaaaatgaagca

SEQ ID NO: 30865 - DNA, 596 bp, Sorghum bicolor
  unsure (1)..(596): unsure at all n locations
  Clone ID: 18061137
gcacgaggctgcacccagcagaggatggttttacgtggacagggtgattcacctgttagaatttgtgatccttgcaaaaagcttgaggaagcagcacgccatgagttgagatatgggcacaaaaatagagctacaagagctaccaaatctggttcgaaaccagaggatgatattctaagtgaaattcttggaggtggagagcatatccaatctctggattctgagcttcctgggagaaccacaagcaatgccagtacctccagaagaacttcttctaatttcagtgcagactcaaatggagatgaaagcctttctgccgaagcacacaattatgaactcaacaatactgcatctatttttaccccagaggagttgcgccaacaagctgtagaagagaagaaaaggtacaaaactttaaaatcagaaggtaaaccagaggaagcactgcgggcgttcaagcatggtaaagaacttgagaggcaagctgcagcgctggaattagagttgagaaggagtaggagaatggctacaanagcacctaatgtctctgctgctgttggtacttcgactactgctggttctgatgaggccgaaac

SEQ ID NO: 30866 - DNA, 620 bp, Sorghum bicolor
  Clone ID: 18061142
gcacgaggggcatttatgctacaggtaggttcttaaggtggatactaagaaaaatcttctataaaatgtgtctgatgttgcctgttggtaaggtttattttggccctggtttattgcttccatcatatggattgtgaatatgtgtccattttgtcctttgggcagtggtaaagtggccatcttgataagatttatttttgccccgatttacttctgccatcatatggattgtgaacttatgtccatttcacagtttgggcagtggtagaatggccatattggtaacgtttcatcatccatctctataatagtggacttgtttgaagtgttagggtgcacattagtattaaaaaactcgaccaacctaagaggcaataggtggcattgtgttataaggagaaataggtacacacattcgagtaaaaaatgaccgaacctcagtgctagagatgtacacccatatcttgtaccagctgagctaggtcagttcgaacactgcggttattagcttcagtgcttcaatggctatattgtccactgaagtttatgttactactaactctttaataagagcaacttagaacaatataatttctttgaatttctccttttcttatttg

SEQ ID NO: 30867 - DNA, 541 bp, Sorghum bicolor
  Clone ID: 18061174
cacgagggttcttttctagcaagggtatttgctgctaggtttgctaaaatcctgaaatgaagtgtctgcttttcccaaatagtattttcattctaatttacttaattagctgaaggtgtccatctagagtttactaactgatagtgtacataatcagtatttaatcttctagcttttgccaggacatgttttgtatttgttgtctgcacatctacagtggttgtgctaaataatgaaattattatgattttttcctgccatggaacatgaaggactaaatggctactgatttttagatcttattttgggcacgtcaagtttggtagaagggcaggagaaagaatgacgattatgttatgaatgtttaggtactaaactcatagaagggcaggagaaagaatgactcatgctgacatgtatatttgcactagcctactcagtgctaatgttttgtttgaaatatagtggtcgagaaagtcgcagattctctatgaggtagcacatggagacgaggatggcaccgcggccacaggcgacgagg

SEQ ID NO: 30868 - DNA, 480 bp, Sorghum bicolor
  Clone ID: 18061213
gcacgaggggatggatttcattgcctcaaggtgttttcgtatcacggtgcattagggctgcagtttgaagaaggagccatgccacagctccggaggctttgcctagaccttgatgcccgggatgaaatgcccgaattagaatctttggaatttggcatccagcatctcacttgtctagtgcaggtccgtgcaactattcactgcaaggatactttgacagcttcagaggtggaggcagcagaggcccacatcagaggccaagtatctctgaaccccaacaatcgggtattcgaattgaacagaagagtgcagcgctctgctgcgaaggcagccgaagcgccggtgatcgccatccagagcctggatgagtggagcagccaggtctgccccgacaagctggtggtggttttcttcactgcgagctggtgcagaccgtcccacaggatggatccagtttttgctgatctcgccaagaagaac

SEQ ID NO: 30869 - DNA, 514 bp, Sorghum bicolor
  Clone ID: 18061215
gcacgaggtggaagactgcagattgataaatcaatgatggatgaattgaaagaagtgaagaaggctgttaatcctacagaagttctgcttgtcgttgatgccatgactggccaagaagctgcagcactagtcaccaccttcaatattgagattggtatcactggtgctatattgactaaattggatggtgactccaggggcggagccgcactaagtgttaaagaggtctctgggaagcccatcaagtttgttgggcgtggggaacgattggaggaccttgagcttttctaccctgatcgcatggcacagcgagtattgggaatgggagatgtactctcatttgttgaaaagacacaagaagttatgcggcaagaagaggctgtagaattacagaaaaagatcatgagtgcaaaattcgacttcaacgacttcttaaaacaatctcaaaatgttgcgaaaatgggttccatgagccgcattattggaatgatgccaggcatgaacaagataactc

SEQ ID NO: 30870 - DNA, 620 bp, Sorghum bicolor
  Clone ID: 18061288
gcacgaggattacttagtggaggagatggctgtgactattatatgagaaagtatgggagcatcagcaaaaacatattggtcagcaaaggcatgattctgcaaaatcaaagacttcttctgacaagttgacagcagaaaatcgtgggaaaattcttggtgaaaggccccttgatagaactactaaactacatagcccatctctttctgcgaaggacgctgttcaactgcaatctaatcttattgacacatttgtcaagccaatatcccttgatggcctaccagagtctgagaagccttttagcaatgatcttgccaaacaagttaggtttgagcaatttcttagagataaatataagggaggtcttcgtgctgcaaatgttacacctacaagtactatgtcagaagctgatcgtgctcgagaaaggcttgattttgaggctgctgcagaggcaattgaaaagggcaagggaaaaaaggttattgatccttcgtcagtgttctctttgcctggaatgaatgagcaacgttttgtagcggcaactcaaccagagagctctgtagtgatacaagatgagaagcccatctatccacaaagggaacagtttgaatggcggccttca

SEQ ID NO: 30871 - DNA, 549 bp, Sorghum bicolor
  Clone ID: 18061291
gcacgaggcccaaatattttctttcctcgtttcatcatactataaagcatacacctacagccctcaaacgtgtcttagaatgctagagatggtctgcttgatctaagttttgctgcaatgttacggatgatgacttaataagcttttataaagttatgtctatttcttctattaacattgaaatattttgagtttttttggatatttttttatatcatcagaaatatggtttgacccaatttttactgcctacatttatttaattgtgctacaataataatattttgcaatctttgtgctgaactaaataatcatgcgatatatttgcactttgcaagatcagtgtgcagtttgatattgcatactctgaaaaagaatagtctccaagttagtttatatgcttaatgtattcatatatctattttctaatgttatattgtatatattttgtatttatatatgtatactctgctgaattattgattgaattctagtgaatgtgtgactcaggtgtgtgacaactgttgggagcatatcctttgaaatggt

SEQ ID NO: 30872 - DNA, 596 bp, Sorghum bicolor
  Clone ID: 18061298
gcacgaggtcagtgtatgttgcgtgatttgcttgttctgccctctcgcccagcaagcgtatacacgtctgcttctattgttttgggttaaatagaaccctctttggggtgatttgtgatttaatctttggtgtgccgctgattatgcattttgatgccggtgtcactgactcacactggttagtgttgattacgcatttctgatgccaaatgtcggtgtgactcactagctagtgttatctagccacgacttctgatttgcctaatttctgctgttttgaggtattaggcattataattgtaatttatccgcttgaagactcctggttttgccaccgttgctgctatgtctgtagattaaagtttccgattctctgttttaatgcagttgtcataccttcctaattgatttgttctaattttttttattcctataaacatttggcaatgctcctgcttttcttaaaaagagctgtgatatcctgttaggttgcttgccattttgattgcccgctgatgactaatgtccacataatcaaactgtcagcaactacaggactatgttcttttctaggtacatagcttttgctaggcacc

SEQ ID NO: 30873 - DNA, 537 bp, Sorghum bicolor
  Clone ID: 18061321
gcacgaggcttgttttaggacaacttttgaatagactaagctagctgcgtctcagtttaacgatctgtccagaaaattaattccagagttggtatgtaaataagttttcgactggttcggcctgcaggtgctactagtttaaagtttaaactagtcccctctgtccaaagtttgatgaacatatataaggcccaaaaggttttgagaattgataaacacgtgatgcttagcaactactacacacctgggtgctagttttactctggtcatcaataaggcgctatgctgatcatagatggacagaaggagtaaaacagaagtaaaagtttgttgttattctatccacattcgcttgattggtaatcaaaatttagatctccagtctttgcttcagagtttttggtctgcaacttgtgatttttctactacttatttcttattacgttcatagctggtgtgagcacattgtttagctgacgctcatcagacctctaggttcctggcttgtgccgagataaatttgtttgactgttgttc

SEQ ID NO: 30874 - DNA, 584 bp, Sorghum bicolor
  unsure (1)..(584): unsure at all n locations
  Clone ID: 18061404
gcacgaggggtgtgtgtacctgagccacacaagcggccagcgccgcccagcgtgaagagataacgcaccggcaccgcagcgcagagcgcagagagagaagaacaaccttgacaaccgcaatacccaattaccaatggcaccattgttgacctcggttcactgcagcagcagctaccctcacccgtcgccacgacgcatcacgccttctccggtctccgcaacaacaccgccggtgctcaggcggacgaggacgaggacgaggaggcagctgcagcgatgcttctgctcccagtacgccggcaaacggcagccgccgccggagccggactcgccgcagcagatggagcgcctcttctccaacctcaacaaggccaccatgaagcacgagcctgggagcgtcaccagtgccatcttcctcgtggctggcacaacggttggggcaggtatccttgcaatccctgcagtcactcaagaagctgggttcttggcctcggcagttatatgcattctctgctggttatacatggttgtgacagggctgttagttgctgaagtaaacgtcaacacgatgtgtgagctangat

SEQ ID NO: 30875 - DNA, 600 bp, Sorghum bicolor
  Clone ID: 18061414
gcacgaggggcaattcaggttcaggcacgtcgtcgagctgtggatgcatggagacattctctctgacgtcgcctcgggattgggggcttagtgatctgacaggagggtgtgcaagaagaactcccttggactgcaaaggtagcaccaacagaagcagttcatcatcaggttcgacagatgtgttccaccctatagctcaagtggcgttgccctataatccccggggaatagaaggcgccgccgcacaaagcgattgcgcagaagcttgccttggggattgcaattgcactgcttattcctatagcaataatggtaaatgctctgtctggcatggggacctgcttagcgtaaacaaggccgacaacaattctattagctctcaagatgttctttaccttcgccttgccaaaagtgattttcagagtttgaacaaaaccaacaagaaaacaccagctgttgctattgctgcaagtgctgttggttctggattactagtgctcatgctagtgtttctgatttggaggaatagattcaggtggtgcaatgctcacagcatccaagatggtggtggtggaattatagcctttaaatacactgatt

SEQ ID NO: 30876 - DNA, 569 bp, Sorghum bicolor
  Clone ID: 18061426
gcacgaggcagtaattgatgctggagatggcgtgcatgtgtcttcaggtgcatcaacaaatgccgttgctgaagatgaaggagcaggtgatacattgagttaaaatttcagttttagtttcaggttcaggtttagttaaatttagttgcagcaattaggatcaagttcaggtttagttcaatttagtagtcttagtacactctaattggtaaaggttcaggttcaatttagcaatcaggttcaggttcagttatctttttaagtctatttagttgcacagaccaatattaacaattaggttcaggttcaggtactgtagtctgtagattgtccctggaatttgagtactgattctgattgctcgtagcagagtatgagaacaaacattggagtatatgatgagcttccttttttcaaaaaggaaatgcagttttaatcattttaggaaatgcaactttaattattattttactgtagtctgtagattgtccctggaatttcagtgattgttcctcgttctcccaaataatgttgatgggctgtccaacaataatttctttttttagagg

SEQ ID NO: 30877 - DNA, 600 bp, Sorghum bicolor
  Clone ID: 18061447
gcacgaggctcagcacactcctttttcattcctcctcgatggttctttctcaccgccgcttcctagagccaatcaatcttgacctgtgttagagctaattccaggtattggtgctcgtttggccctgagaattatggggagggaggaacaatcttgcctagcagaaagtacaggctcaacacgaggaaccgtgccgcgcgcccgcagtccatgcgtggctgtacctgccattttaccgtcaagaggctctatgcccgcccttccttgttgctcatcatctaccacgagaggcgccatgtcaacaagtccggcttcatatgccacgggcccctcgacagggatgccatcgggcctggcgctaggaaaatgccctacattgggagtgaaatccagcagcagaccatgtcattgatctacctcggtgtcccagaagagaacatactgcagacacatatagaaggcatacagcgctactgtagtgcagatgcccaggttgataaccttgcttcgcagtatgtccagaaactagggatgatcatcaagagatcgacacatgagttggatctggatgaccaagctagcatcaggatgtgggttgac

SEQ ID NO: 30878 - DNA, 578 bp, Sorghum bicolor
  Clone ID: 18061463
gcacgagggttcattgcaggctactgagattggaagagccgttaatcggctgcggaaacacaactcacaagagattcggcaccttgtgcgcactctcattgaaggttggaaagttttggttgatgaatgggtcagtactacaaatgctgccctggcagagaactcccctggctcttcaaatccttccgttgtggatgaagaagaagaagaagggcttccttctccacctttagacgaaggggccttctttgctacccagaccacttctattcaactctctgagttttttgatgaaatggatgaagatggaaatttgagacataataatgacatgagccttggaagcaagaggggtaataatggtgggagacttgcaaaccattcagcagttgcaaggcaagagcctcctcgttcttctcctggagttgtcgaaaaagttcaatccaggaggccggaattggcaaggcaagagccaccaatgaggcaagcaatcccacaaaaccccccaagttcaagtatgcatgccaaacctcatgacgtgctcaacaagcaatctaatccctcaagttatgaatctg

SEQ ID NO: 30879 - DNA, 567 bp, Sorghum bicolor
  Clone ID: 18061473
gcacgaggccccactgctggcccgccgtgccgcgcccctcggccatctccatgtcgcctcgcggccccgcgccggcggccctccccagcgcggccccctcccagcgccgcacccacctcccagcgccgattgcaaaccctagttgtgagttgtcaactcccttcaccacctctcggacggcgccgcccccagccattcctctctcggttccaaatctcacgaacggtgactcctctctctcagacaacatgagcttgcaggggcgagccccttcggcggcgtgcaggtagggcgtggctcctccggctaggcgtgcgggtcaaggctctggtagggcgtggaccctccggctgcagcacgggtcaggggctccggcagtgcgtgcggcttaggggcaagctcctccggcggcgcatgagcatggcgcagcccctccggcagtgcgtgcgggtcaggggctccggcagcgcgtaggccttcgagtggctcagggacgagcccttcgagcggcgcgtggcagggtgcagcccctccggcagtggtggtgccggccattagctagttatg

SEQ ID NO: 30880 - DNA, 529 bp, Sorghum bicolor
  Clone ID: 18061489
gcacgaggatctcattcttacgagaaagagagagggttcgcatagagagaacaaaattagtaaaggaaacccgcgcttggggaaggtgaggtgaactaacaattccttctgtcgtgtatcctcgattgatgtggcctcagatgcttcaattgtagatttgagtattgagcgaaaggttacacctacaggataggttctgtattacaggccaatccgactctactagtaccaataggcagcataggggagaaaagcactacaccacgaaataggaatcaacaagagaaaaactttgttagaaattagccctttcctgattggtatcagggttgggaagaatggttgggataacaaacaaccatcaggtttgtactttggatacccttataaccatcaaaggtcgttgaagtggctaattcctctaaataggaggcgttgagaacaaagaaattcttggagctatcgttttcctctagcattaatataattcattggtgttaagaagaacctcttgggggaaggttggcta

SEQ ID NO: 30881 - DNA, 597 bp, Sorghum bicolor
  Clone ID: 18061535
gcacgaggcttccattgtatcttgttgtataccctaatcacaactcaaatgtgtcaagccagcttcacttgtatagtgttttctccttgttttgtatccttcagccatgatacttggtcatcagttgaaccttgtgcattgctaatttttcaaggcacacaagggaaactgattttctgtcaggattctattttactatcttactgcttaaatcttttgtaaggatgttcaacatagttacacaggattatggattcaaagcagatctatgcttcacataattcgtttggaaaacagcatgtaattgcaatccacagaaatatacagacatgtttaagttttgaagcttactggattacagcccattctttattaactcagtgttagtgatggtagaattctgagatagcttctgaatatgtacaggtgtctcagaagatgctgtttctggtcatatacaactgctggttcctggtgaaactgcatgttttgcatgtgctcctccattggtatgttttgcatggttcctggttcttgtttaatggtgtgcagtgtgctcttgtgattttgatacttttggattgtggatgtgtgttt

SEQ ID NO: 30882 - DNA, 563 bp, Sorghum bicolor
  Clone ID: 18061564
gcacgaggcttggttggcttaaaatatactcctctatttgattttttcatcgaacttcaagagacggcttttagagtgattgcggataactatgtcatggatgatagtggaactggtgttggggattgtgctcctgcttttggtgaagacgatcatcgtgtttgccttgctggagggataattgagactgctggacttgttgttgctgttgatgacgatggatgctttattgaaaaaatatctgattttaaagggcgatatgtcaaggaagctgacaaggatatcatcagtgctgttaaggataaaggaagacttgttagtaaaggaagtattgagcactcttatccattttgttggcgatcgggtactcctcttatttatcgggctgttccaagctggtttgttaaggttgagaagattaaggaccagttgctggaatgtaacaaggagacctactgggtgcctgactttgttaaggaaaaaagatttcacaactggcttgaaggtgctcgtgattgggctgttagcagaactagattttggggtactccacttccactgtg

SEQ ID NO: 30883 - DNA, 573 bp, Sorghum bicolor
  Clone ID: 18061566
gcacgaggctcttcccatgcagaaaagaagactgcaggattcagttcgtactgatgatgccagcgaaaccatttctgggcgatcatcacctaggtctgagtcatcgacaactgaattaatggttggacagagcgcagtttcatctgttgaagggaaccatggctgtcaagggctctgtaactctagaacacatcttgctcagatgctcagggttgtaaatgatgcttataaagttcaggttgctgcagatgttctccttgctgctggttatccgatttctgatcttgagacatttatatactctgcaactcccgttattggtcgtgcaccttgcatgataagcagcacttgttcatgggaccaagtagttagcaactctgtttgtcagcatgacatctctaatgtttctttaaggagaatatgggagtggtatgaagagccagggtgctatggattggaagtaaaagctcttagcaatctcagctcgaaaacatcttgcaacagcagttcagagttctttgcatactttgtaccttatctatctgctattcagttgtttgggtggtctaggaa

SEQ ID NO: 30884 - DNA, 542 bp, Sorghum bicolor
  Clone ID: 18061597
gcacgaggcttgattaggctaaccctaggagggtagcaatatagtataacatacatgggcctcatgggcctagccacatgcactcctatactccaacattgccgtcctcacctgtgagaaattacctcaacagggacaccatttagtagcacctgtgttgatgaagatgctagaagtccactaatgatgtcgcaccaaataacaccaaaacccatcttcctcaggacttctaggaggaatggccaggacaccgaatcaaaaggtttcatgatatccagtttaaggagaatctggggctgtttctgctggtggagtaaccttgccatctgttggacaagcatgaagttgtcctggatgaatctcttttttatgaaggcacttagactacttgagaccatctggtcaagatgagaagccagcctatttgcaaggatttttgtgatcaatttagcaaaactatgcaccaggcttataggaccaaaatccttgacactccttgtctcatcccttttgggcagcaaggtaatataagctgtattagg

SEQ ID NO: 30885 - DNA, 633 bp, Sorghum bicolor
  Clone ID: 18061601
gcacgagggctatcttgggcattttgagatactctgctgtcaaagaagcttttcatattgctccttcccactttaagacaacacttacttttagcttagcagaaaagcttccaaaaggagacatggtcttagaagccctgtataataactatttccaactcctggactcttcattgagacatttggcaattgattctgcagtcgataaaatgtcagagaaccattctgtaccattttctttgtatgctctctctagaatgggttttcttctgctgaagacaaaagatgaaactgaaaaggaaatgagcttttgtgctgtttgctttggtgtaacaaaatatctgcaggctgccctgaaagagtcaatttgttactctgagagaatagagtcagcacgtgctacagtcgatcaagtaaaggtggaaggcattgatgtaaatcttgccctcatgcaggagttacttttccctttcattcaagtaggcaagattgtttactctctcagccaatgggaagatccttttaaatcacttctattcttagcttttatgctgtatgttattcaaaggggtctggtcagttacattgtgccctttgttttcttaacttttgctattatcatgatttggcata

SEQ ID NO: 30886 - DNA, 618 bp, Sorghum bicolor
  unsure (1)..(618): unsure at all n locations
  Clone ID: 18061605
gcacgaggatttttaaagcggatggcaacccaacctgtctgagatcaaggtggcaattagaggcttatcttaaccaacaagctgatattcttgagaaggatcctggctcagtgcctttgaattcatttaatgccactatgacacagcttcaaacattagctcctgagcttcatcgtgtccaattcttgcagtacttgaatgccctttgccatgatgactatgttgcttcactggataatcttcaccgctactttgactacagtgcagggatgcaaggactttttggtcgttctgtggctcaggtgcaagatattgttgttggaaagtatgagagtgctctgctatgcttaggcaacttgcattgttactttggacatcctaagaaagccctagaggcgtttgcagaagcagtccgtgtttctcaaatgaataatgatgattcatgccttgcctatgtattaggagccatttccaatctattatcaaagataggcatctcanacacagttggaataatcacttctccatattcacttgggaccaatattggactgggcacaccattatccattcagcaacagttacttgttcttttaaaacgatcactcaagagagctg

SEQ ID NO: 30887 - DNA, 613 bp, Sorghum bicolor
  Clone ID: 18061623
gcacgaggctgacatctatgccgaggtacctgggagaagagaaggctatgtcatgaagctcctctccgtcgacccgtcaaactacgacgacgcgcccatcgaagggatccggaggatcctggaggagttctccggagagaggatcccccggtcggccaagatccccaccggcaagatcgagtggatcaggatgggcaccacggtcgccaccaacgccctcctggagaggaagggcgaaaggattgcgctttgtgtgacgagggggtttagggatttgctccagattggcaaccaggctcgcccgaacatattcgacctcaaggtctcaaagccgtcgaatctttatgaggaggtggttgagatcgacgaacgagttgagctcgttcgggatggtgacagcgacagggatgggtcatctgttgaaggaatctctggggaactggtgagggtggcaaagcctgttgatgttgaagcattgaagcctctgttgaaaggtctgcttgacaaggggataagatgcttggcagtggtgttgatgcattcgtatacttatcctcatcatgaactcctggttgagaagttagctctggggatgggattcaagcatgtatcg

SEQ ID NO: 30888 - DNA, 516 bp, Sorghum bicolor
  Clone ID: 18061631
gcacgaggcagcgtcatgcgcgccgtcgagggcgccgaggccaccatgcgcagccagatggaagagaataaccggctcaaggaagagctgatgaggaaaacacaacagttacagaggatgagggaagatgctacatcccaaagtccattgagtggattagatcaagagcgaaattctgtttctaataaaatggatggctccaactcttcagtaaatcctcaaagtagcttgatccatcgtcagaatggaagttttgaaagtagggagcctctgactcaggaaagcttgaaacaaaaatacattgacagtccccaggcaaatggagcatttaaaagatcattaggagaacagactgctgttgatagtggtggcccatcacaattctctactccctcatctcggtccctttctccaaataggcataaaaaagatggagaatatgattctaggttattaccagtttcagagatgaactcgaacatatcctggaagcaggaccttactgttaaggtcaaa

SEQ ID NO: 30889 - DNA, 542 bp, Sorghum bicolor
  Clone ID: 18061635
gcacgagggttctaataccaattggccgccttggtgttattcttttacttttggagcttatatcagaaatgctacattcttccagcatgaaggtacccatatttgtgatttctgaaacagcagaagaaatatttgcttttaccaatgccttgcctgaatggctatgcaagtcacgtcaagaaaagctatttgctggcgaggcattgtttggccatgtcgagcttttgaaggagggcaaattatttttgttcccacatttacactcaaagggcttgctgtaagaatttgataagatatgatttacagctaatacatagaaagacttaggacatgcttggaattcttttctcatctttgctactattcttataaatgattactaaaggctttgttcttataattttaatttagcacaatttgtggggcatgcatcttatgtatcctgtatccatatgagctcacttgtacttgggttacttgggttgctggtttctgtcatattttggttctgctgtgtgacacactatactcttgacagggca

SEQ ID NO: 30890 - DNA, 494 bp, Sorghum bicolor
  unsure (1)..(494): unsure at all n locations
  Clone ID: 18061639
gcacgagggtgacttctgctacatcctcgacggcgtgagtgaccccagccgcatccgtgaccctgacttctgccccattcgtgaccccttctgctccatgttctagacttctccacagcctccagtcctccaccgattcatgcagtcgtgcctccatcatcctgcaagtacgtccttttctcccctagtcccctccttcctctgctcttcctcccgtgcttcgtctgctctgcttcctgtgatcatgctaagattgttaggacctggataagtgtgctcctttgtggcttggtggatgcttgtgctagactgctatgtggttgactgcttctgcttgcctgcttggctcttctctgctctgcagccaactattaaggtgtgatttgcttctaaattccaactaataaggtatagtttccttccaaattctagtcgcattattatatacattaagatatctgtatggcattgcctcgccttgcgccttanaggcc

SEQ ID NO: 30891 - DNA, 572 bp, Sorghum bicolor
  Clone ID: 18061647
gcacgaggcactcttgcaaccaaggaccgggcttctgccaatttcagtgagagctgtctacatccatgcagtatttaaagtgattacatggtgtttcagtgtatatgttgggagattgggtgattcaggcatggcaatggatgtcacgttcgacaggtcagctgctgatcaaactgttagtttggacagcaatgttgcacttgggtctggcgaagagcaaggtattggggcgagcacagtgcgaaaggaccccttttcacatgaatctatactttacatgattgacctgattcaaacaacagttggtccattgattaactgcaatgaagtagaagtacaagatagagcacacaacctgattggttttgtccatttagtaagagagattcaagagctgaacaaaacgaaggttgctgatggtgacaagccaagcaggttagaagagcttgttaagactatgcggacagtgttctgtcaagaactaggtcctgtttctgtgaatgcacaaatgaaagtggcccttccagatggccttatcctgaatgaaaatcttgttgaacttgctggcatgg

SEQ ID NO: 30892 - DNA, 548 bp, Sorghum bicolor
  Clone ID: 18061662
gcacgaggctttctacaacaaactcattgattcactcctgctcaaaggaatagagccattcgtgacgctggcccactacgacatcccacaagagctggtggacaggtacggtgcgtggctcagcaccgaggtccagcgcgacttcggctacctggcggacgtgtgcttcgcggcgttcggcgaccgcgtcaagcactgggccaccttcaacgagcccaacgtcgccatgaccaagggctacatgctcggcacctacccgccgggccgctgctcgccgccgttcggctcctgcgcccagggaaactccgacgccgagccctacgtcgccacgcacaacgtcgtcctgtcccacgccaccgccgttgagatttacaagaggaagtaccagaggaagcagaagggcatgattggcattgtgatggccgccttctggttcgttccactgacggacacacctgtggaccggatggcgactgaacgggcattggccttcagcgttccatggtatcttgatccgatagtctacggcgactacccaccggagatgc

SEQ ID NO: 30893 - DNA, 530 bp, Sorghum bicolor
  Clone ID: 18061666
gcacgagggtcaaggcaggtggtgcttcgccagtgctgtcaggtttggatggtactcaatggcaaacacatctccaccagcaatgatcacctggagcacagtgaaaatataggatatggagggagctcaggtattttagcatctatacatgagctaggtgaggaatctgatggctatgtgacaccaccaactgatcttgtagacgaaatcattgatgaggagtcaactgaaatgaatgactccgatcaattagtaacggaagatgaaacattgactgaacaaggcacagaggaatcagtcacttctgaagagatggaagacttttttgaagggggtgctgatcaatctgacgagatacagagtttcagaaacattactgaaaaggctgaaaaaatcatggtggtttcaacttgcaataggaggaaatagaaagactgcaaaataaactgaaacagctgcaaggacaggagcataatcatgacgagaggaacttgtcacctagacaaatggctgcttcactgaagcggaag

SEQ ID NO: 30894 - DNA, 565 bp, Sorghum bicolor
  unsure (1)..(565): unsure at all n locations
  Clone ID: 18061682
gcacgaggaagtgctctcggtgcaagcgcgtgcggtactgttcccaagaatgccagacaaatcattggcaaagtgatcacaaattcaagtgcaaacaaatgaaatcattggatcctgctgacaagttatccagtggaggtgaggccaacaataaaaaaacatcaggtttcggtcgcatctcattggtgcctgcctgtaaaaagataagcaagggtcaggttctctttccttatgatgaatttttaaagttgtacaactggaaggaatttgatttcgtaccttgtgggcttatgaactgtggcaacagttgctttgctaacgtggttttacaatgtctctcatgcacgagaccgcttgtgtcctatctattaggaaaggaccatagcagggaatgttctatgagacatgaagattggtgttttttatgtgagctgcaatgtcatattcacagagctagtgggagtttgcacccatttgctcctacaaacattctttctcatctgccaaatattggtggcaatcttggctttggtangcaagaggatgctcatgaattcatgaggtt

SEQ ID NO: 30895 - DNA, 612 bp, Sorghum bicolor
  Clone ID: 18061696
gcacgaggccaagaacaaatggttagaggtgctgcatcttttgctcttggccagtttgctgaacacctgcaaccagaaattttatctcattatgcgagtgtacttccatgtattctaaatgctcttgaagacccatcagatgaagttaaggagaagtcatattatgctcttgcagcattctgtgaggacatgggtgaagatatcctaccatatctagagcccttgatatgcagattggttatgtctttgcagagcagtcctcggaacttgcaagagacatgcatgtctgcaattggttcggtggctgctgctgcagagcaggcttttaccccatacgccgaaaaagtccttgagatgatgaaaggttttatggtgcttattaatgacgaagatctgtgtgcacgtgctagggctactgaggttgttgggatagtagcaatggcagttggcaaagcaagaattgaagcaatattgcctccttttattgaggctgctatttctggttttggattggattacagtgaactcagagagtacactcatggtttttttagtaatgttgctgaaattttgggtgagagttttacacagtatcttcctcatgttgtccct

SEQ ID NO: 30896 - DNA, 546 bp, Sorghum bicolor
  Clone ID: 18061713
gcacgaggcggaggagggaggagtttggggacagcctcaggtccggccggctcgccgactcgcccatcaacatcatcaaggccaatgccatggccaaggcggtgctccataaccagagctgttgctccgccatctccgggatgtcatcgaggggcgcaaaggacaggagttttggtttggtgggtgatggggaggagcttggccggaggggggaggccagcacgttccaggagagctccaggagtttgcttcagaagtaccggcccaaatctttctccgagcttgttgggcacggtgttattgctcagtctctttcgggtgctgttctgaaagggaagcttgctcctatctatcttttccatggtccgcacggcgtgggcaagacgtccatggctagaacatttgcagctgcgctcaattgccgttcccctggtgggaaccagccgtgtggccgctgtgacgagcgcgtggccatattctcgggaagcagtagcagtgtggtagagattgatgcttccaaacttgattgcaaatctagggtcgcgg

SEQ ID NO: 30897 - DNA, 556 bp, Sorghum bicolor
  Clone ID: 18061717
gcacgaggatctttatcagagcaattgcgtgaagctgggattcctcatgaggtcctgaatgctaagccagagaatgttgagagggaggcagagatcgtagctcagagtggacgccttggtgctgtgacaattgccaccaatatggcaggacgtggaactgatattattcttggtggcaatgcagaattcatggccaggttgaagttgcgtgagatccttatgccaagagttgtcaatccaatagatggtgttattgtatccaaaaagcagatgccaccacgaaagacatggaagacgaatgaaagcttgttcccatgtgaactttcaaaagaaacattatcatccgtcaaagatacagttgaaatggctgtcaaagaatggggagagaaatcattaactgaactggaagcagaagagcggttgtcctactcatgtgagaagggaccaacacgtgatgaagtaatagcaaatttgagaaatgcatttatgaagatagcagacgaatataaagttttcactgaggaggaaaagaagaaggtcattacagcaggcggac

SEQ ID NO: 30898 - DNA, 532 bp, Sorghum bicolor
  unsure (1)..(532): unsure at all n locations
  Clone ID: 18061723
gcacgaggattcggcaaggtcctttaatcctttttcttaaggacacagagaaatttgtgggaataatgattcctatcatggtctgaagagcaagttaaaacattttccagctggtgcttttataattggatctcaaatccagcctgacaatcgcaaagagaaggcaaatggtagttctccttttctttcgaagttcccgtacagccaagctatacttgacctcgcattacaggacattgatgggggaaatgataataataaagaaacttcaaaagcaatgaagcatttgatcaaacttttcccgaataaagtgacactcgaggcaccacaagatgaaacggagctttcgcggtggaaccagatgttaaaccgagatattgaagtccttaaaggaaatgcaaacatttcaaaattacgctcttttctaacaagggttggtctggaatgcactgaccttgaggcaatattggtcaaggatcgcattcttacaaatgagtgcattgataanattattggttttgctttgagccat

SEQ ID NO: 30899 - DNA, 550 bp, Sorghum bicolor
  unsure (1)..(550): unsure at all n locations
  Clone ID: 18061763
gcacgaggccagcctcagcctcggactcggcctcggcgacggtggcgccgccctcctcgtggtctccgggaagaagctcttcgtcgtgctcgtcgccctcgtcatcctgcccaccacgtggctccggagcctcggcgtgctcgcctacgtgtccgccagcggcgtgctcgcgtcggccgtcgtcgtcgtctgcgtgctgtggacggccgtggccgacggcgtcgggttccacgccagggggaggatgctcaacgtcagtggcctccccactgctctgggcctctacaccttctgctactgcggccatgccattttccccacgctctgcaactccatgaaggagaagaaaaggttctccagggtgcttgtcatatgcttcgtcttgtgcactctcaactacggatccatggcgatcctcggctacctcatgtacggcgacgacgtcaagtcccaggtgacgctgaacctgcccgagggcaagatcggctcgaagctagcgatctacaccacgctgatcaaccccttctccnagtacgccctgatggtgacg

SEQ ID NO: 30900 - DNA, 543 bp, Sorghum bicolor
  Clone ID: 18061771
gcacgaggatagtggtggacaaggagggaagacagtagccattggcggtgatcgcaagttgatccacaacaatgtatgcctcaactgccatcaccaagggcgctaggcaaaggactgccctgagccttgatgcgagcatggcaaagcagcgcacgtcgtgtaggctgatgatggcgacaccgctctcttcctcgcccatggcctccttgagctagatgtggatcacactagattctactccaaggccaacattgacatcaatgggcctagagcacgcgtgttcctgaacaccagcggtgaggacatgctcaatggtgggtacatcgatagcggcaccatccaccacatgactagacaccgtgagctattctccaacctcgacacctctgtgcatggcttggtgcagtctagcaatgctccagggtggagatacaaggcgttggcttgatcatgtcccaagccaaaaacagcgagcatcacgttcttcattgtgtctacttcaaaccaacgtgcacaactccatcatgagccttggatagcttg

SEQ ID NO: 30901 - DNA, 371 bp, Sorghum bicolor
  Clone ID: 18061779
gtaaaggacacctgctagtacagcaaccacagagtgttgctactgatactaggttggaaatggccgacaatgttgctaattgctatctagagttcactggtagcttggatggccaatcttgtctgataggggcttctgtatctcatgatgaagcaatggcagccaaagttttacagacagcacaacctgacatagtcacagattgcacctttggagtaggtacttcaaaccacgctggatgctcagacatgcagctacctgttacacagactacttctgttcaagagcctggcctgagtttgtcaaaggacctcaactcatcctgtggcctgagtttgtcaaaggacctcaattcatcctgtattcaagga

SEQ ID NO: 30902 - DNA, 515 bp, Sorghum bicolor
  Clone ID: 18061817
gcacgagggtttgttacaatatcacattacgacattccacaagaactggaaatgcgatatggtggatggctgagccccgaaattcagaaggactttggctactttgcagaagtatgcttcaagatgtttggtgatcgagtaaaattttggataacatttaatcaggcaaatctgtccttgaagttcagttatatggatggatggtacccacccagtcgctgctctcagccatttggtaattgtggctttgggaattccacaacagagccatacatagcaggacacaatatgatattgtcgcatgcaaatgcagtcagtgtctacagaaaaagatatcaggagaaacaaggtggtcatattggaatttctatttgcgcaatatggtatgaaccattcgggaataccacagcagacatcttagcagttgaacgtgctttatcttttggtggtccatggtttttggatcctttaattcttggtgattatcccatagagatgcgcaagatcttaggttc

SEQ ID NO: 30903 - DNA, 548 bp, Sorghum bicolor
  unsure (1)..(548): unsure at all n locations
  Clone ID: 18061847
gcacgagggtgagcgtgtggagctgatacgagtcgacggccgtgcaggggagttcgtgtgaaagaagaaacaagacacagaccgtgaattgatctcccacgttggatcttgattggacgatggatagcataggggaagttacaacgtgactttgtgaagcaaagtcactgaatctgcatccgacggggacgatgacgtcgccggggcgcaccaagaggatgacgtcgtcatcagtgcggcggcccaggtggtgccgccccagaaggccgtgggaggcaaacggacgaccacggacgccccggaggcatcgcggaaagccccgcgcttggcctccacatcatcacccccggttcaggagcctcgccaaggtaccctggataccgttgtcgggatgttgaacagacaaatgagtcgttctgaccacctggagaacgagctcgaaatggcccggcaggaagcccaccgccagggaggagctgttgagcttcaagcacgacactcggaacgcatttgagcgttccanaaccaagatcagcagcttggaagcc

SEQ ID NO: 30904 - DNA, 571 bp, Sorghum bicolor
  Clone ID: 18061864
gcacgaggagtttctccacggggacgcaaagcgttgcctaatccaaaccggccgtcgctagtcccggctccagatcctctgcccgccccccggcgtccgcgttcgccacggtcctccgcgcaccggccggcgaccctgcgtgcgcgcctccggtggaccgtagacggcgcccggccccggcggctgcgctgcgctgcgcgccgcgcgcggccggcggacagcgggagccagcagcagcagctgctgctccaccacaccatgtttccctgtcgtggagtggctactgcaaaccctcatctgcctggtgctcttgctgcaaaccgctatggttctcccacgaggccatctttttaccctagcgcggcgtttctgagactgcagggccctgcgtttcgtcatgagaagaaatccttggctctgagagctggtgcggattttcaccgttatgcgatacctccatcctttgcaaagtataatcctgtcaagggcatcaagcctctactgtcatcccccaaattgaaatcaagaactcaagttggttgccaagcatctttgtcatcgttcagctacc

SEQ ID NO: 30905 - DNA, 613 bp, Sorghum bicolor
  Clone ID: 18061938
gcacgaggcaactattacaacagcaaagcaatagccaacagctacagcaacatcagcttcagcaacctgctgtatctagccagcaatctcaaagttcaaatcaacatcttcaacaagaaaagccaggaattggaagtatgcctgttgatgggggcataccaaactcatttgggggagctgaacagacagcgaaaaagagaaagaagccaggctcatcctctggtagagctaatagttcaggcacagccaatactgctggtccctctccaagttctgcaccctcgacaccttctactcatacaccaggagatgcaatgtctgtgccacagctgcagcagaatggtggttcagctaaacccatggtaatatttggctctgatggaactgggagcttgacatctccagcaaaccctttggatgatgtggaccgtttgctggaagatggctcattggatgataatgttgaatcttttctatcacaggatgacatggatcctagggataacttggggcgatgcatggatgctagtaaagggtttggtttttctgaggttgccaaagcacgtgcaagcgcaaccaaagttgtctgttgccatttctcagctgatggtaa

SEQ ID NO: 30906 - DNA, 528 bp, Sorghum bicolor
  Clone ID: 18061951
gcacgaggcagcagcagtcatcatttattccagtgcaacctagacaagtgagctcttctgctggttctcatagtcgacctcatgtgcccactgttactcaattttcacaaaatcttcaccgaccttcatcaaatgttagttttgggtcaagaattgggaattcttccacttcttctggttctacaatgccgatacctgcttcacaagatcccagtacaagcttgttgggaagcgattatcctgagccccttctgttaggttcttctttgtttacagctgattcaacaaatttcttatctgcatctggaagcagaagtaaccagcaaaattctggatccagctctagttccatgcttagacctgctgataatgttggagctccacaagtcgctgggttcaatgcatctcagccaagtacaactataagaggttcatctgatgtgtccaggaggtccttaatttctgctggtgcttctcattctagaagttcaagcatcgcattgcagcaacgtggaacttcatccacgt

SEQ ID NO: 30907 - DNA, 501 bp, Sorghum bicolor
  Clone ID: 18061985
gcacgaggatttgattggggatctcgagcttgtgtagaactttatcacaagggaactataatagaaatctatcgcatgagtcgcaagaagatgcaacgtccttggcggattgatgactttgatatgttcaaaaagagaatgctgactgatagaaaggaccaaccatacaaaagagcactgctttttgttgataactcaggtgctgatgtggtccttggaatgcttcctttagctcgggagcttttacgccgtggaacagaggtagttcttgttgcaaattcgttgccagctttgaatgatgttactgctaatgaacttccagaaattatagctgaagcctcaaagcactgtagtatccttcggaaagctgcagaagctggtgggttgatagttgatgcaatggctggcatccaagatgatctcaaggatgagccagtgtcagtgccactaatggttgttgagaatggatgcggcagtccatgtattgatttccggcaggtt

SEQ ID NO: 30908 - DNA, 185 bp, Sorghum bicolor
  Clone ID: 18061992
gcacgaggccgcacatggctcgggaatatggatttgagtatgagctcatcacatataaatggccaacatggttacacaagcgcaaagagaagccaaggattatatgccgcatataagatcttatttctggacgtcatatttccactttcactgaggaaggtgatttttgttgatgctgatcaaat

SEQ ID NO: 30909 - DNA, 422 bp, Sorghum bicolor
  Clone ID: 18061998
gcacgaggagaacctctgggacatcctcgactcctgcaagaagaagctcccgctccagcacctccagaacaagaaggtgtgcgtggatctttcctgctggctcgtgcagttctgcagcgccaaccgctccccggacttcctcagggataaggtctacctcaagaacctcttccaccgtatccgagccctcctcgccctcaactgcagcctcatctttgtctcagatggggcgattccttcagtcaaattggctacttataggcgccgcctgggattaaatgctgctgaggctactctagaggaggccaactcacaacctctgacttctttgcgccggaacaagagctcagagttctcacgcatgatcaaagaagccaagcatctcgggttggcccttggcatcccctgcttggatggtgtgg

SEQ ID NO: 30910 - DNA, 129 bp, Sorghum bicolor
  Clone ID: 18062011
gcacgaggcacaatctctacaggcctttggtcaattcaggcctcgcatttggtgcaaaaaggtgggttggcacactggaccgaccatgcaagcgccttgccaatgccatggccagcaacatccccaacg

SEQ ID NO: 30911 - DNA, 620 bp, Sorghum bicolor
  Clone ID: 18062038
gcacgagggtttggttgggcgggaatattccggcggtatctggtggagccggcggcgatgtggtggccctccaacctcgtgcaggtctccctcttcagggcacttcatgagaaggagcgaaggagaaaaggtagaatgacacgcaaccagttctttctggtggcattcatctgcagttttgcctactacatcttcccaggctatctgttccagatgcttacctccctgtcctggatctgttgggtatttcccatctccgtgattgcccaacagcttggctcaggcctccatggtcttggcattggtgcaattggactcgactggtcatccatctcctcctaccttggaagcccccttgctagcccctggtttgccacagccaacattgcagctggcttcttcatagtcatgtacataatcacaccgatcaactactggtttaatgtttacaaggcacgcaacttccccatctactcagatggtctctacacagagtctggacaaaagtacaacgtctccagcattatggactcccaattctattttgatacagatgcctatgagaagaatggaccattatacatcagcacattcttcgcttccagctatggccttggttt

SEQ ID NO: 30912 - DNA, 513 bp, Sorghum bicolor
  Clone ID: 18062060
gcacgaggatttcactggttgaggtgtcccagtcaggttccacttcaagcttagatgccactggatcgactggtggctactccctcgtggaggggtctctgccagaggcgagttgtggtgcccaaagatgtgaacctgaggtccatgaagtaccaacagggtcccctgctactgtggggttcccgagtgaggatggaggctctggatttggaattgagctgaatgatgatgtggatggcagaaacggccttgccggaggggaattggaactgtctactgatggcgatgatgccgaagacatcacagagatagctggaatcttgtgtggcgaaagagtggaggggatggagacgaattcaggacaacatgaggcctcgaatggttccaccgtgccttctgaggaaggagtggacaggatggagacgagtttggatgactctgaggcttccgatggctcaaccacacaggattctgataccgacgtcgagacagagtcaagtgtttctagtatag

SEQ ID NO: 30913 - DNA, 156 bp, Sorghum bicolor
  Clone ID: 18062068
tgagaacatgcgccgcattttggtgtgcaaccccatcactaacgactggaagagacttcttgatgctcctgggggcaaaacatctgattacagtgctcttgccttttctgtggacagaagttctcatcattacactgtggctgttgcaaaaagcaa

SEQ ID NO: 30914 - DNA, 557 bp, Sorghum bicolor
  unsure (1)..(557): unsure at all n locations
  Clone ID: 18062088
gcacgagggaggctgccaagtgcctggacacaatgacatccaagggtttattgccaaacgcattcacatataacaccgtcatgacagcttatgggaatattgggaaggtggatgaggcacttgccctgtttgaccagatgaagaagagcgggtgtgtgccgaatgtgaacacatacaattttatccttggcatgcttggcaagaaatcaaggttcactgtgatgctagagatgcttggagagatgtcaaggagtggatgcacaccaaatcgggtcacatggaacacaatgcttgcggtctgtgggaagcgtggcatggaggactatgtcacccgggttctggaggggatgaagtcttgtggggttgaactgagccgagacacctacaacaccctgatagctgcatatggtcggtgtggctcaaggactaatgctttcaagatgtacaatgaaatgaccagtgctgggttcgccccctgcctcaccacatacaacgcattgttgaatgtgctatcacgacnaggtgattggtccactgctcagtcaatcgtaagcaaa

SEQ ID NO: 30915 - DNA, 477 bp, Sorghum bicolor
  Clone ID: 18062095
gcacgaggcttcctcctctggaactggaataggcgaggagacagaaccagccaagcgatcccgcttctcgcactcgtctcgcgccaccattattgcccgcccaatctgacgccgccgtatcctcgcctcgccattatttttagttttatcattgcgtccacgcctgctccactccacgcctgcccatcccactttcgcttccacgcaaaggattttttccctttttaaatattatatatatactacacggtctctgatcggttcatccggccaagattgtccgaagcttgttagagtctatggagggcgctttgctggaaagcttgctcgtcttgctgagatggaggttaagtatcgatgtaaccaaatcctagagattggtcttccaatgggaggacttgcaaaattgtttgctcaggactgggagggtgatgtcaccatggttatgccggcaacagtagctcagtatttgaagag

SEQ ID NO: 30916 - DNA, 612 bp, Sorghum bicolor
  Clone ID: 18062108
gcacgaggctgcaatcgcatatacctcaacccggtgatggaagtgctgaatctctggaatcatctcaaagtaaatttgaatccacagttcctactgcttcctctgggaagagtgaccaagtgtctaattggaattctgaaagcaatgctgttgatcctaaaagaggtgatcatgaagcatcagtaccttctcatagtggttggttatcttcactggaaatgggaaaggatacagcaaatactactaatcgccagcagcacattcctgaatcagttaatcaggatgctgaagaagtgttgtacactgggaggcctaatagcagcatgggtcaatccctacgggaccttgagaatgaccgtgcagatttccagttggcaccacatgatcctcattctgtggttggacaagctaatttgccgcagcatgatatcccaagggagagtgatctgagtcctcttggcttactttggtctgagctggaagggcatccaaaacaacctctctcatcaaacgtacttggtgtaaatgagcggagaaatcccaagcctacagcacccaaggacattccacctgtaaacatgagacacgggccacttagcaggatgaatgaag

SEQ ID NO: 30917 - DNA, 513 bp, Sorghum bicolor
  Clone ID: 18062141
gcacgaggcacaccgccgccgtaaccctccgtacagccgaccctgcggctgcggcggtggcccttgatgcggcgcgcaggtgcatctcgtggatcgatgtcggactggtcgccaatgatgtgttcgttcctctactctttgacattgcgatgtccccgggaagcgcgcctccacttgctgctgcagcggtggcgtgcctttctgctgtggcgttgaagaggatggactcaagggcgaaggtgggattgttgaggtcactcctggctgcacagcaggggcttggtagcccagacagtgggttgaagatggcacccttggtgacagcatatgctgccgaggctctcgaatgtcatcgcaggcttggtcctagtgatgctgatggagctgcagcattggagatgctggaagaggtgctaccagctgtatttgcagctgcagagagcggtaacgatgaagatgtggactctggttccgtgcttgagttcttgtctggctatgtgagcataatgaagg

SEQ ID NO: 30918 - DNA, 608 bp, Sorghum bicolor
  Clone ID: 18062143
gcacgaggaccaaccccaccaaattccgaacccagctcaaccccgcgcccactccgtccggcgccgcggctgcgagcttgaagtcgtcaccgccaccgccaccgccgccgaggcgaacttgtagctgcctccgccgccgccgcggcgagcaggaagccgtccccgctccgctgactgaaccggcccccgccgtcccccctgaggagagagagagagagattcatgaggggatcaagaatgaatccaggtgaccgtagaacacggagcacgatgacaatagtaattgtgatgggtttatcctgcttcttttacatactaggtgcttggcagaaaagtgggacaggaaggggtgatagtatagctctgagggttaaccaagaaactgactgtacaatcttgccaaatttgcactttgagacccaccataccataagtggcactaatccattgatcatgtccaataaaatgattgagccatgccacatccgatacagtgactatactccttgtcaagaccaggaccgagcaatgacctttcctagagaaaatatgacatacagagaaaggcattgtcctgtagagaatgagaaactgcattgtctaattcc

SEQ ID NO: 30919 - DNA, 630 bp, Sorghum bicolor
  Clone ID: 18062152
gcacgagggggaggcgatacccggttgaaattcattatacaaaagccccagaggctgattacatagatgcagcaattgtcactgttttacagatacatgtgacacaaccccctggagatatcctggtgtttctcacaggtcaggaggaaattgaaacagttgatgaaatccttaaacacagaacaaggggcttaggcaccaaaatatcagaattaattatatgtcctatttatgcaaatctacctaccgagctgcaagctaagatatttgagccaactcccgagggtgcccgtaaggtggttctggccactaatatagcagagacttcattgaccattgatggtataaaatatgttattgatccaggcttttgtaagatcaaatcatacaatccccgcactggaatggaatctctacttattaatcctatctcaaaagcttcagcaaaccagagggcaggaagatctggttgcactggacctggaaaatgcttccgtctttacacgagttataactacatgcacgacctagaagataatactgttccggagatccaacgaaccaatcttgcgaatgttgtgcttacactcaagagtcttggtattcatgacttggttaactttgacttca

SEQ ID NO: 30920 - DNA, 467 bp, Sorghum bicolor
  Clone ID: 18062182
gcacgaggcacaaattgaagaattctttaatcgctttggtgctggagaggctgcagcaatgtgcttaatgctagctgcgaagctactttatgctgaagatagtctgataagcaatgctgtttctgagaaagctgctgaggcatttgaggaccctgggcttgttgggatgcctcaaattgatggcaccactgctttatctaatacacgaactcaagctggaggctttagtatgggccaagttgttcaagaagcagaacctttgttttctggtgcatacgaaggcctttgtttgtgctcgtcaagactactttatcccatatgggagctccctgttatggtgattcgaggaccggctggtactaataaacgcgaggatggcgtaattgtttgcaggctttcagctggggccatgaaaattcttgagagtaagattcattctctggaaacatttttaagatctagaagga

SEQ ID NO: 30921 - DNA, 623 bp, Sorghum bicolor
  unsure (1)..(623): unsure at all n locations
  Clone ID: 18062195
ttcggcaagagggagcttgttgcatacaagaatgttaatgatgtaccatttgtgagagatttggtgatccaagtagatcagaaaaatgaagctgtcctcttacctatttatggcagcatggttcctttccatgtttctactgtcaagagtgtgaccagccaccaggacaaccgcacctgcactatccgcatcttcttcaatgtgcctggaatgccattctcaaatgatagcaaactaaattctcaaggcgctatctatctcaaagaaattacattccgctcaaaagatccacggcatagcagtgaagttgttcagcagatcaaaacgttgaggaggcaagttgcttcaagggagtcagagagagctgaaagggcaactcttgttacccaggagaaacttcagataggaaacaacagaatgaagatgatgagactttctgatgtgtggatacgacctgcattcggtggtcgtgggaggaagctcactggaaatcttgaggctcatttcaatggtttcagatattctacttcaaggtctgatgagcgcgtggacatcatgtttggaaatataaagcatgcgtttttccagcctgcagagaaagaaatgattactctccttncatt

SEQ ID NO: 30922 - DNA, 619 bp, Sorghum bicolor
  Clone ID: 18062201
gcacgaggcacgacaggctcttgaagaatacgatgattccttgcagaaactggaggagaataacactaaacagaatgacgactcaattaaggtgtcaggtaaaagaacatttgggcctgtcaaaaatacacacgaagaggtaaagaagagaaaattacaagatactgaaaacagcagtgatagtgagtatgattctgagcctgcccaacatttgagcaataatgaagtaactatgaaacatgatgatatccaatttgggaatgcgctactggatgatgaaccacagaatgatatgtacagaagctttaatgatatcataaaaaatcctggtcctaagacaacttttgaagttggaatgttagctggtgattcatggaagaaggtcaaaagtaataaaggaaatgaccagagcaatggcaatggcattaccaataaatccaaattaccagttccttctattgtagacccaaagcctaagcaacaggatcacagttctgattcagattctgaggaagagatggttgagggcttcttgactgtctctgacagaaaggagaactatgaacttccatctcaagaggatctcatacgtcaggcttttgctggtgatgatgttgaa

SEQ ID NO: 30923 - DNA, 534 bp, Sorghum bicolor
  unsure (1)..(534): unsure at all n locations
  Clone ID: 18062221
gcacgagggttaagaggagcagcagcaagaagtcccaggtcttgaagaagcagcagccactgccccaaggctttttccctcccatggccgatcccaatttcactgatcaggaccccaattattcctcaccttttggtgcattctttgcccaattcgcctacaaacctgatcgccggaaagatggcagtggtctgccacttcctaataccgctgatcgcccagcgaggttgcctcctcgaggccacccgtcatctaggtcttctctgcttactgcaaaagagtcctccaaggctgctaggacaacaacctcgaacactatgcaaccatgcccagcctcagcatcaacctcagggtcacaagaagggataagggtcaaagggatcgagaagcctgagaagatgatgacaatggagaaaaagccaaggcggaaatcgccattacttagtgctgccgagaagcgttccgataaataccgtcgcctgccgctggatcagctggtgcccccaccgtgctccccccataagctattgcang

SEQ ID NO: 30924 - DNA, 515 bp, Sorghum bicolor
  Clone ID: 18062225
gcacgagggggatcgctatattctgtagggattcgagctctagctgctcgtagtagcgtttttgcaatgtgatgtctgagattactatgcatgttgccagtatgatgtcactaagggaccgtttggatcccttcattttggaggaactgaaatctatataatggattaggcttgacatttcataactttcctaagctcacaaataagcctatctcaaattcatagggtgggagatggaaattggattctgtagatcactatgccataattctatctacaacttatagcacactcttcaactcacttccctacaatagaaatgcaatatataagtatgtcccttgtatggctattggctaacaataaatatacaaatatatcccatatacaactatattagcttaattaatctatgcctaaattgtaactattagaatgaaatcaattccaaggatccaaacaggccccaagtaattttaaggagctggttcccctgtcaacggtgcttttgcagt

SEQ ID NO: 30925 - DNA, 519 bp, Sorghum bicolor
  Clone ID: 18062227
gcacgaggcgtatgtttagtgacataaaaaacactgatcagagaagtttcaaatgtccaagtcatcctctttcagaggaacatttgcagcttcttgtcaaagcactaccaatagaagaaggggactatctaagaattatatggccaattatacctagcatccagttttacaaagaaggtccttgccgttacctgagtcacctcattggccatgaaggcgaggggtccatcttccatattataaaggagctaggatgggccatgaacttaatggctggagagagcactgacagtaatgaatattcctttttctcagtaagcatgaggctcactgacgctggtcatgaacacatggaggatattgttgggttgatcttcaaatatcttcatctattaaaagaagatggagtacatgagtggatatttaatgagcttgtggcgataaatgaaatggagttccattatcaagacaaagtccatccaatcaactatgtgatgcatactgtctcaactatgcggc

SEQ ID NO: 30926 - DNA, 506 bp, Sorghum bicolor
  unsure (1)..(506): unsure at all n locations
  Clone ID: 18062244
gcacgagggatacacctatctatcgtggtttgcctttcggctgggtacacctaagtcccctcttttctgtcaaatctgcatatgaatttgcggtaaaaaaaggggccatttgaaccacgatgatgcatcctcatctaaaggatcaacaaagcagttttctatggaaaaacatctggaaccaaaaggtagcaaataaaataaagatgttcttgtagaggctggcccataaagaaatttatccagaagaaggaggggggtnnggtggggattttggacaccatatgcacaatgtgctaccgtcttgatgaagattgtggccgctatttctcaagtgcaaaatggtaaagcaagtgtgtggagacgacttggcctggaagaaagaaaaattctgcttaccagaagttcaggcccagaagttatagagagaatcctaccattcaatgaggaatctaagctcacaataatacttcttttatgcttttatggtgttgctggcatgctcggaa

SEQ ID NO: 30927 - DNA, 439 bp, Sorghum bicolor
  Clone ID: 18062246
gcacgagggaattctttgtccattacaatacagcaaacatgctatacgcttcgagttgtcagcttgaaagaactcgtggatgaaggatcaattgaaacaagtgcactaactccaccagaatatgccaaaactatgcatgaaaacctagatgaggtttgtagtggcattgatgctcctgcaaggacagcatcactggaaacttctgaggaggtgtcctcatggatagcaagccttgtgtgcgctcaaaataagggagtgaaagaaatggatggtgacctgccatttggattcagcaaacaagaggatgaagggtttagtgtgacagctggttggcataccacaccagtaatagggcctgaaggtagcatcttttcagggattaagcagcatgaagactacaaggtcaaggaggtaacatgtctcagagatccaagctcat

SEQ ID NO: 30928 - DNA, 139 bp, Sorghum bicolor
  Clone ID: 18062281
aacttgcatacttcaattgctttgttacttatgtatatactgttctagctggttatttattccaataagtaatgggcatactcaatgaatcatgtgttggcttgttcacagcaccgctgctgctaagaaggctcctgcc

SEQ ID NO: 30929 - DNA, 511 bp, Sorghum bicolor
  Clone ID: 18062302
gcacgagggcggcgggtgctggtgcagatcctcttcggcctcgtcttcgccttctcctgcaacctcttcgagctcgttctcttcgagatcctccccgtcctctccaagcacgcgcgcttcctcaactggcacctcgacctcttctgcctcattctcctcctcgtcttcgtactcccctactaccactgctatcttctgctccgtaactcaggggtgaggagggagcgggcgtggctcgtcgcggcgctctttctgctggtcttcctatacgggttctggcgcatggggattcacttccccatgccttcaccggagaagggtttttttacaatgccgcagttggtcagtaggattggggtgattggagtgagtgtcatggctgttctttctggttttggtgccgtcaatctgccatacagttatctgtcgctcttcatcagggaaattgatgaagcagacatcaaaaccttggaaaggcagctgatgcaatccatggagacatgtacttcta

SEQ ID NO: 30930 - DNA, 506 bp, Sorghum bicolor
  Clone ID: 18062314
gcacgaggcccatgtggaagggcgtcgtcgtcgcctacatcgtcgtcgccgtgtgctacttccctgcctcactcgtcggctactgggccttcggcaacagcgtcaacgagaacatccttgtcacactcaacaagcccaagtggctcattgccctcgccaacatgatggttgtcgttcatctcattggcagctaccaggtatatgcgatgccagtgtttgacatgatagagacggtgctggtcaggaagtttgggttccgtccaagcttgatgctccgtctcattgcccggagtgtctatgtcgggttcacaatgttcgtagccatcaccttcccgttcttcactgcattgctcagcttctttggcggatttgccttcgcaccgacaacgtattttcttccttgcatcatgtggctcacaatatacaaacccaaaactttcagtatctcgtggtttaccaactggatctgcattgtcctaggtgttttgctgatggtactgtcacca

SEQ ID NO: 30931 - DNA, 606 bp, Sorghum bicolor
  Clone ID: 18062320
gcacgaggcatataattctggtctccggtatttcaccgtgcatgcgtgtcctcttgaaaaaagatccagtggactctcctgctttatgaatcctagaagaacccaaaaggacttgaagttcgtatccacttctccgcacgaggcctttcggtgggttaatagttttgcggaccagcaatgctacataaacctgttgcctcaccccatggcatctagcaagaagcattcttctgaactcattcagtttgataccatgtttgatccttatcttaaaaaatgtcggtctccaccaaagatacttgtcatcttgaatcctcgatctggacatggtagatctagcaaagtttttcatggaaaagtggaacccatatttaagcttgcaggtttcaagatggaagtggtaaaaactacacatgctggtcatgcaaaatctcttgtatcaactattgattttagtacctgtcctgatggtattgtatgtgtgggtggtgatggaattgtaaacgaggttctcaatggtcttctatgcagagatgatcaaaatatggccgcctctgttccaataggtataatacctgctgggtctgataactcacttatttggac

SEQ ID NO: 30932 - DNA, 512 bp, Sorghum bicolor
  unsure (1)..(512): unsure at all n locations
  Clone ID: 18062328
gcacgaggccgactccttgaaggatgaatttgatatgctctctgaagatttttcagaatgttttaatgacttcagcatgccagggtttatacggaaaacgaaagagctttgggttgacaagtacacaccccactcattggctgagcttgctgttcataaaaagaagattgaagatgtaaaaaaatggttggaagagaagctgaaggcaccaaagacaacggttggaggatggaccctagtcctaactgggcaaactggtgttggaaaatcagcaactgtgaaagcaattgctgatgaccttggagcggacttatgtgagtggacaactccagtaccaacactgtgggctgaacatgttcatgctaattcaggattacgctatatatccnagcttgaagaatttgaaacctttgtggagaagataaggaagtattcaatgctttgtccaaccaataccaagtcccaaaggaagctcattatcattttgattgatgacatccctgtaacaagtg

SEQ ID NO: 30933 - DNA, 599 bp, Sorghum bicolor
  unsure (1)..(599): unsure at all n locations
  Clone ID: 18062344
gcacgagggtcctttctcagctttaatgtttgtgcctattttcttcttagtgaaaatcacctagttcctactaggttggtcacatttttttaagttatatctatcatgcaatgatccaaattatgggcaacttgccatttcctataatgctgacaggatgtttgtggcttatgctttaaccctgtcttaataagaaattgattttcttctatcttttgtgcaatgttccacatgtttccataagttttgaatgtaaaactaaatatgttattgcttgaaatgatttgttttcataaactattagttaaccatcagtactatatcagtttctgcttttggttaaccatcagtactatatcagtttctgcttttggattgcactgcttaatagatgactcttataacatgtgtgaaatatgagtagctaaactcctctgagctaactatagtatcattgctaacccaggttactgcttgatcagttaacctagctaaagctgcttcccaatcccatataacataaatctcanaatccaagtacatttgttcaatctcttctgttctccacttaaaacctaaatctgttacatgttgcagtt

SEQ ID NO: 30934 - DNA, 428 bp, Sorghum bicolor
  Clone ID: 18062346
gcacgaggtttgagtcgaaaatgaacccgtgaacccgggtcggggtcgatgaacctaggtcgagggtcgaaggtagtgaacccgttttatgtgactgtgtgcccaactagcatttattcttgcaactaatatttatatttttcatcttttttagctttctttattgttcaatgaggtggtggagttggcttagtcattgggatattcttctgtaatatgatgggatattgttctgtaatatgagaatgctaaataaagtgactatatgccaatatagagaaacatttgaactagagtctggagtttactctaggtaaaaaggaagaggataaaggtttgaagatgggggaggtatagagagggatccaaggatgggtaggatccagagaatgtccaaactagaaactgctaataaacagcccggaaac

SEQ ID NO: 30935 - DNA, 197 bp, Sorghum bicolor
  Clone ID: 18062351
gacgtgggcataaaggactttatgatacaatcaataattcgattcattttcaattaggccttgctctagcttccttaggggttattacttccttagtagctcaacatatgtactctttacctgcttatgcattcatagcacaagactttactactcaagctgctttatatactcatcaccaatacattgcacggttc

SEQ ID NO: 30936 - DNA, 597 bp, Sorghum bicolor
  Clone ID: 18062361
gcacgagggaggagagggagaagggtggcgggggtggcgcggcgccgcagaggaagcagagaggtcggagtgatgcgctggtgggaagtggggagctgcttgccattcccggagtcgggccacggaacctgaggaagctcgtggacaagggattcgatgacgtggcgcagctcaagcagttctacagggataagttctttggcaagtctaatgagaagatggttgagttcttgcaaaattcagttggcatcattcacaagaaccatgctgagagtataactttgttcattaaagagagtgttgatgaagagctgaaaggcactgatacatctaaccttcctaaaaataggaggctgaccttctgtgtagaagggaatatcagtgttgggaaaactaccttccttcaaagaatagccagtgaaactattgaactacgtgaccttgtagaaattgtacctgagcctattgctaagtggcaggatgttggccctgaacacttcaatatacttgatgctttctatgcggagccacagaggtatgcatacaccttccagaattatgtatttgtgacaagggtcatgcaagagaaggaatctg

SEQ ID NO: 30937 - DNA, 545 bp, Sorghum bicolor
  Clone ID: 18062365
gcacgaggggaactcgggcaggcaaagctgttcatatgcttatccatcacagtcgaaatacagcacaaaagcaatgggatgaaactatcgttcttgtacttggtggtattgcacggcttttgcgttcttttttctcttacctccagcaactgagaaaattctcttctggttgggtgcttttacttgattttataaaaaatagcatcttaaacggtagcaaggaggttgcacttgctgccataaattgcttgcagacgtttgtcgtctcaaactgtccaaagggcaatctggaatccccatatgtcaaatctgttctcgatatttatgaacttgttcttcaaacttcacctaattttaagaatgactccactgataaagtgaagcaagaggttctccgtggtcttggtgatctttatgtccaagcacgatctctgtttaatggtgacatgtatctaaggcttatggcaattatgcatctgatgatcaagactaccctgaatcctactgattatgatagtgaactgggtagtattcctgctgtacac

SEQ ID NO: 30938 - DNA, 539 bp, Sorghum bicolor
  Clone ID: 18062384
gcacgagggtggtgagggcgccggcgaggcttggtaagcgcgggttgtgcgccggcgcggaggctggcggctcggccggtacggtggtcgggcaggaggaggctttggagtgggtcaagaaggaccggaggcgcctgctccacgtcgtctaccgcgtcggggacctcgacaagacgatcaagttctacacggagtgcctgggcatgaagctgctgaggaagagggacattccggaggagaggtacaccaatgcctttttggggtacgggcctgaggattcgcattttgttgtggagctcacttacaattatggtgtggagagctatgacattgggactgcttttggccaccttggaattgctgttgatgatgttgcaaaaacggtggaacttattaaagcaaaaggaggaacagtcacaagggagccaggtcctgtcaaaggtgggaagtcagtaattgcctttattgaggatcctgatggttacaagtttgagcttatagaaaggggtcctactcctgagcctctgtgccaggtaatg

SEQ ID NO: 30939 - DNA, 503 bp, Sorghum bicolor
  Clone ID: 18062426
gcacgaggctcatcgctggtctctgccacgtgcggcgccctgacctcgcgctgcaggtgctcgacgaaatgccgaacctatgcctcgcaccggagagggatgcctaccgcacaattgtgcctgctctctgtgacgctggcatgcttgatgaggccacacatgtcgtctattccatgctgtggcgggtgtcgcagaggggctgtgacgcagatgttgtggtgtatcgggcattgctggtcgcactctgtgcagctggccggggcgaacaggctgagctggttctggataaggtgctcaggaagggtctgaggtcaccaggcagtcgtcggtctcttcgtgtgctaatgcttgctgtgcttaacctcgaggatgctcgggaatccattgaccaggcgttggctgttcgaggtggccgcactgtatgcagctttgagtccatgattattgacctctatgaagagtgtcggtttgatcaggcggacaaattgctcgaggacatggcc

SEQ ID NO: 30940 - DNA, 434 bp, Sorghum bicolor
  Clone ID: 18062438
gcacgaggagaaattgaaggtgtgcgtgaagttgatcctaatcatgacagtaaaatggtggttgatgatccgaaggatgagaatgaaaaagagaagcatgctgagcttcttgctcttcctcctcatggagctgaagtttatgttggggggctctcctctgatgtatcttctgaagatctcaaacgactgtttgaatctgttggagaagttgtggaagtgcgaatgcgaggaaagggggataacaaggcgtatgcttttattaatttcagaactaaagagatggctttaaaggccatccgaaagctgtgcaataaagacctaaagggaaagaagataaaagtttcatcctctcaggctaagaataggctatttattgggaatgtaccccgtgattggacacctgatgatttcaaaactgcagtggaagaagttgg

SEQ ID NO: 30941 - DNA, 564 bp, Sorghum bicolor
  Clone ID: 18062479
gcacgagggatcagtatcaagcagtggttgctgcagcagctgcctcccagtccggtggttatctgaagcagcaattcctacaccttcaacagcctatgcaatccccacaggagcagtgcaatctcaatccgctgttgcagcaacaaatactacagcaagcgagccaacagcagatggttagtcctgatgctcaaaacattcagtccgtgctcagcccaaatgctattcagcagcagctccaccaactccagcagatgcagcatgctcataatgaccagaagcagaagattcaaccagatcaaccgtatcaagttcctagcagtgcggttctcccaagtccaacatcattaccaagccatttgcgtgaaaaatttggcttttctgatcctaatgtgaactcttctagcttcatcagctctagcagcaacgaaaacatgctggaatcaaacttccttcagggaagctcaaaatctgtggatttgtctagattcaaccaaccagtagttagcgagcagcagcagcagcagcagcaacaggcatggaagcagaagtttatgggctcac

SEQ ID NO: 30942 - DNA, 516 bp, Sorghum bicolor
  Clone ID: 18062520
gcacgagggctcttcatgtatgctttctattattggatattacattagctttgcaagatgcaacaaaggctgtggacataatacaatacttggaaaggtcatttggagtagctaacacaatgaacccgaatgaaaatgcaagcatacctcagcagcaattagctcaaccgaagcctcctgccagaattaacatgcctccagattctgattcaaatgcttatgctggtggatatgagaacctttcagcgggaattttcccagatgatcaaatagaatttgaatctctgtactctacctttgatggacatcagaatttgggcaggcgtatcttgaatgatttctcaagggcatctgctgatctcgctgctactgctgctgatttgaaagttagacttcagatttacaaggtccggcttctactgctcactaggaaccttaaggttgcgaagcgagaactcaaagtactaatgaacatggcacgtggtagggattcatctacagagcttctcttgaaat

SEQ ID NO: 30943 - DNA, 495 bp, Sorghum bicolor
  Clone ID: 18062550
gcacgaggaaatggaagtactccctagactgctcaagttcctcgacagcatcgaggagttctacgactgcattggaggcatcatcggctatcaaattatggtattggagctcctttcatcctctaaggatcacatgcaccgaccaagcaaagacaagtttgttgatttccatgttcccagtggacttaatttattggaggataaagaatatgcatctcaagcagctctgtggggaatcgagggtttgccagaactaggtgaaatttatccaattggtggtgcgggtgatcgtcttggtctagtggactcagatactggtgaatcccttcctgctgcgttgctcccttactgtgggagatctctgttggaagggttgatacgggatctacaggctagagagtttcttcacttcaagatctttggaggtcaatgtataaccccagttgcaatcatgacaagttctgtgaaggataatcatgaacatataactgcaat

SEQ ID NO: 30944 - DNA, 460 bp, Sorghum bicolor
  Clone ID: 18062575
gcacgaggaggttatgggaactgatggttgcaaaaaggacattgatcagattatggcaactgttgattgctctgacaatgtacattctgatatgcattgcaaggaagctaggtgtgttaatacttctttggctgaccctcaacaaaactgtgattgtaattttccagacacagaaaatacttctatgcagagatctggtgcactcttcactatgaatgagactgaacagtcaagcaatgagaccagccacaaggaacagtgtatggatttgaaaagattagaacttgagtcctcatctttgaataaccaacatgattcacctatccgatataatgatggtcataatgtggatataaccgctaaagcagcaagtgcaccactgagttgtggtggtgaatccgagtcttgcaatgcaactaacaatgttgaagctccacctgttggtgatactgaagaagtt

SEQ ID NO: 30945 - DNA, 567 bp, Sorghum bicolor
  Clone ID: 18062594
gcacgaggatcccttctctttgcgtaaagccttttgccacaagtcgcgctttaaatctttctacgttcccttgggagtcatacttggttttgtagacccatttacagcctactgttttggctcctttaggaatttcttctaaatcccaaactccattggagttcatggatttcatctcttctatcatagcttctagccacttctgtgagttggcgcttctcatggcctcatcatatgaggtgggatcaccctccatatgaaattcctctgtgttaaaaacttcatagtcatctgggatagctgaccttctgattctttgagatcttctcggtgcctccacagttggcacttgatctggttggggctgttgttgctccccctcgcctgtggcaactggttcttctatgggctcctgaaggacaggttcctcattttcatctgttgttgccacaggagagtgagcaattgtttctggcatcacagtgtcgggcactgttggtgcattcacaatgggtaattcaaaaaatggctcttgaatcatcggagtgggtgcatacacccgcttct

SEQ ID NO: 30946 - DNA, 455 bp, Sorghum bicolor
  Clone ID: 18062619
gcacgaggcaaagggcagtcctgaaccggagctatgcatctcatttttggagttgccggatctcaaaatctctagccactgttagtgttacttcctcgcaggatcagtctgctctacccatcgattgccgtgacacggttcaagagacttttctgctataaaatcctattctttacccctgtcctaatggatctccctgaaaagaagcttactgacttcatcaaaggcagagaaaaggcaaaatggataccagtcaacaatcataatgtaaacaacttcacagaagatgagattaaaaggataactaacaattacagcactcccattggccaaggtggctttggacaagtttaccgaggttctcttgatgatggtactactgttgcagtaaagaaatacatctgccagaatgtgaaagatggatttgctaaagagttaatcgtccattgccaaat

SEQ ID NO: 30947 - DNA, 562 bp, Sorghum bicolor
  Clone ID: 18062640
gcacgagggtgacgaatagtttgtgggactacactgatgttgtcatgaactacctttgtgggccatacacttcggatgtaggctctggtctcaaccacaaatggcttcaatattttgatattgtaataacaggcagttcgaagccaagtttcttccatgatgataaccgtgcaggcctctttgaagttgagcctgattctggaaagcttctgaatgctgatattcagattggaagcccaagatcaagtcatcaacactcaacaccagttcagaaagtttaccagggaggcaatgttggtcatctccacagattactttctgttgcttctagttcacagattctctatgttggtgatcacatatatggagatattctgcggagcaagaaagttctgggttggcggactatgctagtaattccagaactagaacaagaggtgaagcttctctcagaatcaaagtctacaaggaaggagcttagacatcttagaatgaagcgtgattcaattgaagacagaatccatcatcttgaatggtctcttaaacttgatgatgtcacaga

SEQ ID NO: 30948 - DNA, 581 bp, Sorghum bicolor
  Clone ID: 18062642
gcacaggcttaactgtggactatgatttgagaaaaaagactttcaccatccttcatcaagaggaagtaactaccctctctgcaaatctaggcagcctgggctttcaatccaatgcttcaaggggacacaaaacctgcatcttgttgaaaattcacaaagttggagtgatcgtgagagctattctcgtgtcaaaggactgaagttatatcacatgatggtgttctaatacctttagtcatcctgtattcacgggaagcacattgtcatggagaatcacctgggatcttatatggttatggagcttatggagaagatttggacaaaagctggtgttctgagaggttaagtctcctctctcgaggttgggttcttgcatttgcagatgttaggtacgttcagcctacagagctgcagtgactgctgtcgctaccatattttagaattttatatataaaaggttgtttgacaagcagactagcattcctgcataagtggccaggagttattgcatgccacaaaaaagaaggattcacatacgttaatccactagatcttagcagtacatgaattttaacctttag

SEQ ID NO: 30949 - DNA, 409 bp, Sorghum bicolor
  Clone ID: 18062646
gcacgagggttggttcgtaggtccggatttttttcttcctggggcgtgattcgtggctgagagaggatcagaagagggaacggctattgactattcagtgctcgcgagcgagcttcccaccgtcccctggtcgattcggtgcaaatcgtcccaagcttctgggtcctaatggcttcctcagatatctctgttgatattcgtcctgacataaactcgtttgatcatttcctaagcatgcgatacattgcaacagatagaccctggctgaaattatatggaataagagttcagcctgtgccaccattcagcagtttgagctacaaacctgatccagcactcattcaccattgcctacctgatgaactaatgctcgagattttcacaagaatgagcccatatactttaggga

SEQ ID NO: 30950 - DNA, 523 bp, Sorghum bicolor
  Clone ID: 18062660
gcacgaggcctccatcctccttcatcaagtttgtgaatgttacattttggagaaccccagaagctgcggaatcacatgcaaaaatggcacatagtacaggcttggtacaggctatcctatttgaagctgcagacagggataacattgggggatctgcctatggtggacagaggtccatatgctgtacccctgaccttgctaaactagagggctgcaagcaaggggaagtaatcaggaggccgtcctctgatgatccagattggccctacgtgctagacacacacttcagcgctaatcacctttcagtgaagttagaagatgagccagtgcgcattacaaagacaggcatgtacaacttgttcttcatatcctgtgatccaaaactgagaggcctaactatgagtgggaagactatctggaagaatcctggtggttatctgccaggacgaatggcgcctttgatgaaattttatgttctcatgtcgctggcatatctgttggtaatgattgtttggtttagcca

SEQ ID NO: 30951 - DNA, 209 bp, Sorghum bicolor
  Clone ID: 18062664
gcacgagggtcgatgcgagacgtcgatcaggataccggaagggatctcctgcctatgtctctaaaccgtggggaggaggacgcgccgagggcaaatccgccagctgatcgtgccggagccgccgggaggaggaggaagggggtttctgggattttcgttcccgatgagaacgaggacaaggctggtcctgcgcctcgcaggccaactag

SEQ ID NO: 30952 - DNA, 534 bp, Sorghum bicolor
  Clone ID: 18062668
gcacgaggggatcacagagcagtaattctagagctcaaggttttcaagcacagttttgcaccctagactcgtcttcggccaattgtgtttatcctgcacatagctctacctcttctcagagcataagtggaagccctctgtctcagcaagagagccactctgatcatgcatatggttcctctccaagtgcatcgtgcattactcaggttcccacctggacacttaaggatctagaaaatgtgatgcttggacccgattctgacatatgtagccctgacagttcctttctgcctggcactgccttgcatgaaaataactggagagaacttttgggaattcaaactggggatttgaggcagttaattatagcatgtggtaaggctgttgacgagaatgctttctatatggatgcactgatgtctgagttaaggccgatggtttctgtctctggtgaaccgatgcaacgtctgggagcttacatgttggaaggtctcattgcgaggctttctttcactggacatgccctgtataaat

SEQ ID NO: 30953 - DNA, 168 bp, Sorghum bicolor
  Clone ID: 18062680
gcacgagggtataagccgtcccagcaatccgcggccttcaattcaggtgcaaaggagaggatcattaggatgtcagagatggctgtggatcctcttgagccaccaaagttcaagcacaagcgtgtgccccgaccatctgggacaccacctgttccagtgatgcactcg

SEQ ID NO: 30954 - DNA, 524 bp, Sorghum bicolor
  Clone ID: 18062688
gcacgaggctgcctgctgctgccgcgccgaatgatcaaatggccaccggatcatcaaaaagcaagggaatgttcaatagatccaaatggctgatcgtttctcttgcgactgggttggcgattgccgccttcatccttgcactcaccatatggtaccgtcgaaaacggcgaccggctcacagaggacatgtcatagaaccccttgttttgaatcgtcaagtagatggcatgccagaggaggctatgcatgaccaagaaaagaagggtttgagcagggaaggagacgaggaggacgaggacggccgaagaacgagctgccaactctacagttaccagcatcttgaggctgcaacatgctgcttctcaagtagaaacaagctaggcagcggtggatttggaacagtatacaagggcacactcgagaatgggaagaaagtagcagtgaaaaggctcagggattccaagaggactatacaagaacttgagagggagatatccattgtggccaacttgcgccataagaac

SEQ ID NO: 30955 - DNA, 618 bp, Sorghum bicolor
  Clone ID: 18062698
gcacgagggtctttcgcggatttaaggatacaaagacgcctctatatgcaactgtggctggagatgcaatcaatatagttttggatccaatatttatctgtgtcttccaatatggtgttaagaggccgccattgctcatgttatatcacatgtatggtggaacattctggagatatttcattgcatccatactcttatggaggttaaggctgcatgttgatttgttgccacctagctttaaacatctgcagtttggccggtttcttaaaaatggttttctgttacttgcacgagttattgccgcaacattttgtgtgacactatctgcgtcaatggctgcacgacaaggttcaactccaatggctgcattccagatctgcttgcaaacctggttggcttgctcacttcttgctgatggattggcttttgctggacaggccatacttgcaagtgcatttgctcgtaaggactatccaaaggctactgccacagcttctcgtatcttgcagctggctttggtcctgggacttatcctaagcatacttcttggtattggtctgcgcataggatctagattatttacatctgatcaaggtgtactgcatcatatctacatag

SEQ ID NO: 30956 - DNA, 219 bp, Sorghum bicolor
  Clone ID: 18062705
gcacgagggtcaactgtggagtcaaagagttctgaccaagataaggagattcatggaggtgtcattcctcatagtagtgatcctttagatggcataattcaaaagattaagctcttaagcataaacggaccagacaaggttgtggcagaggtacccaaaaatgctcttgttccttatcaaggtgaatttggtgcactggttgcatttaaggggaagaca

SEQ ID NO: 30957 - DNA, 509 bp, Sorghum bicolor
  Clone ID: 18062716
gcacgaggccccaacgtcgtgtccatcgtcggagcctacgaggacgccgtcgccgtgcacctcgtcatggagctgtgcgccggaggggagctgttcgataggatcatacagcgcgggcactactctgagaaagcagccgcacagttggcccgggtgatcattggggctgtagaagcatgccattcgctcggggtgatgcacagagacctcaagccagagaatttcttgtttgtcaaccaaaaggaggatgcgcctttaaaggctatcgatttcgggctttccatcttcttcaaaccaggtgaaatatttttggatgtcgttggaagtccttattatgttgcccctgaggttctgaagaaacactatggctgtgaggtggatgtgtggagtgccggtgtaatagtttatatcttattgagcggggttcctccattttgggatgaatctgaacgagggatatttgaacaagttctgaaaggcgatcttgatttttcatctgatccctggcc

SEQ ID NO: 30958 - DNA, 509 bp, Sorghum bicolor
  Clone ID: 18062717
gcacgaggaacaaaggactgtgtggcaaaaacattgaagaggttagaggagaagataaatggacgagtgttgaaacacttgctttatttgatgcgagtaggagagaaatctgtgcaaaggcagagtgctctggctcttgcacacctttgtgcccctgaagatcaaagaacaggggggattgataataatggtctcgacttgcttcttgatcttctgatttccatgagctcaaaacatcaacaagatggctcagcagcattatacaaattggccaacaaagcagcagcactttctcccatggatgctgctcctccatccccaacacctcaggtttatcttggtgagcaatacgtgaatagttcaacactttcagacgttactttcttggtagaaggaaagcgcttttatgcacacagaattgctttgcttgcttcttcagatgcatttcgtgcaatgtttgatggcgggtacagggaaaaggatgcaagagacattgaaattccaaatat

SEQ ID NO: 30959 - DNA, 491 bp, Sorghum bicolor
  Clone ID: 18062720
gcacgaggaaaacattctgtttcagtgctttgatcaaacaagaaaaagatggttcatagtcctgtagcattcctaagaaagctccaaacttcctcttcatctttagccaccgagttgatttcttttagcaaatatgcacaaaagtccatgaaatactcttggcagttcatctgtcaaaataatccactcttcatccaagtcacttattttaccttgatttcatttgctggatatgcagctcttaagatcatcaagccacgagatgaacaagatactctgaaagacatagacttattgtttacttctgtatctgcatcaactgtctcaagcatggctactgttgaaatggaggatttctcaagcgctcagctctgcatattgactattttaatgctgattggtggagaggtattcacttcaatgcttgatctttatttcatgcgggctacatctattacaaaagggtcttccaacagaaagggctactcagt

SEQ ID NO: 30960 - DNA, 568 bp, Sorghum bicolor
  Clone ID: 18062732
gcacgaggccgggatgcccaagtataagtacgtcactggtcctccttccgattggagtgaccgtgaggtagccatactgaaggaagggcttgtgagatatgctcgtgaacctaatatcatgaggtacattaagatagcagctatgcttcctaacaggaccatcagggatgttgcgctacgatgctggtgggctacaggtaaagagagaaggaagaaacctgatggattctatacagggaaaaaagtgagagacatgaagccaatccaggacaaaatggttgcatctgtcccaatagctaattttcaaatgacacctacaaccaatgtaacccccttttcaatatcaatgcaacatccaaatcaacaaagtcaagttcacaaagaagctcctgttgtcgacagtgcaacccagcatctcctggaggaaaataatcaattgcttaaccagatttctgcaaatattgaaacattcaagacagtggagaacacagatctttttctccgcacgagtaacaacatcaaaacaattttaagcagaatgagtgaaacgcctggtatcatgggtcag

SEQ ID NO: 30961 - DNA, 618 bp, Sorghum bicolor
  Clone ID: 18062736
gcacgaggtatgaatcgtgcccatggagatttgatcctgttgagacaaatcctgacaatgtgaaagagagagcaacaaagcttctagaccagtacaggaaaaaatcaaccctgtatagaacgaatacacttctcgttcctttgggtgatgatttccgatatgttagtgtggaggaagcagaagtacaattccgcaattatgagaaactctttgattacatttactcaaatccgcatcttaacgccgaagtcaaatttggtaccttggaggattacttctccacattgagagatgaagctgaaaagataaactatacacggccaggtgaattgggttctgctgagctgcaaggttttccaacactttcaggggatttctttacatatgctgatagaaatcaggattactggagtggttactatgtgtcaaggccattcttcaaagctgttgatcgtgtactagaacagacgctccgtgcctcagagattctgggttcatttgttctaggatactgtcagaagtttcagtgtgcaaagctccctatcagcttctcacacaaactgacagcagcgaggaggaatttggcgctttttcaacatcatgatggggtaactggaa

SEQ ID NO: 30962 - DNA, 550 bp, Sorghum bicolor
  Clone ID: 18062771
gcacgaggaagataaatgtgagagttcttcgatagatcataatgatcaaaatgtagattttggaagattatcggcaagggttgacgtaactgatgttgcaaggactgaacacagaccatccttagaggcttcagaggacattaagcaagaggggcatatttcttcatcagcaacaggagttgacgaacacctggatgctggggtcacatcaacaacagcagatgagaaacatctggatgattctggaatgacagatggaacagctttatactcaccagaacctctgtttccattacctgcatatgaactgcaggaccctaaaccagatactagagaaaatagtgagtatccctgccaaacacatggagctgcatctggagatgataagtcaatggatgcttttggcaacatggaaagcaccccagcaggacatgtttctgaaaataggtgttaccagcaacatcagcatggtgaatcatcctcaaagacttcagaccatgaagagcatattacaaatgcatcagaggacggtgttaagcatcagtctggt

SEQ ID NO: 30963 - DNA, 487 bp, Sorghum bicolor
  Clone ID: 18062779
gcacgaggcgagggaagagtcaatccagaaggtgttgcttattacaaaaatttgataagctacctgcttcagaaaggcattactccatacgccaatctttaccactccgatcttcctcttgcgcttcagaacaaatatggaggatggttaaaccccaagatggcgaaactgttcacagactatgctgacttctgttttaagtcttttggagatcatgtaaagcattggtttacattcaatgagccaaggatagtagcactacttggttatgatggtgggtcgattcctcctcaaaggtgtaccaaatgtgctgctggtgggaattcagcaacggaaccttatatcgttgctcataattttctcttgtcacatgctgctgcggtggcaagataccgtaataagtatcaggctgctcagaaaggaaaggttggaatagttctggacttcaattggtacgaacctctcacaaactcaactgaagaccaag

SEQ ID NO: 30964 - DNA, 529 bp, Sorghum bicolor
  Clone ID: 18062785
ggcacgagggatcaactaccacccttccgcattctaaagaaatctgaatatgaaaatttgacaaatgaacagaagtctgcatatcttgatgaactggactaccgtgagactttgtacctaaagaaacagtggaaggagggaatcagaaaacaaaagcttactgaagctcagaatgacgaagttggtgatgattatgaagagagtgcatccccagaggttgtgcacatgtcagatatggacattccactatgttttgactctgattatcctgtgcatcgttaccgtcacattataactgatgatcagttgtttagaccagttttggatccccaaggatgggaccatgatattgggttcgatgccatcaattttgaagcatctaaagagttgaaaaagaatgtctctggagcaattacaggacagatgagaaaggacaaggaagacatgtatattcattcagaatgttcagtaagttataatgctcacagaggctgctccttgatggggggtatggatatgcaaatggcaa

SEQ ID NO: 30965 - DNA, 498 bp, Sorghum bicolor
  unsure (1)..(498): unsure at all n locations
  Clone ID: 18062809
gcacgagggggagatgctcaattgaaaatgcgcaatagtgcctcaggtttatcatatatggttcgagttgaagtgcaaaatgccgatctagacatatacaacaagagattttctggaaaaaataatgtcaatactggtacagtactgattctgctttctgatgacaagactggttttgtaccttacaggatcgacaatttttcaatggagaaactgcggatatatcaacagagatgtgaatctattgaaacaatcgtttatccctacacatcctgtcaatatgcttgggatgagccttgctatcctcatcgccttactgttgagattcctggagaacgaagtttgggtacattcaatctggacattctcaacgacgatgttcatgtgtcactaccatccacatctgagaaagctgaaaggcaattctgcatctcaatacatgcagaaggagcaattaaggtgctaagtgttcttgattcanattaccacaatacggaa

SEQ ID NO: 30966 - DNA, 563 bp, Sorghum bicolor
  Clone ID: 18062833
gcacgaggatccagtggagcggcttacagttgaagaatttgtgcaccacccatttctttctgaacatgctccagagaggaccttgagccggacaccatctgacataagagatggatttccaataaataatagcagtccaacaaggccttcaagccaaagttcacaagaagattgtatgccttttcctttagatgatgagtcaagtggacaggatgagggtccagttcctgacagtaagagcccgatgaaatcttatgggcttcccacgggtaaaagattggataaagcttcaggccagagtccatcaaagcataccagtctgttctccaggtatgtcttgggcaataaccatgcacctagtagccaacaccatggccatactggtaaaatgaccaaggaaagcaagattcctgaagtacatggtacgaaaggtgtttatccagaaggtatggaagtcattagtgactatcttgcacttactcatttttattatgaacaattcttactgaaattattatttctttactttgtaaatgtagattcccctatcattgattcattag

SEQ ID NO: 30967 - DNA, 512 bp, Sorghum bicolor
  Clone ID: 18062849
gcacgaggctcaatgccaaaggcagtgtggtggcgttgacatccattacccattcggcataggtgacaactgctccctgtcaccaggcttcaatgtcagctgtgatgaggtacaagatggcatcccgaagccattcatcggtagcgtcgagctgctcaatatttccttgattcatggcacaatccgggtgctcaaccccatctcaacatcctgctacaactcctcttccggtctcatggagggtaatccatggttgatcaacgctactgattctccctatcggttctctgacgtccacaacaagttcactgtcatcggatgcaacacccttgcctacatctcgggtagcgacggcacaggctaccagagtggctgcgtctcgacgtgcagcagtctgtcagacttggctgatggttcctgctctggcatgggctgctgccagacggctatacccaaggggatggcctattacgatgttggcttcgacagcggtttcaacacaagccaaatct

SEQ ID NO: 30968 - DNA, 521 bp, Sorghum bicolor
  Clone ID: 18062857
gcacgagggattacagtggcgggtgccaaaggagagtaccactgcagtgccagaccaattcgagctctgcacaggctcagcctgataagttctataccatggaaagtgtgaggctacctgataatgctcagactactgtggcggcgagctctcaagactgtcaagtgacttgtctgaacaattgctcttgtaatgcatatacttataacagtagtggctgctttgtttggcatggggatctgattaaccttcaggatcaatacagcggaaatggaggaggcacactcttcctcaggcttgcagcttctgaactgccagactccaaaaagagcaacacagtgaccattggtgcagttgttggtggagttgctgcagttttaatattgctttctattgtgtcctacttcttgtttcagaaataccgccgagaaagaactctcaggatatccaagactgctgggggcacaatgatcgcctttaggtatagtgatctgcagcatgtcactaacaacttctcggag

SEQ ID NO: 30969 - DNA, 551 bp, Sorghum bicolor
  unsure (1)..(551): unsure at all n locations
  Clone ID: 18062859
gcacgagggaactgataataaatatgttgcttcacaacaggttacatctgtttcatttagcaactgtggcacctatttttctggttctagcacatcaaataatactttggtttgggatacaaggcttgtcccaataaatcaaagcaaggatgtttcacgaagcagagatatgcgattttttcggcctttacattgctttagccatggtagtcagatgcctacagcagaatacacaagtcaactgccagggtatgtaaaatgcggcactaatcattattgcatctagtgattagttatgcctgaaaagttggtgacaatttatatgagcttcaattgtgaacctagtggaagtcatctatactatgaattacaatttaatttttcactggattcatgatggtgctgtttctagtaatctgatgtagattgtttctagtaatgaaactaatttgatatcgtagatgttgatgcattttttttctataagcttgttgacctaggacaaatgctaaagtgaacttaggacatatacttatttacttttgctngtg

SEQ ID NO: 30970 - DNA, 571 bp, Sorghum bicolor
  Clone ID: 18062862
gcacgagggtaacaagtccaaatcttgattcaattacacctggcagtgtgtacccaggttctcatacaaatgggataacactgccgaaccatcagggttctgttggtccttctactcctacttcaaatctgaattcccggttaccaggttctcctgctatggttttgggcagcaattcaccgtcaccttcaacatcgaatagtcctagggatgctcagaaatatggtgttcccagacctacctctttacagggtgacgaacaaccaaagattcaatataatcagatggccaatggcagaaatcttcatcagcctggagtttctgctcctggaactattccttccggggttgattgtggtgcaggtgcccgcatgatgccttctgcccctggtatgggaatggtggcaggactaaatcgaggtatgcctggtgccaggccaggctttccaaggattagttcaccagcaatgctaaatgcagttccgtctggaaatctgttgcccaacagtgggcaaggtgtgctcactgcagtaagtgtccatcctggagccatatctggtcctggcaattc

SEQ ID NO: 30971 - DNA, 611 bp, Sorghum bicolor
  Clone ID: 18062864
gcacgaggggagtcagggacattgggtgcaaagtgcaatacacaaatggtcattcctcaccttactgaaaattatggagcttctagagacccacccgagaagcaggcacccatgtgcacagtccattcttttccacacaacattgatcattgcttgacatgggcccgttcagagtttgagggtttgctagagaaaacaccaaatgaagtaaattcttttctgtctaatcctgctcaatatgctgctgccatgaggaaggcaggtgatgcccaagcaagggaattacttgaacgcgtctctgaatgtcttgacaaggagcgatgcaatacatttgaggattgtataacttgggcccgattgagatttgaggattatttctcaaaccgcgtgaagcagcttacattcacttttcctgaagatgctgctactagcacaggcactcctttctggtccgccccaaagcgctttccccgtcctctgcaattttcagccactgattcatctcacatcaacttcatcatggctgcttcaatactgagagcagagtcatttgggattgctatacctgactgggcaaagaatgcaagtaagctggctgatgcggtcgataa

SEQ ID NO: 30972 - DNA, 568 bp, Sorghum bicolor
  Clone ID: 18062868
gcacgaggcttcgtcgtcaccccgccggcgctcccttcctcccctggtccgcccggatacaggttccctcctgagcgcgggaagaagttcccggtgaagcttgaatcgagaagtggtgttaacatcatcagggagaagttggattagtccgccaaagtgctcgatgacagatcattttgctctaagtctaggtgctctttttctgttgttgctaagtaccagtggtttcagctctgaacttgatgtccaatgcttgagagacgttcagaaatcggtgattgatccaaatggtatactcaaatcctcatggatttttgataacagcagtgcgggtttcatatgcaaatttactggtgtggagtgctggcacccagatgagaatcgagttcttacattgcgcctcagcaaccttggtcttcagggtccattccctaaaggtcttaagaattgtaccagtatgactgggctggatctgtcaagtaacagctttactggcgtcatcccttcagacatcgagcagcaagtgccaatgttgacatctctggacctctcctataatagtttctca

SEQ ID NO: 30973 - DNA, 519 bp, Sorghum bicolor
  Clone ID: 18062870
gcacgaggcgtgttcgagcgcctctggccggccatgcgcgacgacgccacgctcgccgcgtccgcttcctccctctccgcctcggcctcgtggcgccgcagcatgttaatgacatcacattaccagaattctggggacccatggatgccttgtgtcaacagtaggctgactcgatcagagttgccaccctcaaatggctatctcatgatagaagcaaatggtggtctaaatcaacaacggctttctatctgcgatgctgttgctgtggccagcttgcttaatgcaactcttgtgatcccaacatttcatctgaatagcgtctggcgtgatcctagcaaatttggtgatatatttgatgaagatcatttcattgagacactcaaagaacatgtaagagttgtgaagaaacttcctgaagatgttttgctgcgcttcaatcataatatcagcagcataccaaatatgagaactaaagcctattcatctccaaaccactatgtgcaaaatgttcttccaaaa

SEQ ID NO: 30974 - DNA, 506 bp, Sorghum bicolor
  Clone ID: 18062877
gcacgaggccaagaggagcccacctgtctccgaagctcaccgagctcctcgcttcgtatgaggatggcctggcctcgagcttgaggaagctcaagccagaggccacctcagaggtgctcacgctatcatggatgaagctcgccgtggactgcttatcggagctgcacaccaatatagccaccctgattactgagcttgagctgcccttatcggactgggaccagaagtgggtggacatttacctgaacagcagtgtgaagctgctggacatctgcattgcactgagctcagagctctctcggttggatcaagggcagctgcttgtgcgatatctcctgaatgtgttggactctgggagcgacatgccatcccaggagcagctcaagaaagctgcggtgtcgcttaaggaatggatcgagcgagcaagtgaaaggtctccgaggcttgatagctgcttggcagcgctacatgagctttctgggaacctttgcctgatgaaggttaag

SEQ ID NO: 30975 - DNA, 496 bp, Sorghum bicolor
  Clone ID: 18062904
gcacgagggttggcgacagctgtacgccggcgccccactcccagctgcccttggcggagcgccgccgccggccgccctactccggctgttcaggacgctttgccggcgagcacccccacaccagaaccacatgaatggatcatatactagctcgattagcctccacgatgtcagtgtcgacgatggacagtcagctcttgataacagcagcagagcctctagtccttttgacatcctgactcctcaagatgttattcctattgaaatggcaaggtctagattcttggacctcgttgtcgattattttatatgtgagcatgttattgagatggtggaatgctgtggctccgactgcagccaggtggatggcaaatcaaacaagagaaagcagcaggaggttcgatacgagggtgacccaagggttgctttgccgttgatgtatatagcaaacttgtacgaaaccttagtgagtgatgtcaatgtgcgtcttgaggcg

SEQ ID NO: 30976 - DNA, 569 bp, Sorghum bicolor
  unsure (1)..(569): unsure at all n locations
  Clone ID: 18062917
gcacgaggctagtctgaactctgaatttgatatgtcatttttctttcttccatgtaattttactttacctctttaaaatggttgtttatttagcagttaggacttagggatcgccaaaagtatgattataaatcatctgcaagattcaagcagatttctgatggtttgatacaatctttttttacatattatatgcactgtgttctttttttatttggttagtaatataattagatatggtgattttattggattttggtagtgtgcaaacagtgctctcagaatttgaagcttgagacattcagtaattctgcaatgctggtggaatatgtacaagtcagcgtatcgcactatgatcaaatgttcgcattgattttggtctgtattaattggccattgcatcttagtatacataaaatccggtacattgtttattttcagctgaataaacgatacatttattaactcanatgtgttgaatatttgtcactaataacaaacttaatcgacaccaccctgcatattactccatctaatgctttgctcaaaatacttacatttcatatatt

SEQ ID NO: 30977 - DNA, 473 bp, Sorghum bicolor
  Clone ID: 18062919
gcacgaggcgacgacgagaacggcaagaacgtggcggagcgggagaggaaggcctcctacttcagctggtactacggcgtggccaacctgggcattctcacctcggggaccctgctggtctgggtcgaggacaaggtcagctgggggctcgggtacggcgtctgcgcgtcgttcgtcgcggtggccgtcgtcgccctcgccgcgacggcgcccgtgtaccggctcgtgcctccggtgggcagccccttgaagggcgcgtgccaggtgctcgtcgcgttcgctcgcaaggtgaacgtgagagtgcctgacgatgctgccgagctgtacgcggaggagcatgccaaggtgtctttcctgcaacaacctcgcgagttgttagagcacacggaccagttcaggtgcttggacaaagctgcggttgtcacgagcgcggacttggaagacggcaacccatggaggctgtgcacggtgac

SEQ ID NO: 30978 - DNA, 543 bp, Sorghum bicolor
  unsure (1)..(543): unsure at all n locations
  Clone ID: 18062939
gcacgagggaggagcctcatgaggttgagtctcagagtcaatatgaactcatgaatccatcagtgtgtaacaatgaacttatcaatccatcagtgtgtaacgatgaaggcaatgagctcattgacgaggatgttgatattggggagaacgaccctccagtttcgactcttcctcctgtggtacttgaagatgaaacagcagacagaagcagcaagcatagtacatctagcagttctagtagtggctcagaatcatcctctagtgactcagattcaagtagctcttctggaagtgatacagatgccaaagctcctcaacaaaacagcgggccaaaggaaaaaattctacctgtggatggcttggataaagaaaaggattcactgaacacattaaatttaccagagcaaagtacaaaccctatatctgtttctgctgatggtgaggggggaaatgtatctgagaagcaggtctcccctgacaaccctgacnagcaaatccgagctgcccttctgagaagccgctttgccgatacgattcttaagg

SEQ ID NO: 30979 - DNA, 486 bp, Sorghum bicolor
  Clone ID: 18062956
gcacgaggccaccccggagaagactctgatgaggagaaggaggcggcggcggcttgggtggctacgaagactgggcgttggtgtttgtgttgtcgatgccgacgcagaggaagacgatgaggtcaattcgacatcctccacttcttcccggggttgctctaggaaggttgctagggtcaaggtgagaccatacaagaagcggtcaaaggaattatctgcagtgtacaaaggccaagtcatcaaggcgcatgaaggtgctattgtgaccatgaagttcagctctgatggccagtttctggctactggaggtgaggatggggtcgttcgcgtttggcgggtggtggaaggcaagaggcctgatgaccgtgattttattgaggatgatccttcatgtgtgttcttcactgtcaatgaaaactctgaattggctcccatcaattcctgcgaagggagtaagggcaagcacagcaagagttcaaagggggc

SEQ ID NO: 30980 - DNA, 544 bp, Sorghum bicolor
  Clone ID: 18062986
gcacgaggctgggcatcatgcgcgtgcccgggatcggcctcatctacacggagctggtgacgggcgtgccggccatcttctcgcacttcgtcaccaacctgccggcgttccaccaggtgctgatcttcgtgtgcgtcaagtccgtgccggtgccgtacgtgcccatggacgagcggtacctcatcgggcggatcggccccagggagtaccgcatgtaccggtgcatcgtcaggtacgggtacaaggacgtgcagaaggacgacgagaacttcgagaaccacctggtgatgagcatcgcccggttcatccagatggaggccgaggagtcggcctcgtcggcggggagctacgagtcgtcgccggagggcaggatggcggtcgtgcacaccaccgacacgacggggaccgggctggtggtgagggactcatccgtcgacgcagcaggcacgtccctgcccctgaccaggagcagcaagtcagagacgctccggagcttgcagtccatctacgagctggagtccgtcggcggcgtcagccggcggcg

SEQ ID NO: 30981 - DNA, 616 bp, Sorghum bicolor
  Clone ID: 18062992
gcacgaggctttgccggcgacagcacccaccacaccagtcaaatgaatagttgatttcatttcaagctattcctgaacaactatattacaatcatgaagtcgttagccaagcaagagacacagccaaaaccgcggctcattgtgcgccttggtgcattccttgcgtctcaccacattctcttcagtgttatatgctgctttgcaggcattatcgcactactactccttccatcacttgcaaaaaacacatacctctcggagaatgctcttatacctggctctgccaatccattattttctactgaagatgccatcgaagcaaacagatttatgaaaggaattgaagctgcggctagagactcaagaggtgtaataggtatggcaaatttcatagcacaacaaatagaagctctaggtgcagaagtgtgttaccataagtttctccctcatagcaagaattttcatcctctgaagttcttcacctccatgacaaatgatattgcaattcaacctaatggcacgaccaccaattttgggatgaatactgtcggcattgtacgagctcctcgtggcgatggaaaagaagcaatagtgctggttactccttataattctc

SEQ ID NO: 30982 - DNA, 557 bp, Sorghum bicolor
  unsure (1)..(557): unsure at all n locations
  Clone ID: 18063004
ccccgcgaggaggagaacacggaggcggtgcccgtagctgtaggggacccggtcaaggtcaccggcaaggggaggaagcagaagaagcactacgcttccttcgagtacgagggcaacaccttcgagctggaggaccccgtgctgctcacgcctgaggacagcactgagaagccctatgtcgccatcctcaaggatataacagaaactgaggggagcctatatgtaactggccaatggttttatagaccagaagaggctgacaaaaaggagggtggatgctgggtagcacgagatacacgagagctattttacagttttcatattgatgatgtgcctgcagaatcagttatgcacaaatgtgtggtccatttcattcctcagcacaagcagattcccagtcgaaagcagcaccctggatttattgtccagaaggtctatgatgcagttgagaagaaactgtggaacctaacagacaaggactatgaggataacaagcaacaagagattgatctccttgntnagaaaacgatagaccgtattggtcagcttcctgatct

SEQ ID NO: 30983 - DNA, 477 bp, Sorghum bicolor
  Clone ID: 18063010
gcacgaggagaaatctgagtgaacattctagcatttaaaatttgtccttattgtttctaccactctccgtcctgttctcttttgaattcagaataatgcatgtcaatcttatatccaagtagcattttttcctatgtaatgtttgattgcattgttgtgtcttgtcttgaggaaatcctccacagaattcatttctacattctgactgttatagcaacgtgcaatgcactggaacaggctattccttatttcatgattctagcaatgtgtgatccaatctggagttgattgtggtcccacatggtgcgcagggggtgcatgtatctgagtcaggttgtgtgacttttttatcatatttgtgcaaaccacatccgctggtactcccaaagaccatacagatgaaaatcttttcacacatggtcggaaagcttaactgcaaagtccatatacctaggtgcctttttttcaccttactaa

SEQ ID NO: 30984 - DNA, 546 bp, Sorghum bicolor
  Clone ID: 18063017
gcacgagggaaaggtctatctgaatttgaaggcagtgaggatggaaagatatttgggcactgagactcaaagccactcttgatagatcacgaagactaacagaagaatactctgaagcacttctttctatatttcctgaaaaagtcaaggttcttgggaaagcccttggaataccagagaacagtgtgagaacatacactgaagctgaaattcgtgctggtgttatttttcaggtctcgaaactttgcactgtacttttaaaagcaactcgagcagttcttggatcgtctgtgtgggatgttcttgttcctggagtggcccatggagccttgatacaggttgaaagaatagctcctggatcattgccatcatccatcaaagaacctgtcgtgctagttgtaaacaaggctgatggagatgaagaggtcaaagctgctggggataacatagtgggtgttattcttctacaagaattacctcacctatcacatcttggtgttagagctcgtcaagagaaagttgtatttgtaacttgcgaagacgatg

SEQ ID NO: 30985 - DNA, 614 bp, Sorghum bicolor
  unsure (1)..(614): unsure at all n locations
  Clone ID: 18063036
gcacgagggtaggtttgtgtttaatctactatagattgtgtttgcaatgaatcataagctctaagtatttttggttagtggtgatataaatggtttactacacgagtgaactatccacatatcaacctgtgtccctgtctccccattctccactcttatgccagtattctctaccaccagattttaacaatatgatattagatcttttgccttatttttttggttgcttttttgccttaaaaccacatcttggctctgaagtttgtgccttcacctcatccaaactcctaggcacgtgcctcgcatgactgtactctgtacatagtatggtcgcttggtgaatacatgaaacaataataatgaattctatgcaatgaacactagttgcacctggatctgcaccatggattttttcagaataataataacacataaattgaacattttatgcattttacttatattatatgcttacatttttgtacttttacttatattatatgtctacatttttgttgtcagtaggttatttttcatatttagtctttcattattacataatcattccagttctctcttattacagttctacgaatggaactggatatacnana

SEQ ID NO: 30986 - DNA, 578 bp, Sorghum bicolor
  Clone ID: 18063045
gcacgaggctccagcgctgctttgcatattgcagcatatttccaacgacctggaggtttaatcgctatgatttggtcaaaatgtggatggctctcggtttcattcaaccaccaacagatgaagggaaagggatggaagatttagggcaaaaatacttcgatgatcttctatcacggtccttctttgggactgcaaataaagaccagcaaacgtattacttcctggatgacctaatgcacagtttggcacagcatttctccgctcatgattgcatgaaaattaatgaggatgttcctgttgtgattccaccaacagttcgtcacctgtctatctcaactgattatttaccacagctgaagagcaaatacaggctgggaaggctgcggacattgttagttctcagaagcccatcattatcctcaagtcattttcctaggaaacttttggccaaatttaagaacttgagggttctggatcttagtgaatcagatattgcagaattacctgaaaccatcagtcagttggttcatctccattacctagctttcagtggtatagctaacaaacttcccaagagt

SEQ ID NO: 30987 - DNA, 562 bp, Sorghum bicolor
  Clone ID: 18063047
gcacgagggttcttgaagatactagagctccagattcctttgcagagcaatgcgaggtgcaacttggccctcctttagaaggtggtcgtattacgatgagctctgtgcagtttggcagctccacatgcaaagcatcttcagaacattcctttgcagagcaatgcgaggtgcctgccccatgtattgattcagttgactatatggatcttgataccgaagctgctgccgaagttgtcttagatgattcagttgggaggccgaataataactcagaaattccaactgcaaatgggatgtcaggagaaccgaaaccatcattttcctctggtttttttgataagccctcaagaaaaaggtcttcctttgcagaagaggatagtgctggttctcctcgaaagttaaatggctattgcaatggacatctcagcagtctagagcaaggaattcttgccaactctggaagtgaaaagtgcaatggagatacactcgcgacatccagtaatggcaattgctatgcagttaatggtgatgcacaatctcgcaatgattccttggatgcaga

SEQ ID NO: 30988 - DNA, 556 bp, Sorghum bicolor
  Clone ID: 18063063
gcacgaggcagtcatcagttttacgatagggattgtctactccatgtccatgaccttaaatatgaagaaaaacattaattagtgtttgaacagaaatatacctgctctgctgttcatgcatgatttggttggtggaagatcgaatacagtaaaaacatgcagctagctaacaactaacgtgttgctgaaaatgaaaactgcagagcattccggagtccataatcgcgaggctcctgaacgtggttgtgctggacgtgcggtccaaccagctcaagtcgctgcccaactccatcggctgcctctccaagctcaaggtcctcaacgtctccggcaacctgctccaagaactgccggccaccatcgaggaatgccggtaagtggtaattaggcatgcatcgtcgtccatggctatatatagctggcaaataaagttcacgacactgacacagacgcatgctgcatgcatatatgatcgagcggcggcactgattcactcactggctagctgactatacgtacgtgactgacatgtatcatgcacagcgcgctggaagag

SEQ ID NO: 30989 - DNA, 467 bp, Sorghum bicolor
  Clone ID: 18063077
gcacgaggatcgaatccaaggaacaagagcttcttgtagctaatcaggccattgcacgtcaagaagcaacagttagggagcttcaaagtgaaattaaaagaaaggaaactgatattgagagattaaatgatttgacgaaagctaatgaagagaaactgaaagttgcagaacaggatcttgagaagcagaattcaggatggattgcagcacagcaagagttaaaggaactggcgcaaatggcatccaaggataaggataatatcaagaatacaatcagtgacttcaaacgggtgaggtctttgctagatgctgtgcgttctgaactaatagcttcgaaagaggctttcaccttctcacgcaagcaagtcgaagatcaagcagcacagttgagtaacaaagtccaggaactcacagaccaaaaggcactgattatttcttatacccggaatttggaagctgctcagctg

SEQ ID NO: 30990 - DNA, 607 bp, Sorghum bicolor
  Clone ID: 18063078
gcacgaggagactactacattcttgtaatggatatgcttggttccagcctctgggatgtttggaattctgtaggacaggcgatggctcctcatatggctgcttgcattgctgttgaagccatatcaattcttgagaaacttcactcaaaaggctttgtacatggtgatgtgaaaccagagaaccttttgcttggtcagcctggttcacttgatgagaagaagcttttcctgattgatcttggtttagcatccaggtggaaagaagcaatatctgataagcatgttgaatacgatcagagaccagatatctttaggggaacaattagatatgctagtgtccatgctcatttaggtcgtactggtagtaggagggatgatctggagtcactagcatacacccttatttttttaataagaggaagattgccttggcaaggctatcagggagataacaagagttttcttgtttgtaagaagaaaatgaccacttctccagagatgctttgttcctcctgtccagctccattcaaatattttcttgagatggtcaccaatatgaaatttgatgaagagccaaattactctaaacttatttctctttttgatg

SEQ ID NO: 30991 - DNA, 536 bp, Sorghum bicolor
  Clone ID: 18063094
gcacgaggctggatggttctttgttgacttaagttactaaatattttctgcattttttacctcaaaaggtgtttatcaagttcaatgtttctagctattcccaggcatctgcgtgatacaccaggaaagcaagatgtgtattcgatacctacaattattagctgctgctttctccttttttggcttttgagcagaaaaaaattgtccacgttaacagagtgtttcacgtgtcgtccatcatgactttggagtgattgagattgacgattagcaggtctcagtgaaagctaagtttatctgtgttgctttctttatttagactaatatgtgattcttcacttaaatatgggtggaagttgtaagcttcggtaaccagttgtattttcaaggaattgcctgcagtaattaagtatacccatagatcctaaaatgattctcttgtcaatctttgtgcttatttgaaagtaatggcagcattgattattggctgccttgttccagtttttgttgtcatattaacatatgactctattaaa

SEQ ID NO: 30992 - DNA, 201 bp, Sorghum bicolor
  Clone ID: 18063118
gcacgaggcaagcctgcctctacgcatactacctctctgcgcccaagctgaatatatatatagtctttttgagtggcattgtggctggctgaatatatcgctaacatattcctaatactatttcaacacagatgctgatttgtagatagaatatggcatgtcgtcatgatgctagcaagatgaagtatttggttctgatct

SEQ ID NO: 30993 - DNA, 612 bp, Sorghum bicolor
  Clone ID: 18063130
gcacgaggaagccatggaagcggggcatacttgttcaaaccagttggggaagctcgttcaattgtcgaaggaggaggacatttcatccttactgaaggaccattggttcaagaagcccattctcttccaaagacggagtggcatgagtcacctctctcacatagtacacgtatgtacaattgtggagactctgtacaggacatgctgatcgagaaggaataccatgttgagcttgttggccatgcttttaatgataaggaactgattgtcagatacaagacagatattgacaaccaaaggatcttctattctgatctaaatggttttcagatgagtaggaggcagacatatgataagattcctctacagggaaattattacccaatgccatcacttgccttcttgcaggattcacatggtaaacggttttctgtacactccaagcagtcattgggtgcagcaagcttgaaaaatggatggctggagattatgttggatcgtaggttggttcaggatgatggccgtggtcttgggcagggagtaatggacaatcggcccatgaatgttatatttcatctcctcatggagtccaatgtctcagctttgcctaaa

SEQ ID NO: 30994 - DNA, 582 bp, Sorghum bicolor
  unsure (1)..(582): unsure at all n locations
  Clone ID: 18063134
gcacgaggagaagatccaattgaaccaaaaactggaatcaaattcccagcatttctggaagatgactccagtccatctgcagcggtattttccttttccttaaaaccatagtttctcttattccggtggaattgattttatttcttacgtatatagaatttttcattttaaatcattttcattgttatgcaagctagtggtgtataacaatcaatacataaatgtaccagctgggtacatgtttgtgatttttttctattgaaacttgcttctttgacaatttagaacttaaagtctacataattgtatatactgtatactgttatgcatccagtatctgcacaatgcaaatttttttatggttttgaaacattgacttaaagctttcagttttggtatattacttttcagttttcatatagttctgtaaaattcttcgttttgatccctccttgtgacagtttccattgataattaaaccttcaggtccttgttgggataggtttcanaggcatgagagtaatgagggtcaaaaatctgaacctgtatgcttttggtttatgtgagttacagaattttttc

SEQ ID NO: 30995 - DNA, 229 bp, Sorghum bicolor
  Clone ID: 18063140
gcacgaggctggtcatcaactgctaggagctagccctcttcctgacttttttttttgaggaatatccctcctgaccttacagagttatagcaacgcgagctgctgctgctactactagtatcttcttgaatgctaatataaatcccctcatcgtctgccatcagctctcgtccgtgctagctgcgcgcgattcgatcgatctgatcgtctgagagtgagagcacgaaaa

SEQ ID NO: 30996 - DNA, 536 bp, Sorghum bicolor
  unsure (1)..(536): unsure at all n locations
  Clone ID: 18063150
gcacgaggcagcccttctcccattacgaccgcgtcctgcgcaagatggttcggctcgccccctcttcacctcactggcatctcgtcgaacacgttttgtgcttaccggcttcatgcctgactgtctgtgttagtctcactgctacagtagcgtgcatattgtgtctgcttaactgctcagtgcatctttgtccatgtcataatgagtatggtcaactagggattagagtagacccaagttggtaggatcatatttgatctggctttaaaagaatggggtttctaggctcttgttcttatgctattggtcacgtgtgtaatcaggcatcttacaccaacattttaaaatgttagattcttggtgcatgatgcgatattattagattacatgtataaatgatcctcattcttcctttatggcttttggaattgttgtcaagttgcctcttgatattagcagcgcacactanatagcctaaattttggccaccttcagttgtgcacagtggtcttcaaaaccagcgcgatgtggtataa

SEQ ID NO: 30997 - DNA, 473 bp, Sorghum bicolor
  Clone ID: 18063178
cagaaacagtatttagatagtaacacaattgatgtggataaatcatctgaatctagcatgggagtttcatcaaaggagctatctgacactgacagcagttttgggtgtagagagaaccagcttgactttgtttctaaagaacaacagcaaaatagttcttgtgataaagagcagagtgatcgtaaaagagaaattatcacttgtgatgcttctgaagtgtctgatcattttgttcctgaagatacatcatctgatcagtctggagctaagcatcatgaacttgattctgcatcaggtatccaggatgaatctggtgcaaagaactgtgatgattctccgaagggaaatgtggatgatgaggagcttgatctcttcattaccgatactattttaccacttatgcgatctcgcctttgtgaagattgtgaatcatctccaagttcacagggttctccttctagaaatttcgacac

SEQ ID NO: 30998 - DNA, 603 bp, Sorghum bicolor
  unsure (1)..(603): unsure at all n locations
  Clone ID: 18063186
gcacgagggtttagtagttcaaatgcttcatctttatcattgccatcaagtgactcttcatatgcttcaaattatcgtggtgccaatgtgctacaagactcttatttgaagttaagatgcgaggtggtaggagctaacattgtcaaaagtgggtctggcatgtttgctgtgtattctatttccgtgaccgatgccaatggtaataattggtccatcaagaggaggtttcgtcattttgaagagctgcatcggcgtctaaaagagtatgctcagtacaatcttcatttacctccaaagcatttcctctcatcaggtttagaggttcatgttgtccgagagagatgcaagctgcttgacatatatctgaagatcaatcttgcaagaaacagacattttctttgttttagcttatgactatnaagggtgctgtgctccattgaattgctcaagaaagacacgagccattatttatgtattcagggattgaaccttctgcaaattcctattgtttcaagctgcatagaagtctgggattttctgagtgtggattcacagacatatatnttcacagactctctctcagttatccaaacattgtcagtc

SEQ ID NO: 30999 - DNA, 520 bp, Sorghum bicolor
  unsure (1)..(520): unsure at all n locations
  Clone ID: 18063193
gcacgaggtgtaaagcagcgccaatacaatccatcaagtggaatgtattcacttgatgtagtccaaatcagcagagtgcaggctgatcagcgggcagggcgagctggaagaactcggcccggcaagtgctataggctatacccaatttccatatatcagaatgagtttcttgaggcaacagttcctgaaattcaacgttcttctcttgctggaagtgttctgtatctgaaatcgttaaatcttccagacatcaacatactgaagtttgattttctagatccaccatcacgtgagtcattagaagatgctttgaggcaattatacctcattgatgcaattgatgaaaatggggaaataacagatgttggacgagttatggcagagctccctcttgaaccgtctctttcaaggaccttgattgaagcaaatgaattgggatgcctgtctcaggcattaactgttgcttcgattttgtcagcagaaatcacattgcgatcagctagcanagacatggatggaa

SEQ ID NO: 31000 - DNA, 527 bp, Sorghum bicolor
  Clone ID: 18063208
gcacgaggagctgttcttcaaatgttggaaaaacagatggggccagactcctttcggaagattctgcaggtgatagtggctccaaatcgtgcctctagaacacttagtacgaaagagttcagacaccttgcaaataaggttggtaaccttgaacgcccattcctgaaagaattttttccacggtgggttgaatcttgtggatgtccaattatgagattgggaatttcatatagcaaaaaacggaatatgattgaattagccgtttcaaggggttgcacagcaaaagctacacccgatcctgatattcacaccaatggtgacactagagaaggcgatgctggatggccaggaatgatgagtgtacgtgttcatgagactgatggagcgtatgatcatccagttctgccaatggctggtgaagctttgcaggtggtggaaatacagtgtcattccagactagcagcaaagcgcgtttggaagaaaaagaacacaaaacttgatggttctgatgacaacatagatgcctc

SEQ ID NO: 31001 - DNA, 476 bp, Sorghum bicolor
  Clone ID: 18063227
gcacgaggacattaccaatggaatatggatatatttggtgtgcctaaagttcgggctgaggctgagcttcttaatgctattgttctcttatttcaacatcttggaattacatcttcagatgtggggatcagggtgtccagccgtaaggttcttcaggctgtgttgaacatgtactccatcccagaacatttattcactgaagtttgtgtcattgtcgataaagtatgcccaaattctgctattgacttaccatctgttcattgctgattgttgtaccatattatttccttgcctgttgtactctgtagctttgggttgttatctgcttgccaattatactctatttgtagcattgggagctgacaagttgtggtaatttataacattgaactgcaatagaaataagacggtttgtatatcttctccagatttttatatttcatttatatactagagcccccccccccccttttttt

SEQ ID NO: 31002 - DNA, 510 bp, Sorghum bicolor
  Clone ID: 18063232
gcacgaggctccagctcctcaatgacatgaagggctcaccgttgtgccagcctgatgtctacacctacagcaccatcatcaaggcctgtgttgatgccacaaggtttgacctcatcgatgttatgtacaaagacatggctgagcgctctatagcgcccaacacggtcacgcagaatattgtcctcagtggctatggaaaagctggacggttggatgacatggagaaggtgctctctgatatgctcgacagcacagcctgcaaaccggatgtctggaccatgaacattatcttaagcctgtttggaaacaagggccaggttgaattgatggaaaaatggtatgagaaattccgaagctacgggatcgaaccagagactcgcacactgaacatcctgattggtgcctatgggaagaagcggatgtatgataagatgtctgcagtcatggagtacatgcgcaagcttgcgttcccatggacaaccgcgacatacaacaatgtgattgaggcat

SEQ ID NO: 31003 - DNA, 603 bp, Sorghum bicolor
  Clone ID: 18063282
gcacgaggcttttcaggagaaaatgttgagaacttggatacaatacaatagaccttctgaaccaaattttactcatgctggtttgcttctagcatttggcttgcatgagcatctaagagtcttaactatgactgatgcatatcgatacctctcacaggagcatgatataacaacacttggtttgttacttggtttggcagcatctcataggggaacaatggatcctgcaatatcaaagatgctctactttcatgttccttctcgacatccatcttctactccagagctggagttaccaactcttctacagtcagcagcagtaatgggaattggacttctatatgaaggctcagctcatgctctcaccatgaagatacttctgggtgagattggccgaagaagtggaggtgacaacgtgctagaaagggaagggtatgccgttgctgccggttctgcattaggatttgttgccttgggtcatggcaattgtgcatttgaattcatggatactttcctagatcgactttttgaatatattggcagtaaagaagtctaccatgaaaagtacctaaatgcaacaactgccgatgatcaaagttgcaa

SEQ ID NO: 31004 - DNA, 534 bp, Sorghum bicolor
  Clone ID: 18063292
gcacgaggagtaatttgacttttttggatgttagcaacaactacttgagcggtgtgatcatggaagaacactttgaaggcctaataagtttaaagaaactagatctttcttctaacaagaatttgaaggttacagtgaatagagactggtttccaccattcagactggaatacggaaattttgcaaactgccagatggcccctctatttccagcttggcttcagcagcagtttcaaatcagtcaccttgacatgtcaagcacatatctgaaggacaaaattcctgagtggttttggttaacattctcacaggccatatatattgacatatctgataacaaactaagtggtagcttgccagcacatctggatggaatggccattttagagctcaacctgagttcaaacttgctcactggaccagttccatccttgccaagaagcatcataacattagacatatccaacaatttattttcaggtaaactgccattaaactttggggctcctacccttgcgacattaattatgttct

SEQ ID NO: 31005 - DNA, 540 bp, Sorghum bicolor
  Clone ID: 18063294
gcacgaggcgccgcacaaaggctggcacgttatttcgctgagggattggaggcacggctggctggttcagggagcccggtgtacaattcgctcatggcaaagcgcacctctgttgtggacttcctcaaagcctaccggctatacgcagcggcctgctgcttcagaatgatggcgttcaagttcgcgaacctgaccatttccaaggctattgcagggaggaagaaggtacacattgttgattacggcatacattacgggtcccagtggcctggtttgctgaaaattttaactctatggccgggagggccaccagaagtgaggattactggcattgatcttccccagcctgggttccgcccagctgctcgggtcaaggagacagggcgacggcttagcagttatgcctctcagtttggtgtaccgttcaagtaccgtggcattgcggctaagtgggagacggttggcgttgatgatttggacatcgaccctgatgaggtactcattgtcaatagcatcctccattttggaaacttgatggac

SEQ ID NO: 31006 - DNA, 635 bp, Sorghum bicolor
  Clone ID: 18063295
cacgaggggcttcgccgccgacgcctggatcgggagttgcctcatcgagctctactcgaggtgcggctccatgtgggcggctgaggaggtgtttcgcaggatggaggcgccggatgtcgtggggtacacttcgcttgtctcggcgctctgcaggaacggcgacctcgcacgggctgtggaggtgctctgtcagatgatgaggcaggggttgcagccgaacgagcacacgatgacgagcatgctggcggagtgccctcgaatgattggcgagcagatacatggatatatgctcaaggtaatgggttcacagagcgtctatgcatcgactgcactgattgacttctattcgaggtacggtgactttgacatggcggagaccgtgtttgaaaatcttgactccaagaacgtggtgtcgtggtgctccatgatgcagctgtgcattagggatggaaggttggaagatgcactgcgagtgttcagcgagatgatttcggaggccgttgagccaaatgagtttgcattttcaattgctctcggggcttgtgggtctgtttgtctggggcgtcaaattcactgctcagccatcaagtgcaacttaatgactgacatccgagtatcaaatgctttgctctcta

SEQ ID NO: 31007 - DNA, 600 bp, Sorghum bicolor
  Clone ID: 18063331
gcacgagggagaaaggaaaggaccgatcagataaggaagttgtaactccatggtttaagttcctctgggaaacatacaggactgttctagagatactaaggaacaattcaaagcttgaagcgttatatgctatgactgctcatagggcttttcaattctgtaaacagtataagagaacaactgaattccgtaggttgtgtgagattatcagaaatcatcttgctaatctcaacaaatatcgtgatcaaagagatcgtcctgatctgactgcacctgaaagtttacaactgtatcttgatacacgtgttgagcagcttaaagttgctacagagctttccctttggcaggaagccttccgatcggtggaagatatccatggtttgatgagcatggtgaagaaaatgccaaaaccttctatcttggtggtgtattatgcaaagttgactgaaatcttctggatatctgacagccacctttatcatgcatatgcgtggctcaagcttttcaacttgcaaaagagctacaataaaaacttgtctcagaaggacctacaattaatagcatcttcggtcttacttgctgcactatctgtggcacctt

SEQ ID NO: 31008 - DNA, 290 bp, Sorghum bicolor
  Clone ID: 18063341
gcacgaggcactcatctattcctaatttatcttgcatttcatccaccgacgcctctcctctttcccagcgctcctgcatgcagctgctctctctctctctctcccaccgccgctgatcctcctctcctcaacgctcctgcctgagctgctctctgtcgccccttctctctcactttctctctctctcactatacccctctctctcccgcagcttgcatctctccctctctatcctgccctctctcccttcctatccctctctctgtacctagatcacatctctcttagat

SEQ ID NO: 31009 - DNA, 526 bp, Sorghum bicolor
  Clone ID: 18063380
gcacgaggcttaactaaagacgatcgtgcacattggtatgaggtagtgtaattgtacaacttaactaaaaaatcatacacattggtacgagatagtgtaattgttcaatttaactgaagaatcatacagagctgactcggtcagtgttaccatatataatatttaaaagtagcctaatttttttagtcctatgaagcctggaagttgctaatatctgtgcatccatgcaatttatcatgaactacccacaaggccacaagctgcttctgttttctctatgtgctgattataagtgctaaatacagtatatttagtaaatgcatgtatgaggaatttagaataagctcatctttatttgggaattaactagaacttaagacaaattgatagtagataattggtgagctatgttgtcactttccaatacaaacatgcagtcctgaattgaaccctctttttgtggacttaagaaaaaggtccagttttcaccaaggaggtccaggctagttttgtgctagctgaacga

SEQ ID NO: 31010 - DNA, 494 bp, Sorghum bicolor
  Clone ID: 18063382
gcacgaggctcagattgaacttgatttgagagatataaaagacaggattgtgaatgagaagcgagcaaaggatgaagcagcgagggatttacagagtgtgaggagagagagtgaaaagtcaaagtctgaattggctgaaattagtaaggtgcatcagaccaaactaaaggaagaggaggaaatatcaaagagcattatggatcgcgagaagcggttaagtatattgtaccaaaagcaggggagggcgacccaattcgcaaacaaagctgctagagataagtggcttcaaaaggaaattgaagatctcaaacctgtacttttatcaaatagaaagcaggaaggtttacttcaagaagaaattcagaagcttaaagatgaaatcaatgatttaactaactacattgagtctcggaaaaacgaatcaagtaagttagaggaagcacttgcaaaaagacataatgactacaacgatttgaggaagcagagagatgtgc

SEQ ID NO: 31011 - DNA, 534 bp, Sorghum bicolor
  unsure (1)..(534): unsure at all n locations
  Clone ID: 18063393
gcacgagggtatctatctatccatgcatgcatccctccctcccattgacagcttcttgttaagcatacattgctactatgatgatgatgatttgaataataagatgctgagcacctccagttccataatctgctgctgctactgctttgtttgcttcattttctgcttccgctgctgtttccaagcaagtttgttgttttgttgacttgtctatgttgtacattggttaatttctcaatagttccattctaaaatacattcctggtcacataaaacatgacgttaactttgtttaagtgcaagcaagtgttcacattacagtttgtagtttgcttagtgctttgtatggctgccatgatggacttctcgttaacctgagacatactatgaggatagcatctatccattcaaaaactataactgagcagcattggtattgttgaagatataacaagttgagggtgtcactcttttgtaaccatctttttcattcgcttttgtgccttgctgcatcccagcatgtgcatgcctatn

SEQ ID NO: 31012 - DNA, 391 bp, Sorghum bicolor
  Clone ID: 18063396
gcacgaggatcaaatttaagtttgatttcttggggtattataatctttcataatcacgttcattatctgaactttctaggttttagaggataagatagcaataataggtcttactaaagtgcaccattgcaccagttttcttttcgttttttttcatggcacaatcctacatcttacttcctccatctatttacttgttctcccctccagacaataccatgcctgtgttcataacttgctcaacttcaaggcacatatatattgcaaggggattatgatttaaaggtcatgcgccaggagtactacattaacaggcaaaaaacgttcatcaatcatttggttaatcagcttgccagacaccagtttctaaagatcgcttgccaacttgaaa

SEQ ID NO: 31013 - DNA, 588 bp, Sorghum bicolor
  Clone ID: 18063409
ggcacgaggtgcggaaatgccgctcccggcgttcctggcggcggcggcgaggctggccgtcctggtggccgctgccgtgacggcggccaacgcggcctccttcgcgcggtaccggcgccgccacctccgccgcatccccaaccccatcgacgagtccgccgaccccatcgccgacttccgcgccctcccctccaactccgccgccgcctccgccggcgaggatgtcgcagaagatggcaatttcttctttgggctagcgactgcgccggcgcatgtcgaggacaggttggaagatgcttggcttcagtttgcagtggagcattcctgtgatgacaaggaggccatgcgcgaccataagacagcagacgcggtgatggcatcggctgcaggggatggaggcgctcagctggcttctaggtccagaggggacgaaaaggctgttgatggagagaagaggaagcctcttaaggttgccatggaggcgatgctcagggggtttgaaatgtttgcttacggtggtgaagctggttctggcgataactgcagccacaacgtcgcagcttggcacaatgttccttgcccgcaaga

SEQ ID NO: 31014 - DNA, 445 bp, Sorghum bicolor
  Clone ID: 18063417
gcacgaggttcctttctatgggtttgtgcgtgatggctggtcatggtggtggtggtggtgggtgtgcgtgtgcttcggtgcgttttgctgcctactgtgctggttggtttatgcggcaaatggatgaataggttgcagtaacaataattatgcatccagaaagaactgcaaaaagtgtggcctgcccaaggaggaagcagcaatgccagcattgcaaatggcagggatggctatgccagcttatgcaacttatattgcaagactacaacaaagccttgctgcttctgcttctgcctataagatgaactttggtatggctgccaactcacctttgcagcagcaactacttgcaaatgcaaactggccctatgggatggctggtagatatgggatgcaatcttctggttggccatttggcaacagcaacccaaatcagttcccaggt

SEQ ID NO: 31015 - DNA, 555 bp, Sorghum bicolor
  Clone ID: 18063435
gcacgaggccccaggggcatggccaggagagagcagaaccgctcgcgccacaactacaggaaggattgcatatactggacacttgagtggagattcaattcaactgatgttgtcctaaccgatcatgaggtagacgagcacacaaccttgctctctctattggaaaaacatcttagtcctggcccttggaaggatcagcttacacaatatcggaataccgatttgcatgatctgaaactgttcattcaaaagtgtgccaagcgatcagagtcaccgtaccgcctactcaatatagaagaaccattgcgcccacagctgaggggtatactcgttgttgagtacccaaccatcaatgtctttcttccgtcggacaattatgactttgaaatcgagaaaatggtgaacagtcttcataaagatggaaaaaaccctggcagcagaactgacgagccacctgtagaaggcagcgagtttcatgaggaggaaatagaggaaggtgagttctcacctgagacagaaattatagatctcaaggactgtggagcttcgaatgcc

SEQ ID NO: 31016 - DNA, 574 bp, Sorghum bicolor
  unsure (1)..(574): unsure at all n locations
  Clone ID: 18063455
gcacgaggccaacttagtgtccaatggccagacacagttttccatgagcatctatacagaacactaattgagctcggtctagaaaatgagcttttggagtatggtggttctgatttggtttcttttctgcagagtgctggtcgtaagcatcaggaagaggttcggtcaatttcttcagttacatctggagctgctaagttgcatgatttaggtgcacctatctcgactagtcaaacaaagtatcttgagctcctagctaggtactatgttcgcaagggggagcatattgctgctgccaggatgttgttaatattggcagagcgacagtgctccaattccgaagaagctccaactcttgacaagaggtatgaatatctcagagatgcagtgcttcaggccaaaagcgcaggcatctctgctgattcgtctagaaatcctattgatagtagcacagtggatttgcttgaaggcaaacttgccgtgctacgcttccaaatgcaaatcanacaagaattggagctcatggctgcgcggattgaaaatattccaagcagttctgaatcacctagtgttc

SEQ ID NO: 31017 - DNA, 597 bp, Sorghum bicolor
  unsure (1)..(597): unsure at all n locations
  Clone ID: 18063470
gcacgagggctccccatcccatggagcccgacgccgcccaaaaccctagccccgtcccgccgcccatctccgcctactaccagacgcgcgcggagcaccacgccgtcgtctccagcgactggctcgcgcacgcggccgccgccgccgccgccttcccgggcgccgatgccgccgacgcggccgcccagccgcccacgccgtcgtcccccggggccgccggcggcgtcatcgaggagttcaacttctggcgccgcaagcccgaggccgcggaggcggtggccgccatcatggcgctcgccgccgtcatccgctccagcagggccaccaccatgatggagctcgagatcgagctcaagaaggcgtctgataagctcaagtcctgggatgctacatccatttctctttctgctgcttgtgatttgttcatgcggtttgtaacaaggacctcacatctggagcatgagaaatttgatgcagcanagtcacgcctaattgagcgaggagagaaatttggagagatatctttaaaggctcgcaagacaattgcaatgcttagccaggatttcatttatgatgggtgtactatacttgtccatg

SEQ ID NO: 31018 - DNA, 542 bp, Sorghum bicolor
  Clone ID: 18063482
gcacgagggagatttagatgattttttcggtggaccagctttcctggcttgggctagaatggggaacttgcatggctggggtggaccactgtcacaaaactggttggatcaacaattggcattgcagaagaaagtactatcccggatgattgagcttgggatggtccctgttcttccatcgttctcaggaaatgttccagctgttttcgcaaaattatttccatcagccaacattaccctgcttggtgattggaatacagttgatgctaatcctaagtggtgctgcacttatcttcttgatccttctgattcattgtttatagatgtggggcaggcttttatcaggcaacagataaaagagtacggcgatgtaaccaacatctataactgtgacacgttcaatgagaataccccaccaacagatgaaccagcatatatttcatcacttggttctgctatctatgaagcaatgtcccgaggtaacaagaatgcagtgtggttaatgcagggttggttattctactcagatgctgcattctgga

SEQ ID NO: 31019 - DNA, 600 bp, Sorghum bicolor
  Clone ID: 18063504
gcacgaggaccatgtgaaaattcggagttcgcacagttaccgcagccgcaaccaccatccccggaaatggcccctccactatgtgattattcagagcctgcacagccatcgccgctgtgtcatccggatgaatgcacaggggcctcgccagacgcaccggtggatgaggttgtggcaggaacgtcaggaaaagcagctaggccgtcaccatgtgaaaattcggagttcgcacagttaccgcagccgcatcttccagctgaaagcacatatgtctgttcaaatgcagcgggcaaggtatcagcagtggcttcagaagatggtactcagcctgcgatggagtcaattgatagcgaggggccattagagattggggtacagagatcattgcaggagccagaggagacaacaacgccctccaggatggaagctgagccttgttcgccagagatggctcctccagggtttgaagattgtaagtctcaatggctgccactgtcagatcctaatcctctggttgaatccacacacactgtggtacaagtgactgccaccaatgccatggacacgacgccagatacagcaactgggtcactgtcacct

SEQ ID NO: 31020 - DNA, 259 bp, Sorghum bicolor
  Clone ID: 18063538
ctttccaacttcctgacttcattgctgcaactggaatagaaaagataatacaggcttatattgagaaagaggatagcaagaaattgaaacagaaacaacgggagcgtatgcaacccaagatgggcaaaatggatatagattatcaagttttgcatgatgcattcttcaaatatcaaacaaaacccaagttgtctagtcatggcgatctgtattatgaaggcaaataatttgaagttaaactgagggaaatgaagccagg

SEQ ID NO: 31021 - DNA, 613 bp, Sorghum bicolor
  Clone ID: 18063550
gcacgaggggagaagcgatattggcagaggtacatatacctctggattaactatgcactttatgaggagctagacgcacaagacatggaacggaccagggaggtttacaaggaatgcctgaggctgattcctcacaagaaattcacgttcgcaaagatgtggctcatggcggcccagtttgagataaggcagaaaaatctgaaggctgcaagacaaattcttggaaatgcaattggaatggccccaaagggcaagatattcaagaaatatattgaaattgagctttatctgggcaactttgaccgttgtaggactctttatgagaaatatattgaatggtccccagcaaactgttatgcctggaggaagtatgccgaattggagaagaaccttagtgagactgatcgtgctcgatcaatatatgaacttgctattgcacagccagcccttgatacaccagaggttctgtggaaggagtacttgcagtttgaaattgatgaaaatgaatttgagaggacaaggcaactatatgagagactgcttgataggacaaaacatttgaaggtatggatcagttatgctgagtttgaggcctctgctggcttgggcagtg

SEQ ID NO: 31022 - DNA, 576 bp, Sorghum bicolor
  Clone ID: 18063594
gcacgagggccgaatgcgggaccctcgcctttggtgaccgaccctgccactgccgggttagttgagcgaccgcctaccggacccccacgccgcgcccggatctcgcatgcgccgccgccgccgtcgcgcgatctagcggctgcgcgctgccccgcaggagtggagtgtaggtcttctgggccctggtgtggtcgggcggcggatatggcgacggaggcgtccacctccgcggcgggcgggagctgggtggaggggatgtccgcggacaacatcaaggggctggtgctcgcgctctcctccagcttcttcattggggccagcttcatcgtcaagaagaaggggcttaagaaggctggtgcatccggcgtccgcgcaggtgttggtggttactcttacttgtatgaaccattatggtgggcaggaatgattacaatgattgttggagaagtggctaactttgcagcatatgcttttgctcctgctatcttggtcacaccgcttggtgcacttagcatcataattagtgctgctcttgcagacattatgttgaaggaaaagctgcatatattcggtata

SEQ ID NO: 31023 - DNA, 556 bp, Sorghum bicolor
  Clone ID: 18063613
gcacgaggcacacacacacactgacgtacgatatcgaacacactgacacaacacaaccgccgggcgccgccggctttgtcgtcaacgtcaccattccttaacacactctctacatacacgtcgcagccggccggcagctcatcttctgtatttaaacgcgctccatccattccggtcagggcacggagtcgtcactcctagctccgcgcgcaccgagctcccacacactctcgcagcaatggcacgcggcggctctaccgcggctcctccacccctcccgccgctgctgctgctgctggtggtagtagtggtgtcctcggcctttttcgctcgctgctgccacgccgcgccgccgggtgcactggtgacgagcgtcccggggtacacggcgggcagcggcgcgctgccgtcgaagcactacgccgggtacgtgacggtggacgaggcgcacggcaggaggctcttctactacctggtggagtccgagcgtgaccccgccaaggaccccgtcgtgctgtggctcaacggcgggcctggctgctccagcttcgacggc

SEQ ID NO: 31024 - DNA, 544 bp, Sorghum bicolor
  Clone ID: 18063623
gcacgaggtttctctcagatgttctcctaatcctgtttagcatgcaaagccagaaacgtacatcgagattcgttctcaaggcttctccaagtgcatttgctgtgacaagtgaccaccccagttgcaactccttggataattcgtcgacaatctttaacagctgaggatgttccatggggtttgtgcttccgaatgcgagtatcttgaagaggtacctgaactccgcatatggcagggtactgagaaaaattggcttaacagttgcaaatgtgtcaaattttctaaggttgctgatgatcaccaccttgctccctttcttcagatttgtcacagacgaataaaattttacccagtcctcctcgtccactactgaatcaaactccacaactatcaagaccttgccctccgccgctcgcctgctttcatgttcttcttgtactctaaaaagatcaccttcattcaagtgtaaaatcaaagagaagtgcgaagtaactctcttgtcactgcatacatgagcgaccagagttctttttcctaccgaagg

SEQ ID NO: 31025 - DNA, 532 bp, Sorghum bicolor
  Clone ID: 18063654
gcacgagggaacaaagcacagcagaggaggtggctgacagatatctccgagaactgattcaaagaaacatgctggaagttgtcgacaatgatgagctaggcagggttagtacctgcaagatgcatgaccttgtgcgtgagctggtgctttctatttccaaagaggaaaagtatggttgtgcatatgatttttcaagcatgtctcacatggacaaggatgttcgtcgtctgtcgtcatgtggatggaaagacaaaattgcagtaaaagcaaatttcccacgtcttcgaaccctagtggcacttggaataatttcatcgccttctcagttgttatcaccaattttatctgaatcccactatcttactgtccttgagctgcaagattctgaaataaccgtagtgccagcgtccataggaaatttgtttaatctgcgctacattggtctgcgccgcacaagggtcaagtcactcccggagtctattgggaagctctcaacctcctcaccctggacatcaagcaaacaaaaatagag

SEQ ID NO: 31026 - DNA, 603 bp, Sorghum bicolor
  unsure (1)..(603): unsure at all n locations
  Clone ID: 18063660
gcacgaggctctttaggtgctctcacaactccaccgtttttcctcgaacggattgtgtggagctaaaaccctttggctgaaaaacgtggagcggagctgaaaaacatggagcgaagtaatcccaaaaaccccctatatcacaggtcagtgatgggaggcctaagccgtatcgccgaacacccaaatagcctggatacgtatcagtccacgaatcagaattttgttttatttattttttgccgatacttcacggatacgtatccaacgcgtatccagtacgggatacgtggccaacctcatgtatccgtgtaacatagacccctgttgtattctcgcaccaaaaaaaaggattctttgcaacacaatagagttatgacttagagtctgtttggatcccttgctctaaactttagagctaaagtctccaaacatgtggtctaaagttagctctaaactttagcccacctcacattagagctttagatctcaaaactaagctaaagtgctctaagtttttcgaactctaaagtttagaagaggggatccaaacaggcccgtaagagaaaaatggatgaatagtcttcttgagcaattcanatcttt

SEQ ID NO: 31027 - DNA, 568 bp, Sorghum bicolor
  unsure (1)..(568): unsure at all n locations
  Clone ID: 18063697
gcacgaggggaaggttgtcatgcttttccagaattgtcggcaagccgctgtgacaattcagtgttcttggagacagaagcttgcaagaaaggagctaaggagacttaaaatggctgcaaatgaagctggtgcactgcgtgaggcaaagaataagcttgagaaaaagatggatgatcttgctttaagacttacccttgaaaggagactgcgggctgccagtgaagactcaaaatcagcagaaatattgaggcgtgacaaaataattgaatcattaagtgcagaatgtgctgctgctaagtcagctgctcaaaatgagcatgacaaaaatttgttgctccaaaagcagttggacgattctttgagagagattgctatgttgcagagtaaaaagattatgtcagcagaagcagaaaaagaaaactccaacctaaagaacctagtcgaatcattatctatgaagaactcaatactggagaacgaacttactgtgactcgtacaagtagtgatgatacnatggaaaaattgaaggacgtcgagggtaaatgcaaccatctacagcnaaacttg

SEQ ID NO: 31028 - DNA, 606 bp, Sorghum bicolor
  unsure (1)..(606): unsure at all n locations
  Clone ID: 18063706
gcacgagggacgatagatcgatggcggccgcgggcatcgcagtcagcgtttccatgggggctctgaagcctgtcttggaaaagcttgccacgctcctgggcgacaagtacaagaagctcaagggtctacggaaggaggtgtccttcctcatggaagagttaagcgacatgaaagtcctccttgagaacatggacaatgctgaggatgaactcaattcgcaggccaagaaatggaggaaagatataattgatatgtcatatgatattgaagattgcattgacaacttcatggaccgtgttggggatgccgatgataaggtggggatcctcaagaaagcttctcactatctgagaactatcaaggatcggtaccgcatagccaatcagatcaatgagatcaagagtcgtgtgatggaagcaagcaaacgccgagataggtacaatctcaatgtgtgcacctctggttctaccacaatagtggctgttgatcctcgcctgactgcactttacacggattcaacaacccttgtgggcattggcactcanaaggaagaacttgtcaaatgggtagaggatgaagagaaacaactaaaggtgatgtcaatag

SEQ ID NO: 31029 - DNA, 604 bp, Sorghum bicolor
  Clone ID: 18063730
gcacgagggtgtagataatgaattgagaaagagggaagagagcaataagaaataacgggaataccgagcatggaaaagggccgaagaaagtaatgaacaaagagaggagcgaaatagaaagcaacgtgaataccgtgcaaagaaaaaaagctttggcagggtaacgacgtctggacatggtattccttcacaattctatgtttattatgcatcaattctatgtttattatgcatcaaaaggagtaactgtcttcttttttagcagcaaatcatgtacggtcagattccgggtgcacagatgttgacatgacagatgtggtaggaagacagtcaccagaggagagtgatgtttcagccatctacaaaggatcgaaacatcatggtaaagaaaatgatgatccaaatgagtccagccactggctacataggaacgatgactatatgaggcaaaaacggccgccattcaggttgtgccagactgaaagttcaaacggcatcataataaattcaggtggttattcgaacactgctagacagctgacaaaacaaaactggtacctgaatatggatgcgccgagcaaggagaaattgctgcaggagaggc

SEQ ID NO: 31030 - DNA, 600 bp, Sorghum bicolor
  unsure (1)..(600): unsure at all n locations
  Clone ID: 18063777
gaaacctctttgaatggtctatgcatttggcaccatggtgtggagatcatagctcatggcctgttgcttcttagtaatgcataaaaaagttatatcagcaagagatttggtcttatctggctcaaaaaataaacattactccatcctatcactatatataggatcagccactccagagcatttgaaacacgtcattgttttccatgttaggatcatgggagctatcagcattctgatttaacactaaaatataaagaactgagaatacatttaccatgcaaagattcttcttgccagcagactcagcaaaacaggaattaccatgaaaaaacctaaaggcaggatagccatttccgtccctcaactatcgtctgatgctcaatttcgtccctaaactaccaaagtggccattgcactcaaaatttacttttggggtcaatttcatccatggtcatttcagtcctcaaacttttcttttaggctcattcttgctcctcatcctacgtggcacaccacattatcatgcctcatcaaccccagctccatcacgagcggaggtgaatggtctctattgagaggactgcangttgtgttgagcta

SEQ ID NO: 31031 - DNA, 631 bp, Sorghum bicolor
  Clone ID: 18063842
gcacgagggggcgcctgcgccgtcaccttcaccgtcggcgggctcagcgccatcaacggcgtcgcgggcgccttcagcgagaacctccccgtcgtgtgcatcgtcggcgggcccaacagcaacgactacggccagtaacaggatcctgcatcacaccatcggattgcctgatttcacgcaggagctcaggtgcttccagaccgtcacgtgctatcaggctgtggtgaacaacttggaagatgcacatgaacagatcgacactgccatctccacggcaataaaggagagcaagcctgtttacattagcatcagctgcaacctcccttcgatcccacatcccaccttcagccgtcatcctgtccctttcttcctctccccaaggctatcgaaccatatgaacttggaggcagcagtggaagccgctgtggctttcttgaacaaagctgtcaaaccggtgcttgtaggtggaccaaagatgagggtgtccaaagcatgcaaagcctttgtagagctggcagatgcctgcggctatcctgtcgcggcgatgccttccgcaaaggggctagtgccagaacaccactctaggttcattggcacgtactggggcgctgtgagcactccattctgtgcc

SEQ ID NO: 31032 - DNA, 107 bp, Sorghum bicolor
  Clone ID: 18063843
gcacgaggatgatctgtatagctatttctgtttcttgaaatatgaaccttactctaaatttagtaatttcaaatatatgatcaagcaccaaattactagagattcag

SEQ ID NO: 31033 - DNA, 241 bp, Sorghum bicolor
  Clone ID: 18063852
gcacgaggctcatgcgaggccatttttgggcttgtaatgagtatggatgtaacacgatatgaatgggattgtagcttccaatatgggagtttagttgaagaggttgatggtcatactgcaatactgtaccatcgtctacgactgaattggtgttcaatgttggtctggccccgagatctttggtatttacgatattggcggcgcaacgatgacggaagctatgttgtgctgtttcgatcta

SEQ ID NO: 31034 - DNA, 505 bp, Sorghum bicolor
  unsure (1)..(505): unsure at all n locations
  Clone ID: 18063855
gcacgaggcaagacttcgatcctggtcttcaaggaccgcgagcgctacatcactggcgagcaccgattccagaagggtttcgacaagagcagcaacaggaagatggtcaagctgtgggctgagaaggagttccgcaacctgaggagaatacatgccgccggcatcccatgcccagagcccatcagcctgaaactgcacgttctggccatgggcttcctcggtgacaagagaggatgggcataccctcgtctgcgagacgccaatctgactggcgatgatgtggaccagcagtggaggaacttgtacgtgcagctcttgggtctcatgcgccgcatataccaggtctgccgcctggtccatgccgacttgagcgagtacaacatcctctaccacgacaagaaactgtacatcatcgacgtctcccagagtgtcgagcctgatcacccccgcgcgttggaattcctacgcatggatatcanaaacgtcggtgacttcttcaggagga

SEQ ID NO: 31035 - DNA, 544 bp, Sorghum bicolor
  Clone ID: 18063856
gcacgaggattaagccatcactttttgacgggattccaaatggggatatgctcgtaggatgggacacaggtgcagatccgctcagtggtattgaataagtatgttagtgcagccaatggtggtggctcaaatgtgacagtggaccgtgatgtggcctcaacgtgggagacattcaggctttggagggtgtcagataatgaatttcagcttcgatgccttggaggtcaatttttgacagtgaacagtgaagatggtttgatcttggctactgcaaagcatccattgtccaccgagactttcttcattgaaagaaatgctggaagggttcatatcagacctctgaatggaggctatgtgcaagatgggataataatttagcgacgtttgaattggtgattgttgccaataacttgcgtggggactaccagcttgccaatggttatggttccgagaaggcgaagatggtcttagaaaggaagtttcattacagcagacgactttgatttcctatctcggcacggaattagtactgtgagaattcctg

SEQ ID NO: 31036 - DNA, 497 bp, Sorghum bicolor
  Clone ID: 18063863
gcacgaggggcgatggcgagctccggcggaatctccgaccagctcttcgtctccgtcaagttagagagcccgcgcctcgcggagctcgacctcgccccccacctcttcggctcccaccccgtggctggctcgtgggacccctgcaaggccctgccgttggagcgggcggctacctccgtgtgggagttcagctgcgtcgtgccttcgcagcacgaatcgctggatttcaagtttgttttgaagcgagaagatgatagttctcagtacattattgaggagggacctaaccgaccactcggttgccagagcaatgaatttgaaatgaggactgcagtgtttaaactcaatgaagggaaggaggtacttgagtgcaaggttcagattgagacagagatgttatccccatttgacctggcagctagttggagggctcatcaggagtattttcagccttcaagggtgcgagggacccacgatgtcactatcaaccctgggtt

SEQ ID NO: 31037 - DNA, 625 bp, Sorghum bicolor
  Clone ID: 18063866
gcacgagggctatccagcacagaagaaagtgctgcaagaaaaccttgttgatgctcatttagcccttttaatttcgaatggtacttgtctagcatggagaattgctagactagctcatgagattaactttgctttctttgctccgcatggagaattgctagactagctcatgagattaactttgctttctttgctccgcatggagaattgcttgtttacctcatggttgtccctgcaaagttaagtggccacacattttttggtggtttcgatgagtccacatggagccaatttattcaatgaaaaaatagtaccaaccagaaatttaccaatggggcatatgcatcttttactgaaatgttttggtaacatacaggaatttgccaaggttcttagacttgccactataataatgtctgttgtttgaaatattcttgtttatgtcaaatactattacacttttaaaattttaatgtagaatcttatatagtggccaaagtgatgtgtaactgttacatatactatatcattagtttaatgatagcattattcttctagcctttaattatttatccccctcttactccgtttcgggatccaccattgcttgatagcctgatgacga

SEQ ID NO: 31038 - DNA, 570 bp, Sorghum bicolor
  Clone ID: 18063889
gcacgagggctaagcaagaaatgtcacaaatgttgattgaaatcattgccaatcctagttctgagttgatgcaaaaattggctagtgtaatgtcagctcaataggtgcccacaatacagcagccacagatgatcacacagccaccagagatgcagatggttgtcatggattcctcgggtccattagttccgagcagtatcggatctacaacaaacaagcaccatgcagttgatgacatcgttcaaccatcagcttgctccctagttatatcatacgacatcaccaatgtccgtacgataaaagttgccacaggttttgcaatccctggccgcgagtttcacggcagtccaattcctaatgactacgccagggttgaagtgttgacagtcgtggaaggacatgaggacgacttgctagacatccccactacagagggtattgagaaacttggacaagctatcaacaatttcatcttatggcctcgacgggacatcaggttggacaatcctgttccaccaatcccaacttccatacttgatgagagagggttctcgcatgcgtgttcctccc

SEQ ID NO: 31039 - DNA, 515 bp, Sorghum bicolor
  Clone ID: 18063905
gcacgaggctctcacaacgtcaaagtatggtatcagcaagatggagcttctcagagcatgcttctctagggagtggctactgatgaagaggaactcatttgtttatatcttcaaagtagtccagctcataattcttggaaccattgcaatgacggtcttcctgcgcacgacaatgcatcgacgtagtgtcgaagatggtgtgatatttctgggcgccatgttccttggactagtcacacatttgttcaatggttttgctgaactcgccatgagtattgcaaagctgccgatattctataagcagagggacctcctcttctatccatcatgggcatatgcactgcctacatggttgctaaagataccaatatcattcttggaatgcgctgtgtggattggcatgacttactatgtcattggctttgatccaaacatcgaaaggttctttcgccattacctgctgctcgtactaatcagccagatggcatctggacttttccggcttcttgctgcac

SEQ ID NO: 31040 - DNA, 598 bp, Sorghum bicolor
  unsure (1)..(598): unsure at all n locations
  Clone ID: 18063908
gcacgaggcaaggtaaaagaaaactgttttccgcttatggtagcagcagtggttcagtcattcatattaaatcaaagagagacaattagtctgtaacaagctatcttaggttcactgcttagataattcaagatgccctagatgggagtataaagaaattgaattttctgcctttggagtaacaaactgctgctctagcttgtatgtcattctttgttttcttatcaccaaacctcattgatcttctcaagccaaagtattttactatcagttcttgttgcattcctgacagaaaaaaaaatgtgcagggcaaactagcccttctatatactgaccacaaatgcaatctttgattgaagatcagtaaggaatgcaaaatcaatatctgaaatcactctagctactgagatttcatttcatcttgttgtcttgtttatggcaagccaattgggttaacctactaaaacatcttaatagtagataccgatggttgacactgatttgataaaatcttanaatgtcaatgtaattgctgttccatgtgtcaataagtttcanaatgatatatcttccatatgttgagcataatctagatnat

SEQ ID NO: 31041 - DNA, 584 bp, Sorghum bicolor
  unsure (1)..(584): unsure at all n locations
  Clone ID: 18063915
gcacgaggcacgctttaaggctattcctagtcactcaacaaggcgggctatatttgaccactatgttcgcacacgtgctgaagaggagcggaaagagaaaagagctgccctgaaggctgcagtagaggcttataaagaattacttgaagaagcatctgaggacatcaaccagaaaacagactaccaggaattcaaaagaaaatggggtgctgatccaaggtttgaagccttggatcgaaaggaaagggaggtgctcttcaatgagaaggtgaaggctgttcaagaaaaagtccaatcaatgcgcaaagctgtcaatgctgatttcaaatcaatgcttcgagaaagtaaagatataacttcaacttgccgatgggcaaaagtgaaagaaaatttccgcagtgatccaaggtacaaagctatgaagcatgaagaaagggagactatatttaatgaatacatagtggaactgaaatctgctgaacaggaagcagaacaagctgccaaggccaaagtggatgagcaagccaagttaaaggagagggaacgtgaaacacgtaaaaggaaagaaagagaagaacaggana

SEQ ID NO: 31042 - DNA, 594 bp, Sorghum bicolor
  unsure (1)..(594): unsure at all n locations
  Clone ID: 18063927
gcacgaggcttgtgaatagtgcaattcaactggaagctcgagtcccattacagatacgtgtttcccagaaaagcaacagactactaaacgaagaagatgttttagggaatctgccattctcggtggatcaacctggcatattttggaaggaaaaagatgaagattcagaatggaacaaagcaaatgaaaatgctgatctagaagaaggatatgatagttcaaaagatgaagtttcatctgtttcctcatacaatccttccaaagcaaatcctgaattctccctgaggagctcgttgtcaatgcagtctctgtcatcacggctctccacgagtgagccattttacaatcaagtagaacgacctaatttcccatcatacagtccaattcctcgattttcagtgtcagagatttcagattatcacgatggaggtttagtggcacctcaagggaaactaaatcttttgctaccggaccatcctttgaatgggcaaagggtctctccagattctgatcactcanaagatgatgttggactcccccttacaccanaaaatgtggatccagctggatctgaaggctttacaacaggaagat

SEQ ID NO: 31043 - DNA, 232 bp, Sorghum bicolor
  Clone ID: 18063950
gcacgaggggcgcgcacgccaccgtccgcgggagcgaggagcagcagtagcgcagtgcaatcttataaaatgggcacgcacggcacaagccgcggcctcactctcccggcgtgctcgcgctccccacctcagctcagcttcagcccgccgctctccaaggtgaccaacgccatgagtcccggaggtgggcgcgtgggggacggcaacaagaagccgcccccgccgaatccgg

SEQ ID NO: 31044 - DNA, 505 bp, Sorghum bicolor
  Clone ID: 18063960
gcacgaggcagtgaaagcagcacagaagaagtttaactctttgaatcacgagtatgaaatagctctggatttcagatcatctatcgaagtatgtgttgatgatgatagcaacatccctaggccgcattataatttccggcagataagcgaaattgagaaccttgaggcaggtactattgtggacttgattggaattgttacatcagttggcccttctggcacaataatccgaaagcttgataactcggaagtccagaaaagaaatcttcaactaaaagacatgtctggtcgaagcatagaacttaccttatggggaaagttctgtgatgctgaaggccagcagctgcagttgcagtgtgattctggtctgaatcctgttctagctttgaaaggtgctcgagttactgaattcagtggtaaatctgtcaacacaaccggctcaactcatgtaaaagtagacccagactttcctgacgctgagagtctgcggcgatggtatgcaact

SEQ ID NO: 31045 - DNA, 575 bp, Sorghum bicolor
  unsure (1)..(575): unsure at all n locations
  Clone ID: 18063969
gcacgaggcatgccactccagtgctcttggcggtcattctgggttccctgctacttacactcggatgaaacaaatgtttgcttggaacatatgaaggggctgtccgtgagtatgttaccagcagtgttacttgtcaacgcgctgaacctgatcgcgctcgtctgccaggccgcatgcagcctctgcctgttcccactgctgcttggcagattgtttcaatggatttcgtggaggggttacctcgctctaagcaggtcaattgcatattggttgtagtggattccttcactaagtatgctcatttcgttccactacgccattcatttacagccagctccgtcgcccagctgtttctgagtcacatctacnagttacatggcttacctaatgctattgtctcagatcgtgatcgtattttcactagtcacttctggcgggaattgtttcgtttggcggatgttcaacttcagatgagttctagctatcacccacaatcggatggccaaacggaacgcttgaatcaatcaatggaaacttttctgaggtgcttcgcccatgccactcccactaagtgg

SEQ ID NO: 31046 - DNA, 624 bp, Sorghum bicolor
  Clone ID: 18063979
gcacgaggatcttggcacacatagtatacatagattgttccaaacttgcacttggcaaggctaaggagacaaggcaagagattgaagacagaatatctgaagcactgcttcattcaccttcgatcatcatatttgacgatctggacagtgtaatttcagtctcttcagatcctcaagtgtctcaatcgtccagttcttctgattctcttgtgagatatttaactgacattatggatgagtacaaggataagattcgaaatacatgcgggtatggacctatggcatttatggcttcggttcaatcacttcagagtcttcctcaagacttaacctcttctgggagatttgatttccatattgagcttcctgctcttgcagtcgctgagcgcaaagccctattgcaacatcaagttgaggagcatgagttactgtgttctgaggaagttctatcagagatagcatcaaaatgtgaaggttatgatgcatatgacttggaaattttggttgatagggctgtgcatgctgctgcttatcgctttcttctgccttctaatgcttctcacaactctctgaaacaaactttgctgatggaagatttctctgaagcaatgcatggcttccttc

SEQ ID NO: 31047 - DNA, 610 bp, Sorghum bicolor
  Clone ID: 18064010
ggcacgaggaaagataagtggttaaacccccgcatcggctattttcagatttcctagcactctgggatccacagagaagcacaactcatagaaggtaaccaccaatcgaatcttgttgccatatatgtacattctcatgtccatgaatatctcagcctcccgtgcatgatgaagctgacgttgctcctgccccaccgggccacgacctcatgttccacccctgcgtccactttcatgtcgacgtcatcactgtccatgccgagtccttggccactggacactaagaaagtcaacatcaaggttgaaattacctcgacaacggttttctctcatctcccgaccttagcttgataatgatgacttctctgtccatgtggtttttttttataaaggaacatatgcctccgagtacaacgtgtgcagattggaactcaaggtggagagttctgattggttggatttatattagagtattttcaatatgatgttaacaaattatgagtttgtttacttgtgtatgctttaatatatataacgtatctagcaccaacatatagtaattatgatccatggttgtagctcttaggtaatggcacttctgatccttttg

SEQ ID NO: 31048 - DNA, 473 bp, Sorghum bicolor
  Clone ID: 18064024
gcacgaggcaccattctcagatccatggaactaattcaagctcgcaacagcaggcatatgctgtgcacttggctaaagaaagacaaatgcaacgacatatggcacctcaacagcatagtgatctttctggagctagtgcagtacctaatgtgcagaatagtactcaaatattgcagcagaaccaagcctcgtctgccaatccagtcccttgttcaaaaccacaacatcagcgacagcaagcggcacaaaatctgctggatagctcatctcccaaccaacctgccactactacacaacagaagcagaagaaacagcagggacaacagcagtctagacaaaatcagtcacaaaggaaccatggtagtcaacaagctaagcttatgaagagcttaggacgaggaaacatgatgccccagagtcctccaattgacagcataccatccaatgctgcttgtactccatcgaagaaccat

SEQ ID NO: 31049 - DNA, 555 bp, Sorghum bicolor
  Clone ID: 18064031
gcacgaggccggagcctggcgaggaaagaaaggcagggccatggcgggagccttcgctctccgcctcgtgcctcgcctcgccgcggagcctcccgggagggggaagggtggcggaggaggagccagccgcgacgcaggcagcagggcgctggtgtcaaagaaaccaaacaagcagcagcatttgtggatcaggaaggagacagctgggtcagggaagaaggctctccgtcttattgatgctcctgtcgatccatatcttttaggtttcaaagttaccaaatgaaagagaagctatttatggtgcattggacaagtggagtgcttttgagcctgaatttcctattatagcagcagcaaaagctttggggatgttgaaaaggcgacaaaaatggctaagaatcatccaggtatgactgttatggacaaaagctatagtacttgctagcaagtcaagagtttaggtgttcttatttggagttttgtttattgcactttttgatagcaaactagttttgccagtcacctgcataattcgatggtgttcacaggtaacca

SEQ ID NO: 31050 - DNA, 543 bp, Sorghum bicolor
  Clone ID: 18064052
gcacgagggtctttttgattgtcttccaagtacactaagaccatcatctgaatctcagcccgaaggtgggaaaaacccatctgaaaatcaccaaaactcagaggctgctgtatatagtcctcctgctcttattgagccaaagtttgttccactactctctaaattagcacaacagttggttcaagctggatgccaacagcaatgctcagaaatatacagtgaagctcgctcttcagctttagaatcaagtctgaagaacttgggtgttgaaaaactgagcaaagatgaagtgcagaaaatgccgtgggaaattttggagtctaaaattgggaattggattcatttcatgcgaattgctgtcaaacttctttttgctggggagcgccagctttgcgaccaagtttttgagtgcagtcaatctttgagggataagtgttttgctgcaataacaaagaacagtttggctacactactcagttttggagaggctattgctatgagtaaacgatcaccagagaaactctttgttctgctagacatgta

SEQ ID NO: 31051 - DNA, 497 bp, Sorghum bicolor
  Clone ID: 18064065
gcacgagggcgtcgcgcccggcggcgcagccgcggcagcgaccactcgacggacacccgctgcgcccggcggtacggactccagacattcgatcggctccctacggtcctcccactcccagacccagtcacagtcccagctcgagctccggttgaagcaagcactgctggcgatgtatggtgcgtctgaccccacagctgcggagcgcacggcgttccggtgtgctgagaagcagtacaagctttacaagccactcaacctcaagggcaggtccaggtccaggagcaagctgtctggtggagaaggaggtggcgctgatctgtcagcggtagttgacttccacgtgctgcttgctgctgatggggagcttcccgcggggattggtcggcatgactgtgtggggtttgaccgccccgtgttctgcttcttggacaggccagggttctatttcattcctggtgctttatcaactgaggaacaatgctgttggatcaggg

SEQ ID NO: 31052 - DNA, 517 bp, Sorghum bicolor
  Clone ID: 18064068
gcacgaggccgggaaggggatcgtgtttatcccagtgaaagatgcagacggtagttaccaccctatggaatcaggaaatagcctttctggaggagcagtagcaggaattgtgatagcctgtattgttattttgattgttggcatctggctgtattataggcagcaaaagatgagaaaagccgtatcactctcgtctccagaggattcggtccaacttagcaaggcttcacaaactgagggcatgaaggttgacagatccatagagttctcatatgaagagctttccgatgctacaaacaactttagtatggagcacaaaattgggcaaggtggatttggctctgtttattatgctgagcttagaggcgagaaagctgccgtaaagaaaatggatacaaaggcatctcatgaattccttgctgaactgaaggttttgacacgtgtccatcactcgaatctggtgcatttgattggctattgtgttgagagttgcttgttccttgtttatgaatttatt

SEQ ID NO: 31053 - DNA, 521 bp, Sorghum bicolor
  Clone ID: 18064084
gcacgaggcttggccttttttttcaagattactgcaatgcatattatattgaatgtttttctttagcaggttcattaagaaaattagagctactctcgaagcctatactaaaagactacaatttcagtgcttagttagcaatggctttcatattttgcacagcggtttccttccggttgatgccaactacaagagtagtattttttcgttgcttcattaatttagtggagggattctatggttgggatttaagcccgaccggtctgagattttcctaataaaaaaaggtcttccacttcatccttgtcgctggtggaattgctgtagttcaagaaagaataatagcctttgctcacatctcaattctttgatgaaaagttgaaaacctggctttgatcttcctcattggttgacccaaagcagattctctttgtattggcagtaaatctctttgcccccaagcttgtcaatgtaaattaatcccttctcagttctctcttcttttttctgtggacagagca

SEQ ID NO: 31054 - DNA, 558 bp, Sorghum bicolor
  Clone ID: 18064092
gcacgaggcttgaagaggggctatcacagggaagattgattcataaccatcccctacaagttgctctggcctcacaatctcttgttcagcttggttttctgatggctcttccaatgatgatggaaattggtcttgaaagaggatttggtcaggcactaagtgatctaatcatgatgaacttgcaattggctactgtgtttttcacattttcccttggcactaagactcactactatgggagaatgttgcttcatggaggtgctcagtacagaggtactggtaggggatttgtcgtctttcatgcaaagtttgcagagaattatagactctactctcgcagccactttgttaaagggattgagctgatgattctgctcattgtataccaactattcggtcaatcttatcgctcaaccattgcctatatttttattacaatctctatgtggttcctggtattgacatggctatttgcaccctttctattcaacccctccggatttgagtgggcaaaaattgttgatgattggtctgattggataagtggatcagcaatcg

SEQ ID NO: 31055 - DNA, 524 bp, Sorghum bicolor
  Clone ID: 18064103
gcacgaggctcagctatgcttgtcgagggtacccgacgatcttctcgggaaaagtgcctcactcctcataccatcgggtagggccacatctgaacgacctctgcgcaccgtgagtgtcctgatgtgtaactagtacgctgttttggtgattttggacttgcactctttttctgaaagttcatgaaagagatgtttagaaaatctacatagttctgtgacggtggatggtggtcatggaagggacagcaatcggaacagctattgagtcaaaaccaggcaatgagcaaaaggactccttaacagaggtgcttagaactactgagactttagtggcacgtgattgtgaagttgaaaaattaattggacttgaagatgacacagaattaacaccttatgaaggaatggaatttgagtctgaagatgccgcaagggatttctacagcacatatgcaagaagtgcaggttttcgaattcggataagcaggtatactcgctccagacgtgataattcagttatttctcgt

SEQ ID NO: 31056 - DNA, 578 bp, Sorghum bicolor
  Clone ID: 18064113
gcacgaggctcaagtctcctctcgccgttgtcgttttcccgtgatatctgctgcaaacatatacctgtcgtcgccaattcatcatgttcttgagacagtcgtcgaagctctctagccaattcgccaggcaagcggcagcccgccagttttccacgagagctgtgcttaggcaagaggtccgggatgcatacatactcagtgcttcgagaacgccaacagcaaagttcaatggttcattcaccagcgtctcggcgccacagctcggcgccgtcgccatcaagtccgcccttgaaaagtccaaggtccccgtcgacaagatcaccgacgtgtacatgggtaacgtgctgcaaggatctgttggacaggcgccggctcgccaggccctgatctttgccggcctcccgtcaagcgtcgaggccatcaccatcaacaaggtctgtgcctctggtctgaaggctgttgtcttcgctgcacaaaacatccagttgggtctggccgaggcgcagatcgctggcggcatggaaaacatgacgagggtcccttactacgtacctcggtcgtccagcttaccgccgttc

SEQ ID NO: 31057 - DNA, 497 bp, Sorghum bicolor
  unsure (1)..(497): unsure at all n locations
  Clone ID: 18064143
gcacgaggagccatatcactaattcttactgaacgctcaccagttccacagtcatctactattaaaaatgagccatgtgaagctgtaactctagatgacgacgatgaggatgactctgttgaacctcatccaaaaaagctgatgcagacatgtagctctaaagtgacaactaacacagtgaagcaagaaaatccttttgtagcgattaagacaaggccagctgctggtactttggttgtttgcccaacaagtgttttgcgacagtgggcaggagaactgaagaacaaagttacaagtaaagctaatttgtcttttctgatctatcatggtagcaatcgcaccaaggatcctaatgaactcaccaaatatgatgttgtgcttactacatattccatagtaagcatggaggtaccaaaacaatcaaatcctgatagtgatgatgaagagaaagggaagcctgaccgatatggtgcacctgtgtcctcttcaggcagcan

SEQ ID NO: 31058 - DNA, 525 bp, Sorghum bicolor
  Clone ID: 18064145
gcacgaggcgcctctaaagttgcagaagcgtctcgggcggcagagcccaaaagaaaccggccggattgggttgggccgagtccaatcgagcggtttggctgcgagtcccagctacctctccggctctccgtcgttgggatccaattcgattcgtcgacaatccccatttctccgctgagaattcgggttcctttttattatttgtggtgagattgcgctgatgttccctcccaaattagtctcctgtattattcttttaattaggagcttcctagaatttgctccgcttgggagtagccgctgccgctgcttgcgcggtgttaccccaatcgacagaataatttagctaatccatcagttagggtctgggaatgttccactactgttcaaaattcgtaccaaacttcgttctaatattctggaacttgcctacgagctgtatttttatagattttattgcctacatgctgggaagtcgctgagaaagcaatttcacgcatcgagcaactagggtttggaaatccc

SEQ ID NO: 31059 - DNA, 366 bp, Sorghum bicolor
  Clone ID: 18064147
gcacgagggcgcggcgagagcaggggaggagggggactggaggaggccggggcttggatggtcgcggtgccggaggtggaggtggagcgctcccggaggtggtgttcatggggaggtcgttcagggactcgctcaaggtgctcgaggccgacatccagcacgccgactcgattgcttctgaatttcggagggaatatgatggcgcctgccttcagatgaggatggcatactgccctgctgcccgctttttcctttttcttgtgcagtggacagactgcaatcttgctggtgcacttgggctgttgaggattctaatttataaggtttacgctgatgggacaaccaccatgtgtactcatgaaagag

SEQ ID NO: 31060 - DNA, 488 bp, Sorghum bicolor
  Clone ID: 18064153
gcacgagggaggatgcttcagcggctgccggcgacgaggtggtcaaggaggtagtgctcgacagcgcgcacacgtggcgcctcaacgaactcgaggcgatcaccaaccagatcaaggccctcgagaatatgatgcacggagatctgctggaggctggcgccaagtcgccggagcggcaggacgacgaggcactcgcggtactcgacgccgacgaggaggaagtgactagagagttcttgatgctgatggaacaaggagaggacaaagacgacgcgaacgccaagtcgtcggctcctcaggtgtcctctctcaagtccggcgcgaagcccggctctggcgtcgacgccacgtgctacatctccgacctcggcaaggggctcggccccgtcgtgcagacccgggacggcggctacctggccgccacgaacccattcgacatcccggtggagcggaaggagctccccaagctcgccatgcaactgtccaag

SEQ ID NO: 31061 - DNA, 457 bp, Sorghum bicolor
  Clone ID: 18064193
gcacgaggatatgcaccaaaggaggtatccaagaaggacaactctagagataggccaaacactggtgcgaagatggatgacttgaaagatgcaccaaaggtcccggagaaggaaggcctgggagatgcaccaaagaaggcttccaagaaacagaggccctcaggagacgataatcattcagttaggaaagacaaagacattcatcattctcagaaacttgtcacaaacatgagtggtcgggctgatgaaagcaaagatagaaatcttagtgagatcagagaaagaaagggtgatgtaatgagatctgagtatcaaaaggaacctggaaaaagatggaatgatgaagctgttggtgatgataaaataaagtttaagagcgagaagcttcgaaatgagacaaagagaaaagaccgtagctttgataatgagaggagtccagaggtagatcgaccaatgt

SEQ ID NO: 31062 - DNA, 512 bp, Sorghum bicolor
  Clone ID: 18064194
gcacgaggcccaagcacaactccgagagcaagatcgtgttgacaacgaggatcgaggatgtgtgcgaccgaatggacgtccgccgcaagctcaggatggattgtcttccctgggagcccgcgtgggagctcttccgtgagaaggttggcgaccacctgatgggtgctagccctgagatccggcagcaagcgcaggcgctggccatgaagtgtggcgggctgcccctcgcgctcatcactgttggccgggcgatggccagcaagcgcactgcaaaagagtggaagcacgccatcactgtgctaaagattgccccatggcagcttcttggcatggagtttgatgttcttgagcctctcaagaagagttatgataacctgcccagtgacaagctaaggctctgcctgctatattgctcactgttcccagaggagttctctatttccaaggattggatcataggctactgcatcggtgaaggtttcatagatgacttgtatactgagatggatgag

SEQ ID NO: 31063 - DNA, 493 bp, Sorghum bicolor
  Clone ID: 18064199
gcacgaggggaagagtcaggccgagtgttctgcaagtcaagatgatgatcttgatgatgactccggtgggatgcgaagatcaggcagcagaggtacgaagcgcagccgcaccgcggaggtgcacaatttgtccgaaaggaggagaagggacaggatcaatgaagaaatgcgcgccctgcaagagctcatccccaactgcaacaagattgacaaagcctccatgctggatgaagcaattgagtacctcaaaaccctccagcttcaagtccagatgatgtccatgggaagtggactgtgcattcctcccatgctgctgccaccaacaatgcagcacttgcaaattcctccgattgcccatttccctcatctcggcatggggttgggttatgggatgggcgtcctcgatatgaacagcacagcagcggttccgtttccgcccatgcctggtgctcacttcccttgttcaatgatcccaggcacgccaccacgatgt

SEQ ID NO: 31064 - DNA, 568 bp, Sorghum bicolor
  Clone ID: 18064203
gcacgagggtaaagatggcttcggttgcagaagcagcgtctagcctggctttagtaggatattcttcttcagaagactcaatggtggatgctgctgcccgagtagctgatggtgattttgcggatagtaaaggggctggtgttgattgccaagaaactatgcctactcaagccacctctaccctcccagagaacatggattggcagaatgattctcttgcagctgctgcggtgacggttgaaccaatgtttgcttcctcatctgagcacgctgcagaatccaagccaattgatgaaacttctgttatgcaagtggaactggcaaccagtacaggggatgaatgtgcagcagagggtgacaatgttgtttcatctgaaactgttgtggaatcagagcctgttcaagaaactgttgttcctagtcaaggaggtagcatagaagctaataatacttctaccatcagcgaagtagacaaagataccgagtctcgtgcatctggtgaagtatgcaaagatgctcagtctcatggcggtgaatcttacactgaactgcaattggcaccttcctc

SEQ ID NO: 31065 - DNA, 511 bp, Sorghum bicolor
  Clone ID: 18064204
gcacgagggatgtcctcgtctctggcctcaatggcctgggtgctgagattgcaaaaaatcttgctcttgctggagtcaaatctgtcaccatacatgatgtcaaaatggtggaaatgtgggacttgtctggcaatttcttcttatcagagcaagatgtcggaaagaacagggctgtagcctgtgtgtcaaagctgcaagagctgaataacgctgttctggtctctgctctaacagaggaattgacatcagagcacttttctaagttccaggctgttgttttcactgatataagtttggagaaggcttatgaatttgacgactattgtcacagccaccagcctccaatctcttttatcaaagctgaagtctgtggccttttcggcagtgtcttctgtgattttggacctgagtttactgtccttgatgttgatggtgaagatccacatactggtataattgcatccatcagcaatgacagtcctgcaatggtatcctgtgttgatgatgagag

SEQ ID NO: 31066 - DNA, 300 bp, Sorghum bicolor
  Clone ID: 18064207
gcacgaggattggatgtctttgtggttctcactgaggattgctgtgctggaccatcacatgatcaggaagaatcaaatgttatagctattcttcttcactgtatacaggaggaaatgcattacaatgttagacatggagccttccaggtgctgagatcagcggttcacaactacccgagctgtgcaaacatgatttgggaaaaacttcgagacaacgctcttaatttattgcaaatagaaagcttcgaagaccaaaagtatgaagctaactttgggcctcctggacctaaagaagaatca

SEQ ID NO: 31067 - DNA, 599 bp, Sorghum bicolor
  Clone ID: 18064208
gcacgagggggaataagaccaggaaatctggtttgcgctcctttatgggtcttattggtatggggcatggaaatgtagagaagaacattctaaaaccaagggaagatccgctacttgatagcgatgatgagagaccagaaagctttgatgatgatttcaggaggaaagaaatgagaaggggtatagatttggctactacacttgaacgtattgaaaagaattttgtcatcactgacccaaggttaccggacaatccaattatatttgcatcagatagctttttacgattgacagagtattgtcgcgaagaagtattgggaagaaattgcaggtttcttcaaggacctgaaactgaccgtgggacagtaaagaagataagggatgccatagataaccaaacagaagttaccgatcagctgataaactatacaaagagcggtaaaaaattctggaacctctttcacttgcaacctatgcgtgatcagaagggtgaagttcaatacttcattggggttcaattggatggaactgagcgtgttcgagacactgctgcaaaagatggtgccatgatggttaagaaaactgcagataatattgat

SEQ ID NO: 31068 - DNA, 504 bp, Sorghum bicolor
  Clone ID: 18064210
gcacgaggcagatccgcctgaaggccctaatggttccgcggtgaactatgatatgattgtgactcatcgaactcatgcagttcagcaaagcatccggcagataactaatgatcctcgaattcagaatgcagtggctcttgtggagaaccatcatgagtgtcggaggaacgcagaaggtgaaaaggtgcttcctgatggccttatctggaggcggctcctcctcctcctatgctactcactgaagatgattgctgagattgacagtctctcaactcgtcgtgcttcttctacaagttttttaggtcgctttttccaagtgcctccaattccttacttcttatcatctttgttgcaatctagagagcaccctaggcgttccaatgaacataatgttgggagtgtggactcagattttgacctagatgaattgttgaatggggaccaagaggatgaagaagatgactatgatcagcttcctcccttcaagccactaagtaaatccca

SEQ ID NO: 31069 - DNA, 152 bp, Sorghum bicolor
  Clone ID: 18064215
gcacgaggaacctgctgggcaaattcgaactctccggcatcccccctgcgccccgtggtgtgccccagatcacggagtgcttcgacatcgacgccgacggaatactgaacgtctcggtcgaggacaagacgaccggggagaagaacaagatc

SEQ ID NO: 31070 - DNA, 139 bp, Sorghum bicolor
  Clone ID: 18064235
gcacgagggcattcttattttgttgcattgatgttattttgtttatcaaaagcccaataatttatccataacatttgttgcattgatgatatttgtttatccatttgacatgttctgacttctgaataaattgatttac

SEQ ID NO: 31071 - DNA, 146 bp, Sorghum bicolor
  Clone ID: 18064247
cagatatgtacgctgcctgcacatatcggaggtggtgaatcacatgaaggacttgattgagttcagccacaagaacaatcttggtcctaaaggtatgatgattgtgcacatttatataatagtgtctccaattttcatttagttgt

SEQ ID NO: 31072 - DNA, 327 bp, Sorghum bicolor
  Clone ID: 18064249
gcacgaggagcgaatacaactgtacggtgactgtagtggcaacaccacttgacgaggtgaacattacgtttagccctccaatctccattccgctgaggaagatgcagcacacacatgcgacctttgtcagaggcctattgaaccctgtatattttggtctaaactcagcatcaaatattccagagctgattggcaccctagagctccctgatatccctttctcgtgcatctcagttctgaagaggtacagcgaagatgacatggtctacaagatgttctcacgtgcaaagctggatgatggtttactggatcagatattcagcaaga

SEQ ID NO: 31073 - DNA, 329 bp, Sorghum bicolor
  Clone ID: 18064256
gcacgaggttaccccgcatccctagccgcgacgactcctcgatcgccggcgaatatcgtcgtccctgactctcaactctggtagctcccagcctccccacgagtccgaccatcccgcggttatcaatctggcttgaactgcacttcgaagtctcgttgcttcattttttttgagtgtttattatgcgttgtgccttcaattcaaagaaccatgcttgggataaggactcaaatgcgatggatggttcaagagtggattttctattgttgtctccagaaggaaacccgatgggattcagacccgaagccccacaggtatcaagagttctt

SEQ ID NO: 31074 - DNA, 466 bp, Sorghum bicolor
  Clone ID: 18064261
gcacgagggtccacctagctgttggagatcaggttcctgcagatggcctctttatttcagggtattctgtattgatcaacgagtccagcctaactggtgagagtgaacctgttgtcataaatgaagataacccttttcttttgtcagggactaaagtcctagatgggtcatgcaaaatgctggttacagcagtagggatgcgaacacagtggggtaaactaatggctgccatcactgaaagtggggatgatgaaactccactgcagggtaaactaaatggagttgcaaatactattggaaatatcggtctgttttttgcccttttaacttttgttatcctctcgcaagggttagtggcccagaaatacgctgatgggcttcttttaagctggtctggagaagatgtactggagatactggaacatttttccattgcagtcacaattgctgttgttgcgggtcctga

SEQ ID NO: 31075 - DNA, 630 bp, Sorghum bicolor
  Clone ID: 18064263
gcacgaggcaaaggtctaccttggtcttggatccattagagcgaattcccagtatcttaaagacctacggcagaggatacgagaagttcaaaaggtgcttggtgatgcatccaaggactctgatctactgaagaatgcaaatgagaaggttaaagcactggagcagatgctgattaagggaaaacagatgcaggatgattgttctattgttgtcaaaaagcttcgagctatgcttcattcagcagaggagcagctgcatgcacacaaaaaacagactgtttttctgacacaacttgcagctaaaacccttcctaaaggtcttcactgcctccccctgagactagctaacgaatacttttcattggatcctgttcggcagcagttcccaaaccaacaaaaactcattaacccaaaactgtatcattatgccttgttctcggataatatactagcaacagcggtggttgttaattcgacagtgttaaatgctaagcatccttctgatcatgttttccacatagtaaccgacaaactgaattatgctccaatgagaatgtggttcctctctaatcctccggggagagcaacaattgaagtacagcatattggggagttcacatggctaaatga

SEQ ID NO: 31076 - DNA, 569 bp, Sorghum bicolor
  Clone ID: 18064274
gcacgaggaagagattcaaatcccattatagatgaggaacagcaagttaaagagccatcaaaagatgacagtacggaaattatttctgaagctgaggttaaacagactcctgaatcatttgagcatccagcaccttctgagctacaactagagatagctgaagtgaacattaatgcacctaaggaagctattgaagttgaaaattcagaacctgaagatggttggcagcctgttcaaagacctaaatcagctgggggtccaggtaaacagatgaagcattatcgtccaaccaccagaaaggtgtatgaacctgatagtcatgatccaacatatacttcacaatacaaggcaaggaattcctattcaaataaccggtattatttcttaaggaagagaacagttgttcctacaacgtacacagatcctcaacagcatgtgaaagttcagacatctggtgccaggtttggtcgcaagatttacaaggctgtgacctatcgggttaagccagagactgcaaccacagaggtgctagatacttttaagagtaaagagcagatgagtggtaaagc

SEQ ID NO: 31077 - DNA, 630 bp, Sorghum bicolor
  Clone ID: 18064279
gcacgaggctcgatatctataaagatttcaacaagttaccaagcgcggatccatgccacggccacaatcagatcactgctggggcttctgaccagagtgggaggatcagcaagaagaggaaggaaatgcatagcgacgaggaagatgacggcgaggagaatgatttccaagaaggtgatgaaccctcggctgctaagaagccaagagttgtttggtcagttgaactgcaccggaaatttgttgcggctgtcaaccagcttggaattgataaagctgtaccgaaaagaattcttgagcttatgaatgtggagaaactcaccagggaaaatgtcgcgagccatctacagaaatacaggctctatctcaaacggttaagtgctgtggcgtcacaacaagctagtattgtcgccgcttttggaggtagagaccccgcatttcttcacatgggagcctttgaaggccttcagagttatcaaccttttgccccctgtgctgctctatcatccttcagcccacacggcttgctaggtagaactagcgctgcaacattcggggtcccagaacttgctcctgccatgacagttcaaactgctaccaacaatggcataataagtcactgtgctggtgatg

SEQ ID NO: 31078 - DNA, 509 bp, Sorghum bicolor
  Clone ID: 18064282
gcacgaggcctggttcgccaagcccaaggttattagtcctgttaactgcgcaagaagaggatggactaacattgagccagatgttataacatgtgaagcttgtggggcacgactcctgttctccactccttcctcatggacaacacagcaagttgaaaaggctgctgctgttttcagcctgaagctggacactgggcacaaactactgtgcccgtggattgataatatatgtgatgaatcacttgctttatttccaccaacgccacctcctgttttagttgggaactactatgaacttttagcctctctgatgcgacttttagcactcccaagaatttcctgctcttctcttgagaccatgaaaaagcggagtccacagctagagcagtttctatcagaaccattctcttcatcagttgttctcaaagggagatttatgcttactgaggactctacaattaaggatttggatgatgcttttcaagatgctgacacatattatcaggcac

SEQ ID NO: 31079 - DNA, 218 bp, Sorghum bicolor
  Clone ID: 18064285
cattactgttcactgctacatcggcttcctgtttgacttcccatctcactgagtttgcgaaaatgcatttgcttctaggaaaatataagcccttgtagttttaactaacactaaaaattcctggcaccgtattttactactgtcttatgattccttgaactaatttaaaaaataatgataaagcaaagaaaggatatgtgctattttgtattttagtg

SEQ ID NO: 31080 - DNA, 264 bp, Sorghum bicolor
  Clone ID: 18064301
gcacgaggctccagcaacaattctatcacatattctgcaaacagcacctatggccactttttcattatatgcttcctgtttgtcatgacaaaggtgagctctttgatcgctccctttttcaagcctatgtgcgggccaacaaaatttttgctgacaaagttgtggaggcagacaattcatatgatgattgtgtgtgggttcatgattatcacctcatgcttatcccaacctttttaagaaataaactgcaccggatcactagtt

SEQ ID NO: 31081 - DNA, 458 bp, Sorghum bicolor
  Clone ID: 18064311
gcacgaggatcaccgtgaccggtgtgacgcaagggacggtgagccagaatctggttgacgggcatgagaaatctgagggtccaaccaagtccccgaggccgcattgctcgctatacactgatgaagacatcgaaagaatgaagaggcgtattgaagagttagaactgttaaatgcagacctaaaacaacgattagaagaagctaaacttcagttgaagttcaatgatgcgattacccaccctaagaatgaaattcctgatggactgaacatttgccacggcattttcatttgttccaatgaatctggctacgaaaagttggaaaagaagcttgctcacgcagactcaaagatcatccatgttgtttctgttcatggaaggacaatttggttaaatgtcagacgttccaggtacggtcgtcaggcaaggaagaaagacagaagttccccagaatttgat

SEQ ID NO: 31082 - DNA, 391 bp, Sorghum bicolor
  Clone ID: 18064312
gcacgaggggcagatgttagtatttctataaatattatcacactgaacatagtttgacttgggacaaacttggatcccatatattttaggacgaagggtgctcatgtttatttggtatatatgctcaatttagatatatatttaatttggggaacattttagtttatgttaatagaaaaatacatgggtaatttggatgcaaattgatggggttacttgattttatattatattttataatagcaaatatggataatttaaatgcaactataggagttactatataaattatccttcttaatgattaaggtttgtagtttagatacagatatggagggctatttacgtttttttatatggctcaagtgtataattttttaagagaacataa

SEQ ID NO: 31083 - DNA, 407 bp, Sorghum bicolor
  Clone ID: 18064317
gcacgagggagggaggagcggacggagatggaggctgctgcggcgtcggggacacctctcccgggaccatcgtgtgggtgcggcggaggaacgggtcctggtggcccggcaggatcctgggccccgaggagctcccaccgtcgcagatcatgtcgccgaggtccggcacgccggtcaagctcctcggccgggaagacgcaagcgtggattggtacaaccttgagaaatcaaaacgtgttaaagcattcaggtgtggagagtttgatgcctgtattgagaaggcagaggccactcaagggactgttgtgaagaaaagagagaaatatgcacggagagaagatgctattcttcatgcacttgaattggagaggaaacagcttgcatcaaagtatcaaactcaaggtttc

SEQ ID NO: 31084 - DNA, 521 bp, Sorghum bicolor
  Clone ID: 18064324
gcacgaggggatgaatcccttgtacctccaccggtgttggcagctcttgatattgttcgtcaaggtgctgatgttatgccaaggaagcagctaaattcagtccttgatgccgagctaggtcctgactggtcctccaagttgaggagtttcgactatgaaccgctagctgcagctagcatagggcaggtccatcgagtggttttgaaggatggatcagatgttgtcatgaaaatacaataccctggggttgcagatagtatagaaagtgatattgagaatgtcaggctacttctaacttacacaaatctcattcctaaaggtctttttcttgatagagctatgaaggtggcaaagcaggagctggcaagggagtgtgattatgtgctagaagcaagtaaccagaagcgttacaaagaattgttatgtgatagtgatggctattatgtcccaaaggtcattgatcaattgtctagcaaaaaagtgctgacctcagagtttgttccaagggttcccatcgataa

SEQ ID NO: 31085 - DNA, 545 bp, Sorghum bicolor
  Clone ID: 18064328
gcacgagggccatatccagcccagcagcatttagaccacgtgtaaatgcaaccttagcgtatagttcatcggtggaacttggacgccctgtgcttcaagggcttcttgccgttgatataatagccaaagaggttcttggatgggttcaattgatgccaaactatgcgactgagctcgtggagtatgtacgcacatttttagaacgtgctcatgagagatgtcgtgcatcatatatggaggctgtccttgaaaagcaaagttatattctcctttcaaggaatgatgttgagagtttaatgcgcctggaaccagcaaacatttctttgcaaaattctactagtgaacatgataacaatgtaacagatgcagaggcagtcgaagtagagattgaactaagtgatctcttattagatatgtgcccaataaaacaggaaaacttgatccatgatgaccagaaactgatattgttggcttctcttagtgactcattggaatatttagctgattcagttgaaaggcttggggaatcattcataagtccacca

SEQ ID NO: 31086 - DNA, 551 bp, Sorghum bicolor
  Clone ID: 18064329
gcacgagggaacaaggagcctaaaattgcagatcttggttcatcaagacttggtgcttctatagaaactcaagaatcggggactctaaaaggagtaacactaaggtacacgccaccagaatgcaaaaatggtggcaataatgtgtcaatcaagttcgacgtgtttagtttgggagttataattcttgacatcgtggctggacaaaatggctactcccgtcgttctgacatgcgtcatcaagtgtttattgagcttgtgagtgccaaatggaagggaaggctgaaagcaacgtcgagttccttatcacacgaactggacatccaacgattggagacatgcgttgaaataggattaagatgcaccgaagatgacccaaatgacaggcctgctataaaagatatcgtgtgccaattagaagaactggaagctaagtgtaggaataaaatgccattggcttctgaataccagtcaagagacttccagaacaaatatttcccaaaagaggagaatgatgggccgtcccacaagaaaagtgactggacaccagcaga

SEQ ID NO: 31087 - DNA, 582 bp, Sorghum bicolor
  Clone ID: 18064330
gcacgaggggcaccaggcagggttccagggggctgtgtacatcgactgccccatgaagccttgcttcttatgcaagatgccaggtcatacaaccttgacttgcccacatagagtagcaatggagcatggtgtcatcccagcccctagaaggaatacaaacacttcactagattatgtctttcagagccaagtcaagggcaagatttccatggttaagcctaagtttctgatacccaaccaactagagtgtggaaacataaaatttcatcagaggcgtgtgacatgcttggagtttcatccaactaagaacaatgttcttttatcaggagacaagaaagggcttctgggtatctgggattatgttaagttgcatgagaagattacatatgattctgtgcactcctgcattctgaatagcatgaagattgacaccaccaacgatgggatggtatatacagcttcctctgatggtactatcagttttaccgatttggacactggcattggctcccccttgctaaatctcaacccgaatggttggaatggtccaagctcttggcacatgatatatgggatggactt

SEQ ID NO: 31088 - DNA, 575 bp, Sorghum bicolor
  Clone ID: 18064340
gcacgagggtcttttgtgctttctttgcgagtccgtgtgctatttgacaacgcaaagtgggcctatcctggtggattctcagaagaaaagcagaaagttcgaaggcggaaaactgcttcatggttaagagagcaagtattgcagcttggcccaacgtttattaaacttggacagttatcctccactagatctgatttattccccagagaatttgtggacgagcttgcaaaacttcaggacagagtaccggcattttctcctgagaaggccaaagttttcatagagaaggaaatgggttgttctattgatgttgtgtacaaagaatttgaagaacgcccaatagctgctgccagtcttggtcaggtacaccgtgcagtgctccacaatggagaaagagttgcagtgaaagttcagagacctgggctcaaaaaactttttgacatcgacctgaggaacttaaagctagtagctgagtattttcaaagaagtgagacattaggaggcccttcaagggactggatcggtatttatgaggaatgctccagaattttatatgaagaaattgattacattaa

SEQ ID NO: 31089 - DNA, 530 bp, Sorghum bicolor
  Clone ID: 18064352
gcacgaggtgcagcaagcgttgtactggcacattgaggcgcgtgtcgtgttggatctccaggaaatccatgactccattaatgggcgagaactccatttctcgatggtagatggtgacttcaagaagtttgaaggaaaatggtccataagatctggtccaaggtcctctagtgcagttttgctgtatgaagttaatgtgataccaagatttaacttcccggctatatttcttgaaaagattataaggtcagatcttcctgtaaatcttggtgccttggcttgtagagctgaaaagatttatctggaaaatcaaagttgtggttcgagaaaattctctgttgaggacttgaagccatcatctacttcttctcagcttgataacttccgtagtaggacagttgatacttcttctagtaaatttaaagaagcacctcccacttctggtgttaacagagtgcttccatcacctgcttctgaattgattagcaaatggggtgtatatggaaatgtatgcagaattgataagcctt

SEQ ID NO: 31090 - DNA, 628 bp, Sorghum bicolor
  Clone ID: 18064362
gcacgaggcttacctcttcctaccagatctcccctcctagcgttcatggaggcttgttcccgtttgctatggatggggatctatatgcacacgaactgtgtccctgttctacaacaaaccctagctgcctgtccttaccttttcgctatagatttggctgcaagtttcctggtgtttattgatgtgcatatcgttatgaattagtagatattttaaatgtgtagttagctactgcttaaatctagaacaactcttagttctgacataggtgtttgcttcatccaacttcatggttgtcttgagtgtattttgtttccgtggagcatatctattttaggccaagcaggtagtcactattgttaccagcttgttcacatttgatgtctgaggctgaatttatcatgttttaagttatctatgtataatgtaagtgttgccatattggtcagcatgtggcaccgtggcattagtcccaagtgctcatagcaagcaaattagatctgacgcctttttcatgctactattaagagatttcaccaattttttagaatagcagctctacatcagctacagtgtgtgtgcaaaagtattgaatatttgcctattaagatattttggttttgtgatg

SEQ ID NO: 31091 - DNA, 405 bp, Sorghum bicolor
  Clone ID: 18064368
gcacgaggatttctcaaatttgcgcaagacattgggtcctggaattgatggctgggaagtatctttgaaaggaatgatgagcatagtggtacttcttggactggtcataacttccatctattggggagtgaacaagtttgttttgaatgatccttcacttccaaagtctgatcgtaagaagaaaaaggaaaagcctaaacttggtatgaaagagagtctgaaggttctgctctcctcgaggtatgtgagggatctagccaccttagtggttgcttacggcattagtatcaatcttgtcgaagtcacatggaaatcaaaactcaaggcacagttccctagtccaaatgaatactcatctttcatgggtgatttctcgaccgcaactggaattgcaactttcacaat

SEQ ID NO: 31092 - DNA, 455 bp, Sorghum bicolor
  Clone ID: 18064386
gcacgaggaggattttctgagctgtttgtcccatttgcatattcagcatgtttaccctgtaactgatgttaatatttcttgttttgaggcttcaataattatcactggtcatattgtgtcttgagaggcaacaaattagagtctctgatgtgcttttctgtagcacattcagtgctgtacgttgccaatagtgaggatggaataagttatcatgcattcattgccttctcaaaccgtgtgtgcatcccgatgtccaacattcctcactttgcttataattgtatggccagtggtttttccattgttggatgaccactagggtgagtgctttaatcttgtctttgtgtgattactacataaagcatcttgtttatatgtactgttctgattttttttatgagcctgatgccacgtctccagtagctgtgggcattgactggtgatgctatgattag

SEQ ID NO: 31093 - DNA, 240 bp, Sorghum bicolor
  unsure (1)..(240): unsure at all n locations
  Clone ID: 18064388
gcacgaggggagggcaacacatttcctgatgaacaatatggttatccaaaggctgaatcagagaggtgggtttcctgcattaggatccttgatccaaggagtagggacacaacctgtcttctggaatnntgcaggnagaaatgaggctgctgtcagtatttgcactgtgaatttccatgataaggagcacggaactctactggcggttggcactgccaagggattgcagttctggccaag

SEQ ID NO: 31094 - DNA, 297 bp, Sorghum bicolor
  Clone ID: 18064404
gcacgaggcatccttaaaaagagaaagagaacagtaagaccagaagcacgtaaggaaccaccaaaaagaccacagcttgtagagccttctgccaatgttccaagacaaatagttgatgaagactcgcccgaagtatttagatgcttgtcatgcttcactttcttcatcccaacaggttgcagttttaatatattccgtatatctgaaaggagggatgtaaaccaacaagttcaagttcagcattcttctgcttccaacagacgtctgaacactgtggaagttggcttctttcttgtt

SEQ ID NO: 31095 - DNA, 515 bp, Sorghum bicolor
  Clone ID: 18064443
gcacgaggaggagatcataatccggattcatgtgaaatccgacaagtgccaggccaaggccatgaaggtggcagcagccggcaacggtatgcgttcgtgctctgttcttgtctgtgatgagaattcagaagcaatcacatcgtccttatcattcatatcagcaaatcatttccccacctcttggttggagcaggagtggagtccgtgacgctgtccggcggcgacaagagcctgctgctggtgatcggcgacggcgtggacacgaacaagctcctgaagaagctcaagaagaaggtgggcgaggcggagatggtggagctgaggacgcacgacacgttcgaggcggcggcgctcccgctcccgctcccgggcaccaagcaggagctggcggccatgatggcgatggcggcggcgcggtcgccctacaacaaccaccagcagcagtggcagcacagctacgccgcggcgcccaccagcccgtactcctaccactacgactacccgtcgccggtggg

SEQ ID NO: 31096 - DNA, 562 bp, Sorghum bicolor
  Clone ID: 18064446
gcacgaggctttattaaggatgatggacaaatacgccaggctgatgcaaaagctggaaattgtcaatgttgagctttttaagggtatctcccaactgtttggcatcttttatcactacatatatgagacatttgggaacctagacaagagtcaaagcagcaagcctttacctgatcaccaatcatctcggcttaaagccgctttatcaaaaataacacaagactctgatcagtggacaaagccaaataatgtttcatattcaccttcatcccctttgtcaatgaattcaactttcggccaaatggatgtgatgcctactgcgcctcctagttcaatgttcacctcctatgggttaaaggagagatgtgcagctgctgaaacattatcattggttgctcgagttttgaaccgatctagagcccatctacactcagtattgtctaaaaataacagttctgttgttgaagagttctttaggacactggtggactctgttccagatttgacagagcacattcacagaatgagtgcacgaatgcttttgcatattgatgggtatcca

SEQ ID NO: 31097 - DNA, 533 bp, Sorghum bicolor
  Clone ID: 18064452
gcacgagggtcacttagtggggaatgatgtggacaccttgcatgaagggagaaatcatctagtggggtttagctttataagagatatagatatagatagataagaaggaactttatccgatacccagtctttattgttgtaccatatatagtcttatggataccacttcacgtttctttttaatggtgtgagtagttccatctttgtttctgacttgaggcttaacgaaaatttgtccatggatgtgattggcagctggtaatccacctccaaaaccgtgggaacgtgcaggagcttcatctggctcagtgccttttaagccgccctctggtggtagcaccagtgatgttgttgaagcttctgggacagcaaaacatggagaggttgtttctgctgctgggaacaatgttgcctcaaatgtaaacagcaacatttcaacgcctgtgcccccaaggccttggcagcagcaaggctatggaaactcttatgggggtaattgataatcttttgttgcatgtttcagaaaatattct

SEQ ID NO: 31098 - DNA, 581 bp, Sorghum bicolor
  Clone ID: 18064468
gcacgaggggcattaataaatctgattacatttttctgagtacatttttctgaaagaagcaaagtgtttttccttaagtttgatgtggttgttgttgttcccgttagtatgaactgctttggagctttggggggtatctgtttctgtagtaatttgtgagaaataacacaataactgatagatttaatcaatatgcgatgttaaggaatgtgatgttctgggatggaggttggtagtatttagatttgcatgtgtttctaaactgcaaataacatggacttgcggtgctgtattctttggtgagggtattgtttgcatatagtgtactaatttatgatgcagcgatgccattccaatcctgactccataagcagcatcaaagtagctatgcactgttcactcatgcatctgtactcaggtaatgcaaagtttagttgtgttcaaatgcattgaaatggtctgctcaagaacatgtaatttttggtttagtttagatctcttcgtaaagatgaatacaccaaatggtattattcatattcattctcatatggttatgatattatatatgcttattgcttctt

SEQ ID NO: 31099 - DNA, 417 bp, Sorghum bicolor
  Clone ID: 18064482
gcacgaggagcattggtagcagtgtcatcaggacagcttgatcaatgtggcgttatcagtaagacaggcagacacatcagcaataccggaggagcaccgaagcttaccagaagccgaatgtccgtgtgtcccaggggatacgtatccccccaaccagaaatcgttcgttccactttgagattcgtggtacacccttgtaattatgtcacattttactcacccatacctcttactggaccatagaattgcgctcgacggtatggaaaaaagctgcaaacgctgaagctcctatgttggacagtggagccgtgttgcactctttctcgtgaaccagtagcctcccctgagctttttttttttactttctaacttcccttcctcagtaattttcccattttcccgattgcagctcttacg

SEQ ID NO: 31100 - DNA, 524 bp, Sorghum bicolor
  Clone ID: 18064484
gcacgagggttctggctgtctcgcatgtatttttctgtgctacaactatgcttttaggaggtgcaaagatacacaaatggaaaaagtgggaggaagaaattcagaaaaacgctgcaggaaacggtatcacgagtcatgacccagcttgttgttgttgttgttgctcatattttagtgcaatgacacacactggtttgaaaatcctcttgtttttctagggaaactggaaacatgtaattaatcgttgtgaaaacaaaagctatgtttatgatctggttattttcttcacaagagaaaggaacagtttgttatcttcgtaagatagacctgtttgttgataggattgataaaatccgatatgtgaaactgcaggatctaagaaggtgttacctatgcatcaagtttcatttatcagagaacattatgaggttattggcacagattctaagacattgtgttggctggtaaggtgtactacattcatgtgttctactgtcatatattacctgtatattgaaaaataa

SEQ ID NO: 31101 - DNA, 564 bp, Sorghum bicolor
  Clone ID: 18064493
gcacgaggaaagaaattacagagacttcgtgaatttgttcgctctgaatatgatcattcatgcttaaggtcttgccgttcacgtgcactgtatgaaggcctcaaggtgactgcaaccccagatttaatgctagggtatttagatttcttccttgggggagatgaaaaaaggcctgatcttccacctcgtcttcgtcaaaggtttccaatgtctctgatctttggaggcgatggaagttacatggctccgttttcacttaatagtgacagtgtgcttactagtcttatgagccaggctgttccctcatggatatggcaccgtcttgtagctggattgaatgcacagctgcgtttggttcgctgtggaaatctgaaagtaacgtttcttccggtcattgactggcttgaaactcatgcaaatccctctttagctgagaatggtatccgcgttgatcttgcctggttccaagctacagcattagggtactgccaatttggtcttcttgtttatgctgttgaaggagaagctgcacttactgaacctgatggaagccctagagtaaaa

SEQ ID NO: 31102 - DNA, 512 bp, Sorghum bicolor
  Clone ID: 18064500
gcacgaggatcatcttgcaaaagctggctttctgtcaacggctcggttcagtcaatgagtgctgagaagcacgatgaattcaagaaatcaattgaagacatggcagcgaattcattacgctgtgttgcttttgcatactgttcctttgacactgaaatgatcccagaggaagacatagcaagctgggagttgcccgaggatggcctgaccctgcttggcatcataggaataaaggacccctgtcgcccaggtgtaaaggatgctgtacgactgtgcaccactgcaggtgttaaggtgcgcatggttacaggagataatattgaaacagctaaagctatagctctggagtgtggaatactagatgcaaatagtgttatttcagagccagttgtaattgagggaaaagtgttccgtgagatgtctgaaagtgcaagaggagatgccgctgacaagataattgtgatggggaggtcctcgccaaatgataaacttttgcttgtccaagctttaaa

SEQ ID NO: 31103 - DNA, 613 bp, Sorghum bicolor
  Clone ID: 18064501
gcacgagggatgctacttgtttccctcctcctcctacttctttcttccccaaagctgttagctgaaggtcccttctgcagcaatgctaacaccgcatgcatgccaagcagtacctacatgtccaacctgaaatcccttgctgaagacctgattggcagcatcacaagctcaaactcacactcagctcatggcgcagccggaacaggtgctggcagggtctatggagcggttctatgcagaggagacaccaacccaggtaaagattgtgcacggcgccttgaggccctttatgcagccatcagcaacagcagtagctcttgctcctcgcagaagaacataaaccttttcgatgacagaaaccggacccagctaatattctctgatcaggacttcagctccagcaacgctcaggaatgcgtagtgagcggtaatctgaaccctccaccagttagtgatgatgctgactcagagttcgatgtgcctctttccaaactgatgaaccagcttgctgatgacatggtgagtaaatcagtcagcaggtacgagacaggccagggctggctccctcaaacgaatcagacagtatatgggcttgtgcagtgcacagatgata

SEQ ID NO: 31104 - DNA, 559 bp, Sorghum bicolor
  unsure (1)..(559): unsure at all n locations
  Clone ID: 18064506
gcacgaggaaacctttatgctattttgcatgcactgcaattatttaaatggcttcatttgaaaaaaagggttttaggagatcaatcatgaagagaaaactgatgacatttcaggtagcagtcatgtcgaggttcacatagagaccaaatttcaagagcacatgaacaataatccaattgtctaaattgcttatttctgcagtgtataccaagtattattggtgactctatcccaatgaaggaaattgttttcataacatatgtaattgttgatggttggactggaatagctggtgatattgaggtaatattcttccatctaaagaacatgcttgtctcgaagttgtaatgcttgcaggaacatgcttggttgtcgtcatcactttcatttttttaatggtatggcttactattttcagccgggacatggattaggagcaacacgcctggtaacgaggcaagattttattttctctatgtatggttcagcaatttttgaacagctagaaactaanactttttcactttccatatattatataagagctgacacgtataca

SEQ ID NO: 31105 - DNA, 538 bp, Sorghum bicolor
  Clone ID: 18064512
gcacgaggaaaaaaagaaatggatggccacggtggtctcctcccgtgccgccgattctcttcctcccgcagcttctcctcggcaggcaggcgagagggcagtgcttctcttcctctcttccctgctagttgcagtggtcgaggcccacgcaagagcagtggacgcctccaaggtagtcgagacgtggggcgcgcctgatgcctccttcaccagcatcgctgcttccctcgccgatcgtgccgccgaccccggtcttggatgtggcgaggaagaacaccgtggtgagtacctactgcgcgttcatttaggtgatttcgtgtaggctgagttgccgaatccctcgaatggggatgctctgtctgatgtcaagacagtggggacagcaccaaatgaactttctttcatctgattatatcgttcattccaactcttttaaggaaagagtacacttttgaataatttttttggcacgaattttagggagatggatgctttcaaaggaaggcattttttattgtttcatatttttctgtctttt

SEQ ID NO: 31106 - DNA, 585 bp, Sorghum bicolor
  Clone ID: 18064517
gcacgaggatctgtctcatgattcagatggtcccctataattgcagtaagtgccaattgcaatcttatggcccaaagagataaagaaaacatgtgacttcttaattttctggatcatggtgtttacactctagggcatattccttttgcccttgatattgttcttttttcttgtctgatacaatattatttatctattgcagattcttgactatggctttgatcgattaggtgccaattcagaggttgggcatccaattcttatgacagaatgtgaatgtaatccgtccttttctcgagcccgaatgtcagaactacttttcgagacatatggtgtaccatccattgcatttggcatcgacaatgcgtttagttataagtacaatcagaaacttggaaactgtaatgaagacgggctggctatttcatgtgaacatggaacttgtcatgttgttccatttttgaaagggcagcctgtgttgggggcatgctgcagaaccaatgttggtggatttcacattactgattttttgaggcagcttctctctctaaaatatccctatcacatggcaagtattacatggga

SEQ ID NO: 31107 - DNA, 615 bp, Sorghum bicolor
  Clone ID: 18064519
gcacgaggggccaatgttggttccttccctacggaaaaacatacaccaccaaccttctcttaaaggtgcaggtcaataataccaaaaactacagatcataaagtttttgcatttttattgtgaattctctttggttggatcactgttgtttcttccaaattaacatccaatgttagactgtgattgcaatagttccactgaagaagtgatgagaacatgagactaaagatgataggattggtatcctgatagtattggtttaggaggatgcatgtgtggactatacatgaagcaacagttatttccttgattacaatagcaaccttttgatactcttcatctcacatctagcccctggaattggttaaacaagttttactccccctcaaaatcaccaaggttattttgcttattcttgaatataaggattctttgatcagctttatgagccatcatacccttcactattgtatgtttctaatcacctgtggcattactaatttggaatcgattttccggtcaatagtctttctaacaacaagaactccatattactgatcctactctaactccaactgcgaaactcagctatctcgatcatgcatcagctgcagc

SEQ ID NO: 31108 - DNA, 526 bp, Sorghum bicolor
  Clone ID: 18064534
gcacgagggagcagtgtacgcaagggaaagcgctcgattaattggagggcagacaaaccttcgacactgtactgggtggagacacaagatggtggagatgcaaaagtagaagtctcccctcgtgacatagtttacatggaaaatgctgagcctataaatggcgaacacccagagattctgcataaacttgaccttcgctatgctggcacctcctggtgtgatgaatctcttgctttagtgtatgaatcttggtttaaaactcggaaaatcagaacttgggtgctttctcctgataaaaaggatgtcagcccacgcattttatttgaccgatcttcagaagatgtatactctgaccctggctcaccaatgtttcgaagaactgcaatgggaacatatgtcattgcaaagatcaagaaagaagacggaaatacttatgtcttgttgaatgggatgggtgccacaccagaaggaaatgttccattcctcgatttgtttgatataaatactgggagtaaagaacggatat

SEQ ID NO: 31109 - DNA, 475 bp, Sorghum bicolor
  Clone ID: 18064547
gcacgagggctgataggaagtatgcacatacattcaaatataaaggtgttgagataggtgtggttgtcagctatgctgtgctaattcatcctgatacagctgcaagtatttcggttggcaatctccaattagtcactgtttcacctaaatcatcaaagaaaggactagctccaaaaggcaaagaagttggacaaaaaaagggaattccagtaactaaagaaagggcccatgaagccattgtttatatcttactttcagactctgttgcaaaagggcatgttatgcttccctactctattcgtcacttcataagtgctgatgtacattcatgggtatatattaagacatattctgccaacatcaaggaggatgaacctctagtgacaatatctcctttacagttcaagatgcgtgtgaaagatgcccatggtagcagtaaattagtcagtcaagaagcagacacttcgaggataac

SEQ ID NO: 31110 - DNA, 419 bp, Sorghum bicolor
  Clone ID: 18064558
gcacgagggtatgcggaggagcatggttatggggccaagctgaaggtgcgcaattcgttgattgcgatgtactcgaggtgcgggtgtgtggataaggcatacagggtgttctgtgggactcctcagaagagtgtggtcacatggagcgcaatgatctcaggattggcagctaatggttttggggatgatgctatctcagcattcgaggagatgattagatcagatgttgctcctgatgaacagacttttactggtgttctttctgcatgtagtcatagtgggctggttgacgagggttttaggttttttgatatgatgcgatgtgagtatgggttgaagccaaacgttcgccactatggatgcattgttgacctaatgggacgtgctggcttgcttgatgaggcttatgagcttgtgac

SEQ ID NO: 31111 - DNA, 374 bp, Sorghum bicolor
  Clone ID: 18064565
gcacgagggattactgcatgcaagcgattgccaaatctggatttgtggagccaactcctattcaatctcaaggttggcctatggctttgaagggtagggacctgattggtatcgctcaaacaggctcagggaaaacattatcttatctgctacctgggttggttcatgttggtgcccagcctcggctacaacaaggcgatggcccaattgtattaatcctcgcccccacaagagaactggctgttcaaatacaggaagaatctacaaaatttggatcatattcaagaactagaaacacatgtgtctatggtggtgcacctaacggtccacaaatacgtgaccttacaagaggagttgaaattgtcattgcaact

SEQ ID NO: 31112 - DNA, 525 bp, Sorghum bicolor
  Clone ID: 18064570
gcacgaggattggataatgtttgcacattatatgctgaggattgtatgaagaaaaggttatgtgccttatgcttatgcgacatcggagataggctcgcatctagatgtgtgacttgtcaagactggtaccatgattcttgcatggaaaacctgcctgctattacacaaatgacagttgaatggatgtgttcattttgttcacttttgcagagtgaggaccaattagagaaccaaatacctgtaaagatgttcaaaggaaactgtcctgcacttaccgcacttgatgaactcatctcttctgcaaagggtttatacactgggattgaggaaatgaatttactaaaagaaattgtcgagaaggctcgtatcttgaatgcctacttgatgcaaattctggatgattcagactcttatcatggagaagatcttactgtcatattcaaatctcttttagttgctctcaaggcaacatcagcttctggcttgtatgatcactatatcagttgcagaattgagtctgtgttg

SEQ ID NO: 31113 - DNA, 525 bp, Sorghum bicolor
  Clone ID: 18064573
gcacgaggctggagcttatatatttagaccagatggtaatacaccaactattgtttcatcatcggtgactctcaaagttatccgtggacctctatttgatgaagtgcatcaacaattcagctcttggatttatcagattacacgactctacaagaacaaggagcatgctgaagttgaatacacgattggtccaatccctgttgatgatgacgtaggaaaggaggttatcacacagttgactgcaaatatgagtacaaacagtacattttatacagattccaatggaagggatttcctcaaaagggtgagaaactacaggaaggattggaatcttcaagtgactcaaccagttgcaggaaattactacccggtcaatctcggagtgtatatagcagataacaaatatgagttatctgtacttgtggaccgtgctatcggagcatcaagcattcaggatggtcagctagagattatgctacacaggcgtttacttaatgatgatggcagaggtgttgcagagccact

SEQ ID NO: 31114 - DNA, 449 bp, Sorghum bicolor
  Clone ID: 18064585
gcacgaggcttggatcagtcttctgcagtgcatgatatgttcttcccagaactgaataccgctgtagatccaatcaatggaggaaatgacagcatgtacttctactaccccggcagaatttggttggacacagatggaaaaccaattcaagctcatggaggaggtgtcctgtatgataagaggaccaacacctatttctggtacggggagaataaggatggcaaaacctacaaagctcacagcaagggagcagacagggttgacatcattggagtaagctgctattcttcgaaggacctgtggacatggaaaaatgaacggcttgtcctccgtggtgaggagaagaatgtaacacatgatcttcacaaatccaatgtcctgtagaggcccaaggtgatatacaatgatcggactggcaaatatgtgatgtggatgcacatagatgatgc

SEQ ID NO: 31115 - DNA, 543 bp, Sorghum bicolor
  Clone ID: 18064598
gcacgagggccctagagaccttcatgcaaatcggttggatggcactatccctcctgagcttggcaagttgggaagcctccttgagctacgtttgagtaataacagccttacaggcattattcctgcaagtaatgattcagacatgggatctgtcaacagcaatgatcaaattggattgtgtcagctatctccgctaaccaatattgatctctcgtataactttttggttggagatattccttcatgcttacagcaaatccaaaggtacaccttcgccttttgtgacttaaaagtttcagttgtcttcctgcacttacctgttttacagtatttgaacagatcaagcttggtggggaattgcttccagaacaacacatcaaaccgtccactacagcaatgtgatactaatcaggacagaggtgaagacaatggtgctgatgagaatgcgcagaaaggcctgccagagccactttggctattcattctggaagtcatcgcggcactttcattgctttgtttgttaacactttgtaccatgactgg

SEQ ID NO: 31116 - DNA, 601 bp, Sorghum bicolor
  Clone ID: 18064600
gcacgaggccgtcgtcgccgtcgaggcgttcagggcgtacaaggagaaggtcgccaacctcaccggagtgacgcggaaattcatggggaaccttgtgaaagcgttcaagaccaacctgccggaagtggtggtgacgccggcggcattcgatttcgatcacatagtgaatggaccaaccatgggcagccaaacagctggtgttggaggcattatttctactgcaactgttacactggaacaaccagccatggaaccgatggtctccggatctgctggtttctggcactcagcactgcagcagccttcatcgtcatctcttatttcacaagaagcaaatatcgcaaatgatagtgtgcaagaacacagacctataagaagccctgttcagcatccagttcgtcctggtaggcatggcggcctcctcagcaatccgtcacagtttcaaccgattcactcaacttttttcggagaagctacgacctcgatgggaccgccgaacataggggcaataacaccattacaattcaacatgtcaaacatgatatcaagtggcgcgacatcgacgccccttgtcaccttctcgatgtctgcacctggacaa

SEQ ID NO: 31117 - DNA, 541 bp, Sorghum bicolor
  unsure (1)..(541): unsure at all n locations
  Clone ID: 18064637
gcacgaggcaattcggcacttatctgtttccagtgatagtgatacggtggcacagctcaagagccgatgtgacctgaagagattgcgcacactactgattctcaagaacccttcctcttcgttggatcaactgccaggagattttttcacagagctgaaaggccttcgagttcttagtctggaaggctgcaatatcattcgtctatcggagaggattggaaaccttaaatacctcagatacctggcactttgcaaatcaatcaccaaacttccacaagcactgacaaagctctatcgtcttcaaaccttcagtagtcctaaggggtctggccttgaggtcccagaacatattgtaaacctgacacgtctgcgacatttggacatggatacatcaaaaatcactggcattgggaaactggttcacctgcagggatcagttaagttccatgttaaaaatgaagaaggccatactttaggagacttggatggtatgagcagtctgcgtanagagcttcatataaagaaccttgatgttgtaaca

SEQ ID NO: 31118 - DNA, 421 bp, Sorghum bicolor
  Clone ID: 18064639
gcacgaggacggaatgcaatgcgagcattgcagaacaaacctctgaggagaagaaagctggacattcatttttccatcccaaaggagaatccatctgacaaagatttaaaccagggaactcttgttatttttaacttggatccatcagtttctaatgaagaggttcgccagatttttggggcatatggggaagtaaaggagataagagagacaccaaacaagaaacatcataagtttatagagttctatgatgtaagagcagcagaggctgcacttcggtcactgaataaaagtgagatagctggaaagcggatcaagttggaaccaagtcgtcctggtggaacacgcagaaacttcatgcagcagcttggtcatgatttggaccaagaggagcccagaagctacagacattctcatgttg

SEQ ID NO: 31119 - DNA, 375 bp, Sorghum bicolor
  Clone ID: 18064658
gcacgaggcgcaggtcctatggctcgctcctcgaccttaagcaactggtttcggagaaagatcttatagtgagagaggaggcttgccgggtagggttgctttttggtggattcaccggatcatatcatgcacttcgatgtttccttaggagatttaggaaaaaggagacaccatacaatgcaatattagcaggttcggtggcaggattggccatactagcactggatgattcaagtaagaggcggactctatctctgtatcttctagcgaggcttgctcagtgtgcatataattctgcgaaatctaagaacaaatttcatttttggggaagccattggagacatggagatgcattgcttttttcattggcatgtg

SEQ ID NO: 31120 - DNA, 260 bp, Sorghum bicolor
  Clone ID: 18064669
gcacgagggtggatcttcgtgctcaacaccaacaggtcgctctacgtcggacaaaagcgcaagggcaagttccagcactccagcttcctgtccggcgccgtcacctccgccgccggtaggctcgtcatccaggagggcgtcctcaaggccatatggccctacagcggccactacctccccaccgaggagaacttcagggagttcatcactttccttgaggaaaacaacgtcgacctcgcaaatgtcaagcggtgctccgt

SEQ ID NO: 31121 - DNA, 601 bp, Sorghum bicolor
  Clone ID: 18064672
gcacgaggccgccgctctcggaagcccagagtgctcgggaacggccatggcgatgcggtccgctgcgcggcaagccatactctctcccccgcttgggcaacgcggtcctggccccttcctctgtggtcgctccttgcctgtcgctcctcgcgtggagccgtgccgagcgtcgagctccgccaccgcgccggccgccggaaagcacctccctccattgttcagcgttgcgccgatgatggactggacggacaaccactatcggacgctcgcgcggctcatctcgcggcatgcctggctctacacggagatggtcgtcgccgagaccatcgttcatcagaaggataacctggataggtttctagcatttcctgaggaacaacatcctatcgtgctgcaaattggtggaagtaatcttgaaaatttagcaaaagcaacagaactggcaaatgattattcatatgatgagatcaacctaaactgtggctgccccagcggcaaagttgctggtcatggttgctttggtgctcgcttaatgtttgaaccagaggggatgccatgtcaactattgcagctaattgtgatgtcccagttagtgttaaat

SEQ ID NO: 31122 - DNA, 505 bp, Sorghum bicolor
  Clone ID: 18064677
gcacgaggagaaaccacaccggatatacgtacctcgggatgaggcatttgaggagctgaagcaaggtgccttctcatcagggaggctgcgggcagtacttcacacccttatcccatcgatgattgcaaccatctcagctgaaacccacagcttccaaggtttccaccacgttgataatctctacaaggagggcctcaggctgaagttgggtctccaggagcacctgttccagaaaataccccttgttcagaagattcaggaatcaagtgaggggatgcttcgctatgatacacctagaattctttccaaggacaagtttgcatggctccgtgatgatgagtttgctcggcagaccgttgcaggaataaacccagttagcatcaccaggctcacggttttcccaccagtgagcaagttggatcctgcaatctatggctcaccagaatcatcgatcacagaagcgcacatcgctggtcagctcaatggactcacagtacaacaggca

SEQ ID NO: 31123 - DNA, 135 bp, Sorghum bicolor
  unsure (1)..(135): unsure at all n locations
  Clone ID: 18064683
gcacgaggctcctctagaactagaagcaatcaagcaatgacaagaatataactactagagagactgatggcggacccggtagaatggagtcgggagaacatcacattcttgcacgaaaacgaggtgaacgcgnga

SEQ ID NO: 31124 - DNA, 524 bp, Sorghum bicolor
  Clone ID: 18064684
gcacgaggcaatcatgatggcacagccatgataatctcatgggtgacaacaagtgagcctggctcgagtactgtgatctacgggacttcagaggacaacctcaactatactgcaaatgggaagcacactcagtatactttctacaactacacctcaggatacattcatcattgcacaatcaaaaagttggagtttgacacaaagtattactatgctgttgggattggacaaacggtgaggaagttttggtttatgaccccttcagaaagtggcccagatgttccatatacatttggtctcataggtgcttcccaatatgatgaggctagctatgactttattgctcatcgctgaaatctaggatcgattatattactgaaattaacaattctgttcaggtgatcttggtcagagcttcgattccaatgttacgctcactcattatgagtccaatgcgaaagcacaggcagtgctttttgttggggatttgtcatatgcagataactacccataccatgataatg

SEQ ID NO: 31125 - DNA, 548 bp, Sorghum bicolor
  Clone ID: 18064691
gcacgaggcttctctactactactcctggggccaagtctagccgagggatcaattggtgcaaggcgaaggtgacttccaatctcactgcaaccccgtccacgctgccgtacgcaggcagaagcattgaactctaagagatcttcccatcgtcgcacatcagctagcgtgatcatggcaactgccatagtcagcgcagcgttttcgctggtgggcaaggcgctgtctcctctaaccgatggcttgctcaaggactgggcagccagcgtggagctcggtgacaacgtggaggccctcgagcaagagctgctggctgtgcaggcgctgcttgagcacaccatcggcaaggaaatagtggacaactcagcactcaaaaagatgctgcttagacttcaggacctcgggtatgacgccgatgatgtgttggacgagctggactacttccgcatccaggacgagctggatggtacctttgatgctgccgacaagcatgccaagggtgtcacacataacctggccttcaatgtgcgtcacactgcaaaagctgttg

SEQ ID NO: 31126 - DNA, 444 bp, Sorghum bicolor
  unsure (1)..(444): unsure at all n locations
  Clone ID: 18064695
gcacgaggatcttatgattctcaacactcttgctggacgatcttacaacgatttaactcaatatcctatatttccttggatattggctgactactcttcagaaaagcttgatttcaacaaatcatctacattcagggacctgtcaaaaccagtaggtgccttggatgcaaagcgctttaaggcttttgaagatagatatcttaattttgttgatccggatataccaagtttttactatggatcccactactctagcatgggaattgttctttattaccttctaaggcttgaaccttttactgctctgcaccgcaatcttcagggtggtaagtttgaccatgcagatcgtttatttcagagcattgaaagcacatacaggaactgcctatcanatacaagtgacgtcaaagagcttatacccgaattcttttacatgcctgagtt

SEQ ID NO: 31127 - DNA, 545 bp, Sorghum bicolor
  Clone ID: 18064705
gcacgaggagagtttgcttggagtcggagagctcatgatcgaccaccgctcgtcgggactatgttccggatgctcaagaatttcgacaggctcttcgatgagcaggtggagtacgcgcttgcccatcgaaccagcaggctgctctttcctaatcctgggcacagtgagctctggacctctgatccacaagtaattgagcatatcctcaagaccagcttcagtaaatacagtaagggcgacttcaacactcaaatcatgaacgatctctttggaaatggaattttcgcaaccgatggggagaagtggcggcaccagaggaagttagcgagccatgagctctcaaccagagtgcttcgtgacttcagcagtggtgtgttcagaacaaatgcggcaaaactaacagaggtggtctcatctgcagcaaccaatagaacttccatagacatgcaggatcttttgatgaaaacaactatggattcaatcttcaaagtgggattcggttttgagctgaacacactatctggttcagatgaacctagcatccc

SEQ ID NO: 31128 - DNA, 586 bp, Sorghum bicolor
  unsure (1)..(586): unsure at all n locations
  Clone ID: 18064714
gcacgaggctaagaaagaaaatggctttagcgcgcagaaatagtgctgtcaaccgcaaacaggagaaccttgtcaaatcacttaggctgaagaaatgtatatcgagcattaaagctgtgaaaacacaccctattgaagaacttcagggaaagattcagctgaagggaaacatgaatttatctccagacattgttttagctttgggtgtctctgggactggccggactattttgtctccagatagaccggtgtcaatagggacaaaaaggggttcaagtacaaaggttcttgcctgtaagaaattggctaaaaggagaggatccaaagaactgtgcagtccaaataactcattggatgtgactaggactgtccagcagagaggaagcaaggaagtggcagagccaatggaagaatgtcccttagcatttgagtgtctgaattctggtacgcaagagaagcttgatagaactttggaggatgcacagaacataactgaattatcgaatcaggacctgttcccgttggtgcctcctggctttaaatcaatggataatggganaggtactaatatacatgatactcaatt

SEQ ID NO: 31129 - DNA, 493 bp, Sorghum bicolor
  Clone ID: 18064720
gcacgagggttactttgagtcttgcatttgcaatgaaacagctaatgaatgataaagcacttgtaaggcatctttcagcatgcgaaacaatgggatctgctggtaccatctgcacagataaaacgggtactctgactacaaaccatatggtggttgagaagatatggatatctgaggtctcaaagtcggttaccagtaacaatagtttggaagatctgacctctgccatttctccagctacattgagcctacttttgcagggcatttttgagaacaccagtgcagagttagtcactgagaaggatggtaagcaaactgttttaggaactccaacagaaagggcaatatttgaatttggcttgaaattggaaggtcttgatgctgaggataggacctgtaccaaggttaaggttgagcctttcaattcggttaagaagaagatggcagtgttggtctcattacagaatggcatgtaccgttggttcaccaaggg

SEQ ID NO: 31130 - DNA, 520 bp, Sorghum bicolor
  Clone ID: 18064755
gcacgaggctgtctttggagcactttgtttcttcttataacaaggcttctagaagagcaatatttcttgattacgacggcacacttgtggctcagtcatcaatcaacaaagctccaagtgaagaagtcatatccattcttaacaccttatgcaatgatccaaagaatgttgtatttatagtaagtggacgaggacgtgattcccttgatgagtggttttctccatgtgagaagcttggtgtagctgcagaacatggctattttatcagatggagcaaggaagctgcatgggagtcaagctattcaagtccgcagcaagaatggaagcacattgctgaacctatcatgcaggtatacacagagacaacagatggatcttcaatcgagtcaaaggaaagcgctctagtatggcactatttggatgcagaccatgattttggttccttccaagccaaggagctacaagatcatcttgagagggtgctatcaaatgagcctgttgttgtaaagtgtggtcatta

SEQ ID NO: 31131 - DNA, 417 bp, Sorghum bicolor
  Clone ID: 18064763
gcacgaggcggatcgctccagagcctaagaaatatgttgatggctctacagaaggagaactctagcctaaagatagagaaagtcaagcttgaggcagatctcaagagtatgaagagtacctcacaaaaaactgttgacagtgcattagatactaataacaagatttctgactcggaaaaggttaaggaagagatggattctttgaaaagagcattacaggatgcttcccgtgagagagacaaagcagtgcaggatttggctcggctgaagcagcatttgttagataaggatcttgaagaccaagaaaagatggatgaagatagtaaactcattgaagaattgcgggtagtctgtgagcagcaaagggctcatataatgcagttagagagggctttaaaggttgagatggcaaagcag

SEQ ID NO: 31132 - DNA, 480 bp, Sorghum bicolor
  Clone ID: 18064764
gcacgagggataaatcaaggatcaatggaaattcgctcctcacaaatcaaaggggttactctcttgaaggttttgtccaaatacaacagacaaacttgcttgaattttgtgaaccatggagtttttcagcaggcattgtggcactggtacagaaaagctggtactattgaggactgggtaagatctggaaaggaaaaatgcaagcttagttcagcaatgatggttgagcagctgcggttttggcgaacctgcatctcttatgggttttgtatagctcactttgctgatttctttcctgttttgtgtctgtggctcagtcctcctgaatttaagaaactaaatgaacacaatgttcttgttgagtttagttctattgctagagagtcatatcttgtcttagcagctctggcacaaaggttaccactccttcattcagtggagcagcttgccaatcaagatcggggagtttctgccagttat

SEQ ID NO: 31133 - DNA, 542 bp, Sorghum bicolor
  unsure (1)..(542): unsure at all n locations
  Clone ID: 18064766
gcacgaggggacggctgctggaggcggacgaggagccccgcagaggcagctcggccgccggaagatgggaagcactggtgggaactgcaaaaggtggtgggatcaccaagatagggactgcaaaaacaatgagaaaatgagattccatgttgtagctgatgaagattccaggagttttatgcgcatacctcaggagtttggaagctatttaagaaaaatcatttctgacaccatcaagctaaatgctcccaatggttgcacctatgatattgcggtttgtagggagatgggtgagatagttcttcggtctggctgggatgtgtttgccgatgctcataacttggaacaaaatgactatcttgtgttcaagttttgtgggagctcgagctttaaggtccatatatacagttcatgtggtggttcccagaagatcacttcctgtgttaatccagatcctgagatcctagaagatgttcctccctgtactacttctgatcatcacgttccanatggaaatgagatacctcatcctggacatgttc

SEQ ID NO: 31134 - DNA, 563 bp, Sorghum bicolor
  Clone ID: 18064780
gcacgaggcatcaattagtcatttggcggtgggatgtgcatatatctatggatatcattgggcattggttagatctgcttaattcagatggatggattcccagggagcaaatcttaggagctgaagctttaagtaaagttcctgaggagtttgttctgcagtacccttcaaatggaaatcctccaactttatttcttgcgatacgtgatttggcaagtggtatacatgcacagcagttttcagatgaggaagctgaaaaggtttccagtttccttgaaagggcttatatacggctaaattcttggtttcagtggttcaacagtacacaatcaggtaaatatgaaggcaccttctattggcatggaagagacagcataacaagaagggagttgaacccaaagactttgacatctggattggatgactatccccgtgcatctcaccctaatgatgaagaacgccatgttgaccttcgttgttggatgcttctggctacaaactgcatccgttccattgcagagtttcttaaaatggatagttctcttgaaaaggattactataag

SEQ ID NO: 31135 - DNA, 487 bp, Sorghum bicolor
  Clone ID: 18064806
gcacgaggcagatattactcccgacagagaggccccagaactgatacgtggcttagtacttcacgctcttggtgaagtatcaagcagggtgaaagagatgaatctagttgacatgctaacaagggatatggctgatttgattggtaatcatttagatatttttcggaaaaaccaaactctaattggtgttgatgtcatgaggactttgtcttcagaggaaagagatgagagactgaagcagcacctaatagtttcacaggaacttcatccagcactgttatcttcagagcatgagtacaaggttcttcaagaaatcgttgggggcattatggctctagttttgagaccacaagatgcacaaagtccactagttcgctgtttctccagggaactgatgacctgcctagtcttgcagcctgttatgaacttcgcaagccctgtctacatcaacgagttgattgtctaccttctaaacaacaaagataca

SEQ ID NO: 31136 - DNA, 574 bp, Sorghum bicolor
  Clone ID: 18064810
gcacgaggggatttgatacggggaatgtcatgtgaggcggacaccgtgatatggggagcactactgacggcctgcaagaaccacagtggcattgagattgcggagcgggcagcggtggagatgctgaaactagatcccagtaaccatggagtgtatgtggtactgtccaacttgtatgccgaggctggtaggtggcaggacgtggacaagctgaggaaggagatgaagggagcgcggctctctaagatccctggggcaagcacagttaatggtgatgggtcactggagcaaccagagtcaccaccaccgcaagggaatgtgcttgtctagttgcccggttggggctttgtcctcattaagtgaagttctgctgcaactttgtgacaatccccagaaaagatgatgcagctaggagaataaatgaataatggatggatcaaatgcatctaagggatcaatattagacagctgacaagtgtatagacaaatacggagcactgcaacacttctgagaatatgcatatcatcatcattagcaccgaattacggcaatattaattcggtatggtaaata

SEQ ID NO: 31137 - DNA, 433 bp, Sorghum bicolor
  Clone ID: 18064827
gcacgaggccatccctcgctgagcatcgcgccaaaaaagagaaacgtcgccggctgctctttacgcgttaataggccatgttgttgggctgacagccgtgcgaaggaggtagagcgcctgaactcagttgctctgttggatggcacgaacggcagggatggagcgactgcagcgagcagccgtgaagagcaattgcagaggatctcattctgacccctcaccacggtcgtctcccgcttgctgtgggggcacgcgctactagcatagctcatcgacggctggaccgcggcatagcagagctcctaatgtggcagccaggcagccaggcaatgcccgacaaccctgtccggctctacggcgactggaagccccgggactccaggaggtgtacgcgctaccgcggcatagcagagctcctaaacggagcagcagg

SEQ ID NO: 31138 - DNA, 514 bp, Sorghum bicolor
  Clone ID: 18064829
gcacgaggaattggcccatggaatggatgaacaatggtcctatcattcttctcactcagcctcagtttcaagtgggcaatattctgtgaaaaagagcactgtgaaggaagttcaagatcgccaacattgtcagccacaaggtgttgcttacttcactgatttgtcggagaaagaaattgagagaagacggaagattggtgctgcgaacaaggggaaggttccctggacaaaaggcaggaaatggagtgaagagcacaagaagctcatcaagcaacggactgctgaagctctgagagaccccaaggtgatgtcatgttaggaagaaaatgttaggccatcgtcagctacataggcagacaagcaaagacaaaataagtgccgcactgaggacgatctgggagaggcggatagtttctgtccaatcaagacagaaggttctgcagatatggtcaaatagtatagctgaagcagcaaagaatggtgatcacagccaaaatatgcttcactgggacag

SEQ ID NO: 31139 - DNA, 413 bp, Sorghum bicolor
  Clone ID: 18064849
gcacgaggggtcagttggcctcagagattgcaaagcgctcgagaagatggtcaagacgcacgccgagaatgggggcctgtacggcgccatctgcgctgcgcccgcggtgacgctggcctattggggcatgctcaaaggcttaaaggcgacctgttatccgtcgttcatggagaagttcactgcagaggtgatccctgtggactcgagggtcgttgtcgacagaaatgcagtcaccagccagggtccaggaactgcgatcgagtttggtcttgctttggtggagaagctgtatggcaaagagaagatggaggaggttgctgggcctctgtacgtgcgccctcaacatggagctgaatataccgtagaagagcttaattcggctgaatggaaatgtagtagcacacctcaggttc

SEQ ID NO: 31140 - DNA, 492 bp, Sorghum bicolor
  Clone ID: 18064862
gcacgaggggggccttctcgagctccgacacaccctcgagaagctcgtctgtttcaattctacggatgctcttaggcatgtcttcgcgagtagaatcatggatatcaaggactctcctgtatggagcaaactttcatatgtctcatgtgcatctaatggtgtagtactcatggatgagtcattgcaattgttacctgcaattgaaaccttggatcttagtcgcaacaagtttgcaaaggtggacaatctgcagaaatgtacaaagttgcgaaatctggatcttggatttaatcatttgcgttcgatttcatccttgagtgaggtttccagtcgaatcgtaaaacttgttgtgagaaataacgctttaactacagtaaatgggattgaaaatctcaagtcacttatggggcttgatctctcctacaatatcatctcagatttctcagaattggaaatgcttggtactctatctctgttgcaaaacctctggtt

SEQ ID NO: 31141 - DNA, 552 bp, Sorghum bicolor
  Clone ID: 18064875
gcacgagggcgacgcgggcgtggtgacccgcctccgccgcgccggcgccgtcatcctcggcaaggccaacccctccgagtggtccaacttccgccccgtcaattccggctggagcgcccgcggcggccagacgctgaatccatatgttctctcggcaagcccgtgcgggtcgagcgctgggcctggcgttgccgcggcagccaacatggcagcagtgacactgggatcggagacggacggctccatcctctgtccatcgtcgcgcaactctgtggttgggatcaaaccaactgtcgggttaactagccgatctggtgtcatccccatcatgcctcttcaagacacgattggaccaatgtgtcggacagtatccgatgccgtccatctgttggacgccattgtcgggtatgatgagtttgatgcagaagccaccggagcagcgtccaagtacatcccacaagggggttacacgcagttcctgaggatccatggattgaggggcaagagaatcggtgtccctgatgtgttttttcatggatatgatggcgtgca

SEQ ID NO: 31142 - DNA, 466 bp, Sorghum bicolor
  Clone ID: 18064883
gcacgaggtttaaatttaaaattagacatccaatcaatcccctcttggatgctcacgaaaaattacatatgtctgcgcctaggatttgatttaggatgccactaaatattgaagctgacctaggagaaatgtcagaagattttattttttaacttcataaatcttgaatttgactacaggttagataagagaactctagatatgcttttagggggtatttggttggaggtgttaaagtttaacaggtattgtagcatttttgtcttatctggtgatttgtatttaatcatggactaattaggcttaaaagatttgtcacgcaaattactctctatatatgtttttagttttgtaaatagtctatatttagtactctatgcatatgtcgaaacatttgatatgacaggggttaaattttactagggtgaaccaaacaaggctttaggaccagcgtagtttaaattat

SEQ ID NO: 31143 - DNA, 610 bp, Sorghum bicolor
  Clone ID: 18064888
gcacgaggcaatgcggtaacacctctgtattcacttgatgctgaattctccaagcccatgtggatttttggtgtcagctcctatgatttccttggaatagatgatacaagtcacaaaatcgtttgctgttacaggcagaatggaaagtcatatgtcggggtgcttgaccacaattccgagtccttttcgaaaatcgatattcccttctcttctgtaactaacatagtggtgtctggagatggatccttctatattgagggtgcatctgctactcttccagtatcaatagcaaaggtgacacttgataaaaagagaactatggcaactgatttctctattgtttggtcctcctcagaggatgtttcacaatatgaatcatacttcagcttgcctgaatttgtggagtttccaactgtggtcaatggtcagcatgcatatgcttatttttatgctccatataataatgttttccaaggtttatcagacgaaaagcctcccctacttgtcagaactcatggtggacccacagatgaagcacgagggattctggatcttagtgtgcagtactggacaagccgaggatgggcatttgttgatgttaactatgggg

SEQ ID NO: 31144 - DNA, 471 bp, Sorghum bicolor
  Clone ID: 18064894
gcacgagggagaactttcagccttccaaagtcagggggatacctgatatcagtatcaatgtcgcgcccactaatgcaactgaggaaggatcagcggctactttggaacttgacttggaacactatgttgttccgtccccgccgactgcaccaccaaatggatatgctgcaaaccttgctgcgactccagcatccatgattcaaactggggcatcgtggacaaatgatatccttctaagtgatgggattcaaagtccaagtagtgtttctgcaaaattagaagatcgtagtaacaacaagaagaatattgaggcctgggcaacagattcttctaagaattctggactcattgaatcaaaatcagttggcacctttacaccactgcaaaagctagatggtcaaaaggggctgttcgttgacaggggtgttggctctcctatgcttccaaaatcagccagtgcatgctccctgg

SEQ ID NO: 31145 - DNA, 446 bp, Sorghum bicolor
  Clone ID: 18064904
gcacgaggcaaggctgagctgattcctgatttggatattttctttgagagactgtatgaatatttctgtgcaaagggtttaagatgcattatcatcaagtggataatcgagatccttaatgttacatttatggtatgtgctattggtttcttcttcttgtttgttgactgggatgcccttggccatttgaaatgtggagtggaagcacttgagataggggataaaccatgtgacctaatgagtgtcatcaagaacgacccattagttccgttcacatatgtgaagcttatcactattggatcaatggttatattgacgacatatggaattattaatttaatcaagttctttgtaaaattgagaagcatactcaatgatcgtgacttctactataacagtcttaaggtcacagatctggagattcagactatatcatggcccaaagt

SEQ ID NO: 31146 - DNA, 526 bp, Sorghum bicolor
  Clone ID: 18064911
gcacgaggacatatttctgtatgtttttattatctggacctttaatttgttaacgtccgttgtacctgtacatttgttccaagctttcaggttgctgggcctccagctattgcaagaggagccctcacagagattgcttcgaggcttagaaataggactttgggagttacaagtactgccaataatcctccaccttttgcccctttcgatgatcctcctgttgatatgcctagcagaaaatcgacactatatggagggcctgccaatgatccaccgtatggaaggcctgccattgatccactgtatggaaggcctgccattgatccactgtatggaaggcctgccattgatccaccatttggaagtcataccaacgatcgaccatatggaaggcctgccgttgttccaccatttggaagacctaccaatgatccaccatatggaagacctgccaacgatccaccatatggaaggcctgccaacgatccaccatatggaagacctgctaatgatccatatggaaggc

SEQ ID NO: 31147 - DNA, 508 bp, Sorghum bicolor
  unsure (1)..(508): unsure at all n locations
  Clone ID: 18064933
gcacgagggatgatacagatgtcagctgctggaattggtataatggaagcattagcattgttcctaggatcaggattatttcttaaactaatgggcgtgtcacctgtctctccaatgcatagacctgcaaaactttttctttcattgagagctctcggagcacctgcaaatgtgcttatgttggcagtccaaggtatctttcggggattcaaggatacaaagactccggtgttttatataggtttgggcaatctttccgctgtagcccttcttcctctacttatatatggctttcagcttggcataactggtgctgcaatttctacagttgtgtcccagtacattattacagttcttcttcttcggtctctaagtaaaaaagctgttttgcttcctccgggaatagatcagttagagtttggtggatatctaaaatctggtggcatgctgttgngaagaactctttcaattctgttaactatgaccattggtacatcaatggctgctc

SEQ ID NO: 31148 - DNA, 539 bp, Sorghum bicolor
  unsure (1)..(539): unsure at all n locations
  Clone ID: 18064936
gcacgaggcttcatctttgttttctgattggttcctctatcaagcaaacaaattcagagtacactctgcttctgtttctgaaaagcaaaacacagaggatactttcagaaagcatgaagctattggcattcggtttagtcttattgagcttcttacaatcttttgctacctctgactaccaagttgcagcattgtatgaaataaggacgcagctcagtgataagggtggtgtcttaaaagactggaaggataaccaaatgaccccatgcggttgggctaagattaattgtcaagacaacaaagttatcgcaataactttgagctcagtaggattagctggaatcttatctccaagcattgcaaagataacaactttacaacagctgttattagatgggaatgaaataagtggtggaattcctgaggagctggggaacctatcaagtttgacaactttaaatctaggaagaaatcaatttaatggctccatacctgactctcttggtcgactcctaanacttcaaaacctagatctaagc

SEQ ID NO: 31149 - DNA, 540 bp, Sorghum bicolor
  Clone ID: 18064941
gcacgaggagaatacgcctgctattacctcaattcctgcaaacttatctaccaccttgaaggatgatgaaagcatgagttttcctccacgacgaccatctcctgctattactgaaattggaattggcaggggcatagctcgaggaataactagtagtcagggattaggtacagctcccataactattggtccagtcccaggaaatggatcggttagtgcacttcctgcaataaatgacttgtccaaaagaaatatattgaacactgacgagaagattaatagtggtggtctttctcagcagttggttacgcctcttggtagtaaagttcaaccccagcaggttcccaggactaatgatgcaattagctctgattctgctaatccaaatgaaaatcctattcttggtggaagagtattttctcctccagttgtttctggggttcaatggagacctcaagctgctgctacatttcaaaatcaaagtgaaactagtcaatttcgtggaaggcctgagatttctgctgatcacagggagaagta

SEQ ID NO: 31150 - DNA, 474 bp, Sorghum bicolor
  Clone ID: 18064952
cggtcgtctgagcgacatggccaccgcgcacgttttcctctgcctcgccgccgtcgtgcttgctgctgcggcggcagcagcctccccagctcatcatcagcattcgcaatgcctggacaacccgccggacctgtctctgcgtggcggcgagtctggcgtggtcgtcggagacctaccagggggcttcaaagcctacgtcacaggcccgtccgagtccagccgcgccgtcgttctcgcctccgacgtcttcgggttcgaggcgcctatactcagaacgatcgccgataaagttgctgaggctggatactttgtcgtggtgccagatttcttcaatggagatccttacgacacaagtaaaaacattacagtgtggatcaagtttcactccccggtaaaagctgccaaagacaccaagccactctttgctgctttgaagaaggaaggaaagagcattgctgttggcggttattgctg

SEQ ID NO: 31151 - DNA, 624 bp, Sorghum bicolor
  Clone ID: 18064958
gcacgagggctcgtcgccgcgcctcgatcggcaagcgtgttgtggaggcgctggaggaggtgaaagaactgaccgagcaagggaggaagttcaggacatttgggctcaagccaccgccgagggccgtcagtcggttatcccaaaccgagaccgttgggttggagcccatgttggctcggctccatgatttgcttgagaagggcgagtcaaacataattggtgtgtggggtcaaggaggcatcggcaagacgactctcctacacgccttcaacaatgatcttgaaaagaaagatcacaactatcaggttgttatctttattgaagtatccaattcagagaccctgaacacagtggagatgcagcagactatctctgataggcttaatttgccatggaatgaattagagacagttgagaaacgggccagattcctggctaaggcactggccaggaaaagatttctattgctacttgatgacgtaaggaagagattccgactggaggatgtcggtatcccaactccagacacaaagagccaaagcaagctgatcctgacatcacgtttccaagaagtatgcttccagatgggtgcacagaggagtcgcattgaaatgaaagttttgg

SEQ ID NO: 31152 - DNA, 607 bp, Sorghum bicolor
  unsure (1)..(607): unsure at all n locations
  Clone ID: 18064986
gcacgagggtcgtcgtggcggcgctcctcttgccgcctgccgtcttcgcggcgcccgaggagcacctcgtcaccggcctcccgggcttccatggtgccttcccctccaagcactactccgggtacgtgaccgtggacgagcgtagcgagcgcagcctattctactacctggtgctgtccgagcgcgacccggccaccgaccccgtcgtgatctggctcaacggaggcccgggatgctccagcttcgacggcttcgtctacgggaacggtccctttaatttcgagcctgggagctcgcctggaagcctgcccaagctgcagctcaacccctacagctggtcaaaggtctcgaacatcatgtatctcgactctcctgccggtgttgggatgtcctactcattgaataaatcagattatataacaggtgacctgaaaaccgcagctgatgcgcacaaattcctgttgaagtggttcgagttataccccgagtttcagttgaacccattctacatctcaggggagtcgtatgcangggtttatatccccacaatcactgacgaagttgttaaaggcattgagagaggtgtgaagccaagaatcaatttcaa

SEQ ID NO: 31153 - DNA, 570 bp, Sorghum bicolor
  Clone ID: 18064992
gcacgagggttgttttcagacagatcctaacaacacctgctgttcgatccaagaattcaaaaatagctttcatgttcttgactccggggacgctgccatttgaaagattgtgggaaaaattctttgagggccatgagggaaggtataccatatatattcatgcctcaagggagaagccagagcatgtcagtcccatatttgttggtcgagagatacacagtgaaaaggtaacttggggtaaaatttctatggttgatgctgagaggaggttgctggcaaatgctctacaagacattgacaatcagcattttgttttgctatctgatagctgtgtacctttgcacaattttgattatgtatatgactacctgatgggggcaaatctcagttttattgactgcttttatgatcctggaccacatggaaattttagatattcacagaatatgttacctgaggtcacagagactgattttaggaagggttcacagtggttctcagtcaaacgccaacatgcattgatgattattgcagatagtctttactatactaagttcaagcttcattgca

SEQ ID NO: 31154 - DNA, 554 bp, Sorghum bicolor
  Clone ID: 18065034
gcacgagggggagcctgaaaggtgttcttgacagtttagaagcaaagattcaggatatgagggaattcgtcatgctacttggtagctgcccacgcctgcctcgtcagatgtactgtacatatctgttcatggataagtgcatgtttggtcgccacaccgagaaggagcatgtcatcaatttcttgctgtgcagtgatggtactcatgatgactgcccaaatcttggcatccttccgatcatcggtccgcaccgagtcgggaagaaaactcttgtgcaacatgcttgcaaggatgagagggtacgcggtttcttctccaagatattgttcttcaaaggggatgatcttgagaacgcagaattcgcggtgagtttagaggccgcctcagggaagaagtgcttgtttgttgttgagttcagctggaatgtggatgaggcggcatgggcaaacttcaaatccacttttcaggaggcgacgggtcatggaagtaaagttcttctgataggaagaactcaggaagttgctaagttggggacggcaatgcccatctggatg

SEQ ID NO: 31155 - DNA, 482 bp, Sorghum bicolor
  Clone ID: 18065047
gcacgaggaattcaagaggtgaccagctgttagttggtgcatcactacggatgtcgtacctttggaattccatgcgacatctcaaactggtgcacaacatgagggcaaagagtgacccatggtttgcagaatacttgctacgcatcgggggaggcttagaggaggctaatggtgatggtgaaatccgtcttcctgatgaaatatgcataccacatacccgggaagacagtgatcttgatacgttaattgactgcatattccctgccctcaatgccaatatgtcaaacaagagctacatcacctcacgagcaatattgtctccacggaacgactgggttgatatggttaacatgaagatgataagtcgtttccaagggaatgagatggtgtatcatagctttgatagtgcggtggatgatccacataactactgcccatctgagtttctcaacactttgacccccaacggtcttcctccacat

SEQ ID NO: 31156 - DNA, 492 bp, Sorghum bicolor
  Clone ID: 18065048
gcacgaggcggcggcgtctccggcctcgcctgatgaggaggtcgacgcggacagcctcgacgacgaggaggaggccgatgccggcgtggagagcaagatcctggcgatcaaggatttcctggaggacccggaccaggtcctcaaatatcccatttttacctcgtttggcagtgctacaatttgctgacagtgtggtctcctctgcttcgttgcaatctgtacctctgtcgtgtggtctcctcacagtcggaggacgagatggtgagcctgctgcagaacctagcagacatggacatcacctacaaggctctccaggacaccgacattggccgccatgtgaatggcctgcgtaagcacccatccagcgaggtccggcaactggtgaagctgctcgttaggaaatggaaggagattgtggatgactgggtgaggctgcacaactcaggtggtgacgttggtggctcgatcataagcgatggtgactcacctgat

SEQ ID NO: 31157 - DNA, 431 bp, Sorghum bicolor
  Clone ID: 18065078
gcacgagggtggctttgttgttgtatctatagcggatagttttgcacctcaggagattggtagtcgtatgggtgtctcaaaagcaaaagcaatttttacccaggatttcattgttagaggagggaagaaagttccactttacagtcgtgtcgtacaagggacttcgtctaaagctgttgtgattcctgcaattggagactctattggaattacgctaaggaatggtgatatgtcatggaaagattttctttctcgtgctgctggaaggtcatcttcttattctccagtttatcaatctgtggatgcactaactaatatactattttcttcaggaacaactggggagccaaaagcaataccgtggacacaactttctcccataagatgtgcatctgatacctgagcgcatttggatgttcgtccatgtgaca

SEQ ID NO: 31158 - DNA, 547 bp, Sorghum bicolor
  Clone ID: 18065083
gcacgagggaacaatggagaagtatcccatactggtcaagatgcagatactgcatgtgcagcataccttcatctcaatggattttgccttctgatgcttgcacatgatgaagcaaatattattttgagagaatccaaggttcatgatgctatccgatgctttttcagggctgcgtccgggtatgaagctccaaaggttttgcagaacttttcattggaaacagggtttcaagtttctggggaatctagatctatttctttgtggagacttaactactatgagtgggcaatgcaaatttttgagcaacactccatgagtgagggggcgtgccaatttgctcttgctgctcttgagctagttgatatcattgatgggttagataatggaattgaagctgagggccttccagagaccgcagcaatgattaaaggacggttatgggctaatgtattcaagtacagcttggatctgaaacactttcgagatgcatattgtgcgatcgtctcaacccggatgatgatagcaaatacatctgtttgaggcgttt

SEQ ID NO: 31159 - DNA, 429 bp, Sorghum bicolor
  Clone ID: 18065089
gcacgagggtgagcccgatccttttgccaaagctgaggctgaagaagttgactttgagggccaggagaatactggcatcaattttgatgcctatgaagacatccctgttgagaccaatggtcatgacgttcctgcaccagccaacacatttgcagagattgatttgggtgacgcattgaatgagaatatccggaggtgcaagtatgtgaaaccaacaccagtgcagcgttacgccatcccaatctccattgctgggcgggatctcatggcctgcgcacagactggatccggaaaaactgctgcattctgtttcccaatcatcagtggcatcttgaagtctccaaggccacaacagaggtcgcggagctcaaggactgcttttcctctggctctgatcttatcaccaactcgtgagctttcagtccaaat

SEQ ID NO: 31160 - DNA, 372 bp, Sorghum bicolor
  Clone ID: 18065100
gcacgagggtgaatgaaagcatggttactggagaatcacggccagtagcaaagagaaagggtgacactgtaattggagggacagtgaatgagaatggtgtgctccatgtccgggctacatttgtgggatcagagggtgcactggcacagattgtaaggctagttgagtcagcgcaaatggcaaaagctcctgtccagaagtttgctgatcacatatctagagtctttgttcccctggtgattcttttttcaatgcttacttggctcacatggtttgtcgcggggaggctccatagctaccctcactcatggataccacaatccatggatagctttcagctcgctcttcacgttgggatatcggttatggtga

SEQ ID NO: 31161 - DNA, 357 bp, Sorghum bicolor
  unsure (1)..(357): unsure at all n locations
  Clone ID: 18065108
gggccatggcggacgcggcggcgccggggctgctgccggtggcggcggacagggacagggagagggacaaggacaaggacgaccgccgccgctgggcagcccgctgcggcttcgccgtcctgggcatcatgagcaccctcctcgtctacggcgtcctccaggagaagatcatgagggttccgtatggagtggagaaggagttcttcagatactcgcttttccttgtcttctgtaaccgcatcaccacatccatggtgtctgcgatggtgttacttgcaagtaagaaatccttggaccctgtggctccgctacacaaatatggtattgtctccatatcanatatactgaccacaacct

SEQ ID NO: 31162 - DNA, 400 bp, Sorghum bicolor
  unsure (1)..(400): unsure at all n locations
  Clone ID: 18065110
gcacgaggaagtcatttgtctgtgatattatcacaagatgcattttcagccggtcctgcaagcaatactgaggaaatgcgagaactgcaagagctgcagaggacgttatacacattcttgcatgctatggcaacgcatgatctttctacagttctccttactcctagctctaggcagtatctggagaccataatgcagttgcttttatttacctcatgcaaacataaagatatactactacgcaaggcatgtgtacagatttttgtgaatcttgttaaagactggtgctcntactctgaagataagcttcctggcttccgagtatttatgattgagaaatttgctactaattgctgtttatacagtgtccttgataaatcatttgatttacgcgatgcaa

SEQ ID NO: 31163 - DNA, 304 bp, Sorghum bicolor
  Clone ID: 18065121
gcacgagggccattgcgattgggaagaggtccacagagaagctgttccgcatccttggtatgtatgaggcgctagctgaggtgctaccagagcttgagggtttgttctccggtgaggcaaaggatttcatcaaggaggaggctgagggaatactcgcgcggctcggggatgcagtgcgaggcacgattgaagagtttgctaatgccatacagggagagacttctcggagaccactgcctggtggggagatccatccccttacccgctacgtcatgaactacgtgcggctgcttgcggattacaa

SEQ ID NO: 31164 - DNA, 413 bp, Sorghum bicolor
  Clone ID: 18065125
gcacgaggtgtgaatctttttactgagtacccctttttttctttttttctctctttcctattctttcaatatccaaaccctttaggaattggccgataagaccgtgattcctaccgatcaacctcacttctagtgcctcggtccattgggaaacccagatcccaccgatctgataaacgtagaaacaaataggatcccttttagagctgagaatttctccttggatctgtggaaagatgctttttgatcttggcccagccccatctagggatagaaagattggttcctgagaatcggcaattcatatgaagtccaaaggggtgagcggaaattggaccagtgtattaggctgtctattgccgatatggagaggaacgagtcgttgctgatagccgcttcatactttttgggta

SEQ ID NO: 31165 - DNA, 359 bp, Sorghum bicolor
  unsure (1)..(359): unsure at all n locations
  Clone ID: 18065143
gcacgaggcacataaataatttagtaatatttatctagagtctttttgatttaaaagtaaattatgtttataattttgatcttttgtaaataaataaatgcccatgttattaatatcaaccttaatgtttctttattaattataacttgattagtttaaacatgatcactcgattagttgctttcatatattctatttttcaaaactataaatgcttgattggcttgagtgatatataattaattatgaatagaatatgactgacatttaaccctcacctttataattctttataatttggtcaactcaactnttaagatatttctttgaataaatcatcacctgttttcataaaatac

SEQ ID NO: 31166 - DNA, 183 bp, Sorghum bicolor
  Clone ID: 18065148
gcacgaggagcgctaccaagcttctataagtgaaaaacaggagagccactgctgatcttagcggccatcttgcaaacctgaggaccaagtgtagcacattagaagaacgctgtgtaagcatatctcaagaacttgatcatgtccgacatgaatgcactgattggagggtgaagtatgaacaat

SEQ ID NO: 31167 - DNA, 304 bp, Sorghum bicolor
  Clone ID: 18065152
gcacgaggtttaaacccatctgatcgaacggctattaacgatgaaattatcacagatcttgtgaccgagtgtcgctcaaatcaacaaaagcttctgcagtttgtcagttcatcagggaatgaacagttactaaagcaaggactggagataaatgatctcttacaaagtgtactggcaaagtatgatgctgtggcctctggtgctcctttggcagttgaagcacctgtgcgagaggcaatcgaggctcctatggaggctcctgcagtaaagccatctgcacccccagaacataatgataatgtta

SEQ ID NO: 31168 - DNA, 303 bp, Sorghum bicolor
  Clone ID: 18065157
gcacgaggattagaaacatatagtgtcttattagtcttggccttacactaccagaaaactgagtatccttgagggccagcaatttccttgaggggcgaaattaaacccccaaggatatacaattaccttgagggttgtataaaacacccaagaaaatgcatattcttgagtgctaaaccaaaccgccaagttaaatctgtatttccttgagtgctagttgaaaccgccaaggtaattctatatttccttgagtgttattataaaccactaaaggtaattacatttccttgggtataactagaa

SEQ ID NO: 31169 - DNA, 333 bp, Sorghum bicolor
  Clone ID: 18065164
gcacgaggggaacaggattcttttccagttgttcctccggggtgttctgatgatgaaactagcatccaacaattcatcaatgaagcaaaagctgctctagtatcagttggaattattagggatgctttcatatacaatggaaaagatccagggaagctttctggtcggattgtagattcagatatgcatgatgttgctcgttttctcaaccgccttttggggttgcctccaaacatccagaataggttgtttgatctctttacaagtatacttgatattgtccttcacaatgcaaggatagaagggcagctagattctggaattgttgatatc

SEQ ID NO: 31170 - DNA, 289 bp, Sorghum bicolor
  Clone ID: 18065166
gcacgaggagaaatttaaagagtcaactgccccactcgagaatgcttgctatatctgctttgaacacattattgcaaggatcacctcataaggcgtctgcacaagattcaaagcaatcagtagatcaccctgaagattgcaatatttcatcaacagaagagattttgaatgagataatccgagaggaagggttcatgaatgagacgctgaacagtttatctcatgtccatattatttctgataatgatggttcgtcaaaagcgagttatgggggcgtcatcttttcaag

SEQ ID NO: 31171 - DNA, 355 bp, Sorghum bicolor
  Clone ID: 18065167
gcacgaggttgaattgttttcctacactttcaaggaatcccttattattatactctgcaatactgattgagccatcaaatatgtgattcattttcctactgaatcctgcaccaggttggcacactttgcctctgctcttcactaatcggagtggattctatgagcattctctatttatttcacctgtgctaggacaccatatctacagtttgttgtgaatctcgtattgatacattgcctattgtgaatctcgtattgatacagtgcctactttccggttcattcatcttgtccttttttatattgattggtggaatgttgccacactttgcctctacatataagttatagtctc

SEQ ID NO: 31172 - DNA, 574 bp, Sorghum bicolor
  unsure (1)..(574): unsure at all n locations
  Clone ID: 18065171
gcacgaggaaagaacaagaacttgaaggcacgttcaggttcatgcactcaagattgcggacacatgctgagtcaatagctttctttggtggtggatcaagggagaaagctatgattgacgctaaattcacgacattgctcaaccactcgaaggttctattgagaaaaaaatggctttatggtatttttgatgattttgtgacgaaacagcttcctcataatgtgacatgggggctgagtatgctatatgctttggagcacaagggagaccgagctttgacttcaactcaaggggagctggcacatgctctgaggttcttggcatctgtggtgtcacaaagcttcatagcgtttggtgatattcttgagttacacaagaagttccttgaactctctggtggtattaacagaatatttgagcttgaggagcttctacaggcatcacaaagcaatcctgtcgtgccttctgatgctataaatgccacttctgaagaaataatttccttccgtggcgtggatattgtaacaccatcacagaaactattggctagccnattgtcttgtgatgtatctca

SEQ ID NO: 31173 - DNA, 513 bp, Sorghum bicolor
  Clone ID: 18065188
gcacgaggtctccttgggaggcgacgccgcgaccgcgcgacggccacccagctcctccgcttccgccgttgtcctccagcacgatgagccgaggccgccggggcatcttcgatggcctccccatcccggccgacaaatcctacctcaaggaaggcctgttgcggatcgacgagagctgggcggccgcgcggttcgactcgctgccgcacgtcgtgcacatcctcacatccaaggaccgcgagggcgagatccagttcctcaaggagcagagcgatctcatcgaggatgtcgtcgacgaggtcgtccacgcctaccaccatggtttcaacaaggccatccagaattactcccagatcctgcggttgttcagtgagtctgcagacagcattaccggactcaagggggagatggaggaggccaaaaagctgcttggcaggaagaataagcaccttggccagctgtggtaccgctccctcacactgcgtcatgtgctctcccttttggatcacgtcg

SEQ ID NO: 31174 - DNA, 483 bp, Sorghum bicolor
  Clone ID: 18065189
gcacgaggtggaaccatttgaagatttttaatctactgctcaagataactcttgttccaagttttccctggctactctcagacttgcgacagattgcatgttctttcgtgttatcttcagaacttcgacttgaggcatacagtgatcaggccagttgatttcacttgattgaggacgtcttgaactttgatctgctcattatctgggaatttttaatgttgaaccattgaggagtattcttttattggatgtctttatgaccattagggtgacagttcacagatgaagagattgaacaaagctatgaagaattttatgaagatgtacatacagaatttctgaaatttggtgaacttgtgaacttcaaggttctttgtgcctccttttgtcctgagacaacatgattccctaagccaatgcttcacatactgttgtattcattacattcagtttgtttgcttcacatgattgtttctctaaatt

SEQ ID NO: 31175 - DNA, 501 bp, Sorghum bicolor
  Clone ID: 18065193
gcacgaggctgacatggccctttttgctattggtaccttgcgtctctatacatctttattaatttgacttatatacaattaaaaaataattctaatacacctattaatttgtttttatggcaaaaaagttgaaccaaaactgcaactgttagcttataacatgactgttgatatgtttttgaaatactttactggtgcttctggcatcatggctaggattatcatgtacatgatgtggtccactcttaggttttaaaaggtctactctgacgctatttgcatcgattgaaacgtctttaagaacaaatcaatggatacttcatacagttctggcttataatttatttgagcttgtaatgcctgaaaaagtcggttgtaaaaatttgttagaatgtgcatgtattgacatgtttattaacaaggtgaattacttttcaaaatggtgaattttttttggatgtagtgatatattgtttcttgatacacaggtgttggttattg

SEQ ID NO: 31176 - DNA, 626 bp, Sorghum bicolor
  Clone ID: 18065195
gcacgaggctcgttcttccgtgaacgtggcgtggagcctacatggacacctcactcccttgatgagcagatgcaatggttcaagaagcttctcccatccattgcatcgtctgagacagagcaaaaggaaataatgtccaagtcacttttctttgtgggagaggttggtggaaatgattacaaccatttaatcgttaggcagaaatctcttgatgagctacatgaagttgttcctaatgttgttggtgccataagctcggccatcgtggatcttataaatcttggagcaaagaagttagttgttccagggaacttcccaatagggtgtgtcccattatatcttgcaatctttcagagccaaaaggaggattactacgaggaacaaacaggctgcattaagtggcttaatgaatttgctgagtaccacaataggatgcttcaggaggagttggagaaactcaggaatcttcaccctgatgtgaccatcatttatgctgattattatggcgctgcactgaacatattccgtgccccactccagtttggcttcacagtcccactgaattcgtgttgtggaagtgatgctccgtacaactgttccccttcaatattgtgcgggcgtcctgg

SEQ ID NO: 31177 - DNA, 461 bp, Sorghum bicolor
  Clone ID: 18065198
gcacgagggttacgtgatcccaccattatgttctagtctaggaatccatagcattcgcagtgaatccagtagatcggtaggccctggattgctgtacgtcaagatgcttagcgattcagtgctaataattccatttaattgagattcagtgctagtactatttgttgaaaactgtactcaacttccttggcatcaatggcagtagtgaaagaaaatattctaattcatcttgtttgtttaatggacatgattttctcatatctaaaatgtcggttttgcatgggccttgattattaagctacaggccctataagtgaggtagcagtagcagtagcaaccttcagtgtctactttcgtttttgttatccaagagaatagcttcatatttctaattttgcatttccttagcacttttaatgtatacgattgaaggcgtattttttggctcgtagttgggttgc

SEQ ID NO: 31178 - DNA, 540 bp, Sorghum bicolor
  unsure (1)..(540): unsure at all n locations
  Clone ID: 18065203
gcacgaggattattccagcatcctgctgcacctcacctcgccatggggggagcttctaattctaacctgcttcctcctggcttccacttcttcccatcagacgaagagctcgtcgtccatttcctccgccgcaaagcctcgctcttaccatgccagccagacatcgtccctacagtgtgtatgaatcactatgatccatgggaactgaatggcaaagcacttggggcaggtaaccagtggtacttcttcagccatgcgaagcacagcagggtcacaccaaacgggtactggagctctgtttgtgcagacgagacggtgagcagtggtggctgtagtgtcggtctgaagaagacacttgtcttctccactggagagccctctgaatctgaggggaccgagaccaactggatcatgcatgagtatcacttactggatgggaggaaggggattagcagtagcactacctcaactaatagttcaagcaagaaattgcatcacccaaacacagagtccaataactgngtgatatgccgagtgttt

SEQ ID NO: 31179 - DNA, 525 bp, Sorghum bicolor
  unsure (1)..(525): unsure at all n locations
  Clone ID: 18065208
gcacgaggcttttatcaacgggcaaaagttgcaggcagtactcaaagcatgaaatagagcttgccactgattacttttctgatgcaaagaagattggtgagggtggctacggcaacgtatacaggtgtacccttgaccacaccgaagtagctgtaaaagttattcaacaagattccaccgataagattgatgagttcttgagagaggtggagattctcagtcaacttcaccatcccaatttggttttactgcttggtttttgtcctgaaattggatgccttgtgtatgaatacatggagaatgggagtttagaagatctacttatcaacaataaagggcagccactccattggtttcttcgattccaaattatctttgatgttgcttgtgggctcgccttcttgcatgggacgaaaccagagcccattgtccatcgtgacctanagcctgngaacatcttgctggacaagaattatgtaagcaaaattggtgatgttggttttgcaaagctcatatcagatcttg

SEQ ID NO: 31180 - DNA, 509 bp, Sorghum bicolor
  Clone ID: 18065211
gcacgaggggcgctgctagaactgcaccgtcgctatggagaactgcggcgcgctcggcatcgtggacagcgcgaacggcgtcgtcgagtcggcggttctcgtcgatggtcgccgttcggccgtgaacggcgtcgtcgagtcgcctgagaaggacgtcgtcgagccgcctgagaaagacatcatcgactccgacgcggtgctcggcgtcgtcgagtcggcggttctcgtcgatggtcgccgttctgccgtgaacggcgtcgtcgagtcgcctgagaaggacgtcgtcgagccgcccgagaaagacatcatcgactccgacgcggtgctgtcggaggtgcttgccgcggaggacgtcgttttgcatcagccggacgacgtgctgccagagtcgcagccgaactccatcacgcaggactcggagctcgcgccagactccatgggagatgtccctgattctttgccgccggactccatcacgcagttttctgaagcgtttgtatgccgttcgt

SEQ ID NO: 31181 - DNA, 529 bp, Sorghum bicolor
  unsure (1)..(529): unsure at all n locations
  Clone ID: 18065213
gcacgaggattgactgcagctgctgtagcaaggtcctttcagtgcttgaatttgtggcgcatgctggttctgaagtaaatacgccatacagaaatatacttgtggatgggcaagacattgaccttttgcattgtctcattaatgcatggaatatgcagtctgatgctgaaaagcaagatttctttcctgttagcattgagggtgatgaccccaatgatgacacctgtggtatttgtggcgatggaggcaatttgatctgctgtgatggatgcccctcaacatttcacatgagttgtctaggactggaggaacttccctctgattattggtgttgtgcaaactgctcatgtaaattttgccatgaacattctaatgatggtgctgaagacactgctgatgttgattcttcattgcatacttgttcccagtgcgaagagcagtatcatgaagcctgttctcctgagaatgattccataactaacctttccagtcagacaggcnatttattctgccaacaaagctgcagact

SEQ ID NO: 31182 - DNA, 534 bp, Sorghum bicolor
  unsure (1)..(534): unsure at all n locations
  Clone ID: 18065214
gcacgaggaggcgatggccgcgagggctcgtggggaggacgagctctcggcggagcagttggagaccaacaaccggctccaggaggacgaggtgctggcactgcaagccatttatggggatgacatggtgatcttggaggataaggcatgtctacgttcttttcagctttttgttcggtatccaattcctaatggcactaaggtgttcttgaatcttcatccaaatggaactatggttggaactgataatgatgggagccaagatggtagtgaactcttttatgcttgcagcttaaagcatttgccacctgtggtgttaacttgtttgctgccatgttcatatcccagtacaagtgctccttattttactatctcagccaagtggttggatgaacccaaagtttcacacctctgtgccatgcttgatgagatttggactgacctgccaggacaagaagtagtgtatagatggctggactggctgaatagctcttcatggccttgcatttctttgaaatgacacataatactagn

SEQ ID NO: 31183 - DNA, 575 bp, Sorghum bicolor
  unsure (1)..(575): unsure at all n locations
  Clone ID: 18065226
gcacgaggcttcttttacgtggtggggatgttttggagaagttctctgatgttgatgccattgtgtttgacaagactggaactttaacaattggtagacctgtggtaactaaagtaatagcttccagaggcatgggagatgcaaatacaaaggatttgggggccaaccagtggacagaggctgaaattctgagttttgctgctggagtggaatcaaatacaaaccacccacttggaaaagccatcatggatgctgcagggtctgccaactgcatcgttatgaaggcaaatgatggatccttcatggaagaaccaggatctggtgctgtggctactgtcggtgagaaacaggtttctgttggaacattagattggattagaaggcacggggtcattcacaatcccttccctgaagcagaacactttggccagtctgttgcatatgtagcagtgaatggtgctttggctggtcttatttgttttgaggataaactcagggaagattctcgtcaagtaatagacactctatctnagcaaggaattaatgtatatatgttatctggggacaaggaaagt

SEQ ID NO: 31184 - DNA, 530 bp, Sorghum bicolor
  Clone ID: 18065227
gcacgagggagagagagagagaatggacaaggtggagagcaatgaaaccgggcgggcacggggcacggggaggcagccaccgccaccgtgcagcatcgcaggtgattgatatgatgccgcgcgcgcgctgccggactcgccgtcgccggccgtcgttggacttggacctcgattgatcgatcgatcagtggatgcagatgcccgggagcttccactggaacttgcctgcgcggcgctcgtcgggtgtgccggcggtgtagttcctccagacgtcgagcaccccgcggaggtcgtggagcttggcgccgagtccgacgcagcagttggcgtggagggtgcagatcttgttgaggtccttgctgagctggcagaagccgctgatgtaggcggtgtcgaggaactggatggcgaggtccagcttgggcgccatctcgtgcttgatgaggttgaacacgtcctgctcgtgcttccccaagaagcgccaccgcccctgctgccacgcccggtagaagtcgatggtcttggccgac

SEQ ID NO: 31185 - DNA, 582 bp, Sorghum bicolor
  Clone ID: 18065231
gcacgagggcgcggtgggcggagctcaagcacgacgaggcctgcagaagtgccgcaagcaacagtagcgccgcaagcttcagaggccgtcgctgctgccagcctgcctgccacaaggccctctagtcggcggtcgaggcgggacgtcggcgtgaagcaagttgtgtctgaggtagcgtcgagcgtggactccgacgtggagagcatcgggcgatggagcagccgagggagcgacgacggtggggatgaggcagtgttgttgcccaggccattggcggcagtcgtcgccagagaccggagcaggagcaattcgcccgcgataagtcggaatggtgtggactcagctgcagcgaatcgcgcaccatcaacaggaaggtcaacctttgcacctccagttggcgttaatgtgaggcctctacaagctgtggaaattcccaatgggacacctagggatagaagggctgtttatccagatcccacttttgcccagtccacacggtcacgggactcacatgacagttcaacactaacagaagagcttgaaatgctaaaagatgagaatgtaaatctcctggagaagctt

SEQ ID NO: 31186 - DNA, 489 bp, Sorghum bicolor
  Clone ID: 18065250
gcacgaggctgatggtaaactgcttgctaccggtggtcatgataaaaaggttacgctgtggtgtacagattctctgaagcctaaatcttatctggaagagcactcgtttcttatcactgatgttagatttagcccaagcatgtcgcgccttgctacatcctccttcgacaaaactgtgcgggtttgggatgcagataacactgactattcgctacgaactttcacgggccattcagcatctgttatgtcacttgattttcatccaaataaagaggatatgatatgctcctgtgatagtgatggggaagtgcgcagctggagcataaataatggtagctgtttgacatgtgttaaggtgtttaagggaggtgctactcagatgagatttcaacctcgcaagggagagtatctagcagctgcctcagagaaagttatctacatacttgatggggagacacaacttgcttgtagaagtcccttgcaggggca

SEQ ID NO: 31187 - DNA, 431 bp, Sorghum bicolor
  Clone ID: 18065254
gcacgagggcccaccgtcagatcacacgcactcctcacagtcacacacacacacatcgcacattcatggcacggggagtaaccggcgacgccgcaggaagttccgccgccgagcgggggacgggggcagccgcgccgcctcagtctgcaacgtggcagcgggtgcggagggccgggcagggggcggcggcgcacgcgctgctgctctgcttcaccacgctcctcgcgctcaagctcgacggcgtcctctcgctctcctggtgggtgcttttcatccctgtatggttgttccatgctgttgctgctcgatgcctattctcgttaccggctccatcatcacctgaaagttgtcaacgggttccattccattccatcgtcgcaactccgttgctagttgcttttgagctgcttctctgtgtttatctggaaggc

SEQ ID NO: 31188 - DNA, 573 bp, Sorghum bicolor
  Clone ID: 18065257
gcacgagggaggagtccgtccgcccacccactgcgctgtaagtacaccatccgctgcgattgagcccggccaccaactgtgaggaacgacgccgtcggccacgaggacgccctccgcccgctcgctacgccgcgaggacgccgtctgctgcgagtgagcccggccgccggctatgaggaatgacgccaccagccgcgaggacgccgtccgctgcgagtgagcccggccgccaatcgcgacgaacgacgccgccggccgtgaggatgttgttcgcccgcccgctacgtcgtcggccgctacgagtgagcctagcgacgaggaacgacgccgccggccacgaggacgccgtccgcctgcccgagccatcaacgccgcccagattattcaggatgaaataatcaaggacttgcccttgctttgttgctactgaattggccacgtcttcattgaataagattctaagagtggaaaactaatattggatgaggctgtttttctctcggattaaaaaaagaaacagatagtaacttcggatctcatgctttgaagctcataatacatgtgacttgactt

SEQ ID NO: 31189 - DNA, 595 bp, Sorghum bicolor
  Clone ID: 18065265
gcacgaggctatctgcaacggtgagagttcctagaaacctttgttttataaaaagcaggctgcctcactttagtatgtgattcatgatgccccagcatacagtctcaaccagtataatatctacaaaagtctaatatgtgctgatgaaatatcatcactgaagtttaggatttgaagaagttttagggatactagttttattttaacaaatgtaaaatgctaaatttggaccgattttattgattttgtaaaatttaaggacaactattaagactgttgcgtatgccatgaatatggttttctagaatggtcacccgcaactattaaaactgaatggtacccacaaagaatgctttgaagactgatttgcatgttagatcctgatctatttccatcattccatgtaagctggtcctgcaaaactataatctttcaccaaggccgaaattaacagatactctttagtggcctaacctgctggggcaactttgatattcagcagcgattttgagcaacaatcctttgattggtagtcctgttcgtaactagaggtgaggtgccaactcactcaacatacgacaaagcaaccaacaag

SEQ ID NO: 31190 - DNA, 127 bp, Sorghum bicolor
  Clone ID: 18065278
ttagcaattggagatatgagcacaaatctgggaaaccatatgaaggcacagcacccattgttgcgacacttgacggaacatgaatgtgacaccatgggcatcaacaaagcatgtgaaaatgtttatc

SEQ ID NO: 31191 - DNA, 484 bp, Sorghum bicolor
  Clone ID: 18065297
gcacgagggttgcatatggatcttatcaaggagtttgaggtgagggaaactgttcgcgatgtgacattcttacacaatgagcagttgtatgcagtcgctcaaaaaaagtacccctacatatataatcgacatggtacagaaattcattgtctgaaggaacatggaaaagcattgaaactccaatttctgtctaaacaattcctcttggcatcgataaacagctttgggcagctccactaccaagatgtgagcactggtgaaatggttgcaaattacaggacaggtctggggcgtaccgatgttatgcgggccaatccttacaatgctgtcattggtcttgggcatgctggtggcaaagttaccatgtggaaaccaaccagtgtgaaaccccttgttactatgctgtgccatcatggcccagtgactgctgttgcatttgacaggggcggccatcttatggcaacagcaggtgttgacaggaaga

SEQ ID NO: 31192 - DNA, 597 bp, Sorghum bicolor
  unsure (1)..(597): unsure at all n locations
  Clone ID: 18065302
gaaatcacctggtgatcaaaaagaaagaaatcacctgctcgacggcatcatcggcaaggcaaggcggcgggcctctgtaccaatctccccgcctgtggtcgtgtctgccgcggcgaacatgagcaccacatcgtctcagcatggtggttaccctgcccagaggtctgcggcgaacatgggatccacatcttctcagcgtggttaccctgcccggaagtctgagccctggactcgccttacccaccaagagagacgaccgcaatgggttgcttataatccaaggacaatgagacctccgccacttggcactgataccaattgtatgaagattctgtcctggaacgttaatggacttcaaactattgtgcagtcagggttttctgcagatgaattggttggcagagagaactttgacgtcttgtgtcttcaagagacacacttgcaggagcgcaatgttgacctttttaagaacctggtacctgaatatgattacacctattggtcatgcagtgttgcaaggcttggttattcangaactgctgtgatatcacgggtacaaccaatctcagtccaatacgggcttggtgtaccagagca

SEQ ID NO: 31193 - DNA, 188 bp, Sorghum bicolor
  Clone ID: 18065308
gggacgaaggtaggattatgatagcggctatttcattccttcttggatatgaaaatgctccacaagaggatgacagcgaagcatcaagcagtgaagatgaagcatatcaaaaccctcaaattcttctcagtaaacaggatgtttataaggcaaatcacaagggtacagctgctagtaagaaaaagaag

SEQ ID NO: 31194 - DNA, 604 bp, Sorghum bicolor
  unsure (1)..(604): unsure at all n locations
  Clone ID: 18065315
gcacgagggctcactttcccctttttctccgggtgtgcgtgcttcggcggtgtgttcgtgcttctgaccgtgtttgtttgatttgtgtgcagccgtgaacgtgcagaatggcgaggaggtggctgtcaaactggaatcggtcaaatcacgacatccacagcttcactatgaatcaaaactatacatgcttttgcagggtggaactgggattccacatcttaagtggttcggggtggagggggagtacaatgtcatggtgattgatctgcttggtccaagtctggaggacttatttaactactgcagcagaaagttctcccttaaaacagtactaatgcttgctgatcagatgatcagtagagtagaatatatgcacacgagggggtttctacatcgtgatatcaagcctgataatttcctcatgggtttaggacgtaaagcaaaccaggtatttgtcattgactatggccttgcgaaaaagtatcgagatctccaaactcataagcacataccatacagggaaaacaaaaatctcacaggaacagcacgatatgccagtgtaaatacccatcttggagtagagcanagcagaagagatgatctg

SEQ ID NO: 31195 - DNA, 609 bp, Sorghum bicolor
  Clone ID: 18065328
gcacgagggtcttgaagacacttcgtcaaatgcaaacttgggaaaagaccaaactcaaggatcaaatttgcggcttgaacaagtccttcctgttaagcagactgttgcatcaagcttgaattcagcttcaccaccattttatcctgcgaggtcatccaatcaagagttcccagttggtcaaggagggaatgcacaacttagtaataacctcctgagagggaaggcctttgtaccatcagttgggaatgttggagctgctatgaatggcatgaatagacccgcactgcttccagctgcatcatcatcaaatggcccgtttcctttagccactaatcaagttaatagagactatggccagcctgcacatccaattgttcaacaaaacccagttcaatcccctcccaggatgcctgcccagatgtttggtgcaagattcagcaatagcagtaaaatatcacctgcacaacctacgtcaactatttcgggtgatgatgctgaaatttcttcacctagtggatcaaacaaatatgattctcggttaacagttaagggacaacctgatgacaaaggagaagagcgtgcatttctctatggtggggctcatgctct

SEQ ID NO: 31196 - DNA, 579 bp, Sorghum bicolor
  unsure (1)..(579): unsure at all n locations
  Clone ID: 18065344
gcacgagggtttctctcaatctcgcagattatgcattgacggccggagagacgattgagataattcttctattgtctgtacctggtggtgcacctgaaccagccccatcccttcatctcactttgagtatggtggaactaagagcttttcaagaaacatctgatgcatcacagcgacctgccgcaaccttgccattgtccccatcatctggtgattctcttcctggaggaaaagatgaggtttcggttattaaagcagggctgaggaaggtgaaaattctcacagatctggtgtcaacacgaaggcctaagaagacttgccaagatgaggaaggtggcgaagataagttctatgttaacagtgatggtgctgaatatccatgtgataccgagtctcttgatgacgatctggatgacatagtacaggaagatgaatttggagattcaactatcaggaagtcattcagttatggctctctgcagtctgtcaactacgttggtggcctagtttatgcccatgcaaagattgatggggagcatgaggactggatatattatagtanaccgaaatctgatgccg

SEQ ID NO: 31197 - DNA, 556 bp, Sorghum bicolor
  unsure (1)..(556): unsure at all n locations
  Clone ID: 18065349
gcacgaggattaaatcaatcaagtgttaacttaaagtctgatttggaattcagtgatgatattcaatggaggcccctcacaatggcagactctgggtattctaactgttgggccacatatctccaaattacaaatgaatgtagcggtttacaggaatattctgttgaagtgagcataccctgctcagatgacattgtgtctagaagtggctctaactacaattgtcctgtgcattttacatttaacattcaactgatcagcaacgacgcagcccagggtttagatatgtttcataagccagttgcctggaattgctcagagtcattccagtctcatggaaaccgtgatcctatcccttttgatctgctaaacattactagtgccttggttgaacaggactcanattggcattttgaaagactatctgaggaaatagatcttttcagagagttacctgatgacaatagcaagtttgggaagttgacattagcccggctattgcttgcttgtgctgctgtaaaatcccgtggaagatctctaattgaaaggaagggat

SEQ ID NO: 31198 - DNA, 512 bp, Sorghum bicolor
  unsure (1)..(512): unsure at all n locations
  Clone ID: 18065357
gcacgaggctcaacactccgcttcctgagcatccaaaactaattcgtggccaattgaagaatggccttcggtatcttattttgccaaataaagttccagcaaacaggtttgaggctcacatggaagttcatgttggatcaattgatgaggaggaggacgagcagggaattgcacatatgattgaacatgtcgcgtttcttggcagtaaaaaacgtgaaaagcttttggggaccggtgcgaggtctaatgcatatacagacttccaccatacggtgtttcatatccactctccaactaaaacaaaggaatatggtgaagacttactcccttctgtgttggatgcattgaatgagatagcttttcatccaaagttttcttcgtctcgtgttgagaaggagagaagagcaattctttctgagctccagatgatgaacacaatagagtatcgcgttgattgccagttgttgcaacatctgcactcagaanacaaactgagcaacaggtttcctatt

SEQ ID NO: 31199 - DNA, 525 bp, Sorghum bicolor
  Clone ID: 18065358
gcacgaggctccttggcattgccaacaacgtctgaagcactacaaatctttctgccgtagaggaattactatctcggtgcatagttttgtatacatcatgagtgaagagatgaagagacttgttgcttatgtggaagatctctacgaggatacaaattcatgcaacatggtcaaggtacaatggttcgacaaagttgatgaggttggtgtttcgttgcccatggatttcgatgacagagagattttcttttctctgggccgtcaagatctcaatgtagaatgcattgatgggttggctgcagtcctgagtgcccagcactacgagaagttcaagagtgataccagatgcagcttgtggcaaccttatttttgctgtcggcagattgataatggtgaagtcaagccttttgatgtcacacagctgcaaggctactggagccaggaaatacttaggaccatgttcaatgcaacttcctctctgaaggtgcgtttcaaggtccctaaatcgggacccagttcagatgg

SEQ ID NO: 31200 - DNA, 616 bp, Sorghum bicolor
  unsure (1)..(616): unsure at all n locations
  Clone ID: 18065370
gcacgaggtagccagccagtagccggaacacaagttgctgccagggatcatctactcgccagtggatcaggaaccaccaatgtttcaagtgctgaaactctggcaactacaattgttgatccgattaaattaaggcgacaggtatttcgacgtagaagaaaggagcggagggttcaggagctgcttcagatggataagaaggttgaacttgagatgcgaaatgcagcaataaatagctcaatgaactttaacaataaagttagaggcagctacaacatatggaggcaggagttccgctttattaatacagattcaacactaaggctcatgaaagatcagataataatggccaagttatatgccactattgcactctcccagaaggaaccagacatgtatgccttgctcatgaagtgcataanagaaagccaaacatctatcggggatgcacttattgacagtgaactcgattctagtgccttagagagagcaaaagcaatggggcatgtgctgtcttcggctagagatgttctgtacagctcgggtgaagtgtcaagaanattgcgtgctatgttgcagtcaacggaactaaatattgatgcagtgaagaacagaa

SEQ ID NO: 31201 - DNA, 611 bp, Sorghum bicolor
  Clone ID: 18065371
gcacgaggccgcccccggcctcctcgtatctcctcgaggtggtctccgaccttgacgactacgccgacgacgacgacatcgacgtgtcctgggcgcgcccacccccgcccgccttgccagaagcaaacaagagagatcttactgaaacaaagaatgaacatgctccaactccagtttcacagaaaccaaagctttctaaagcagagagacgtgccattcaggagtctcagcgcgctgccaaagctgctgccaaggaggcaggtttaaaaccaacagccatggcttctgatgctagcaccaaaatatcaaagcaacccaagacagcaaagacatctctaaagaaagatgtgaaccaagttaaccctccagttgctactgataagaagactggtgaacgcccacccgacaaagatagaaaaaaagatgttcctcaaccccgtatgcaatttgatgatgcacatcgagtggtgaaagcaaagaagcgttcagttgttaaccaatcagaagctcgaaacagggtcgaactgttcagacatctgcctcaatatgcacatggcactcaacttcctgaccttgagtcaaaatttcttcaacctgatctaatgcatcct

SEQ ID NO: 31202 - DNA, 456 bp, Sorghum bicolor
  Clone ID: 18065373
cacgaggggatcgcggccgctcggcttgctcatgggctgattcgtggtttcctcgggagggaattctgatcggatcgtggggggtgtacatggttccgtgtgtgatggggactgggggagacgcttgagacccagaatcctggcccgcgtggcgagattccgcgatctgtgattttgatgtcgggcgctttcgagtcctagctgcggaccggagagtggtgcgcggcagcttggatttggatccgcggttgtttgcaccgtggtgtgtgaaatcgagctgtttagatctaagttctgcgagatgccgtggcggtggaatctcgattgatccgtgtgtctcagcgcccatgtagctcgtgtgactgcaatacatctgctaatttggttctcgacgtcttagggttacacctgctgctccgtaatcctgttgagtctcgtgtggatctgttgactgta

SEQ ID NO: 31203 - DNA, 519 bp, Sorghum bicolor
  Clone ID: 18065391
gcacgaggagattatccagatgctaaaaatcagcctcatgttcaggttgctttgagactcaagcaaaatggttactctggctgctcagctggtgacacagtcccttatataatttgctctcagcaggactcagataatacacattctgtgggaatagctcagagagctagacatcccgaggagttaaaaagagaccctgacaagtggatgattgacattgactattatttgtcacaacagattcatcctgttgtttctcgtctgtgtgcttccatccagggtactagtccagctcgtctggctgaatgtttgggacttgattcggctaagttccaatcaagagtgactgagtctagcaatcaagatacatctacgatgctgttatctgtgatcgatgatgaagatgagagatatcgtggttgtgagccactgcgtttatcatgcccaagctgttctggtaccttcgactgccctcctgtatctagtctgattactagtgctacaagtgtatcagatcca

SEQ ID NO: 31204 - DNA, 472 bp, Sorghum bicolor
  Clone ID: 18065402
gcacgagggcccggtgctgcagccggcgcatcatggcgcgggagaaactctggattctgatgctgctacacctacaggtgccctgctccaaagcgaggtatcggagagttcccttgtgcaattggatgatggaggaatcggtgcgggtgtagaaagctcgtgccttgaggatgcggtgtcaagtgatgggattcatggtgagcaagaagagcaggagcaggagcaagggagcaacgctaatgctgccactggttgcgatgaaccagatggagaggccaaggatggtgctttgcctctggctcacacgccaggtgctgaagaaggagagaaacaatttgttgtctggtggaggctgccgttcaagctgctgcacttctgtgcttggaaggtgaaaccagtgtggtccttctcaatcgccgcggcatttcttggcctggtcgtgctggggaggaggatgtacaggatgaagcgc

SEQ ID NO: 31205 - DNA, 291 bp, Sorghum bicolor
  Clone ID: 18065403
gcacgaggggggcgacgacgaccgccgccctcccctccggccaccggtctcggtcgcggctcccctggattcgcggcaccgcgtccgtctccggatcgtctcggagatctgctgctgagggagctgcatataatctgaggtgctcctgaagtgttcataagaggttcctgttgtatttatttttgttggtgcgagtgtaatggaggaagaggaggaggccaacagggaagccgcggagagctgccacagggtgctcgccttgctctcgcagccgcatgaccccgcacaggt

SEQ ID NO: 31206 - DNA, 577 bp, Sorghum bicolor
  Clone ID: 18065421
gcacgagggatatttcttgcaccgagttcaacatgggcgagggaactgaaagcattcgcaatggcaacagtagttgccttactatgcaggaagcagaatgtggaggatatcctcatccagattgtatatctgttgatatggttgatgaaagatcactgcatgatttgccccatgggttttcacaaaacaatgagcaatatgagatggagcagttcccacagagtatatgtgaaagcggttctatgcagatgggctctccggaccaatattgtgatgatacatctttatcagatttttacatggatgtatcctccccagagtcaatatcctgtgagcagaaccagtctgaagatatttgtttcaagagcgagtctagcactgactcttctccaataccctctagcagaaattccaccacagaggatgctgataaatacttaggtcaaacatcaaaacaattgctggactccaaaattgttcctttcagcaaccagcacacatttaagaacatgggatatcagaaacctctggcattgcataaacaatatgcatatagaagtgacaactcttctattca

SEQ ID NO: 31207 - DNA, 517 bp, Sorghum bicolor
  Clone ID: 18065426
gcacgaggcacagtcaatgccttacaaacacccatgataaatgcaagcatggtcttgtgcgataggcactttggggggattaattatccagttggtggtgttggtggtattgcaatatccctggcagatggccttgttgaaaagggcagtgaaatccgttacaaggcgaatgtaaccaatgttattcttgaaaatggaaaggctgttggggtgaggttatcaaatgggaaggagttctttgctaaaacggttatatcaaatgccactagatgggacacgtttggaaaactcttgaaagaaaaagaacttccagaagaggagaaaaactttcaaaagaattacgttaaagcaccatcattcctttcaattcatatgggtgtcaaagcgtcagttctgcctgctggcactgactgccaccattttgtacttgaggataattggaataatttggaaaagtcttatggaagcatatttttaagtatccctacagatcttgatccatcattagctcctgaag

SEQ ID NO: 31208 - DNA, 593 bp, Sorghum bicolor
  Clone ID: 18065438
gcacgaggctggaaggttgaatcatttgaggaagtaattaggttaggatctgaatcacctgttgaagccaacatgcctctcccttctgatgttgcggtgataatgtacacaagtggtagcaccggattgcccaagggagttatgatgacccaccgcaacgtcctggctacactctcagcagttatgaccattgtgcctgcacttggcagtaaagatatatacttggcctacctcccacttgcacacattcttgagttggcagcagaggcactaatggctgctgttggggcctccataggatatggatcacctttgaccctgactgatacatccaacaaaataaaaaaaggaactctaggtgatgcttctgcactaaagccaacattgatgactgctgtacctgctatacttgaccgtgtgcgtgatggtgtgaggaaaaaggtggatgcaaagggtggtatagcaaagcaattgtttgacattgcctataaccgtcggcttgctgcaatcaatggaagttggcttggtgcctggggtttggagaaacacttgtgggatacgcttgtgtttggaaaggttcgtgctattttggg

SEQ ID NO: 31209 - DNA, 596 bp, Sorghum bicolor
  Clone ID: 18065441
gcacgagggaaacatggaatggactacagacttctacatgcagtcacaaacggacacccttggtatggccaatggggatacaagtttggtgctggcagctttgctctcacctcagacacctaccaaaatgcagtagacatgctttccaacataaacctggcgctgtactactcacaccgtagcccaattaggactgcattgaagaacacaattgctctttattgggcgctctctaatcggcagctagtgaccctccgggatcttttccgcttcattatgcacctccttcatcaaggtcaaaagatgtcaaaaccctcaactgacaagcacaaggagcttacatctaatgagctatgtgcatggactaaagaagatctacatcgagcagaaggtgcaatgctcaaggttctccaggttgtccaaactggacagtgggtatcttggcgcgcacttaggggtgctgcgtcgaaggctgttgattcgcaggagctgcttgattattctctccgagaactgggtgggaaacaactggataatggcctttctgttgctgtccgctgcaatgctgagactagtgcaattgagtacaggctgga

SEQ ID NO: 31210 - DNA, 493 bp, Sorghum bicolor
  Clone ID: 18065462
gcacgaggacaaaattgtcattttgaaaggaagaggaagggttgattctaatacacctgatggagcaactcagcagtcatcaacccctgtgaagagtgtaccgccggcgacttctagactagaccagcgacctgaagccagtggaagaattattaaaactatactttcaaacaaggaaatccgcagttcaaatccatctcaacatgagcaggaaggtcatgtgtttaatactgagaaggataagcggccaccacgggctgtcaaccctcgtaccattgtgaaagatcagttagttgaaaattctgagagaagccattttgatgagaagactaatcatcttcatggctctgctccaattggtgagaaggttgaaaggcatgccagaaacagagatagacctgatcgtggtgtatgggcgcctcgccgctatgacaaatctacatctgggggtggttcacatgcctcatcgtcagatttccctcaaatacagtca

SEQ ID NO: 31211 - DNA, 549 bp, Sorghum bicolor
  Clone ID: 18065480
cgagtttgaagctgacgcagctcttgaaatattgtcatttctgaagaacagatatccattggagtttgcctctaggaaaataggggtcattactccgtatagaagccagctctctttactgcgttcaaagttcacttcctcttttgggcctgagattgtttctgagatggaaataaacactgtggatggatttcaaggtcgtgaagttgatatcttgctgttgtcaactgttagagcctcaaattcttcaggtgataggcatcacactggtgaagcacgcagcattgggtttgttgcagatgttagacgtatgaatgtggcactaacacgtgccaggatttctctatggattgttggaaatgcaagaactttacggattaattcacactgggattccttagtacgtgatgctgaagaaaggaatctgtttgtctcaattaaacgaccatatggttcgatgtttgaaaagggccaacctcattccagagatactcatagatatcacactagtcatcttaagcagaaggataacaaaaaagctgctttgat

SEQ ID NO: 31212 - DNA, 528 bp, Sorghum bicolor
  Clone ID: 18065490
gcacgaggagatgggtggctataagcctcgcctcagcctgcataattcactgttccgtgcacttgtgagtaaaacaggaggcactgcgaagcacaatctcaggcaggctgagtttgtctaccacaatatagtcacaagtaaccttgcggtgcacaaggatatttatgcagggctcatctggctccacagctatcaagatgtcattgacagagacaggatcaaagctcttagggatgagatgaagcgagctgggtttgaggagagcactgatgtgctggtgtcatggatgagggccttctccaaggaaggagatattaaagaaactgaggcaacatggcattggcttcttcggagtggttgtgagcttcctgtgcaagcttatatctgccgcatggagctgtatgcacgctctggtgagcctatgaaatccctagaaattttcaaggaaatgaagaatcagaacattcctcctaatgttgcatcatatcataagattattgagataatggcaaaagctagagagataga

SEQ ID NO: 31213 - DNA, 476 bp, Sorghum bicolor
  Clone ID: 18065496
gcacgagggtcatcttcacgcttccgggtgggctaccgcagccgctgcccgacgccaggtgccaaggccttcgccgatctcttcgtcgtcgaagagcgcccaccagatccgcccctgagctgagcatcgatgtctcctttggctcttctccaagctctcttcgtcctcctgtgctgctcgactctggctctcgcttcctcgtcggagctaacccttgcacgagctgcttgtggagacgaccagcttgtcatcttcgatgcttctgatggcctccttaacctgtcggtcaatggggttctggtgcaggaccgcgtgcttgcctgccataagctcggcttctactttgccagtggctgcatccgctgcagcaacctttcagatgcgttgaggggtgccgtagagcagtactgtggtgaagggagtagaacgctccatgcaactttacatcaggatgtgccaaggaagctcttgaggcg

SEQ ID NO: 31214 - DNA, 529 bp, Sorghum bicolor
  unsure (1)..(529): unsure at all n locations
  Clone ID: 18065497
gcacgaggaagactcagatcgaactcaaatatttttcctatgtagatcagagctctttagaatggaaaacaagctactgagtccatgccactaccccattttcacatcccacccatgcctgcttaccgactagccccacgagaaacaaggaattttgtctgtgactaaatactataactataacagcccaagttttattcgggccaattccatgtttattgcactccatgtcaagatgctattttgtctattaacttttatcgcaatatgttcataatatagcattatgtaagtttttttagtattgaatctgccagtacttttttatccactcttgttactttaatatgttgttagttaaagctattagagttcaatcatacccatatttctaaagtaacatgtatagtggaataagcgtgaagccgcatgcttggtgactggtgttatatataactacacttattggatttctgagggttttccccttctataactgctgaactggtaagatttctacnaacaagct

SEQ ID NO: 31215 - DNA, 609 bp, Sorghum bicolor
  Clone ID: 18065502
gcacgaggaacacttcaggttcttggtcagtctcctatgccaaccgatatgtgcagtccgagacgctcaagctagaaacagcccggcagaaaccttgcttcctccctgccatcgagggcgactctgcagccatcatcgctgcctacattttcaaccatctgagatttggcaaggtgaacaaggacatcagcaacaccaatgtgtttgagcatgccggcagggtgtttgctgtcgctgagaaccatctacctcaggagatcggcatagataacctcgacactagcggtacctgggacgttggcggggaatgggatcggcccgctttcacggcacatccaaaggaagctcctggatcaggagagcttgtcatctttggaatggatgcaaagaggccattcctagtaattggtgttgtctcagcatagagttgacctcaagctggacagatctacactttgtcatgatataggagttactctgaagcacaatgtaatcatggatataccacttactattgacatcagtagactcgttaaaggtggccagttgattcagtttgagaaggaagttatgcaagaattggagtgatgccacgttatggtgatgcag

SEQ ID NO: 31216 - DNA, 466 bp, Sorghum bicolor
  Clone ID: 18065506
gcacgaggggatgacactcatctagacaagaaaaaaggtaaaaagaaaagtaagaaggcgaagaaggatgacacagagatggaggaacaagatgacattggtgaagagaatggtcggaaaaagaagaagaagaaaatgaagaaggatggtatggagacggaggaactggttgatgtaggtgaagagaacggtcgtaaaaggaaaaagaagaagaaggatgactcagagatggacgaaccagatgatgaaggggttgacatggatgaagagaatgatggagcagttctggaatctgaggatggagagcctaatgtggttgaactgcccacagaatcaaaagggaaatatgtacctccgagtttacgcaatgcttccaattcagaatcagaagagattacccagatgcgtcgcagagtaagaggacttctgaacagactttcagagtcaaacgtggagtccattactc

SEQ ID NO: 31217 - DNA, 611 bp, Sorghum bicolor
  Clone ID: 18065510
gcacgaggctaaaacttcaaaacctagatctaagcgaaaatggattgtcagggacaatcccaatctctctctcaaatctttcatcactgaataatataaatctatcagacaacagcgatcttcatggtgaaataccagaaaatctgctccaggttgctcaatacaactatacaggcaaccacttgaactgtagcccacaatcaactccatgtgaaaaacgcacagctaagacagggcctaaaattaaaagtaatgtttggatcttggttgttgtttcttctctacttggagttgctttgtgcatcatcttttgctttggaccaatcatgttcagaagcctcagcaaaggcaaacagagagtaagggatagatcaaatgtggttgtgcaccgagatatctttcgaaaaaagattgtgcaccgagatgaagagctagtatggggaacagaagggaacaatctagatttcacattttacaattattcacaagttttggatgctacaaatgacttctcggtagaaaataaacttgggcaaggtggcttcggtcctgtttacaagggccgacttcctgatgggttggagatagcagttaaaagacttgcttcgcat

SEQ ID NO: 31218 - DNA, 608 bp, Sorghum bicolor
  Clone ID: 18065513
gcacgagggtatgctgcccagcttctcgtctcaatgctcttggttgtgagttcgtatccatcttaattaagcttaaatgaaatgtgctcacaaatttggttggactatcaaatgtgcagtttcggctgaagcttttaaactattgttattcctcaaaatggccacaaatgcattcacgtttgcttttcttttactaccttgaaattcgttgaaccaaatataccgtcaaatgagagattcatatttctgttatcaattttgttggaaacttctggtcttcttgtttgagagtgctggaagcttttgctcattgtagtttgttttagccttgtggaatattggctattactgtcaattggtggataaataatctatcttctattgaccacctgttgtatatgatgtaaaagtaaactaggtaactaagtctgaatctccaactatagttgaaataacactgcattggaattgaccattatgttgatatttcaagtttgtaggacaaaaagtattgtgcctttttattacattatcatgtgatcatctctagccttccatttgaactcttgcatgcatcattgtaaatgtggttgcaataccctttgtca

SEQ ID NO: 31219 - DNA, 443 bp, Sorghum bicolor
  Clone ID: 18065514
ggcacgaggcattgatatttctggaatttctgacaagccattggtgaagcgcttgaagaaacttttccgatctctgagactgaaagaaagtgcaagtggggcttacttgctgcctccaaaaaatgttcctacacttgatattgttggatcattactattagcaggttccaaactttcagacaacaaaagtgaaaagtcagtatcaccatatagagaagaactaccacaggctaactttgatgtgcaaaataaagataaagatgactctatttccgaagagccgaaaattattggtgtggaagaggaacctcctaaaagaagggtaatcggtcctgcaatgccatctcgtgaattactggctgcagcagctgaaatgacagaggctcttaggtgccgggatgctgaactggaagccgatgatgatttgctcataggccccccac

SEQ ID NO: 31220 - DNA, 565 bp, Sorghum bicolor
  Clone ID: 18065518
gcacgagggtcttctccccatcccctaacttcttctcttctctcacagatggcggcgaccggtagagaatggtcggcgcaggcgaggacgccgccgctgtgtgtccctgggatccagtgaggcaaggtcccttctctctctatatctctcacagcttttccctgttcttcccacttggggtggcaacgcagcggcgcatgagatgccggttatggaggtcaacgacccaacgcaggcaaggtcgccaccaccgtcgcgtccccaagattcaacgaggtgaacccctcctcccagcgcagggccatggcgtggcggcgctgctcgagcctctcctcccccgcacagatccatggcgttggcggcaccacgcgaggccctcctcctcgctcaggtcccccatggcggcgctgctcgagcctctcctcccccgcacagatccatggccccagccatggaggagaaaatgtttttagatctgaataatttagatttttaggtaatttatttacccttccatggtggagaaattggttttagattgttttagacaatttatttacccttg

SEQ ID NO: 31221 - DNA, 578 bp, Sorghum bicolor
  Clone ID: 18065521
gcacgaggccatctcgctctacatctccatggagctggtcaggctggggcaggcctatttcatgatccgagacacgaggctgtacgacgagtcctccaattcgaggttccagtgccgggctctcaacatcaacgaggacctaggccagattaagtgcatattctccgataagaccggcacgctcacacagaataagatggagttccggtgcgcgagcgttgacggtatcgattacagtgacatcgcacggcagcggcctcctgagggtgagcggatttgggcgccaaaaatatcggtgaacaccgatagggagctggtgaagttgatcagggatggggctgataccgagcaagggacgcagactcgggagttctttctcgccctggcaacgtgcaacaccattgttcccatgatcgccgatggtccagaccctaagaagaaggtgattgattaccaaggcgagtcaccggatgagcaggcattggtctctgctgccgcgtgatatggctttgtgctagtcgaacgaacatcaggtcacattgtgatcgacgtccttggtgagaagctgagatacgatg

SEQ ID NO: 31222 - DNA, 534 bp, Sorghum bicolor
  Clone ID: 18065536
gcacgaggacatatctcctattgcttggtatccttgctgccactgtcacatatcaagctggactaaatccaccaggtggattttggacagacagtgttgatgggcatattgccggggatccaatcttggagaccatgcaaccaaggcgttacaaggtgttcttctactgcaatgccacagcatttgtagcatctttggtgatcattaccttactccagagccaactgattactgttagtgccatgaagcgtcacatactgcaaacagccatgatactggatctctttggacttatgggagcctatgctgctggaagcagcagaaagttctcgacatccctttatgtgtttgtcttggtccttcttgttttcatctatgttgtaattcatgttctgctatctttggctcttatgacacgacccagaagagatgatgctatggagaatgaagatgaagatttggagaaacggcgtaagtttctaatgttgcttgcaattctggctgcttccatcacatatcaagctggcataagcc

SEQ ID NO: 31223 - DNA, 553 bp, Sorghum bicolor
  Clone ID: 18065537
gcacgagggcccgatctgtttttgccgcatcagcttggactccttgccgccgccctcgccttcctgccgccgctggggccgactcctctcctccgtccgcacgaaacaccggccggccgaggcgccactcagtaagccgcgatggatgaggcggcacttctcgctggagcaggggcggctgccgccgcggcgccccctgcagcggctgctggagccgccgtgatgggcgtcttcaagtacaacttcgcggcgcagttcctctcgagggttatcccattcgtgttcaacatctggttcgtgcgccagctcggcgcggacgatggcgcggtgtcggcattcgcattgcagcttcctctatttatgaactgcatcttatttttaagccgggaggggtttcgacgtgcatgtttgcgtaatgattcccagagtgatgtgttgactgacgaagcgatactaatggtggcttggatggtaattccaatgtccatcttaattacttctattggcagcatacttgtgttgagtttaaagaaagtgaagctatctgacccct

SEQ ID NO: 31224 - DNA, 545 bp, Sorghum bicolor
  Clone ID: 18065561
gcacgaggcttgtccctgtgcatcataaggactctcttgaggatattacggatacagctgaaataatagaagaacgtcccaccagacagccttcctctgggcatcatctggatactgttgacaattctgatgaccataaaacccatgatgaagcatgtgacagtgctgtagcttctctttctgttgatgctgaaagaaaattgagtatttgcaactccatgaatgttcatgagaatgtcagctcaaaagattcagaactttgcagtgcagattattcccaaaagttcaataggtctgatgaaacttgtgatatacataaagaggtttcttcaaccgtaaatgatcctgatgaaagaaaatgcacagatgatccaacggggtgtactaatatgacacaatccatgcaagtttctgagtcctgtgatctaccgcatggcaaatttgtcagttctcctgaagaacatgattttaatggccgactggaaagtaaccgactttcaccatctagggatgagcctgatcttaattcaattgatatggaagtg

SEQ ID NO: 31225 - DNA, 610 bp, Sorghum bicolor
  Clone ID: 18065567
gcacgagggaggactttgtcaaatatgaggaccccttcttacgtgggtgaaattacacttacggactttagccttggagaacttccaccttatgtgcatgcgatgagagtccttcctctggatcttaatgaattatgggcctttgaagttgactttgagtattcgggtggaatactgctgcacattgaaacaaggcttgaggttcaggaaccagagttgcaaaaggacatcatgaaaagtaattttggagcagatgctaatggagaggttgattctgatcttcttgagagtattgaacagtatggtaaccaatttaaaggctcacataaatcagcttcttcgatggggggaaatgatgaagcaggtctcttttggtttcttatgtctttccttgtttaattaatatatacctactggaatcattatttgttcttaagtgattcgattcaacggttattgaacaataaggataaattcatataatttattttctgccaaatggttgtatcaattcttgtcttcagcccttaagaagtttgttgtcttatttttcttatgtatgattggacagactttaaggtatacattgctagaatgtatggcattaggt

SEQ ID NO: 31226 - DNA, 517 bp, Sorghum bicolor
  Clone ID: 18065573
gcacgaggctcccgccccgccccgcccggcctccggttcccgaacccccactcctcctccctctccgctcgcacacacccgtcgctcctctctcgctccctccccctcacccgccttcgcatccccgcaaggaatatcccttccgtggcgtcccttgcttcttccccaccccaccttgtattagtgcgtccctctaccgcttaatttcccggtctctctgcgctctttcgccgtcttggatcttggtcgcctcggctggttcgtaggattaatgctgaagggttatccaatattcagtgaaaactagctactgaaaaataggagtagcaatacctttgatgccccattcattctgtttctgcaatgtccttgtcttctatttgctgtgggaacttccatctactaaggaactctataggagacacttgcagtatcaggtggcttaaataccatagcagattaatatatgaaactttcctctcaagcagaagacatcaaagtagaccacttagtacaa

SEQ ID NO: 31227 - DNA, 536 bp, Sorghum bicolor
  unsure (1)..(536): unsure at all n locations
  Clone ID: 18065579
gcacgaggctctaatagcatgtacatccatatccatttgtgccaagaagcagccacgggagagtgaaatgagttagcacctgcgctaagaaatgtgagcgaccaagcatggatgctaatgctagaatgcatggtatcaatacttaggtttgctactggtgctaaggctactttttctaacaaaactaaacattctaaatcatctgagtacctattaaggggtgctaaagtaattacgtagaggtaattaagagagagacgattctagataactaccttttgcacctaaatcaagaggtaagtggaagtgcacatggcctcctagtgggtttggtgacctaatgacaagtaatttaggaactagccatgtgaatgaaatcttatgaacaacataatagagcaaatggttggctatcaatgctcaacgattcctcaaaatgaaaaggatgatatggaactcaatgatgtgtttattcgttttatattttggatttgagtttaggaaatgccatactataaagagggatgtgactctna

SEQ ID NO: 31228 - DNA, 567 bp, Sorghum bicolor
  Clone ID: 18065585
gcacgagggtgatggtgaaggtactaatgtgctgtctattggcgctgctggctgttctgtgacccacatcaggaacccaaagctaaaagagaactacacttctgttgatgttcgttctggtacaattgtggcacctggtggccgtatggattggatcaatgcgatatgcctgctgttcagttcaggttcagatagaactgaaaaatcacatgatagtaacacagtaaatagctatcagtctggtgaaccttattcatcatctttatttcttgagttggctgatgttgctgttagctatgaacctcattttaaaaattccactctcagtgctggagcaaccgaccgcaagtttttctcatgccttttagctgcatcatcatttaaactccataataaatctgcatcagcctctgcagctactgattttgatatccagctacgtgatcttggggtcctcatttctcaatcatctggctcaacaaatgccacttgcagttatggtgtagattaccttcgtcaagtaggttatacaaaggttgcccaaaacaccttcattgaagcttctct

SEQ ID NO: 31229 - DNA, 598 bp, Sorghum bicolor
  Clone ID: 18065587
gcacgagggtttattttgattgtgtattcgactctgttcccataaaacaagtaagatagtaatttcatttttcactcagattgcaaaagcatgtctcgatctaggttatgtatgcacaatacctggtagtaagcagatctctgatgctctgttccatttctgaggaaaataagtttagtctattaaggtggcactttgatccctgatgctctgctcaatctctgtgaattttcagtggagagggtagaagcaattctagcagagctggagctgtttctccagcagtgcttattgatgtggatgctgcacccactcctgctgccataggtaaaattatgttgtgtggaacagataacattgttgaaatgtttctagatgaagcagttgagaaaaagaaagcaaaaattgtttcttatccttgtaattagaattgttatagttttaatattcacctacatattaagtaatgctagtctgcctctcatgtctcatcagttatgaggttatgatgtcaggcaaggtatgaaactcttaatgttgccatcatagttcagatagataggcatggtttcctgattccattttacagtgtttttag

SEQ ID NO: 31230 - DNA, 604 bp, Sorghum bicolor
  unsure (1)..(604): unsure at all n locations
  Clone ID: 18065594
gcacgaggctcattccagcaaacttttggcagaattgtctgtatccttatctcaaggccaatatacacttaaggatggcatcatcagatacaaccaaagaatttgggtgggtgcaaatccttcattacaacaaaagataatgttctcattacactccagtccagtgggaggacactctggttatgacgtaacttataaacgcatcaaacacctctttgcttggtctcaactcaaacagtccgttaaagattttgttgcccagtgcactgtctgtcaacaagctaagagtgataggactgcatatccaggtcttctggctcccttaccagtccctgaaggtgcttggcatactgtcactatggacttcattgaaggactccctaaatcatctggacataactgcatcctagtcattgttgacaaattctccaaatatgcacacttcatttccctagctcatccattcactgcattccaagttgctcttctctatatgaacaacatattcaaattacatggtatgccccaggttataatctcagacagagacnagatcttcactagtcatctgtggcaagaactcttcagactgttgggcacagat

SEQ ID NO: 31231 - DNA, 490 bp, Sorghum bicolor
  unsure (1)..(490): unsure at all n locations
  Clone ID: 18065598
gcacgaggaaaaagttttaccaaaattagctaaattatttccagtgatatggtatatgcataaacttttttcatatgtattttgaactttatgaggtataaccattgaaaaaaaatatgatgctacatttcttcttatatcttttttttttctaaaatcatttcagcatgatatgcaagtgagggataaggcattgttacttctggattcatggcaagaggcatttggtggacctggtggcaaatatccacagtactactggtcatacattgaactaaagagggcaggagtaatgttcccacgacgtcctgtagatgctcctccagtatttactcctcctgcaacacatcaggcgtatggttcacctagatatacttctggaagtctaaatgagagaatcacatctgatgctggaacattgagctttgagggtttgaataatattagaaatgcaacggaacttctgtgtgatatggtgaatgctnttgac

SEQ ID NO: 31232 - DNA, 606 bp, Sorghum bicolor
  unsure (1)..(606): unsure at all n locations
  Clone ID: 18065605
gcacgaggcttttcccctctctctctctctgctagggttccccgtccgatcccccctcggccgcatcaggttgagcgagcgttgttggatttttgtgcgacgacggtggtgtgttgattggatgttgaaagaattgtagctgtttgaggcggcaagcaagaggccgcggaagcatctgcgtcgagccatggataaggggctcttcaccaacgacggctccttcatggagaggttcaagcagatgcagcaggaggcgcaggagaaggagaaggccgctgcggccgctgcctcatcagctcccaagcatgcgaaccccaagcaggggtttgctgttgcggcaaacaagcggccattcgagctgaagaaggctgctccggtagcctcgtctggtaagctggcctttagcctcaagaaggccaaagtcgcggttgcacctgtcttctcagctgatgatgaggacgaggatgctgcggatgtggagagggaggagcctgccaagcgccaaaaatctgtgcaagctgatgctcctgtggcagctgccccgntctggggctgttgccccacccccatcanatgatattacagtgagacaagtcgctgacaaat

SEQ ID NO: 31233 - DNA, 493 bp, Sorghum bicolor
  Clone ID: 18065608
gcacgaggccggagccgagggccgccgccaaaaaccgccctcctgccgatgctcctatccgagaggaggatgaggacgaggaggaagacgatgggcatatcaagaccgacagcgacgacgatgacagtgatgaagacgacgatcaccatgagcatgacgatgttaatgtggacggcatggtgcatggacagcaaccaaagcggattttgatgagtattgtgggatcttctccagtaacaccacctctgcctccaaggctgaaccagaccccaccaacgcctgccaccgcaacgccaccgcctccagtactggagtcacagatggctacctgggattacttctttggcccaactcccaccccaccacccaccctagagcagcctgctgataatactttgtggatggaaaggcgtgataatgagccagtggctgaggtgaaggcacctgtggcaaaaccagttgttagtgagccagctgctactgaggaaaggcc

SEQ ID NO: 31234 - DNA, 584 bp, Sorghum bicolor
  Clone ID: 18065618
gcacgaggagaaggtctgccgcagattgtagtgagagcgattcttgcacgagtgacactgacatggtagagcttgagaaaagcaatattcttgtcatggggccaacaggctcggggaaaacattgctggcaaaaacactagcaagatttgtgaatgtgccctttgttatagctgatgcgacaaccctcactcaggctggatatgttggtgaggatgttgaatctattttgtataagctcctagcgcagccactgcctctcagacgtcctccagtgttgtttatcttgtcatggacatgggatgggaatgggacatggcatatgaagtatgtgaagatcttaaagatttatataaagtataaacattggatgtctccaagccaggctgctgattttgatgtagctgctgcccagcaaggaatcgtctatattgatgaagttgataaaataacaaagaaggctgagagcatcaatcttagcagagatgtttcaggtgaaggtgtgcaacaagcactgttgaaaatgcttgaaggaacggttgttagtgttcctgagaaaggggccagaaggcacccaagaggtgac

SEQ ID NO: 31235 - DNA, 547 bp, Sorghum bicolor
  Clone ID: 18065619
gcacgaggcaaacttcccttttcccaggagccggctcgtcgccatcctcctcgttcgtcgccgactcgccgcctccgcctgccgccgctcacttcctcccccatcctccacccagggagaaggatgggctccgaacccaagaggacggaatcgagtcacaccacggaagaggagacgggcacgcatttgttcaagattatcgggtacacgctcacgaagggcagaggcgtcggcaagtccatccggtcgggcatcttcaccgtcggcggctatgattgggccatccgcttctacccggacggatctaccgaggctaccaaagattctgtggtcgtctcgcttgtgctaatgagcgagaacgctgaggtgcgggcgtcctatgacctgagtttggttaaccagaccacagggttgccagaaaatgtgttccgggaaagcacctttagagtgttcaattcttgcaagggaaattggttcaccccaaggatcatcataagcaaaagaaataagctggagtttaaatcagctgactacatcgtggacgatt

SEQ ID NO: 31236 - DNA, 581 bp, Sorghum bicolor
  Clone ID: 18065623
gcacgaggggatgaggatgagtttggtagcgccaaaggagaggaaaagagcaagaaatctcatgacaagcgtttggattcggttgcagtggaaaagaagggggtaaatggaaatcatatcgcggctccactggactctgcttccacggagaagcaggctgacctgagacagacaaatgggatagggaatcatcagcatcatactgaagatagtgaatccaatggtctcgagaagctagaacaaagtaacatgggcaacaagcgaggtggacacactgctggaaagaaaccgaggcatggcgagagcaagcagcagaagcattctgcagtcaagccagtgaatcattgtgaggacaacattggtgtcaaggaggaagcgatgaaggatgtcaaattggtgtttggagaggacatcaggtgtgctcggatgccagttaactgctctctgtcgcaactgagagaaatagttcagaacaagttcccgtcattgaaggcgtttctgatcaagtataaagaccaagaagaagacttggtgacaataacctcgtccgaggagctaagctgggcaagcaatctggcaga

SEQ ID NO: 31237 - DNA, 582 bp, Sorghum bicolor
  Clone ID: 18065627
gcacgagggtcaatgcgagcggccacgacgtgaccgcggcgctgctagaggacggcgcgctcgcggggagcgttgccagcggcatagggtacggcgcgctcatggggagcgttggcagcagcatagggtacagcgcgctcatggggagcgttggaagcagcatcgggggaggccacatggaccccatgcacatcgtggggatgcgcgcgcacgccgcggcgcacaggcatagctactcccacgggatcggcccttgtgatgacggtcacaatgggaacgatgaggagccgtcccaagctcgtcatgtggttgtctcacagattcttgagcttgggattgtatcacactcggtgatcatcggactatctttgggcgtctcacagaacccctgtaccatcaagcctctagttgctgccctctccttccaccagttttttgagggctttgcattgggcggctgcatttctgaggttaatatctggctcagttcaagggtttctctacactccttatggctttcttcttcgctatcacaacgcctactgggatcaccgtgggggcaggtatcgcgtccttctaaac

SEQ ID NO: 31238 - DNA, 613 bp, Sorghum bicolor
  Clone ID: 18065628
gcacgaggctgagaaggaaaagttatatgcatatttgaaaacagtcacatgtcgttttagtactaccatggacatatggacatcatgtcataacaagtcttatatgtgtgtcaccttacattggatagatgataattggcatattcaaaagagaattgcagctttttttcaagtagagggacgacatactggtcacaagttggctgagatttttactgaggtcatggttaagtggtttgttgagaagaaattatttgccttgactttggacaatgcatcaaacaacttggtggctgttacagatttaattgatgaccttacacagaatggtaatgcgtctttagtttgtgatggcatgttttttcatattagatgtgcatgtcacattctcaacttagttgctagggatgggctagctgttattaacacagctcttggaaagatgaaatcattggcactaaccgtgaagggatctcccttgcaatgggaggaactcatgaagtgcgcaagagagtgtgggttggatacttcaaagggcattcagcttgatgtttcaaccaggtggaactcaacatatttgatgctcagggatgtcttgcattacaagcctgct

SEQ ID NO: 31239 - DNA, 267 bp, Sorghum bicolor
  Clone ID: 18065636
gcacgagggttttgcgccaactacacaagttaccttgggcagaatgtcaacaataccttctgaagtgctttctaaaggttcacaaaggaaagaacagccaggttcatctgattgcgcttctcactgctagtctcagccgctatcacgatgactttgctgtcgcagtggtaaatgaggttttagaagagataagggttggattggagttgaatgactatgggatgcaacaaaggcggcttgcccacatgcggatccttggagagctat

SEQ ID NO: 31240 - DNA, 531 bp, Sorghum bicolor
  unsure (1)..(531): unsure at all n locations
  Clone ID: 18065644
gcacgagggtttatacaaaaggtggtatcgttgcacaagtgaaggaaccaaaggttctacgtttcaaggcactaagagatgcaatgagagatcctggcgatttccttctgagtgatttttcaaagtttgaacgatcacctgtgcttcatctagcctttcaagctctggataaatttaagaaggaacatgggcggtatcctaccgctggctgtgagcaggatgctcaaactttcctcaagtttgctgctgatattaatgaagcatctgttggtccgaagctggaaaacattgatgaaaagttgctctgtcattttgcaagtggttctcgagctgttttgaacccaatggctgcaatgtttggtggtattgttggtcaagaagttgtgaaggcatgttcagggaaattccatccgctttaccagttcttctactttgattctgttgaatctctccctacatatcagttggatccccaagacttgaagccttcanatagccgctatgatgctcaggtctctgtttttggttccn

SEQ ID NO: 31241 - DNA, 421 bp, Sorghum bicolor
  Clone ID: 18065659
gcacgaggctcggatcgagctttgtttggagaatcactcacgatcagctgcagctgataacacagagaacagcactttagccaagagtaatattcatcatgatagagcccacagttcagtagaatttgccctgacatttgtacttgaccatgctctcattcctcacatgaatgtagctggtggagctgcctggcttccatattgtgtatctgtgaaacttcgctattcttttggggacaacaatcatatagctttccttgctatgaatgggagccatggtgggagagcctgctggttgcagattgaggagtgggaaacatgtaagcaaaaagtttcaagagctgtggaaactgtgaatgggtctggtgtagctggagaggtgggccaaggaaggctgcaaatggttgccgagatgatccac

SEQ ID NO: 31242 - DNA, 558 bp, Sorghum bicolor
  Clone ID: 18065673
gcacgagggtcatccccaaagcaaagatgactacatccattgcgatagaggatgtccgaagggaggttaaaatcttgaaagcgttggcaggaaacaaaaacttggtccaattttatgatgcctatgaagacaacgacaatgtatatatagtaatggagttgtgtgaaggtggagagctacttgacagaatactttctagaggtgggaagtactctgaggatgatgcaaaagctgtcctagtgcaaatattaaatgtcgttgctttttgccacattcaaggagtggttcatcgagatctcaaaccagagaattttctttttacatcaaaagaagagaactccaatcttaaggccattgactttggtttatcagactttgtaaaaccagatgagaggttgaatgacattgttggaagtgcttattatgttgctccagaagttctgcatagatgctatagcacagaagctgatgtctggagtataggtgtaattgcatatatccttctttgtggcagtcgtccattttgggcacgcactgaatctggcatattccgttcgg

SEQ ID NO: 31243 - DNA, 468 bp, Sorghum bicolor
  Clone ID: 18065690
gcacgaggctgaggttctttttttaggaatacaaaacatccacacaatgagagatagtctttctcgccttagggactatgtggatgctcatggctcaatttcatcaaatggaagcccttcagctgtatctgttgttggagatcggaggaatcgtggatcaacctggggtggaggcaatctaaatagcatgacatcattttcttcaacactgggggaatggctaaaccatatccagaatattctggtcggtgcttcatggattgctgcacaaatttcagaagaagcagcgtcagttcttgtacattgcagtgatggatgggaccgtacaacccagttggttgcacttgcttgtttattgcttgatccctattatcgaactttcagtggattccaggctcttgttgaaaaggattggttaccatttggtcatccatttgcagagagaatgggagttccaacagtagctga

SEQ ID NO: 31244 - DNA, 493 bp, Sorghum bicolor
  Clone ID: 18065695
gcacgagggaagttggtacaaaagtgggggcctacatgagaacattttctggcgattgctcaccttcagatcttgagacagctttgcagcttgtttatcaactatttacaacaaatgtggagccaagggaggaagaagtaaaaatagtgatgcaaatggcagaggaagcaatctatgctcaagagcgtgatccatacactgcatttgcgaatcgtgttcgtgaaataaactatgggaactcatacttttttaagccaattagaataagtgacttgaagaaggtggatccaatcagagcatgtgaatatttcaacaattgtttcaaggatccatcagcttttacggtggtaatagttggaaaaatagacccagctatctcacttccactggttctgcagtacttgggtggaatacctagggtacaggatgctactcaaccacttagtcgtgatgatctaagaggattgccattcaagtttcctgcaaccatcat

SEQ ID NO: 31245 - DNA, 513 bp, Sorghum bicolor
  Clone ID: 18065701
gcacgaggctcgggacccgtttggcacgactcacaggtcgtcagcctcgtctgttcgcgacctcgcatcgcacggcagcgatctccgtcagtgcacgagctttgccgacggtgagcgacttgctgcttccgcggcatcagcgccgacacgcctgggaaccagaagatccacttcagctagcctccggagaatcggagcccgggaggaggggtattgttcgtctttccactgcagttttcagcagatggaaggcagtcagcacaacatatttgaagcgattgttatcaggagaaatggagaagactgaacaagaaaaacaagctaggttcatcggatcgaaagccctttcatgaatgttgaccagtgcaattctataacaaacctgtcttgaagagcttggcgagccattgtccggcttgaaaccaggaggacaccatgggtagaatgcagatgctttgcagtctctgatgcccatcacgtcaggatcacgaatggatgtggcagaagaggctg

SEQ ID NO: 31246 - DNA, 277 bp, Sorghum bicolor
  Clone ID: 18065722
gcacgaggtagtggtgcaaaacaaaagaaggttcccgtgtcaacagctaagcaaacagctagcttagacgacccctttgttgttctcgaaacaacttcatcctcagcccatccgtttgcagatcccttggatgaatttggtaaagctgcaaaatatcaagggaaaagccgtgaaagtactagtgttgagagcagtctggattcaagcactttcaaccaggctccaaaatctgaacctttttttacctcagaagtggacaatggctcaaaaggtagga

SEQ ID NO: 31247 - DNA, 322 bp, Sorghum bicolor
  Clone ID: 18065725
gcacgagggtggacctcaacgcgctcaagtccgccgcgtgccggagatacggtctggcgcgggcgcccaagctggtggagatgatcgccgccgtgcccgaggccgaccgcgccgcgctgctgccgcggctgcgcgccaagcccgtgcgcacggcgtcgggtatcgccgtcgtcgccgtcatgtcgaagccgcaccgttgcccccacatcgccaccaccgggaacatctgcgtctactgcccgggcggtcccgactccgacttcgagtacagcacgcaatcctacactggatacgagcccaccagcatgcgtgccattcgggc

SEQ ID NO: 31248 - DNA, 611 bp, Sorghum bicolor
  Clone ID: 18065782
gcacgagggtgaacttgagcaatatgcttcaactttacgtgaaagtggtggacccttatctccaagtagaattctttctaatctgaggaatattggatgtcgcttgggtggtggaactcaggaagatgctcatgagtttttaaggcatcttgtgatgtctatgcaagcagcttgcttggatgggctgggtggtgagaagcacgttgaaccaagtttgcaggaaacaacactgatacaacagatgtttggtggccgtcttaaatccaaggttaagtgcctcagatgctatcacgagtctgaaagatatgagaatataatggatcttactttggagattcatggctgggtagagtccttgcaagatgctttgacacagttcactgctcctgaagatttagatggtgataatatgtataaatgtggaaggtgttctgcctatgttaaagctaggaagcaactgagtgtgcatgaggtgccaaacatattgacacttgttcttaaaagatttcagtcaggaaaatatggcaagatcaataaatgtgttactttccctgatatgttggacatggttcctttcgtgactggatctggtgacaatccccctctttatt

SEQ ID NO: 31249 - DNA, 468 bp, Sorghum bicolor
  Clone ID: 18065783
gcacgaggcatcgattcaccagcaaaaatttctcagcgccggcctcacggcagaccggcctctgtatcactgcgcaaccgatggcttcctccccgtggccgctcaccgccggtgccgcccccgtcccgccgccagaagcagcagctgctgctgctaccgccgccgccgccacccccgccccgacgtcggagcagcaccgggttaaggaggaaggaaacgctgccgccgcggctgtaccgaagcaggaggaggaggaggaggccaagccccacttgccgcgggacgatgactcgtaattgcgatcccccttgccatgcgtcgcttctctgttaccgcaatgcatgctctgtccttgcgtgattctcgatagaaacgctgcttcacttacggttatattgttgttttatgcgtgcacccatagggctatatgggatccgcgaacacgctgttgtatacttgtattagtcg

SEQ ID NO: 31250 - DNA, 395 bp, Sorghum bicolor
  Clone ID: 18065785
gcacgagggcgcctcctcgctgtcgcaactctggatggtaggataaaaatattcggaggtgataacattgaaggcctccttatatcaccaaagagtgtgccatacaagtttttgcagtttattacaaaccaggggtttttggttgcaatttccaatgaaaatgaaatccaggtatggaatcttgagttcaggcaactattttattcgtcccagtgggacatcaacattactgcttttgcagtcatagaggggacctttatgatgtaccttggagatgagaacggtcttctttctgtattgaaatatgatgtacatgatgggaagcttcaaataatgccatacaatgttcatatccattctttaatccgtattacctctacgcctttcttgcccaa

SEQ ID NO: 31251 - DNA, 597 bp, Sorghum bicolor
  Clone ID: 18065815
tagacatggcatggcaatatggcatacttcattccatgcatgctggagcattgccttcatccgcaagaagcatgtaatcatcggttgactaacaacgataatttgttctttaatgtttttcgtccaggctgagaggctaacagtgattgtaaaattgcaaaaatggcgcaagccgtttcgttcttttactgcagtgtggaacaccaaatcgttgctgcagtccttttggcagcctttttgttcttttcctgcggcacatggtggaatgctaaggcgtgactgtggtcctaagaacctatggatctgctgaggtcttttttgtttagagaaggtccttttggttagagaagcttagtgatgctaatctgaccagtgcattgagctgggaagctgggaagtttcatgactgaaagttcttctgcatctgctgtctctagtccaaagttcttttgcatcagctgattgtgtttcattttcttgaactttaatgtggaatcaagctttctgtttagatcaataaatttgtgtctatatgttagtatactaatttctgacgctagtgaaagtgacttttgagaaaaattgggaaaacttttg

SEQ ID NO: 31252 - DNA, 573 bp, Sorghum bicolor
  Clone ID: 18065830
acagttctcaaaggccgcgtgtacaacattgctccatacatgaaatttcatcctggaggtgttgatatgcttatgaaagctgctgggaaagactgcactgctttgttcaataaataccatgcttgggtaaatgcagagttcctcttggagaagtgtcttgtcggattccttgatcccaacgagtagatctgggggttcaggccgcatggcattttatcacttgatgcacaccctgactgtttgtaggcacctcagtagatgaattaaagaatctaaatgttctattgtatcaaaacgggaatacattgattcaattctgtttcaaaaaggaaagcagaattgttatggagatgagaaaatccagtccaatattggtatgtcattacactacgaggtgaattgcaacacctgatggaatacatgccacagctatgacatcgtcaagatgaacgcttgtctgtgtagaaaacgagtggttgtttatatatgctgtgttataatcctttccgactactgtaatatgcatatatattgatttttcatattttttttcacaactggaaactttcattt

SEQ ID NO: 31253 - DNA, 590 bp, Sorghum bicolor
  Clone ID: 18065839
tgtccaaatagcagaggttgtcagctgttcagtctgccttgatgatcttgagctggggtcccatgcaaagcagatgccttgcgagcataagttccactctccttgtatcctgccatggcttgaactccatagctcctgccctgtgtgccggtttgagctgccatctgaagagacgaaagatttgaatgagcctagcaatgtcgacagaacagagagcccccaagaggaagtcagggctgatggccctgaaaatgccagtgagagcagtaacagagcatgggcccttgttccttggttcagtgggctattctcaacccctgaaccgcaaactgccagaggcgctttcaccgatcaacagactccatccgcttttggaaccaacccgaatgctggggaaagttgatttcttcctcctttgtgaataatgctcatacatctaagaatagcaatgacccttgtcagtagatgacttatttttctgtactgacaatcattggatggatcgcaaggtacaaagtttgtggctgttctgttttgccaggattttagcgatcatttcacctttaattaatttcatagctactgagcct

SEQ ID NO: 31254 - DNA, 608 bp, Sorghum bicolor
  unsure (1)..(608): unsure at all n locations
  Clone ID: 18065845
gggaaaggagattcctgcctcctgcagggtacaacaaggcagggtacaacacggacttaggctcagatttctgctccagatcacccgctgaatattcagcagagcgccaacaagtaaggtttgatcccttcacaggtgaaccttacaagtttgatcccttcacaggggaacccatcaggccagatccaaacccgcgccgctcaggaagcttgtactgatcagattgtttgaagcgatatgccggataagatcctgaaacaaagctagatctggataactctcttcttatctgccaagtgcctctatgtgatgttgcttctggccaacaagatcatgtatcccgagcaccatgcatggtccagtagcacgctttgtttatatttgatgaaccatcttggcactgaattgtcataggaacttttgtggccatgacgctacttgttgtttgtaaaacattcaagaatacctttttgatagatcaattaaaaattcaacaacgtgaacatggggaaagctattttttggtattttcttaaggtgtcaataaagtaggtgtgtcaatgcagagtttcanaatgctacgtatattgcaagcggatattttaccg

SEQ ID NO: 31255 - DNA, 425 bp, Sorghum bicolor
  Clone ID: 18065850
tggccaagagatgcgccgtaactgacatgggagaagggttgctcctggggtttctgtacagcatcttcatgtccgccgtgcagctgtttgcaccctgccccatggccgcgttttattacgagtgtaaggggagcacgacggaggcatcggcggtggaatacgtcaaggtttctaccaaggagcaagttgatgcttgattattagtagctactctattctgtcaccctgatgtgcactgtgcatatatcctgttaatatccatgttacttgactggtccaagtcaagcgcttgctcgtaaggcagccaacgtattgtactttatttttttatcgcattcctcggctctatggtcttgtattaattaaggatagctcaactaaatcatgagctacagcaacatttatgagtagaaagtcatccgtcc

SEQ ID NO: 31256 - DNA, 541 bp, Sorghum bicolor
  Clone ID: 18065851
tggagcacgagctatgaagttgttctgactctagacaaggagaagcataaagttgacgggccaatatactactatgtattcaacagtcttctcttctcgctacttgttctacacatatattggtgggttttaatgtatcggatgcttgtgaagcaaatacagtctagaggacacgttggggatgatatacgatctgattctgaaggtgaagaggaacatgaggattgattgagctgtgtaaagtctggaagatgataaggatcatggggattgattgagctgcataagttccaaaggtgaaaaggaacacatggatggattgagaaggtgaaaaggatcatgctgtactgcagtatcagatcattatgctgttttccttttgtattggttctgataagtaacaatacattagtgcccttctctaggtgagcatcatcgatagatgtcacttgggaattatctattgatgtaaaattaggttacattgtatagcacacacacaacttaatggaaaacattagcagtgcgcaaaaaaaaaaaa

SEQ ID NO: 31257 - DNA, 626 bp, Sorghum bicolor
  Clone ID: 18065859
gtgccaggagcaatccgtaggtgatatctcttgtgatgaagatactcatcttggatattcaacaagtattgcaaacctgagtataacttctactagttgcaagtctccaagatctaagcaatttgctgaacacaagcatgaatgtggaggtgcccattgggcggctgttttaccaactgatgtagttttagctggacgaataatggcacgcagcatagaaaaaatgatgctgtctggaaagaggtttgctatctccggcccaaatttggatctagttcaccattatgatcaacattctcctgccaacaagttggaatcacagatatatgcaattgtcctattgttatgcctccaaaatcattatagatcagaccttttgtggacagaagattctttgtcacagctggttcttttgatatttcaaattaaagtcaattcaattgctattgtccgagtgaggtctgtggatggaagcccagagctcacagtaaatagaggtgtttctggagctgaaggtgcaaacatgtgtagtgtggagcaggtcagggttgctcaagctgtttatgtatctggtagcctgttcaatcactcatgtcagcccaatgtaccatgcatatttctttcgc

SEQ ID NO: 31258 - DNA, 565 bp, Sorghum bicolor
  Clone ID: 18065864
agattcctttagtttctgttggtgatgatggtaggttatttactgttggaggcaatgatggaaaaaacaaatttgaattggtcaacagagaaaagaggaagctgacactttgcgatattccattgtcccttacatgcgcgcttcataaagatagtatactagcggacccaacttctgaagaagaatcgataatagagacctatgtgactgttgttgtagattcttcagatcgcctagtgtcattacagaaagttggaggagcagtgacatccatggcgactattaaggagtgcattagcttggcgaaagaaagaagacagagcctaagagaaattctgatagactctgtcaaagccatggaagtcgaccaaactgaataattctgcaaatagattcagttaatctaaccgcattatttcttgatggcttctctctgtctcggctgcactggttgtaacggcagttttgttgacttagtccaagtatgtagctatttgtactctacagtcttcacagaattcttcacttaagcagcctgacaattttgtttgatgagcatgtctgc

SEQ ID NO: 31259 - DNA, 522 bp, Sorghum bicolor
  Clone ID: 18065869
acagtatggaggtgagggtgttaggtatgatgtagatccctcatctgttcatgaagtgtttagaaggatgcaggatgtgtgatcttgcgtgacatgaaagtcaggttcctgatcctttgtctatctgtaaccttggtgaggtttttttgtcatgctagcatcctttgtcacacattgaacataatattacctgctacagagaatgcaaacatcaggccagatgatgacgatgaaggatgctgtctgtttgtatcaagaaacccaataggcatcagtaaatgccaaggacattgttctctgcaattttctgagcaaggagcagtgatgcattggaggtgtcattgtacaattacaacagcaggcaatgattcggatggttttctgatggggatagttctgtagttacatctagcaatcatgtatgttttaaggggtttagacgtttagtcatgtgaagaaaagtgaaggtgtactaatcacgccctgagttgatagttcctcagaagttgatagttccttttt

SEQ ID NO: 31260 - DNA, 526 bp, Sorghum bicolor
  Clone ID: 18065875
ccaaagcccaagatgaagaagcatttgcatctgaaagctctgtttgatagcttgaattgacgcaaaaaagcaagaaagagctaaaaggatggaagaaaaggaagtctatgtgcaactgtatgaagcagtagaggcgtttttccacatggcaaattcgatgctggatgaaccgggcctcgagatcaagcgctcaagggcagtcgagcagctgtctgcaagtttcctacctactgcaagggcattcctgcagagtttggttgtctggtggctgtgccaactgcaagcgaatgtagcaactccttgagttgcattcctcgcatgtattctctcctgtgattcagtaagagttagagctttgttaggcctcaaaattattcacagtttagagcgtagtcaacaccaaaactattgctgtagctactcttgcttcttggccaacgcaaagttttttgtgactttacattctgatacgatgatgagcaaagtttttgtgacttcacattatgataataatcataagatggtc

SEQ ID NO: 31261 - DNA, 209 bp, Sorghum bicolor
  Clone ID: 18065902
cctgtatcagccccagggcgcccagctttgcgggatttggggggttttagggcggggaaaagtgtttttggaagcaaagtccaaatagttcagggggggatactgggaggtatttgtttccccgtttttgtgaggtgtttaaacccggaaaagaaaattgggggatagggtaggggcccatatgccaagcaaatgtttttcaaaactgt

SEQ ID NO: 31262 - DNA, 662 bp, Sorghum bicolor
  Clone ID: 18065913
acatccaaacatgaaattgcaaccgaaggtgaagaaagctaaggctgcatctgcatctaaagctgtgaagggtccgtgtattgatcagaatgcattacatttgatgaggggcatgacatccacacgaagaaaagatctaatggagtgcataaaacagcaaaatgcaaagcacgagtctcgcagatgccctgcaagtgaccctctggacaaaaagaaaagaaaggtggttcttcagtactaggtattactaagttggatgccaaaatcttgtactactgtatatcctttcttttttcttttgctactctttctctgtatatcttggtttagcatccctgcggtcatcagctgccccctaatctaattttgctgtcatagtcttcatggctggctagattggttgccgccttgcagggtatatgagagtttcagagttattagttaatcaatcttttaatatttctgcatcctgatgttttgtcacatgcctatgtggctatgttatgtgattggcacctgtaacaactgcccgttttgtgtagtaggtagcactactaggacaggacagagcttatcctgtatcatagctagtgaaaaatatcagtgctgtaacaaaacagacaattttcttatatggaatttctcaggaaaaacagtgtttg

SEQ ID NO: 31263 - DNA, 520 bp, Sorghum bicolor
  Clone ID: 18065919
gctgcaccgaagaaaacttaaggtttgacttggacgatgaaagagtcattgtcctgaagtaccagaacgcaaagcttgccacatcccgggtcctcaaacggcacaggataccgtcagccatatcgagtgaccttgtcgaagatgaaccaactaatggcgaggttgagacatcatgcaccagctaatgcgggcctctttttagacctagttagggagttccccgatgaagcacggttcaaggagcgagctgcattgttggcgtggcaagcgcatccacctgaagtacatggcttcacttgctcccttttgggcggcttcagttttttgacgtaaggagtaagattatgagctccggagcttttcggcctgaatgtaacagtaacgtaatcattcttttttatttttactaaacattcatttttgccatcgttggcatggcgcacccacatggtctgtatcatcaggaaacatatgtacagcacaggaaaaaataatgttgaaaaggaaaagagtgcagctc

SEQ ID NO: 31264 - DNA, 649 bp, Sorghum bicolor
  Clone ID: 18065923
tgtttgctaccgatttagcctcattgctgtgccttaacaagctcacacactgtctgccatcaatacttggtaatttccattgagtcattattaaccataaaagaagtttgctacaccgaaatgttcttgggatttctatcttaatttaatttttcatatcctccgtaattgtactcttatatgtctggtattaattttactgcttgatttaggggagtagatgattgtgggcagaaaggagtttgctacaccgatatgttcttgggatttctatcttaatttattttttattatttgcagattttgtttttgtggatatgaatttcgtgataatttatgccattatctaatcagtttagaggactgaaatagaatgtaacatctgcaacggagacctgaggaataacatgaacattgcgaaccaaggtagcactttctcgacaacaagccaattgaagtgatcgtatgtttgcttatttagactccctagggatgatgaaatctttttgttcaaatgtagttgttcttagaattagttgtagaatgactgtcaaaacaaatggttatgagctagatcaattttgtactttgttgttcagtataactgttgtggacatgctaatacatgaatgaatcaatatttgtttgt

SEQ ID NO: 31265 - DNA, 172 bp, Sorghum bicolor
  Clone ID: 18065932
aggcccagttccctaatgtaggggttccaaaccccgttgaaccccatttatttttggaagtatcagttttaaaacttgtttaatttcgggttgtaaaattttggggtgttatatcggatgttatatagaggggttgtattgcccattaataaaaaaaattccagaatctgtt

SEQ ID NO: 31266 - DNA, 162 bp, Sorghum bicolor
  Clone ID: 18065964
gatcatcataagaaacgctagcagtgtatcctgtgcaatgggctccgtagatggtttatgatcagccggtatgtaaatctgttttagtgagcagttaaatctgtcaggaatctcgtgtgacccctaacacatggaatgataggatatgtgccttctttttcc

SEQ ID NO: 31267 - DNA, 531 bp, Sorghum bicolor
  unsure (1)..(531): unsure at all n locations
  Clone ID: 18065990
gtgaatcaagaggcacagaagcctcaacaagtatgtcaacagagaacacctctgtgtccatcaatgtcccaaagttggcagagggcattgaatttgggaggcaaccaatggttacatcctccacattggtagaactaacaactagactagatttcttcaaggagcgaaggtcgcaactgatggaacaacttcatagtcttgatttaggacgtggatctgctcctcagggttttccttacaagccaccctctccttggaaccacccaaggagaatagctccttaagtgggatgtgtgatagtcttctgtatgtaatgttgtcatggaggtgccttttagacaagttttttccagtgttgtggcggtgtatatgtattttgtgcttctcatagaaattggataggttgactacttgtatggccgtttgattcatgccaagtgcaaaggatgaggaaaactgggatcaaatgagaacccagcatgagtttataaataactcggggaaggctcgaggctgtgnttttatcctcgc

SEQ ID NO: 31268 - DNA, 581 bp, Sorghum bicolor
  Clone ID: 18066026
gaatttcggagcattaatgattttatactacaaaattgcggggcatgtgttgacaccatttttggacacgtatctttggacacgtatgtgggaatcaatgaagtatagatcagcaggcgaaagagtggtgactggttcacaaaggagttgcagatgggttatgatgccgatgatgaaatagcagaatgtggacaagtctaggagtggtgattgatctatgccgatgaccgatactggtggttgccgatggctatgaaaggtgattttccaatgataacaaaaggaggcgtaggaattgtcgataggatggtggtggtgtgccgatcggctgtggtggataaattaatgttttccatagttattagagtttgttttacatacggattccgttcgattaggaattagagtcctagtcgtgtctaattgtaactcttttggatagggtataaatgtagaccccgtagcaatgtaagaaacaatcacaatcaatcaaagacaagtttttacatctattccagcatctattttttcgacgactttgtcaactcgcatattttctttttacttacgagttcttagga

SEQ ID NO: 31269 - DNA, 497 bp, Sorghum bicolor
  Clone ID: 18066030
ttaggccactgacgatggaagacctcaggcaggcaaagaaccaggttgcagcgagcttcgcctccgagggtgctgtgatgaacgagctcaagcaatggaacgacctgtacggcgaagggggctccaggaaaaaacagcagctgacgtacttcttgtaggttaagcatttggctggtggtggaggaagaggaacagggcatgatttcagcattcggtggatcattacttggaacagaggaaccgactgagcatgatttcagcattcggtggatcattacttgagaaacagagcatgattccaagatgtggggcatagtagtagtagtagtagtctttgagatccatgagaggagattgatgatcaatttgtaggatcatgaactattcttttacaagcttttgtacatgtgcgctagactgccatctccttcgttttagtctattgtctatatatatgtatatttggattgattgaatagctcttccattcgagggtc

SEQ ID NO: 31270 - DNA, 541 bp, Sorghum bicolor
  Clone ID: 18066047
catcaacgaggttcaggttggagtttactttcctttggattgggacaggataagggccgctcgggatcatgagactcagtacaagatacttgaggaagaaggccaggaagcaaggcgcaagaaaggtgagctcaagaagaaaatccaggaacagctagctcagaatacaaaccaacccattgtgacggtgggctgagtacgtctggaacagccacaggctgattcgatgatccgtacaaggctgaagacgatcagagcgggctgcctgggagcaacagccaggtgggtccaaatccaatatggtacctacgtgggtgcgtaccgtaccagtgcatgtgccgccattccctgatatatatcatatatgtgctatgcgcatgcatgttgttcatttctgttttccaaaggattggtggtgtacgtgtctgtgcctgcgcatgttgtaaacaagtactgtatttgaatacagcctcttctacctatttcttcttggtttctgtattataaattgaagatgcttttacgagacaagaactccact

SEQ ID NO: 31271 - DNA, 378 bp, Sorghum bicolor
  Clone ID: 18066072
ttttggcccaactgactttgaaaatcaagcatttttcagctttttacacaaaaaggtttgcatgaagggaagagcagcccaattgaaggattcgtacataaagactcgtttttttgggggcgctaatgagttgtatgcccgtaatggcaagctaccccctagacttccgaaatttcaattgtttagaaccaatgatcagtggtcagaatgaactgtttgtaagcatgtgcttcaaattttgagaaatgaataacggagattccttattgtcgatatacatttttttacccgtattacggaaatgtctatatagggagtttgggaccctatgacgcaatgttctcggggattatgttaacttcccggattttgcttttt

SEQ ID NO: 31272 - DNA, 543 bp, Sorghum bicolor
  Clone ID: 18066076
acggtgccatttattttgatgaagctgacgcagcgagcttggaattgaggctgttttatcgaccatacacgttgtcatttactcactggcgtttatggaagggctctgcggtctttcggcatggcgttcagacagtggctggctgtttcttgtctcgggatctcatctatgaggataatatgtgaaggtgggagaggagaagggggttcgacggaagtgacttagtagactattctccagggagatgacgaacgggatcaagagatggaagaagtggtttgcttcggggcatacaacttggttggtgcatgctgaacagatccgtgtaaaggttttggggttcgtcgtttgcgtacacacgtacatgatatatcgcggttgccggacgaactaggatggcttggggccatactcaactttggtgctctttgtataactaggactgcaactcctccatatctcacatcccatgtccgccccgaggaaaggtggtataacgatagtgaacgactactacgtctagtctatgtaggtattgtattc

SEQ ID NO: 31273 - DNA, 520 bp, Sorghum bicolor
  unsure (1)..(520): unsure at all n locations
  Clone ID: 18066089
actttctgctgtcaatntgatacacatgttgcaatgattatttattgaggttttgtcctctaaaatgttttagcattaggtactgcagatgctcagctgaacagggacagtgtatgccattgttaagttgaatttgtctacatgaggacttctgtatcttattaagcagagtgatgcttgcaactcgcaaaaatcagctggataccggaatcgttcaagtagccccaaaggaaaaaaaagggtacgaagggaggagtaagtgaaatcatggaaggtactatagtcttttgtcggtcttgctcttgctatgtaaatttctgacatccttctggtgactgctttagaaaaggttgagttttgttaaagtgtgtagtttgatggatataattttgtcagatgcaatcagttatgtttggtctttggatgctagggacttccagttagtttgtatttaaacatctcttgttgtaaatgaactaaactgttgtgtacattcggcagactggctaaatactgctat

SEQ ID NO: 31274 - DNA, 396 bp, Sorghum bicolor
  Clone ID: 18066099
cccctttactcagattctagaagattggcacaacctgccgaaatgctgctacctgtttgtttaacagctaagtctgttctttgttacttctctaatatgttccgttggtgatgcttgcagttctttgctcaactcaaccatattaatcgaaagaatggtgcccttcctgtgcatgttcgtcaactcgtcagtttgttgattggaaactttgcccatctaattatggttctggaccattaatgatttttgtatttaattggtaaactgagttatatatagaggtaatgataattggtgatctacatacatgtttgatttatcctgttaaactactagtatcagaatttacacaagtggtgctgaggctgagaaactagccatatgtatggcatctgc

SEQ ID NO: 31275 - DNA, 451 bp, Sorghum bicolor
  Clone ID: 18066116
cagtggctctagaaggaactcacaatcccaggacagacccaaccgacgataccgagcttctaggaaaggattctgatctgactccagcttcaccagctgtggcaccgcaagaggctcccaagccagacccaaccgatgatactgagcttctaggaaatgagaagcctgatctgactccatcttctccaggtgaggctctgcaagcgactgcggacccagattcgacgctgactgatatttaggctgtgtgaagctgtggcatgtaaacgccagacctgtactctgagcaagtgagcattcaccttgctagtcgtcggttactttcccctggcttcatctggagaggctgtagtggcaaacattagtccttagtggccactttctcgtctttttgcctcgtcctgatgggaactatgtaaatccttgagaacaatgttatcccgtctcccgt

SEQ ID NO: 31276 - DNA, 416 bp, Sorghum bicolor
  Clone ID: 18066145
ctcggaaaccaagacactgaaaaatgtgaataggaaaagtgcacaactgaagatagttgatcggagaaggatgatcaaggtgcttttgcctctacaagctggacaacggatgctcttttggtttctcggtactttatatatgtactctctaatgatcgccagtgtatttggatcggcattttaagctaccgactatagtgtttggtagtcatgaataccgatcgtggactgtaatgacatggtatgtgatgtatggctagatagaaccataatggctacagaagccgtgcatatagtgaacgattgtgtagtatgtgcttgaacaggaccataacggctgtgaagccctcatgttcgttgtttgtggatgctccatttcttctaagttaaaacattagcgaataaatgtgtttggt

SEQ ID NO: 31277 - DNA, 578 bp, Sorghum bicolor
  Clone ID: 18066151
gcctcttggtattgcgttgcatggtatcccatataccggatacctgatggaaaatttcaggctgcattcttgacatatcattctattgggcactggattcatcagagcagctcagcagacggggctgttgttttgccagtcataggcctgcagtcttacaatgccaaggcagagtggtggtttgagatgagcaaatccgattctgaaggtgccgagtcagcagagcatcagtccagtgaagcatcccagattctgaaggagagattgcacacgctgaatgagtctgcggcggtgatgtccagggccagcgtgctgaagaatgggcagatgagtagaaacaggcaccccgactacgagttcttcctctcccggagctgatagatgctggaggtcgatatcatcatgtcatggacctgtccgagactccggggccgccgatgaaaatgacagtagctaccactagaactgatgtgtacgtacgttgtctagctttggaagggctagcttttgcaagcgctggtcttccatgtgcaacctgcttaccttgtatatattatcatgatatcaattctccatgg

SEQ ID NO: 31278 - DNA, 505 bp, Sorghum bicolor
  Clone ID: 18066164
aaattacttgctgtggagttcttacatgaagaggacgcagttttttgttcttctcctatgcatggtgattgcacggaccatgacagagatcaggagagaagatgtggctgggcttttagtgcgacggagaataagtgaagcaagggcagggcagagagactggggctcggtaatgcttcctggttcgctttcgccagatcctcatttgcagccttggtaccggaacgcagctcaggttttgagctctgtggagacaggaccaatgcttgcgaagtactcacctgctgatggaaaggacatgttgtacaggcaagctcttataccctgaagtcctgatagagattattaccatcaggacttgcctgatagataaaaacacacacccaatcttcctgggtattgcagggaaattatttcatttcctcaatgctatgacataggatctttgtacaggacaaattttgtgtttgagctgttgtttcactaatggtgatgggtctttgat

SEQ ID NO: 31279 - DNA, 594 bp, Sorghum bicolor
  Clone ID: 18066169
tgtgaaacgatgaaatggtggggcacaagcagcgacacagactgtgtgcctgccaaagatggaagccatgaagcccatgatttaacaacgcatgagccgtcaaagggcatgactgatgatgacgagttggactggggagcagatgaagcagaagcggaagctgaagctgatggtgctgttacagcagaagcgtcggcgcagctgtgctccctaagaaggaaagcagtagatgatggacgcaagctattgaatggcggcaaccgcaggggccaagaattttctaggctgaacaaaaggcagaagctagtgctggcccaggtatttggggcttcactgccagatgttgtatttcttgtgtctagtgagtgaagggcaactgtagctgcgttttccctccctctccaggtcctcatgtaatatgacccattattagctagaagtgtgaaatcttctcattggattcaagaatggcaggagcttgttttgtcttcctatcatacaagtcattgctgccgcttttctctacgtattttctcttatctccccatgtgtgtacgaggagagcaccttatgttatatatttgaatgcacgcc

SEQ ID NO: 31280 - DNA, 666 bp, Sorghum bicolor
  Clone ID: 18066171
accaaaggttttgaagaagcggagagaattatatgatgagatggaagtgttggactatttgtaaaaccttgagaaacttatgtacataatagaaaacattaattgtcgtgagaggtatcgtaccagacaatttgggtggcagtactgaatgcaagatgctacagagagagagatatagatcagaaggaaggttttgtcactatggtcttaaacaaaattggcaaggtggcgtacatactgtctgaaccttcctgtagcaagattgatcctgtgatccatgtctcgcagttgaaccaacaccggaccgggcctgcattcctggggacgagaagcatgtgtctgttcattataaaaagttagtatgtgtctgttcctgtgaagattctgcagcaactattactccatgtaagagtaggtataatagtagatttataggcaagctaatattgatgtggagaagagaataagagaaaacaggagagagatgatagcttgattatataagtacgtaccaagctgggcatagatacataggtagttgtgggtccaaatagcaagtgttgtgaggagaaataaaaaagaaaaggtgttttagagacaagtatgagacaacttattgtataacttagctccaatcacttggtttatagtcaagcacttgattct

SEQ ID NO: 31281 - DNA, 279 bp, Sorghum bicolor
  Clone ID: 18066175
catggaaacacaacatcttcccacgaggaagaacatcattcatgccctccaaatcaggtccacactggtcatcgaggatgcgttacatgatgagacactgcaaaatagaattttgacaggaaactttgctttctgctcaggagatttgcttggaggagggtatcatgtaggagctttatcacgtgaaatagggtaacataggccctactattgttttgttcattattttcttgtaaattgtagattactattgctctcttttgtcctttttacccctgt

SEQ ID NO: 31282 - DNA, 601 bp, Sorghum bicolor
  Clone ID: 18066191
tgtgaaaacaaacatagctatgaattattgcttctgcctggaactaacatctgtggcggtctccacatcagaaaacttgatgacaacacttaccagccaacaacatggcaaataaagttcaaccttgacagtgtcagtccaagcagcacctacaagttcagagtggctctcgcgtcttctgcactcgctgagctgcaggttttcttcaacgatcaggacaaggctcgtcctcacttcgccactgggctgatcggcagggagaacgcgatagcaaggcacgggatccacggtctctactggctgttcaatatcgatgtggctagtgcttggcttgtgcaaggggtgaacaccatctacctgaagcagcccaggagccagagcccgtttcagggattgatgtacgactacttgcgtttggaggggccgtgtggctgctaatcttttgtgtgtggaattgcgttgctagatgtaaatttagaactgcattcactgtatcaaccgaatgccaccaccagtttaaaactggcgccaataaccatggcttatttgtggacagcaatgtttttatctcacaacaattcagccaacaatactttcaggc

SEQ ID NO: 31283 - DNA, 686 bp, Sorghum bicolor
  Clone ID: 18066202
caagggggtgataatggcttgccagagtcacttgaagatgtaaattctatttcatcagtgtctttagactggtgatgagaatgtgtggggccatcctctttgtcagtctcaatttctggatttgcagcaggactgcatctgttctgggatgaacttccctcatgagcctctgtgttttccgcatggtcttgttcagcatcctgaagttgattgcttttgttctggagtacagaagcattcatgggtgccacatcagaattcccaacagaagatgccttttcaatgactacctcattacaaacatcacttgtaacatctattttctgtttcttccgctgccgattagactcttcaccctgatgagcaaggtcatcaattgtggtttcactgacgctagtttgcttttctgatgagttactatgtccattcaattggccctcgctgtagacggctcttggaagcggtctagtttgctgctcatgttgcttgagcaattgctctgcaccaaggaaagcagctaggctcttcctagcttcaatatatgttttctttgtttttttgtattcttcagtggctttagcatagatgcatactgggcaatgtaactgtctagggtcttcaaatgtcaatgatgaaccaaaacagctgtcatgagcagataacaagcagctgctacattgaagcat

SEQ ID NO: 31284 - DNA, 538 bp, Sorghum bicolor
  Clone ID: 18066218
cagggcatcaagggcccgaaagctcagctgatgatcccatacgcaacccatctactacagttcactgaagctgtcttcaaagataggagcagggatgacagtgtgacaaaggctgcagttgctgtaattggggatctcgcagacacgcttggccagagctcgaaggatctgttcaagacccacctattccatgttgaattcttgagggagtgccaagcccaagagtttgatgatgaagttcgggagactgcacaatgggcccaggggatgataaaccaggcggtggtctcttgatgtgggaatattttggtctgttgggtgtgtgaggttcttttgtggctgtgccaagttcatttgccacagatgaacgaaaagataccaatatatatgtagcgtcagtcttaggatcatggtagtcatttgtgcgttgttggtctgtcaagccggtgtgcgtcacattggaccgggtggtttatgtccgtggatgtcttgaacagcaaaacatggttcatttatcttggtatttttcaatgctggg

SEQ ID NO: 31285 - DNA, 503 bp, Sorghum bicolor
  Clone ID: 18066232
gctagcttttggctttgattggcctgtttcagacatcaaccctttacaagctatccgaaccgcaatgttccgtaagcctcctgggtgggaggtcccctggatccctgcagagcgcttgaccctagatgaatcactgaaagcgcatacgatgtttgctgcctacgcctgctttttggaccacgccgtgggcaccctttttgaagggaaatacgcggattttgtggtgctgccctttacatcgtgggacgaattctccaacgatgtgccggggcaggtcctggcgacgtacgtgagcggcaggcaagcctatccatgaaccataatagatagcagttttaggaagatcacgttgtgtagggtttttgctaccattctttggaaatcaatggctgcaatactgtaatcagcattttggaagatacgatttgcaacattttttcagagagatttacttactactacaaaagaaaggttcacttggaagtaaggccttgtttagtttt

SEQ ID NO: 31286 - DNA, 479 bp, Sorghum bicolor
  Clone ID: 18066240
ttggataagatgtcaaggacaggaagactcccctggtcactagcttttttgtgatccagctcttcgtatgtgcttgtaccagggaaggtggtttgccaaaccgtgaaagccactggcgatgcggcatggcagagcaatatgagtgaaatcagctgctaaaggattgaaatcgacatatcgcaaattaagaaaaagagaggatatattggcaattagcaattctttggtgatggaagttttgggttgtgtaatactaggatttgttttgaggcaatagttattagcatttaagcactgcttttgaacatgacatggacaactgggggtgaatttttggtactttcctgtatgttgaccgataactcttctagtgttctgagacataaacatccttgattcttacagctttgctgtgttagtgtacagtacttcagctttatgagtatgatgtgatgaacaatgcttattcatatttgctt

SEQ ID NO: 31287 - DNA, 461 bp, Sorghum bicolor
  Clone ID: 18066243
aacattgccctttttggtacctgttcagtgataatgtatttgtggaacaagatgcaccctggtgcagatcctaatgctgagtagcactgaactcccaagatccaagcagtcacaggttggcaagcacatcatttgtgcacccagcttatgattcaagaacgggaggtagctgaaaactgcacactttgccaacttgctaggaatggaagttgaaccatcgctttttgtcaagattcgagataagtgtagctatggcgtttctttttttttccccatccagtgcgcagttggtggccaacttcatgactatgatgagtgactcaacttattatgtcaaaaattgtaattagtaacacgtttgatgaatcataatgccccccaaaaaatggtcttttttggcctccctttcattaagcagtttcatcccttttaatcagaagacacaaaaagggtggcccccg

SEQ ID NO: 31288 - DNA, 508 bp, Sorghum bicolor
  Clone ID: 18066298
tgccctgcagtaatatatatgatattcaagggagatagcagtcacaaccgccgctaagcatgaggaggcatatccctttccccatgatttttttttgtggatttagatattgcaccagatcgacaagccaacctgatgattcattctttcgacttgctcctaacagttagttgcaactgttatctgtaaatgctgcaagggaactcgtcttgacagagttaattagattttgtataggtttgcattagccatctagttacagagttaactctagcatggaatcggtttggacaaatgctgttttgctcccttggttacatcccgcttcagtgacgttacagaagctaacaatccaccaatactgctagatgtatatcaatctgttagattatgatcgactcttcgcgacattgcgcgtgttcttttggtaaaaagagtggttcttgtttagtagtcgcttccaaaattctgtaatttcatttgtggctggaagagttgttctgtgggt

SEQ ID NO: 31289 - DNA, 600 bp, Sorghum bicolor
  Clone ID: 18066300
aagttgcactgagactgaggtaggcggtagtagggagtggtgggtggctgggtgctaatgctgaagctgtaccagccggctctcgaatgcctctctttcccttgatggatggatagattctgagatggatctttcggcgttactgtggtgtgtggtgtgcatcttttgatggtcaactgcatgtgacacacgcgtggacggcaggcaagcatggcaggcatcgtctctgctgatgggatcggcatagcctcatcctggggttcgcaggtcgtgtgtggggcggcagcacagcagcccgctgttttgtactcctacaagactgctggcttttgaggcgctacttctgcaaaatatctctctcagtatctcacctcctttctctcattttttttgttttttgtaaagacgacaaaaataaagttgtgcctgtaaattttattagacatagaaattttattagttccaagccaatttgctgacactccatccatccagtttcattgaagtgacatttttccagtgttaatagcatgtaaaatttgtttccttacttgaagcttgctaatgaatggggctaaaatattagaaggctgaacattg

SEQ ID NO: 31290 - DNA, 333 bp, Sorghum bicolor
  Clone ID: 18066340
ccagggaactagaattccccacgccttgcacaaatggattgcgacaaagaggttggttctggacccaataataaagtaattgatagcaaagccattttgatactatcgccaagcgcggtgggcttgcagttggcacttattttttgtttttgcctcattccaatggttttttttttctttaacttcttgtagaggagaaagccgaaatgtatttatttgacaagtacacatgttattgcgagttttagcccttcccctgtaagaggctagcatgtgttctggaagagttgtctgtataaaaaaaagtttatctttcttttaccccctgaccct

SEQ ID NO: 31291 - DNA, 404 bp, Sorghum bicolor
  Clone ID: 18066372
aggtggcctcgcttacagaagtgttcactgtgctggaggagtacttcgatttggcaccagtacctgctgagagtagaatatgacagcgaagttttattggacttggccgctaatgtgaaatcggctacccaaccaacaccttgaataatgtggacaatgttgatgccatttcaactttcaagtatcagaagccctgctagagcctgcagccagaaggcgatggctgttccaaatgtggattaaatgtcattgaaatggcaatgaagtgattcgatttgttgtaaatctactatcatatgttgtccccaactaaatcagcttgtgtcgtttagtgactgaaatggccataagtatctgacaattcagaatataacaataaaaaaaaccatggataccattcgttc

SEQ ID NO: 31292 - DNA, 587 bp, Sorghum bicolor
  Clone ID: 18066381
cttcgtcgtgggaagaagatactgatatcaaggcattagagcctcttcctctacatcatcgacacatggcaacagcaaatcagcagttacaaaaggctgcgaagcttttagatacaggagctgtgcgtgcaacaagatttttgtggcgtcatcccgttgcacgagtcaccctgctattctatctggtgttcgtgcatttgttcttgatgcacttgttaaaccgccttcaggacttcgcatccagagaaggaaattcagccatggggggtctggccagcgcaaacctgccataatccatagccgtctctgtgcccttcttatatcttgttgattcaggcattccccactgattctagccccacacgcgttacaagtttccctgcttgaatgccctattaaccctcctatttcttttttcccctatatttttcttcaccctcatcttttgtaaagtatagtagcattcgttgtttggccatgggctctataatccattcttttacactcattgatgagtcagactgagtatgatccagcttgtatgcacaccttgacataatatataccccacacaacccaattgagcc

SEQ ID NO: 31293 - DNA, 587 bp, Sorghum bicolor
  Clone ID: 18066386
ggtctacatggcaagcatggacgaggaggtacatggaaacagagctgatgatggatcctcacgggggcatgagagatcatctagcatccgggctctagatatgaagtccagaacgagatgtggtgcccggtgttgcttgtgcttcgatccattgcctatccaggacatctctgtcatcatgttctactgctgccatgcatatcatctgtcttgccttgaaggtggtctagactcgatgagatcaaccagtaatcaggatagtgacagcggcacagacgatgaggatggttccccatcagggcagtctcgtatgcgctgtgtattgtgcactactgctgctgcataatttatactgtgttgggtagtacacactaccttgtgttgtgttgtaagttttgagcacaatgtaattagtgtgttcttttcgtgtgtttcacatgtacaatagcgtgattcttttgagggaagccatgtcctcggcaagaggagttttgtgtaaatttgatgaaccagcatgagcaaagttgtgcggcatttccattttttttgtaatgccacgtttgccagataatcaaaggtttattaac

SEQ ID NO: 31294 - DNA, 548 bp, Sorghum bicolor
  Clone ID: 18066400
ccatcagggagaagataaagaatttcaatctgtcctttgaagatgtttaccgagttcagacagcatggtctatcccagatgaccaactccgcgatgatgtccggatttcaatatcactgaaagttatacaggcctataggacgttcgagggaagatattcaggctttcttgatggcacaaggcatcgagatcgttatgtaaagtacaggccagaggatttggagacacttttgctagatctttttgaaggaaatcaaaagacactgcagcattcttgtcgagtgtaaagctgaaaccaaatcttgaagaagagatggctcaatccccaccacctgtattttggtttccttctttggtttgcaatggtactcttgaatgtgtatagtgatgtcctgttctgccaaactagcatgattttgccatttcttgtggcctgtcttgctgcatactgtaggattcctttcctcgtgacattgtagaagtacatatgatattagagtagcattgtactgttcacgaaactttggtaatggagtgtatagtttcct

SEQ ID NO: 31295 - DNA, 392 bp, Sorghum bicolor
  Clone ID: 18066405
gacggcgtggtggcgcagctgcaggcggcgcggagggcgctcggggagaaggacgtggcggtgcccgggatgacgcgcggggacacgccacggctgagggtgctggaccagtgcatccgccagcagaaggcgctcacccaggccggcatggtggaggcccacccgtggcgaccccagcgcggactccctgagcgcgcagtcaccatcctccgggcatggctcttcgagcacttcctgcacccgtaagcatgcacgcatgcatgatcgatccacttttcccttcttccatgttaattttatttctactccgacctgatgaaaattctgaatgttagtttgatcttgttagtactagcttgttagggcttactattacaagggtaggttttctc

SEQ ID NO: 31296 - DNA, 520 bp, Sorghum bicolor
  unsure (1)..(520): unsure at all n locations
  Clone ID: 18066447
ccgaagatgcagactagactgcagcgatccacgtcagttcagtgtgctggtcagagcctctgagggagggaagatgcacacgcaggcaggtcgtgatcaagctcctatctgcgtgcactcctcaacaggtcatgaaagagaggtgcagttctggaagaaaaagtgcaacctgccatggctgcatggcagatggcacgcatggattggcggtcaactctctcgtctccatcaccccagttaatatgatacctgatggctccatatgcgatattatctcgtcatgcatacagataatagtcggaggctcatctgtcgccgctaatctagaagaaccaagtctgtacgcgtcagcatccgtcggcccgctgactgctggagaagggcatggcccaggtgaggacacgagcggctgtttgcttcagtcagctgcttagtctataagcatcgtatattgtatttagaagagatggtattagtggataaaagtaattaggagaangggcatccgtccaggtgttct

SEQ ID NO: 31297 - DNA, 622 bp, Sorghum bicolor
  Clone ID: 18066455
cacagagataaggatagcaaatggtttatcagtcggaaggaatggcctttcgacatgtacccgccatgggctcatggtcctggatatataatctcacgtgacatcgctaagtttgtagtccgaggccaccaggaactgactcttcagctattcaaacttgaagacgtggcaatggggatttggatccaacagtacaagaacagtgggcagcaagtaaacattgtgactgatgaccggttctacaatgaaggatgcgacgctgactatgtccttgcgcactaccagacccctaggcttatgatgtgtctgtgggagaagctgaagacggaatatcaagctgtatgctgtgaatagcatccaaattgcaagtaggagcgagaggaatggataggttagcctacattttgaacagaacattggctaagattttgacgctgggtggaaaattgttgggaatgcacaaaaaagctgtaacattgggttatcacttttgtgttgtgtgtccatgttcttggttttttggtggaaaatgttaatccatgtacttggatggatgttgtaaaagagtgttgtaggacatgtttgagagagtttccacaatgctgttgatgttgccgtgctg

SEQ ID NO: 31298 - DNA, 173 bp, Sorghum bicolor
  Clone ID: 18066471
tttatgagatgggggagtctgcgtaggcttcattacccagttagtagtagataacaaactggctttgtgggtgtctggtagccccatgtgtatgtaagctggaggcggtaggtactggggtgctaaaagtagtcgatcgaccttttggtatgaagggggccaggggtagtgtt

SEQ ID NO: 31299 - DNA, 471 bp, Sorghum bicolor
  unsure (1)..(471): unsure at all n locations
  Clone ID: 18066474
catggcggtagtngtatatgtgcaacaagcatgaagtattgtgtgaccgacaatgaaccaaggtcatggaagcggtggtggttcgtcttgcggatgtagcgccggtgggtgacggaccagacgccgtagcggtcgctgatgagcaggctcggcgttccctcgaaggtgaaccctcgccggcggatcttgaatgccagtcgtcttggacccttttaggctggtgtaatggtactggatctcttgcccgtcttgcccgctgctgcctgtgtaatgttctgccggcgcacatccatcgtggattgacgacttgtacgcgttgtcgggtatgctagcggttaccgtacctgtatctatacacacacacgaacaagaaggaaagatttatatatatgttctcatgtatatatatctacaaaggtgatcacatcggtcacaagttagcacaaaccatctggtaatataattgatcct

SEQ ID NO: 31300 - DNA, 214 bp, Sorghum bicolor
  Clone ID: 18066518
aagctccggaatcccttttgggggagatagcagcaaaatccccctagcgggttaatggggaaaccccgtttttgaggaatttttgcccaaagtttttgtggggggggagggaataaaagtttgggatccctcccctgttttgcagttaccgaggtttgcggttgtattgttatatttttttagaggatttgtcccctgcccaatataagattac

SEQ ID NO: 31301 - DNA, 178 bp, Sorghum bicolor
  Clone ID: 18066555
caatagaaccccatgaattggatttcagtgtattaaaggaggaaagctattttgttgggcttcatttcatcctccccccgaagatatgtagacagagctattggaatgacaacaaaatctttcctttccttgtagggaaatatcagatgggccaggttctgtagttgtgctcctatgt

SEQ ID NO: 31302 - DNA, 617 bp, Sorghum bicolor
  Clone ID: 18066573
aaaaaaagttgcattgactgccaagtatgaaactattgagttataaagctgctaccaatgagcttcgttgtgtgcttgtttagacagacactgcagttttcttcagtaatcatcagttcaggtgtgtccatggtgtacaactagtgaacagttagtggatgagatgactagaaagcataaattgggcacaattcattcctggctttcaattttgagcttctggctgtttcccaaagaatgcatcctttgtcgatagttcagacaaatgattacaacaactataagaaaccaataccatatgtttgtgacaaattatgctgcatcagcatgacattttgtatttgtgctgcttttcagattcccttaggtcttgttcaggggagggttacccacataatttggcctccatcgaggactggccgagtggagagaaagatacctgaagggagaatttcacctggttgatcttactccctacctactccattggatgatgattcatctaccagacataaacctgctcgattatcatgtattatcaaatcataagttttgtaaagccacaaatgtatacttgccccattagttgtactgtgatgctgtattctgggatcttc

SEQ ID NO: 31303 - DNA, 622 bp, Sorghum bicolor
  Clone ID: 18066593
gaaggaggtacaaatcaagcataaccctgaattgaagcaatggtgtgaattctttttagaaggaaaagaaatagtctgattcaaatggcagccaaacaaactcacgatttgtacctatggtcttcagggctgtcaataaagaaactcacgatatcttcagggctgttgcctatggtctcgctgccaataaagagactcacgatatcttcagggctgttacctgacctgctgcattgactgtctacactgacactgatcgggccggttgccctgttacctggaagtccacgtctggttatgcgatatgcgatcttcttcatggatagtctcatttctttgttgtccaaaccacaagagcatcgtgtccaggtccagagctgaggctgagtacagacccctctagcgtgccactgccaccgttgttcgtcagcacagtctaccaactcaaggatagtttaattgccttgggggctctattagttgtatacatttgtaatatttaatcaatataaggtctgatttagtttccatttttttaagatttcttgttacatggaatcttgcagcatatacatgaagcattaaatataaataaaaaaataactaattgtacagtttgtct

SEQ ID NO: 31304 - DNA, 223 bp, Sorghum bicolor
  Clone ID: 18066599
caatctgcttcagggcaaggaagacaacattgtttgctatggcttcaacaatcaactgggcacttttagctgtgttcataacaatctttcataacaatgtattcagttttaagtcccccaggtcaattatgttttagcatttttgcagcactttggttgttgctgcctgctggtcctttatattgtaagcctcctagcaagaaaattaatggcatttttcgcc

SEQ ID NO: 31305 - DNA, 529 bp, Sorghum bicolor
  Clone ID: 18066605
gttgatgaagcgtgcctgcactgccatgaagccgacaacatcgcttccccatctgatcagtggacccaaggagaagtgctttcagcccgtataaagactgtttgggcatgagtggaggaaacgtctttagtttagtgtacttgatgcttacttggaaggaaagggacttagctgcacgtcacacacttattcatttagagaccttgtgttttaataaataataatttggtttgcttattggttttgaaggcggttgttaaagtgtgggtgttaaacttaattcttgttgaagtaacttatttgcgttaggatgttcattaatcctagtttggtatttcagtatttttttttatattttattcttccgcttgctataaatacaaagaagatactgtcaaattgtttatggttgtgtgcagctgttgtttgtgtagtctagtagcatcccggtgtatttgtggttttcggggtgttacatatacagtatggacacatgccacattgcagaaataaatttctatctgctacg

SEQ ID NO: 31306 - DNA, 556 bp, Sorghum bicolor
  Clone ID: 18066607
gtgtatgtgggtatgttcctacagaatttatcacggatgaaggtttctattcctcaaatccaactaaacactctatggatggggcatttgctgcacgtcttgtccggtcatcacactaaggttataggagttgccacaaggccacagctagattagttgcatcatgaacaagaatgctgaggatgccctgaagaaatccatttgatgagtaatgttataaatgtatttttcaagccaaggtactagaactacacctgcttgaatggtctgccactgtgcgtctctatttagttgatcctaatgtagtatgactatgacacttttctctaatgctgcaaatggtagagttagtagtgataagcatttccggatggatgcactcatccaaaattccaaatgtagcctaacagacatacatttagttaactatggtattttagaaattactctagtgcatgttatttgtaggcaatacccgacaagtgtcgtcattactctgtggatgaaacaaggttttttatcagcatggaagttatatatatcattccttatttgc

SEQ ID NO: 31307 - DNA, 510 bp, Sorghum bicolor
  Clone ID: 18066630
ttcggtgtgcatcccaagaatctaatggacaaagagcacccaatatatataaccagccttgtaccgttgtcatcatcgcctatacttcgcctgatgccccctcaaagagaaattgatgcctccaaagggcgattaccaaaggtgttgttgggagatctgattgtgggctcagctgttctgcccaagaaggaatttcaggtggttgtgtgggaatcacggatacccccttacaaaaggtttgttcatcttgctacatattgtgatgatgagccggtggtctcttctcagcatcatactgcatcacctagcatgaagcgcagacggttagataaataaagctgacgctcatcaccgtttgatagcaacatcatcagatgctatatatttaaatgtggtccccacatttacaatactcctatatagcatttgtaatactcgggccagtgtggtcaacaaaagtagcttacactctctcggtcctgttttggcttttttaaatgcattgctttt

SEQ ID NO: 31308 - DNA, 620 bp, Sorghum bicolor
  Clone ID: 18066637
agcacaccaaggatgactcccccaggctcacctccaaggcgttatgcatcggtatcaccgccaaggcgacattcaatctctgttacatcgatgaatatgttgaatgacaggtcctcaggcttttctggtcagcatacctctccatttgacgctccaagtcaaacaggacgaacaagagttgatggaaaggagttctttcgtaatgtcagaaatcgattatcatatgagcagtttggtgcattcctgactaatgtgaaggagctgaacgcacacaggcagaccagagaggataccttaagaaaggccgatgaaatcttcggtcctgaaaacaaggacctgtacaccatttttgagagcctgataactcgcaatattcgctagtcttctgaagggttgaaacattacccatgattactagtgattcaagttttaccagtatactgtgattatgatattcatcactattttaatttgaagtctgtagtctgttgtggattcttggtatctagttctatagttacttatgtccatgtagtgtcccacgtttgtctggaagctacaatttatattctaatacaagtggaggaaatatggaataaagggaaatatgttattgtctg

SEQ ID NO: 31309 - DNA, 236 bp, Sorghum bicolor
  Clone ID: 18066641
atgtgcctcatagcccaaaaccttttacagcttgtgccgagtcagagcatgacgagaccccccatgtgcctcctaaaccacaacattttccagctcgccccgagcaaggccatgatgagatggcacagactttttaacaagccccgccgacacatgaagaactactccctttagtatgggaagctcgtgaaaagatccccatcatgataaggtcgacagggtcaaaattttttggg

SEQ ID NO: 31310 - DNA, 586 bp, Sorghum bicolor
  Clone ID: 18066648
gttcttagtaacatgcgggtgctaatgacagaggattctaacagtgctgaaagcggttcattcttgttagatgataattcaagcatcccgttctcggtggatgatatcaccaactcaatgcaggagaaggactttacggatatcaaaccggctgatgagctactcgagaaccctgccttccagtttttacaggattagggcttgtgaagtctcgagcatcatgctgctagatatcttgtcagatcatttcttcatttgttgtatatttttttgatcctttctacccatatgtgctagttatattttcttttcagctagctttgtaaaatccatataggtatttgttagggttgggatgggattccccccttacagatagaaaaggccgtatcttttaaagcggggcaaatgattctttgtagggcaacatgaaatcaatgtttttacccaagggtggtaagggaggggtagaggcaatgtagtaggctctccccaattatagattgtgtaaattatatactgtaaatcgacagtgcaatgaaaaaagaaaggaaagctatatagcaaatgcagttatgttgatgcc

SEQ ID NO: 31311 - DNA, 487 bp, Sorghum bicolor
  Clone ID: 18066652
ggaggtgaaattcagtttggaatgagtcacatattggtggtaatggttctgtgcagagatttcctgggtttaatcacaggtgagtgttatgctggcaggatcagaaggcagtggcagagaatatttgtgggcatacagcttggaacaatgtaaagaccatacaggccacttggctcctgtgtgtggtaaaaccttgataactcggaaccaagcatgcagacatgcgcaacttcccttggtcattttctggggaaggaggccgcctagttgggatgaagcatagcttggttcaggactcaagtaaaaaagagttaccatttttttctttgggaagggagggttagaggtctgtcttgactcgtttttttttcccccttggctgctgcgttaccaattttcctaacaggggaagagaggaagtggtgttggctgttggagctgttacagatatccatgaaaattccgttgattcactatattgtgatgc

SEQ ID NO: 31312 - DNA, 168 bp, Sorghum bicolor
  Clone ID: 18066666
ccaaaggcaacattagtggattgctcatgtcattgagctacctcacttgtgggtaggttcttgtggtgtcctagtgaggacgaggttcgtgctacacctcttagccaccggaccaccaagtgttggtcgacacaacaaggacgtagcgtgccggcaagcacggaactc

SEQ ID NO: 31313 - DNA, 397 bp, Sorghum bicolor
  Clone ID: 18066686
gccgctcctcaaaacaaccagcaaccgcccgtgctagatgatacatcatgtcatgcttagggcaaatcaagtcttcaatacccccaaaaaaacaaaaatacttcgcagtggttccaacaaactgggttaatctgatttggaatcaagagctacaacaatgaattgtttttttctcagatccattcatgtatggattttttccaaacatcggtcaatgtataggctggagagggagctggattagtcaattatgtacattaggttctcttttccattcttacaagcagcaacatgtcatgttagattaattaatttgagtgaggaatggaactgttaggtcaacttagcaagtcatcactctacatagattacttccaatcaatgaatattttttcct

SEQ ID NO: 31314 - DNA, 169 bp, Sorghum bicolor
  Clone ID: 18066687
tgtgcctgaatacataaggagggcctccctttctttttctttttctttttctttttctttttccctttggtactttgacttgccaaggatatacatgagtgtttgagctgttccaaacttgcaatgacaagtgcaattattttttggatcacatggttccacatagttt

SEQ ID NO: 31315 - DNA, 456 bp, Sorghum bicolor
  Clone ID: 18066699
accgctctctgtttcatcatagcaaaaaatagaggcagatgctttcgccagtgcggacaatcacatctcatggtggaatcggtgggtttggcctgatcatatcatcatccgctgttaaaacttgtggcacgctagttcagggtgatgaaggattgattggtcgattgatgtttgctgttatcagttgctgtagagataacagcgtatagtgttaatgtgatgatactttgttgtgatataccatgtggcaaaggccaagttaaccagcatgtcatggttgtgtgtgtggtgaatatgttgtagttaagtttgtagtgtgggcatactgtctaagtagaggatttggctagtcatatcgagtgacttttcttttgattttgactcccctttgtaacggtgatggtgtgtgtaagtgatttcttctgtacaaaaattgacagagtttgaaatgatttt

SEQ ID NO: 31316 - DNA, 645 bp, Sorghum bicolor
  Clone ID: 18066713
tatgatagaagaggtgaatctgagagagctctggaagtattccctcgtaccagttcatatgggtatagctccatgcaggtcactgatgatggctacggtggacttccatcatatacatcaaaggcatatgaagaacatctaccacgtgacgaaatgactatccctgctagtggtctgtcaaaagtaatgggaaaacgtggcacaaatttggacaacattagaaagatttctggagctcacattgaaattattgaatcaaaatcctctcgtcatgaccatattgcttacatatctggaacctctgaacagaggcagtcagctgagaatttgatcaaagctttcataatgtctacctaggattccttctgttatctgagaacatcatctcatcagtttgatctcttttgacttctgccatccttagttccccagggtttgtgaagaacattgaatgcagtgtttcctccacctgtccaatttcctgagaatatcatgcatatctgagcaaggtgtactccagtagtagacaaggcactcattgttccttagctcttcaactgttacctatttgtgttgacatagtcatcataactcacatgtcttactcttcgttatctcaatgaccagtccagttgctgcttaccg

SEQ ID NO: 31317 - DNA, 203 bp, Sorghum bicolor
  Clone ID: 18066717
tggtgaaaaaaaaggtcaggttgttagtgaactgatttggtgggagatgtgaaagccatgtataggtagagagtagcatgggcaaatgaatcccttgcccacaagtttacaagggggtttcagttttcatgtatagatttaattgcttcattcataggcagaacaaacatcattgttgagtcaaaggagtaagtccatatggg

SEQ ID NO: 31318 - DNA, 405 bp, Sorghum bicolor
  Clone ID: 18066721
acttgtatcatgggcagctttgcagttctatatgtttatacacctgagctctaccctgcatcgtctcggaacaccggtgttgggatcacttcttcccttggtcggattggcagcatagtttcacctctcgttattgttggcttgttagagagctgccgtcaaaaagaagccgtgttcatgattgacctggtgctcttccttgctggagtcacatgtgccttcttccctcgagagaccaagggatgccaaatccagtgagagtttgaaatccataattccatatggatgtatgcttgcaaattatagtacaactaccattgcagtttatcatgagcccttttgtggcctaacttaagattgctgtacagatacttttggaatatagaaaatacaaatccctttttc

SEQ ID NO: 31319 - DNA, 222 bp, Sorghum bicolor
  unsure (1)..(222): unsure at all n locations
  Clone ID: 18066725
aatgatttaattttggctatgaaatggcagacgcgaagcttggctactcaacaacatgcgacaactcagacatggtagtagattcctgaagcatgtttgttataatactttaggtcaaaagtgctcagcattgattttacactgtattttatgcttatctttcatccactaattgcttgtaaaatacttacngcggtcttcntatgcgtatactttttcgcg

SEQ ID NO: 31320 - DNA, 340 bp, Sorghum bicolor
  Clone ID: 18066746
ctggtgtgattgtacgcggtcaccagtgattcaagaaaagtatacggcagcgcatggccatcttttggtgttattatataggtataggtagttagttattaatataagtttattagtagatctgggtccgttgtaagttaccctgttgttggggcccatggcccatttgtcagctaaatcggagggccagatgcaaactgtactgtaacgtggtggactggtggtggttgtggttcttgtgtgtagctatcatgcttgacattcttgaggcccgaggctccctgtactggattgcccccccctttgatgaccaccaggagttggaggcagattgctcccc

SEQ ID NO: 31321 - DNA, 422 bp, Sorghum bicolor
  Clone ID: 18066768
agcatagaagaagctggtttgcgcgagatgaaaataatggagaaatggcaggaaaggcccgccgagataatgaaagaagcaaactccgcgtggcacaaggatggcaccagctcggcccaagaggacgaggacgccgaggaggcgaaagcaagagcgtgggacgactggaaggatgacaacccccgtggcgcaggcaacaagaagctcacgccctgtggctaatttgtgaaacgcgcgctgtatcgataaatacttcacatggaacacgatgctcatgtagatcatacgatgtttgatttgatcaatatttagtctgcgtcttttctagtgatgttcagtgtattatagcctgtttgtgtaagtgctatatgtcctttccagtacgatgcatttttctggagcatgagaaaccgtattcccgt

SEQ ID NO: 31322 - DNA, 435 bp, Sorghum bicolor
  Clone ID: 18066769
ttttcttgaccaacatgctgagggaaatcttgtccagataatagatccacaagttatagaggagggaggcgaagaagtccaagaagttgctgcacttgcagcgtcctgcataaacttcagaggtgaagtacgaccaacaatgcgacaagtggagcataccctagaggggctttggggttccaagaagtacaagagagaagatacggtagcagaattggaggatgatagcattatgacttattgtccgtcatcaactgaaggaggacaaaatgttaaagaatcgagcagaagatatagtttggagcaggagatgatgatgtctgcgagctaccctcggtagcattgcgtgctctgtcccttatgcaatagcataattcagttgtaccctacttgcaaaaaacaaaaacaaaaaaaatcaaattctgccctttcatc

SEQ ID NO: 31323 - DNA, 567 bp, Sorghum bicolor
  Clone ID: 18066785
ggtctgggatagagcagatgagttcattccagagaggtttgatttagagggacctgttccaaatgagtcaaacacagattacaggtttattccattcagtggaggtcctcggaaatgtgttggagatcaatttgctctcctagaagcaatagtggcacttgcagttgtgttgcagaagattgatattcagcttgtgccagatcaaaagattaacatgactactggagctacaattcatacaacaaatggactatatatgaatgtaagcctgcgtaaagttcagcaagaagctgagttagcactgagtgaatcgaaatagatggaaacgacttcaaaccagactagagagcacctgcactggctacagaattgtcaagatgtgaaatactgtatgcttctccagtttctagttgaaagctctactacagtactatactaaatgtcactgcgtcggcgtacagattagctattacagattcggctgcttaaaacttaggtcctggtggtaatctaaggccgaacagattcatatattggtgagcagcatgccaaatctaccagtcattc

SEQ ID NO: 31324 - DNA, 609 bp, Sorghum bicolor
  Clone ID: 18066786
cgtggtgtagcagagcttgttgattcagacctcactggttcattctgcttcctttcttcggttacatcaggcgcattggcctcactggtttctggatcatgggcactagccatggataaagatcagaagaaactagctttgcccatatccatctatgcattcctagtcggttattatatgtgccggatgatgatcgcgtggccacaagcatgtgtggctgcataccatgtcgcgtatgcagagaacccgcagaaccctcagctgggcacgctgataccagaacatctgcacgagctcgaagcaatggcggcagatcaagatcgtcccagagttatccattcttctgacgacatcgacaattcatagattcttccattctttcagtcatttcccccctggtccctagagggtagacacctcggctgcagacagatgcatgctgatggttgaggactgctgctaggctgctggctggtgcagatgatagtgtgtgcttagttctgtagatattggtcaagtggacaactggggaaaaaaagtggttagaatccagacaaaaagctcatagaagtacagagtttagtaaatcaaacaaaaatgcagaattag

SEQ ID NO: 31325 - DNA, 467 bp, Sorghum bicolor
  Clone ID: 18066790
gcccaatggcacccaagtcaatgtattgcagccttctgcaggtttttcgctgaagctgcattgcaacagaaacgtctttgtcgccgctgctctgctattgctcgtgatcctttgatcacctctactccccatgacagtcttttcaaaacaaaatcgccagatatgataggtttagtcaacacttgatcaccctgtattgatttacgtatagtgctataggatcacattcttttggcttgtgtccacagttccagtaggagataggatagaacacgggatgagtccatagcctcataggccatttttgttccatttttacacgttcataatgtaccttgtgataatttactccacccagagtttgtgtggtggtggccctggtgtgtgtacatattagagatgacttcaggatgtattgaccttatagactaagggaataatgatgctcacttatagaggtatacttc

SEQ ID NO: 31326 - DNA, 245 bp, Sorghum bicolor
  Clone ID: 18066808
gaacatcgatagagatgaataattttacatattccacatgtagaaggtaaagatagctgtgacctgcgccccttgatgattttttttttctaatcatctgtttgactagattttatcctgtagatggcagctttatgtaatatagttttcttctgaatctctcactagtcactaatgtatctgctgataagaagtgcaggtgtaaattaacagtcttaatgccaaagatttcagttaagattgtc

SEQ ID NO: 31327 - DNA, 576 bp, Sorghum bicolor
  Clone ID: 18066816
aaaaaatggtccaagaggaagagtcggacgacgcagacggagagtcggccgacgacgcagaggatgacgaggaagagtcggccggtgacaaagagtcgggcgacgatgaggactacgaccacgaccacgtcgccgggtcccctgcggggcacgacggggacggagccagattaggtgactttgcagagcaaagttacattgtaactttcctgcgatctccaccctccattccctatccaatgactcagcacgcatacaatgcaaaggcttgcaacacttagcatttttcgtccacttcggcaggaggcagcagtctgtggcagttccatgccggtgatcatgagttcatgaccagctctggcgggctgccctcccttgtggtgaggacatgaagcagccccgaccactagatcccgtagccgaggccatagtcaaccatatgcaggtggtgccccccgccatctgcgttaccccgatacttctctgaatcgccgtatcggtatcgcgatacgtatccgatacggcgatacgccgatacggcgccgatacggtatcggagaagtatcagggaaatag

SEQ ID NO: 31328 - DNA, 227 bp, Sorghum bicolor
  Clone ID: 18066822
ctcattgtcgccgcagagtgttttgacatgggtatagctgttgttgggggggttcatttgctgtcacaattttactagtaacggtccagtggggtaatcttgttctttgttcgtcgtagagcattgttgcagggttgttgttttcggtaattgtatccctgctagtaagttttccaaacaaacccaatatagcaaaggaaatttcttgtgctgatgagcagagcttc

SEQ ID NO: 31329 - DNA, 487 bp, Sorghum bicolor
  Clone ID: 18066826
cctcctcaaactcaaagccgtgccgccgtgtcacgcgcaacccggtgggcatcgacaagcccatggaggagctactgtcgctgctgcacgaggtggacggcgagccacagcagctgagggtcatctccattgttgggttcggtggcttggggaagaccacccttgcaagggcagtctacgacagccctcacgcaaaggaaactttccactgccgtgcttgggtttccaccgccggcgccacctcgcccgagatcagcatcagccaacggattaaggctgtcctccgtgacatactccagcaagttgttcccaaagacaccatggaaatggatgttgacagtaaccaccttgaggcctcgctcaaggaatacctcagtgataagaggtgtgtgtgtgtgtgcgcgcctctctctcccctctttcagctccctagtgtagcgtagcgtagtgacagacttttgattctaatcttatccatctttttgtt

SEQ ID NO: 31330 - DNA, 499 bp, Sorghum bicolor
  Clone ID: 18066859
gcacagatagcattgaaatcctggcgatcttcaaacgggaatcagaagctggtcaaaagaaaaagaagaaagcaaaaaagaagaaggctaagtagattaacaaaagactgacccacctgtaactggaaggcaggaggtggcacaggcgctcaccttgcggatcttcagtaattagtactgatccagaaaaggtacagaatgagtgctcatggctgctgaggaattttacacccactaaaccagtcaagtggacaatatgtgactagcatatattaacttgacacaaggttagctagagttgagtgtgcttctctctccaagatgcactatgttagtagacaaaaggtagagatctcagtcagcaaggtgttaaatatgctattactaggttggtgataggccgtttaccccgaattctgcagcccctttgatgtaatttgtacctttgtcatgtttcactgtacattaatgaaaagcccgcactatcatttgccgctac

SEQ ID NO: 31331 - DNA, 478 bp, Sorghum bicolor
  Clone ID: 18066861
ggctgcggcaattgctagggatgataatggtcatttcctaggagcgtcggctctggtgctaagggggatatcagatccggaggttatggaggctattgcttgcagggaaggtatgtctctcgctctggacttacaagtggtaaacttcagattggcgagtgacaaccagaacgtcgttaagaatattcgtcaaggcagtcatggtgtctatggccagatcattcatgaaattaaggaaagacgattttcctttgctagtgttgagattgtgcatgagagaagggagtccaatgttgatgctcataatattgcccgtagtgctctttttgatgatttaggccgccatttgtggctgatgagtccaccgtatggtgtttgtaactcctatatatctcttgatgaataaagatttgtatgcttgctcaaaaaaaacttttgaaggcaagattaatgaaagtgtcaaattacacatattccc

SEQ ID NO: 31332 - DNA, 402 bp, Sorghum bicolor
  Clone ID: 18066928
aacaagggaagatatccaggaatgcttcaagaaaggatatgtctgtgtaagagcgtttcatcggaggtccagagtaccactgcgcctatgtgccacactgcatgctaccaacaccataaagaaaccagctggtgacaagcctgtgaagcggggtagtacatcgccggaagggaagaggaagaagaacgagacgaaagcatcttccactaagtaggagctgatggttccttgacgtagctgtgtacaaatttattgtagctaggaattaatggtctgtaaagaaacgaattgtagggagtaatgctgaactagttctgtaacaccccctggttaggacttagacgataatgttagttgtcttggctgttgtaaacgttagtcatgatgcccgagatggaagcg

SEQ ID NO: 31333 - DNA, 594 bp, Sorghum bicolor
  Clone ID: 18066941
gtcaggagttcatggaaggatatttgcagcagatactggcaggcctatacctggctcagtgatgataaagggcattgattccagggtaagtgcgagcagtactttcggagattaccatcgaattgttgctcctggtgagacatatgaagtcgtggcatcaatggaaggcttccggcaaaaatccacacgcatcatgctggagcaggaagctgtcaacctggatttcatcttggacccggatggaactgatgggcagatgaagctgccccataacgaccagggctgccactgcgacaatttcaagctgttccatgttcaagaagctcacctctggttgtatcttcttatcgtatccgttctcctgaccctttatttagtcttcaagagaaaaacggtgtcaaggttggcatcaaggttgctgacatatagatactcatcactcagacggcctgctgtataagaggaattttgtgccttaggacagttttgtaactcacataggatcttactaaaacggcctataagttgagggatgagcaatgtaccatggaaatggaagtttagcaccaatgaaaaataccacaatctcaaggt

SEQ ID NO: 31334 - DNA, 691 bp, Sorghum bicolor
  Clone ID: 18066946
ccagtttggatcacacaactttatgctgttactaaattgaccttaacaatgacagctctccggaaagacaacttaagcaagctaagcaatctcaaaacattattctccctcacttttacacttgctgcagaaaagcagggtccagatactatggccattcttgcaaaaaacaagttgttctcggatgggcagatcataattccaaatggtggatttgagaaccttaagctgcttcgtttgtgtgctcctctcgttccattgctgatattttcagaaaaggccatgccaaagcttgaaaggcttgaggtgcggttcaaaatgttggagggcatttatggcgcagaaaatcttgcatcactcaaagaggtgtatttgacattaaatgacaaagatggtgaggttataaccaaatatattgcagaagaggtgagaagtgcagtgaagggagttgctgccaaggagtccattgccaggattatccttcatatcgtcgagacagattaagattattaatgccatttgtttgggttcaattttctgagtcctgtgtagtattgtcctattgtcacttgtgcatgttgggaattcttaacttgattatttatttattctgggtgttgtgtttaagtgtttatttatctttaaactcagtatttgtttattcatgttaattagtgcaactgatgacttt

SEQ ID NO: 31335 - DNA, 580 bp, Sorghum bicolor
  Clone ID: 18066957
cctccagccatacctagaaacattcttcgcaagatgggtcttaacaatgtccctgggcttcgctcatcataatcctgatgctgtgatatcaagcaggagacttgtgctagtgcacaatacagtcatttgaccatccataatgctgttaacttcgtaaacagtatgctctaggctgctggacttaaggaagcagattggtttgctgaaggtctgaagtttctacaagcattttcacttccaatccgttcacaagtccacggctgtagccagacgtgtgcattcattttgaagccaaattttgttcggtcgaagcatccacgcttaacagagaatgctcaaacacagttcgtatacaaggatttgtcacaaggatagtgattagtttgaaatatttaaatgtactgcttctgaacctttttgcaataggttcttgcacattgagacaagccatgcatgggtagtgtttgctcatcatacgtctgtaccacagtgcaccatatagtttagcgtcatggagatagtagtccatgttgcaataccacatccacgtggaatgattatcgttactcttattcttctc

SEQ ID NO: 31336 - DNA, 510 bp, Sorghum bicolor
  Clone ID: 18066964
cgtggcattcatgtatgcccctgggcatcatatataaactgtaactgctgcttccagctggaccggcatgccaccccaccgccaattgcattgttcattgcgcatcctgtgacgcttagaaacaaaataaagtcttgctgagtgtagtgtatctcagcgctgtcgtgtcgtgttgtgtgaaagtgtacttgagagcagattatgtgtcgtgactgctaataggaatgttggttgtgcctgctgctgttgcaatgccctgaggaaacatgaggcggcatgatcgaagtgatttgtcatttgtctcctgggaagccgcaggtttgttgatcgacgcatgcatgcatgaggactgatcgaggagatataggccaaaaaacggctgcagtgtactacaagacagttgtacaatccccctcctgtaacttgagtttgtctgtaggcaataacgtctccttgtttgtattctgtattatggaatgctaatttcactgaaggtgttacttttttggt

SEQ ID NO: 31337 - DNA, 360 bp, Sorghum bicolor
  Clone ID: 18067001
cggctgctgctcggcttagcttttttttatttcgtttcgtttcgtttctttttttttcccccgttgggatagccctggtcaaacatacatacagtacgctttgctgattaagaaagacaaaacgtgatgacaatttttttttttgacactgtcaaacggttgggggtggttggccctcgacattgacaacgtggtttggagagggccccatgatgttttgcagacctgcaatcgctgtcctcgattgtatttttcgggctattcgattgataccctagtagtacatgtacatttacaaagtggccggctatgacctttgtactgtcatacatatagggaaagcgattgaaactgatttgg

SEQ ID NO: 31338 - DNA, 668 bp, Sorghum bicolor
  Clone ID: 18067019
agcacagcagaagctgttgattctgcaagggaacttgcactaaaagagggcttgctggttggtatctcctctggtgctgcagcaattgctgctattaatgttgccaaaagacctgaaaatgccggaaagctgattgcggtcattttccctagctttggagagaggtacatctccagcatcctattccgtccgatatatgactctgttcgaagaatgaggaagagatagcgagccttgtacaacttcaagcacgtggccagtcccttctcaacacctgacaggcttccatgatacgataaacatgtaacagtgaagaccctgattgattgcaacacgcagggtccgaagttttgaaacgctccaagcacgaataccagacttttgaagctgcacagaattctgtcaagtgagctgcaggcctgcagcttggttctaggaggagtgcctcatgtttagaacctgcttgtacaatcctggtgaaacatgcagaattgggtgccgcagttagcttagactctttctttcagtagtctagacgtctaggaccgggtacaaaccgtttgtaacctgatacgcacttgagctgatcttagcgtccaactatcagcaaattctttttggcttttgaattttgattgattgttcatcttttatttggcatctgcttt

SEQ ID NO: 31339 - DNA, 671 bp, Sorghum bicolor
  Clone ID: 18067023
caccctgtcactgccctttgtataccaccggacttgaagcagcttctgagtggggatgccagcggccacttgctctcatggtcattgaaagacgacagtttcaagggttcatagcacagaggaatatagggattcagctgcacatatagagaacactgattaaattataccactgatgtcttcctcgtccagaactgagcattggcgtgcattgacgaaagagctcagatcagcaagcttctacatggtatattaaatgttccctggatgccccatgcctgggccatacagcagcagtccgggcaggagaaagaatacaacagacacattgaaagaatgaagtggacgaggcgatcgaggcatcgctgcgctcacatcataatcttatactgtgaattatcagatggttgtaccttctcttcttgtttttttgaggagaaaaggattcatgtgggctgtaggtgccagtgtttgtaaagtctgtacagggtaattttggtggtgccggttgaggtggacgatgatggtgtactgtctcgatgttttgtttggggttgcggaagtaaggaaagaggtgttaggttcattttctctcctccccccctagaagtgttgttcattctttgactgggtgtaatttgagcacccttgtgttcagtaaatctatttgc

SEQ ID NO: 31340 - DNA, 613 bp, Sorghum bicolor
  Clone ID: 18067048
acactcctatgcatgcacgaacataaagctgaatgcttccaatacaggcaagctctaatgagctagaagattttgtggcagcatggtacaaaatgcatcaaccataggtgagattccagttataattgaggaatttcataaaatacctttgatcatataccactacttgatttcaatctcaaattatccaaatcagattatatgctagtcaatagcaagtctcttggatgttgttcgtgtgaatgttactatattgagttctctcacatactggttcaagaatgagtttctttaacagtaccagattgcttctactattaaagtgcctgattagaaaaacaaatccgcaacttatcagcatatttgctttcactatgccattccatcttgtatagccatctgttagttggtatctctcctattattctaaattttaattttacatgccatggcctgaaagtggggataaatgcctttgtaataatgtagcacttatctctgttctaccagtttgtaaagttgcaactgcaatgttgtgccattggatttgtaagctgtcatccccagcacaacgtttaaactcacatttcctttcaatatgaaatagttcctg

SEQ ID NO: 31341 - DNA, 557 bp, Sorghum bicolor
  Clone ID: 18067064
ttcagcatcgtcagtgctgctctttctgagggagatggttctcctgtcaccgaaacaagcatgcgcagcttcttcatgcacacggtggaggctcctcgccatgtggcggcctcagcccatgaaggccgggtgcatggcgggaactttatgcccatcatgcttgacggtggtgtgggacttgggaagaagccggctaacaacgctgatgccagtacctctgctcctcgctactggaaaaatatggagaaagcgtatggctctgcgcagcgcaactggctgtaatggcagagttcatggcctgcccccgccatctcgatatcctcctgcgttcaagtatctcccgtaccctctggtctggtgtgaaatctattatgcgtggtatgatccgtttgtgtgtactgattggtcaggacttgtttgctagtgtggacgttgtggttgtttgtgctttgtaatatctgtctcgtcgaacatacctagtaacacaatagctgtgtgaatgaattgtgcgaaaggagcccctcaccatgatttatataaataaaagaggaggttgc

SEQ ID NO: 31342 - DNA, 668 bp, Sorghum bicolor
  Clone ID: 18067164
aagttggacgatatggagtctaaaatagcaaagataaagaaaggtggacttgcaaatgtagaagcagtggaggagctattacatcttatgaaacttgatcaaactgagcaaagaatagacctttctggtcgggttatacttgctgatgttattgcagccacagaaaaacctgatatccttcacgtatttatggaatcaaagggccttctggtgttggatagttggcttcaagaggctcacaaatggaggtctgacgatggtagcagtccaaaagaagcagataagcctattgggccaggggaattttttttggccatgcttcgtgcactcgctagattgcctatcaatttgagtgcattgcagaggtgtagcattgggaaaagtgttaatcgtctgcgcggacataaaaatgtggagattcagaagaagtccagattacttattgaggatgggaagcgacgtattgatgctgaaatgaagttagggcgtgtttggttgaggacaaaacaaaattaaggtgtggcgaaatcgataacatagatataaaaaatttctcattggtttatacacatatatatgtatttataattgtcatctactatataagtaaaactattttgaataaataaaaagatacaaggatagtcagtagactaacccaattgtgg

SEQ ID NO: 31343 - DNA, 176 bp, Sorghum bicolor
  Clone ID: 18067165
tcaagtgctggggtcatagcagattcaattttcaccctttggaacaaaaacttgatagattttgatccccccggtatagaaattgaataagggggtttggaagcaaaactcgatagatattggggccccctgtttagaaattgaataagggatgccccttgggtaaaaaaattttt

SEQ ID NO: 31344 - DNA, 667 bp, Sorghum bicolor
  Clone ID: 18067177
cagagttgccatgaatgcatcatacacttcgatatcaagccggagaacatacttctcgattcgtcattcgctccgaaaatttcagactttgggatggcagcatttgtagggagggattttagccgagtcctgactacgttcagaggaacagcagggtatctcgccccagagtggcttagtgcaattcctatcacaccgaaagtcgatgtttatagctttggtatggtggttttggaaatcatctctgggaaaagaaacacgccagaagttttcagcaagagcagctatcatgttgcctatttcccggtgcaggccatcaggaagcttcatgagggtgacctgcagagtttggtggatcctcagttacaggaagaccttaatttggaagaggctgaaaggttgtgcaaagttgcattttggtgcatccaagataacgaatgtgatcggccgacaatggttgatgttgttcgggttcttgagggtctccaggagcttgatatgcctccaatgccaagactacttgcagctataacggaacgcgccaatgcggagttaatgtgataattcaccggtactttgtagtgtttgtttttttgtttcagcaaatgtggtagttgactagttgtatggcgaagctgaaagaataaaagggcatgctttcaatttt

SEQ ID NO: 31345 - DNA, 175 bp, Sorghum bicolor
  Clone ID: 18067178
gtcatcagttgatttgtttttgactatctgacaacaatttccctgctaacctccttgcggtatcgtggttctcatttccctaatttgaggggctgtacatgccagttttcgtaaagaatagttgtgtttggatgcacattgtgttttccttgtgaaaattgaactgattcttgtg

SEQ ID NO: 31346 - DNA, 657 bp, Sorghum bicolor
  Clone ID: 18067195
ctggctttgccccagaacgggaggagcctgtcgccgaacgacatgttgtacgcccacaccacccagcagatccagacggcggcgaaggcgtacagcgccatgaaggcggagttgatggcccatttcttcttcacgatgctgccgtacaggatcaccagccccggcatgctctgcaggcccaccagcgtcgccgatgtcatctgccacgcattgtcgcccttgttcagccactccggcgacgacggcgagctctggtacgccagcggtatggcgcctgctgccatggctggcactcgaaagcttggtaggtggagagggcagagcaggaggaaggagtgggttgagttgcactgaacttcagcagcaaggcagcaaagcttttgtaaggcttgtctttgtctctacctgtgaatcaatcctacgtagtacagtatcaatatcaactttattgctccctcgctacaaacacccaagttgaaggtcagagtcttaaaaacaggggcaggcagcaaaagattggtattagcacgctgatgaaatgaacctgtacttacccaagtataatatcatcgctatctgtgcttcacgctgtgctgtgaacttgtgatcatctcactagttgattttagtactactccgaatatgattggtcctagg

SEQ ID NO: 31347 - DNA, 688 bp, Sorghum bicolor
  Clone ID: 18067199
atatcatgcttcaatgagctattatgtgttcttctgtacacatttgtcttccccacattgcctattgtcaaattttatcgcttgaaggcagcttccgaaggtagcaaaactgttgctggtgacctagctgctgcaggagtcccaattcaacatgaagagcaagctatggaggatcccaaacaatatgtgcgattaagcaccaaactactgtttctgcaaaacgttgattacgcgcttgatatctttctgacatatgtcttgactctatctatcttccctggattcctatctgaagacaccggatcacacggcctagggacttgcaaccctcgcacgctttctactcattcctgcattctattttactgcaaagtacggcgcacaagggtacatgatctttttgacatccttcttggggttgagcaacgggtatctaaccgtatgtatccttacagaggcacccaaaggatacaatgggccagagcaaaatgcgctggggaatgttcttgttgttttcctcatgattggactgttttctggtgttgtgctcgattggttatggctgatagggaaaggttggtgataactaaagtcacctcataaagggtgttactcttttgctaagtgtatcctgttggtacatcgatggaaaaaataataataaatccgatttgctgattttcttgct

SEQ ID NO: 31348 - DNA, 126 bp, Sorghum bicolor
  Clone ID: 18067210
cttacagaacatccgaagggtaatttttgatgatagaagaagtgagtattcccccgcaaaagggacttttttccctttgtggcatatttggggaattgaatgctgattggaattacttatgctatc

SEQ ID NO: 31349 - DNA, 654 bp, Sorghum bicolor
  Clone ID: 18067218
ttctagggaaaggaactgcctattccgaccgaggagaacaggccattctacagggcgattcggaaattgcggaagcttggtttgatcaagctgctgagtattggaaacaagctatagcgcttactccaggaaattatattgaagcacagaactggttaaagattacgaagcgctttgaatttgaataagaccactctccattttcataaaaagggtggaagatcaaatcaagaatttcattatatccctttcttctaccttcaattttatatcatatttcataaggataaacaatagggataggctctggaacagaagtaataaagtacataaaagtcggcaatctaaatattcctacctaatatatcaggacggtcttattaataattctaatgagttatcttggaatttggaatcgaatcaaaaaatctatattatgctcactcaaggaaagtagatgtagatagggacttataccctcagaaaaaaaatacactagcttcttaaattaaaacgtaaaaaaagatttttttgttatgtcgggaaataatttcccagaataaccaatgtccgttaggcacctaatccttatgtcataatagatccgaacacttgccttggattgacttcaatatataattgctcccagtgaat

SEQ ID NO: 31350 - DNA, 475 bp, Sorghum bicolor
  unsure (1)..(475): unsure at all n locations
  Clone ID: 18067235
tcttcaattatgttcttatgataatggtattgtccttgcatggtcatgccattcttcatgggtgataactacggcagctccgcttgtcagaacaagttgatctggtgataagagatgatggggatacagtaagatgaatgagcaaaggcaaagntgagccttccccttacccacccacccatacacaccccaaaagaaaacaaaacgataatgctgactttatgtgatttccttcacattttagttgaatatatattgttgcttcatgctgacttaatttctttgttgcatttgtctgactccatgcaattactacctttgggtttagggtttgtaagaaataaccagtttgcaactaattgttgtcattgctgctgtagtggtggtgtactatatatattgtagtgtacatttgaatgaatgatcctccttaaatcaatgagaggggggaaatctgagacatgcgagtactttg

SEQ ID NO: 31351 - DNA, 609 bp, Sorghum bicolor
  Clone ID: 18067238
ctggttccaagaggccaaaaattggagacagtcctccactcaggcaaagaaatcgttcttttgacatggcacttccttgcaacaggactgacactgaagcaatcgatcgtgttaaggaggaccaaagcttggatgaagggaaaaaattgcaagaacagcaagaaagaaccccaattctagagaagagcgtgaatagttggataggaagatggtgccagggtggcactcctgtttaccatgaagacccaggccagggaaggcaaggaacaaagcctggccggtcatccgaagaacttgaaggtcagttcccaagcattgcagcgatggcgatgatggggcgagcgatgaacaagcttcggccatgcgagcatcagaagaaggggccatttgtggtgtggaagacagattgacctttgtgtatacgtttttgggtgtaatataccggtttctttccagaaagtaaatgtaaagcaactgtgaagtttgcctggcagtggttcatggtttattttttttttctgaagtgaaagtagctaagtgtagtgtctaccgatggtgtaatggtttaatataccaatcatataataatatactcttcactgtgccgtt

SEQ ID NO: 31352 - DNA, 691 bp, Sorghum bicolor
  Clone ID: 18067263
agaaggtgatccggtggatgagatgcattttattcttcatggttgtttggagagtgtaaccactgatggtggacggagtggattctttaacaaggtccagctaaaggaaggatcattctgtggtgatgagttgctcacttgggcattagatcccaagtcagctgctaattttccagtttcaagcaggactgtcaaggcactcaccgaggttgaggcatttgccctatgtgcagaagagctgaaattcgtggccagtcagttcaggaggctgcacagcaggcaagtacaacacacattccgattctattcccagcaatggaggacctgggcagcttgcttcatccaagcggcatggcgccgttattacaagaggaagatggcagagcagcggcgcaaagaagaagaggcggcaagccggccaagtagtagtcaccctagccttggggcgactatctatgcatctcgttttgcagctaacgccatgcgaggggttcacaggctaagaagcaaggctgtccctaccattgtcaggctgccaaaacccccagagccagattttggtgtcgacgatgctgactaacgaaacaatcacactgaactcgcttgtaattgtactttacctcgtctgtagattatgtacaaaattcaatgacagctgcagaagataagttgtaaaggtttgtaaccacgc

SEQ ID NO: 31353 - DNA, 377 bp, Sorghum bicolor
  Clone ID: 18067269
aattctgtggaggtaccatgtccagatagtgcagctggactatacattcggactcgtgataaccaagttgttaaggttgtgtttgatgaggatcagctggcttaccaaattggggaaactactgaaatactgtcaagagggtatctgtgtgcaacgccacactgtgtgcaggcacccaacagtgaaaatgcttcaaatgttgaccgctctacttttgccttgttcatgcaaccagattggaatgagaagcttaagtttccgagcgaaatcccctatcaccaagagttgattccaccaaacggaacgctgactttcggggaatactctgaaaggcctagtaaacatagtattacccagacaacaacgtagagctatac

SEQ ID NO: 31354 - DNA, 681 bp, Sorghum bicolor
  Clone ID: 18067275
tgacattgcaggagggtatatccaagttagaagagtttctacaggctgcaaatattactcttctgaagttcagatctgtcttgtttgcctgtgttcctaaggccactgaagtagttgcagctgtacttattgtcacagctgcatttcttgtcttcgtaccttccaggcatctgctacagatgttactcctagagatgtatacaagggagatgcccctaaggaaacagaacactgaaaaattccgcaggcgaattagagagtggtgggctcgcattcctgctgcacctgtgcagatgatcagacctaacgaaagcaagaaaaagagatgaccatgggctttgggctctcgaatagaaaaaaaaatagccacagatttcaccattccccggtttgaacctgatcagctaacttgtatagactttaaccctgactgcgtagtaatcaaaatgctacggaattccactaaaaaactagccttggtatagtgctgtgttactatgagtgtaaaatgatggatgcaaaagaattattcatttttcttgcaagacatttcttagaagtttctagagctctaatgtgctctagaagaatttatcagatgttaggactaatacttggttggaatgtaaggctccgtttggcaaagtgaatccagtaggagttctgccattttttttttcc

SEQ ID NO: 31355 - DNA, 516 bp, Sorghum bicolor
  Clone ID: 18067277
gaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaacccgcagaacgaagaggactcgcttgcgtactgagacacaagaccaggtcaccaggctcccagagtcttaggattaccatttgttattagtaggaaggcgcactactgtactcgtgtatgtgcagtggccagtggggtgtcttcaatcgtcttgggaagagatgattgatgtgtatattgtaagatccatgaaaattgtaagatcaacgccatttttgccatgtatgcaagcatgccccactgccagaggctagcgagggcgtggtgccctttttggttttggacccgcatggtggcaggattcaatgctacattgaggcgaatggcagggcccttgtttaattcccaaaaatagtttgc

SEQ ID NO: 31356 - DNA, 511 bp, Sorghum bicolor
  Clone ID: 18067286
gtttacacagaggtggtgatggccttgtgagggagattgaattccggcggcctattgttgtgagcattttatttgagagacgggtgcatgctcccaggggattaaaaggaggacgagatggagctcgtggtgcaaactatttagtcagaaaagatggtagaaagatttcccttggaggaaagaacactgtatcagttagtgctggtgacatttttcagattttcacgcccggtggggggggctttggctttccttgatgacactttttgcagatgctgatcgtcccccatttgtttcctccctttgtacactagtagctttatttatccccctattgaaataaaacgtaataggactgacacaaacccaccctgttggagattgcagatgctattattgctccctgaggcattggatttgaataaagcatgagtggtgctattgttcatcagatcccttttatgtgaaacctataatggcaaaattgatgatgaatgacgtttgcactttc

SEQ ID NO: 31357 - DNA, 539 bp, Sorghum bicolor
  Clone ID: 18067291
tcgcggtgtccaatacaggaggtgccatggtcattcttttattactccaagggcaagaccatcgagctcccaaatttacgtgaagagtttgaggtgcatcttgcaactgatgttgccttcagattgcagcctagacaactgaacgaaaccactgcagtggcaagattgagaacaaagctgcttgtaagcaatggacggttccagctggcttctgcagaaaagcaatcagatcaatcaaagcgtcacttgctacactgcagcactattgatccaggtcgcttgctgtcagcattgcaagagaaggggatggtatgttcatttgctgcagatgatagctctactgctagtgaatgttctgttctgattactagtcctggagatgccttggtgaagataacatctgataggactgttatatactgcgataatgagagaacatgcaatcaaatttatgatgcacttagcagtgtttgtaaagggatatgactgcataatactgtatgtgtaatttgtgttcgtaatgaaattgtccgtttgtg

SEQ ID NO: 31358 - DNA, 203 bp, Sorghum bicolor
  Clone ID: 18067304
ggcggtgctgatcatccctttctcatccgtggaccgttgtcccccctaccccatttgcaggcatgttttaactctggtaatatgcgttttgtcttgcaattaaaaccattgcaaaggaactattgtcttggttgttccccacatctgattgctttacttatgttgtgggagtattagctaggcttaatggatttaccaatctt

SEQ ID NO: 31359 - DNA, 613 bp, Sorghum bicolor
  Clone ID: 18067305
tcctgacgggatagagaagatggtcacctacatcatgaagagatacaacaatctacccatgttcataaccgaaaatggttatgcacaaggtggagttggttacaaccaagtcgaagattggcttgacgaccagagtaggatacagtacctcgatggttacctcacaaaacttgccaaagttatcagggacggcgccgacgttcgaggttacttcatctggtctctcattgacaattttgagtggacatacggatacaccctccgctttgggcttcactatgttgactaccaaacacaggaaagaaagcccaagtcatccgcgctctggtacaaacggttcctccaaagtttacatgaagctcaatagagggtgccttttgtttaaatatataagcgcgtgaggcgtggcgactgaacaggctgctgcttcaattcagaaaatgaagaacatgatcttatttgtaggctagtcttagtgaaagttttatattatagttttgaatgcacatatgtattttagaaatagtacagaagatttttatccccataaaaattctctgtactcctatgaaatgtttattatatctctttattaatatagttctataccggt

SEQ ID NO: 31360 - DNA, 494 bp, Sorghum bicolor
  Clone ID: 18067307
tgaccggcgagctcacgacggagtcggacgtgtacgcgttcggcatggtgatcctgcagatgctcacggggctgctggacctcaacatcgcggagcaggcgcgcgaggccgtgaagatggacgccgtgcacagcgtgctggacgcgtccgccggaccctggccggaggtgcaggcagagaagctgatgaagctggcgctgaggtgctgcagcctggagaggaagcggcggccggcgatcacgtccgatgccgagtggagatcgctcgacatcctacgggctatggcaaccccatctagtaaagcatcatggaaatggaattcccatgcgagctgaacaaactgtaataatgtacagtatgcacctcctagtatatatgtacgtagtatcttgctgcagatgccatgaaaattgaaaacagtagtgttagctagtagtaattctcttgtgattagataagcatgatccaagaattaatgtgcattattaggatat

SEQ ID NO: 31361 - DNA, 551 bp, Sorghum bicolor
  Clone ID: 18067342
ccacagggaatagtcaggaggtgcaatttctgggggaggttattcatccattcgatgctcaggctgatggtgagctcagtctcgcggtgggtgaatatgttgtggtccgccaggtggcggcaaacggttggtctgaaggtgaatgcaagggaaaggctggctggttcccatctgcctatgtagagcagagggacaaagccccggcaagcaaggtgatagagcctggacttctgactacctgatccatccttctcgtacttatggttgctgacttgctgtcatggtcctttttctacattattgtacatgacatgtcccatgagtgattagcgtttcgtagaacctttacctttctgtgcagattattgttcttctaggcttttcgttggttggtaactgtatgtaaaaatatagttttgtctgttaggatttccttttggtattataacattgtacagagctattggtgttggtgatgagatgctgtcaacgtgccctttgtattcggacatcatgcttcctgccgaatttatgctaactaatgatttcat

SEQ ID NO: 31362 - DNA, 674 bp, Sorghum bicolor
  Clone ID: 18067357
gtgcgtaaccaatatcaacaactgcacacacactgctgaagtagaggaggatgccggtcaagattggggggaggtagtgatgactatcgcacacctgctcaaccacttgccgacgaagagcttccaaggtaatactacatacgaagcctggcatggtcacacgccatcggtgagctacctcaaggtgtttggctgtatcgcctatgccaaggatctgggccagctatgaaagctggatgaccacggcaagctcagcgtcttcatcagctatgcagaacgggctaaggcctactggatcctcgatccagtgaagcagtgggtgaagctgagccgtgatgtggtgttcgatgaacggtggggcttgggattggtccacctcgggcatagggagctcagctacagcagggaccgagttcaccgtcatgtactagatgcctggagatcaaggaggggcacaaagtgcttcttcactgacatttccagttccaagggagttctagcagagtgcggccatcccatctaggccctctgctcaggcaccatcaccaccaccaacggtgtcggcacactctgcttcccctatgccaccatcgctggttcgtgctccttctgcgtcaccagtgactacatcgacaatagctgaggacaatggtcatgtggagttcaccactccg

SEQ ID NO: 31363 - DNA, 137 bp, Sorghum bicolor
  Clone ID: 18067376
tttgttcctgtaacaccccgacgcagatcaaaataaggaattttggggaaggggctactactaatgcaaccatttgatgaatatttatttatttgcagtctcagtttttactatggcaaccctgttcgcttaagctt

SEQ ID NO: 31364 - DNA, 509 bp, Sorghum bicolor
  Clone ID: 18067388
gtcggggcaacaaccagaatgcaggaatatcacaacagagagggcagaacaacatatctagtaatcaagcttcacttccgagaccagacttcagcaacactaaccagatgccgctagggatcttgcagttcaagagcgagcaatagtaacagaaccttgcttactgttgtttgggtgtcgttcttttggcaaataggatgtctgcaattcgtacagtcatatggcatcaaagtttcttaaaagtctgataattgaaatggtatcagtttacagtttttcccacagatacacaggatagctgatacggcaccatcatttgtagtttgtacatgttattaagttcaagcgtgcagtatatgcatatgcttatgatgttttgtagatggatcagtggtatacatgtttatcttctgattttattcccaacatccaacaagatcttgtatgtattgtaataagcttgaaaatataagtgaatgtacagatgtttttcagttacgttttacttg

SEQ ID NO: 31365 - DNA, 425 bp, Sorghum bicolor
  Clone ID: 18067415
tttcagggtaaacaaatggcatatttctggatgacaatggccttcattcagatcttcacagttgttgagtgcatgaggtgtgcactttcaggggtgtatgcaaatattccgtttatttctcatgcagcattcatccattcagatcttaacctgttcaggtagttgatcattgcaaaccacatttttggaattaagaggtactgaggtggttgggtaatgtggactctcaaataggaaaaggactaattagagacgaaatcagtgtaatcatcgttctttgctgcattgttgtcggtgctgttgacttcatgtctctgaatttatgcttcagtggcaccaggctttgtgcttttcttcttccttctaccctctttagcggcacaaactttgagaatttatttaaatggataaatccttttcgattg

SEQ ID NO: 31366 - DNA, 127 bp, Sorghum bicolor
  Clone ID: 18067431
caaccacagtagtgttgcaccgaatgtacattgtacagaaatacagggtactgtacttatattagggtaaattttggttgctatgaacttaattaagataggtgcgcgattggattaagaactgatt

SEQ ID NO: 31367 - DNA, 230 bp, Sorghum bicolor
  Clone ID: 18067438
ttctcgtttgcagtttgctcgtggttaggaataagtgttgcttgtcagtcagcgtgagactgagattagactacatcatatagccagccactatgtatggcggtccaaattttttttttttttttttacctggtgccgaataagtccgagcagatgctacgggctcaaatacttgtggggaatatccacccgttcagtttggactttggaatgaatccgtctgcgttatc

SEQ ID NO: 31368 - DNA, 404 bp, Sorghum bicolor
  Clone ID: 18067479
tgcaaaggatgcagatttgttaattttggagggcatgggacggtccctgcataccaacctcaatgcccattttaagggggatgctctaaagcttgctatggtcaagaataagcgattggcagagaagcttttcaatggaaatatatacggctgcatttgtaaatttgaaccagttttttaacaatatgggagtggcagtggagcattgcaacttgattggtgcagccggggagacagaaacaagcatggggaataatggtcattccagtgtacggggtacaagaaacgcccttccaatacgcaggtagtgtttgggataatagtgtttcaaacgaggtaataaataaaggctttaaagtccatttccagaaatattgaatggagaggtttgagccagccaactg

SEQ ID NO: 31369 - DNA, 176 bp, Sorghum bicolor
  Clone ID: 18067499
aatccattgttaatattggttctggatttaggtatctgtaggataagtatctttttgttttgggtcacttgaattttttttagtagaactgtaattcagaatgcggaccaagtaaaacttgtagatgtgtgtttctttctctagcttttcgttagtggggtctcagcttctcatat

SEQ ID NO: 31370 - DNA, 661 bp, Sorghum bicolor
  Clone ID: 18067504
aatgtgtgcaacagggagtttctcccagcagacagcccttggacatgcccttatgatcatttgttttatgatgcatcagtattatggggccttattggcccacgcagaatatttggtgatttaggcacttactctgctgtgaactggttcttcctaggcggcgccattgctcccttccttgtctggtgtacacagaaagcattcccggctcagaaatggatccgacatgtcaatgtgcctgtattgattggtgcaaccagcttgatgccgcctggcactgcagtcaactataccacatggatactcattgcatttttgtcaggttacgtggtctataggtaccgacgtaattggtgggagcgacacaattacctgctctcaggtgcccttgacgctggtttggcattcatggctgtattgctatatctatgcctgggactggagaacaaaagtttgaactggtggggcaatgatttggatggatgccctcttgcttcatgccccactgcaaagggcataactgtggatggatgcccagcacataattgagagaagccatcattcagtatctaggggtaaaattacattttatccctaaaggggcatgtacctatcaatggaccatatagataattgagacttgagaggttctcttattgct

SEQ ID NO: 31371 - DNA, 617 bp, Sorghum bicolor
  Clone ID: 18067505
ttcgtgcatagatgcttaatttacattttacctgaaatttattatacacatcttgcccatacatgccttctgctggtctgtttttgtttccttctgagtgcatacatgcattttgaatgggtgcttatatcctcctaaaccttatggttttgtcctcattttctgcaggagatacccccagcaatcattcaacagaccactagaaattttgtcaatggttgctgggttggaatacataagaaccctgacatattgattaagactcttagctgattaagaagacaggtatctactcgaatttccatttactttcgcaagatatacagagacagccctgcaacaaaaggtctgccaatggatcaatgtttgctgccttccatttggcgtttcaatccccaggatctcacataaggtgaatgaacgtgatgagttggcgtctcttaaggaattcgcagtggagacagggtcacaatttgagatgtgtttccccctagccttctttgatgtgatggttcaccttgtggtgcacttggtttcacgaatagaggcattgagtcccatgtatttgcatgaggtgtggatgtatgagcatttatgtcaacactaaatggctatgt

SEQ ID NO: 31372 - DNA, 181 bp, Sorghum bicolor
  Clone ID: 18067530
ctgaagattgggtgaatccttcctactggaaaatgagaaaccggtccatgaagttccatttctcccatgcgaatatagatatgctactttcgtgccgcagtttaggttatttttcggagacatagctctggtatagttttgtagtcacttcccaccgtaggtgtaatgtttagttatcttt

SEQ ID NO: 31373 - DNA, 603 bp, Sorghum bicolor
  Clone ID: 18067555
ggaataaaagatcattcgttggactatggagatcatcaaacactgtagacataaagaaaatgggatccaatacactcaatggtagatcatcaaatgccaggatgtcaaatgtcactgaatctcctgacctgaagaacagtgaagtgtgtgacagtccgcacatcacagggcaatggaggccagacctgctgaacccggacatcgtccgagctataaaaggatgcatcgactggccccgaggagtgcagaagcacagcttgaagtccaagattctagaggcaaggattgacggcagtaaggtccagctgcgtcaagcgttaaagcagaagatataagcatggtcagcgggtcacattcttgaaggaaagaaagagatcatgatgcttctgctagtggggtttcagttggactgctggaggcctggttctggcagcgccccgcgagaggaatttcagcagcagtaggtgttagatttgaccgtacccaatcgatgcctcacggcccacctgcttccttaatgaaattgttagcccagtgcccgttgtaatcacgcctgtcctgtgtagaaatattttgatcaataagcaatgaaatcattcgacc

SEQ ID NO: 31374 - DNA, 675 bp, Sorghum bicolor
  Clone ID: 18067567
caaagaagctaccaaagggccaaggacgagctgcattgtagctaggacccatggatgttgcgtttgactcagcctaggagcatcaggctttcagtgaagatgtatataactcctttactgcgaacaggatagatgatgtcactattcattgtcctgcttaggttttagagtagctggttgttcatgtaaattgtgacatgaagacatgctataattgtcacactaggggagcgctggcatacgacgtttggtgttgtccaagcaggacaatgaatagtcagcatcctgccgccaagctggaagatggtcagcatcctgacgccatgctggaagatggtcagcatcctgccgccgttgggaccattgtccaagaaaatgcaaatcttggggtttaaattcgggatgaatatgggatttttcccatagtacgggattctgcaaaaacatatgttctgaatctctgtaaaatagggatggtcatactgggaaaaatggatggttgggatggaatcgtcagtttttgtatctgaataattcagtcacggtccattaacttgggccttgtttagttgacaatttttttggattttgggtactgtagtactttcgtttgtttgtggcaaatattgtataatcatagactaattagggttaaaagatttgtctcgtgatttc

SEQ ID NO: 31375 - DNA, 543 bp, Sorghum bicolor
  Clone ID: 18067583
ccatctgttcggctggcgtgtacatataaacataagccagtcgccgacgaggtcgcccggcggtcacgtcgatttgccgccgggttactgtggctctggaagctcacagggagaggtcgttgcgggtcgtcgcgttgcgtttccttcctttttgtctgtgggtcgggacggacgggccgggtggtggaggccggcgtcaataattcccgtcgccacccctcgctgcagcaaatgatggcgagcaacagtggagtgcagtggagtggaggtggtgaggtggtggtggttgcattgcacttgctgagccgccgcacagcagcagccaacagcagatgcactgcactgcactgcacagtggccgccttatcctgtttgcctatcggggcaatggttctttcagccgggtctaatcatgtttggtgggataaggtgcctgccgtgtttagcaacgagggatacaatacaaagagattattgttgccatcgatcgccgatgtgtggtctcggtgggactagcgcagcgcgtttcgtcttttggcctgg

SEQ ID NO: 31376 - DNA, 655 bp, Sorghum bicolor
  Clone ID: 18067597
cattgaggctgttgagtcctgcatcgagatttggaggtccagccattcgggaaaatacagcattctctttgtgctggacatcatctctagcctcttcagcggaagaattgtgtgggagaaagtcagtccagcgctacagcgtgcagtgcaaagccagatgagtctaatgagcacaccattcatcgacaacaatgacctttttgaaactggcagtactggaggcatgtcaagggatttgattgataggatcccaaagatgaggttcagtgctgcaagcaactgtgatcaggaaactgatagcagctgctgctcagtctgcctccaggatttcggagcacaacaatttgtgagggccctgcctcagtgccaacacatattccacgtgcggtgcatcgacaattggctccttcggcacgcgtcttgcccactatgccgggccggtgttcatatagaccatatacatatgtaaaaaaacttgcagcgtggcacctggtgtattttcatagtgaatacccgtgctcctgttggatatcataagtatagctgtatacatagggtttctctcttttttgttacttctacagtcttacttatgtggggctatgctttcagctgcacgtttttgtcgaagtaatagcttgatatgtacatcctg

SEQ ID NO: 31377 - DNA, 164 bp, Sorghum bicolor
  Clone ID: 18067617
ttcgttggggttcaccatggggttggtcccctccagctgaacgcgtccgagctgacccccccaagtagcccagggatgaggtaattatgtaaaccccctctgtatcctataactcccacccccagtgtggaggtccatgtacgctttgggggggtcgcgctact

SEQ ID NO: 31378 - DNA, 636 bp, Sorghum bicolor
  unsure (1)..(636): unsure at all n locations
  Clone ID: 18067619
tctcttatgcttttatggtgtgnctggcatgctcggaataaggtgaaccaaggagaaagaagatgtgtgattgaggaaatctgtaactctgtttattatcatcttacgtgtatgcacaagctcaagctttcagcctctactcctacaaggcatcaacaggaacgatggtcttattttccaaacactagaaaagggggttggggatgtatcatcagaaaccacaaaggtgaatgtttggctgcaggggttggagcacttcagggactttctaatgccatgctgagactctggcttgtaggaaagcttcggagctagccacctctgttggagttggaattcaaaggataataattgagttagatgcccagaatctggtttctgcattgatgtcagacacctacgatcgtgcggagcttggagcatgttttaaggaaactagatccaaaatagcatgtgattttgtatatattgtaatgtttcaaaatgtcccagaaattgtaatgctgtttctgactgtcaagcagattatggtgcttctctgagtgatgttcagttcaaattatggatagaccaggacaccaaaccttgtaatcccacttgtatccgggaatctacctgtttctgtatgttaaatgg

SEQ ID NO: 31379 - DNA, 629 bp, Sorghum bicolor
  Clone ID: 18067624
cttttcttcgttaaatagctgcagtatatatatgcagccaactgctcctcaatctacgatgaagctaattgccacatatatgccatgttcaatatttattggccctcttctaagttccttgcaaatttactgaaattatttgccaacctgtgtctttctgtgttccttaggccatttaattgatatagtacagacacctcacggttaatgtatacctcaaaatctttcttctttataatcagtttagttcacaaaaattatttattcagttaatagattttgctatctcaaagcaggctatagcgaggcacgaccacagccttctgtgatatggtcctgccgtacaataaccacgaaaccggtttcgaaaccctttgattgtataaggcatttcagtattagttagttgagactgtctaagacttttgtaaacttatgtactcgcttctaggcctgtccactgtatattatttaagctattatgcttcgatctcatgtatattacttaggacgcctaggtcctgtccaaaatttatatgccgatctatttatgtaattgcaagaagcacatatgctatccgtactaatatactccagtatgcatggaacttaatatgctatcatgtttt

SEQ ID NO: 31380 - DNA, 669 bp, Sorghum bicolor
  Clone ID: 18067647
tgatgctatatttgtggctagtgcgttcctgtccttgcttctgatttctgcccaatacaccaccaggcaaacagacaagcatccgattgattgatgcatgctgcccacatctgtgcatgttgtcttttataaccactattcatccaaggttgacccattcttttgtaccacagtttccaaaggcactgtttcttgatagacctccatacacagttacaaaacataacacgtcagttaacttgaacaaagtctctattttgtaatatgtttcccggtggcattggttcatggtaaacagttcctccatatggaggttttcttgtctgctgaccctgcactgccacagcgaccatctgagtcatctctgatgatgctgtaatgggattcattgtaatgcagtctgcattgtagtacattttgacgaggacaattgaggaagcccatattaggaatggagtatgactttgtaaaatagcttgaaactagtgtcctagcacggtatgtgtttggtgtatcttctatattcttttggctgtttcatgtaacatttttgcgacaactctgaaaggtagatctgttattcatgtgactactatatactacctgaatccttataggtactttgtagtctgtacgaatatcctctataatgatgatgtttctttggtg

SEQ ID NO: 31381 - DNA, 150 bp, Sorghum bicolor
  Clone ID: 18067660
tcaaaagttaggttttttttttttgggttgatccctaacgaagagggagcaggcaatgatgcagtagcatcatttttcgttaaatgttatgttaggtcggatggcaatgaatcatttgacttgcttattttgtcatgttcatatttacaa

SEQ ID NO: 31382 - DNA, 641 bp, Sorghum bicolor
  Clone ID: 18067709
ccttgagcaaatggaataaccagcatgtaaggttaggggccaaaatcacttgcaaatggaacaatatagttggatcagggagctgcttgtttgttcctaagatgatgttcgttggggacaaaccgcgaaggtccacaaggggaagcaagtgacgatacttttgaggcatgcatactcgtgcctcacatgtctgtggctgctttattggactgaatttcaagtatctgctttagttgttgttttagctcttgccgaaatgaatgggtgttatgcacaggatccttgcaaaaagagggtaatagtatacttcaagttaattagtctctaggttgcttccatccgttatagtattgtgcagactgatgactggtatgcgtttgaggttttttgtttaaattttagtaggcaatagggtactgtgatcaaaacattagtgtgggatgtcctatccttcaaggaccttataggaaatattagtgatggtgtcaacagacctccagagatctctaatgtgctcacaagagaataaaaatctattgtatgactctttgtatcatcacattcaaaagacattctcctcacatgaggagtcatgccattgaattcttgatatcaatttcaatgaacaattagttaatttc

SEQ ID NO: 31383 - DNA, 643 bp, Sorghum bicolor
  Clone ID: 18067712
attgcctgtaggcaatgaggcatctgtgactggttcgtgtagttgcccatgcccacgctgtttcagttgatgtatcggacgcaggctgcataagcataatggcattcctgcttttacagtgataatggatctcccagcatatgcattcttgcttttatccagcacatggccctgggacaagtgtcattagttgacagttcaacgtcaactcaccaaatcaggatgatatggatgatgaaaatgtaatgatgaagctggtgaggtggtcagtgcagctgaggtgctttgagtccaagacccaagtgaataacgggagcagaagcaatgggagcagaaatgcagaagtagatgagcagtgaagacaattcaaccagccatggaggtggatgatggtacgggtttcatattctgagtcttgctttgcaagtctgccaataaatataatatgactacttcaaagtactaccttcatgaactatggggctgcaaaccgtttgttccatctgtgatttggtcgattttatgttcattaaacctggcatatttggctctagactagagttatatgctggttattgatgtttgtcaaactgtaagctacttctccatgcaagcatggcacattggccctagtagaatttat

SEQ ID NO: 31384 - DNA, 283 bp, Sorghum bicolor
  Clone ID: 18067734
tgtacaccgtgcacgtcttcagaactccccgttacttgtatccggtgcaggccaccgctctggactgatattttgtaggttccacttaggaatcagtatcagcaactctatcctagttggtttgtagcttgcacggcacccgttcttgtgtcgcgtaaaaatcttcagactaaatgcttagttgaaattgttgtcgtgattcgtaagttatctatgtatttgaggagtcctcgacatgctttcgacgatgaactgcaataatttgaatgcaggaggattgttg

SEQ ID NO: 31385 - DNA, 579 bp, Sorghum bicolor
  Clone ID: 18067751
ttgaacagaccaaaggatgctgctgagaagctatcagtttatataagagatggcaatgatattgagttgccgtataatgtggagaactctgaaaaggcattggttgagagagatagtgatggtgaagactcggttgctccttcagtgacaaaactagccacagaagaatctgagcactcagagagcctcaggccagaggaggcccgtggtgttctgtatattgaccttggcatgactgctgcaatgcagggagaagttgagcaggccaattacatggtgagccgtggcctggcgatgttgcccaacaacccccgggcagtgctagcatcagtttacatagaccttttgcaagggaagtcccaggaggctgttgggaagttgagacagtgtaggaatgtcagatttagacccggtagcatagcagccagcagctgagcttagaaaagcctcccttttcatgatttctgtagtttacaattaccattataatatttttggaccctgaccccaatgtggatgatcaaagatggaaatgtgtaccatacataagaaatgaaatgtagctctccttttagcgcc

SEQ ID NO: 31386 - DNA, 231 bp, Sorghum bicolor
  Clone ID: 18067811
gacgccacggccctctcatgccgatgagtagataacagttagcaggagaggctactaattgatgcagcaaatatttctctatagtattattgtgaatggtgaaagaaatttcctctgttggtatatgagttcgatctggatgttttctcgtcccaatgtgctttcttgtttcactgctgtacttttaaataaagatgaatctgaaactacagattattctcactgcaattc

SEQ ID NO: 31387 - DNA, 575 bp, Sorghum bicolor
  Clone ID: 18067845
gatgtacgataaacagagaactcacgagagcacggagaaggtcgctggaacattcggatacatggcgccggagtgcacgtccggccgaaagttcctgctgtccatcaagtccgacgtgtacagctacggggtgttggtgctggagatcatcaccggccacaagatctacacgttcgaaggccaggactccgagggcctcgtggaatacgtgtggcagcactggagggagaagagagcgagcgacgtcgtggacggcgacgtggtgggcgtggaagcagggcaggagcacgccgcacggcaagcgctgcggtgcgtgcacgtcgcgctcctctgcgtgcagtcggaccgagcaaggcggccagccatggggcaggtcattgccatgctcagcagcgacgacgcggcggcggaggagctgccggagccgactctgcctgggtacgtcgtccgtccaacggcggcgtctggtgtccagctctgcttcgggtgcaggtagcgccgccggccgggtgtggtatttggttggtcaaaaattctgaaaagcagaatctgaccacacacaaacacacacacac

SEQ ID NO: 31388 - DNA, 568 bp, Sorghum bicolor
  Clone ID: 18067863
ctgtcttatttagctatctttgtaatgctaatttgcattactgagagggaagcattgatcacagatccgctcaatttcaatgtattcaacatattgtttgaagttgtcagcgcatatgggaatgtgggtttctctgtcggttacagttgcaagaggctactgaatcatgatgtctactgcaaggatgcttcgtatggatttgttggaaaatggagtggcaaggggaaagtaattctgattatcgtcatggtttttgggaggcttaaagcgttcaatatgaaaggaggaagagcttggaggcttagatagtctcaatcattgaacgctttaagtctccaagctcctcctagctcctgtcatattgattgacaccactccatgttatgtggtgactggtgagccaggtatacataaaacagcgaccctagcatagcataagctgatgataaagatgacaggtgcttttcagcaatgcctctctgccttccccaaatgctattccaccttcgtggtgtagcaccaatgtcaatatccaagacaataacactacaacaagaggcctattctg

SEQ ID NO: 31389 - DNA, 347 bp, Sorghum bicolor
  Clone ID: 18067881
agcttcagtggattgactagtttccatctgattattatctggggactgagatccatgtttctttgttgatctgatggtaaaaatcatgttgtggtactggcccttggtcctgtttgtttgaatcggtacggattcactgggggtattggaaccaaggatgtcggagaacaatcatgcccaggctgattgcgatctcgagggagaaagcagtatgccgtgctggggtaccatctgcttgtaaaacatgttcattcacgaattgtaagaaggaaaaagagggtaaattcttgacctttgttcacaggattgttcgattttactttgctaattaataagcaacggttctc

SEQ ID NO: 31390 - DNA, 301 bp, Sorghum bicolor
  Clone ID: 18067928
tgctagctttgaaatagaagcccgtccaactgggtttcctacccaaaaaggtgagaacctgcccatgaacccaagaagttcgtactatgctaggtgattagcatatgttgtaatgtattccattgaaacttttactggtgggacatttgcgagctagttgttttactatctaatgggtatatactgttacagaaacaaagctctgcctatatttacccattcaagtatgtatatgtgtttttgcgcagcacatttgcaacccataatactccatgacaacaaatttataaggtgtttcttt

SEQ ID NO: 31391 - DNA, 567 bp, Sorghum bicolor
  Clone ID: 18067939
tcaccggcgagaagcctacccacgtttcctcggccccggagaatttcagagggagcctagtggaatggatcaattatatgtccaacaacgcacttctccaagacgctatcgataagtcgctggtagggaaggatgctgatggtgagctgatgcagttcctgaaagttgcgtgttcctgcacgctcgccaccccgaaggagagaccaaccatgtttgaggtttaccagctcgttagagccattggggaaaggtaccatttcactgccgatgatgacctggtgctgccacctcttagcacagatggtgatggtgtaaccctcgacgaactcattgttgccaagtaattgcaaaattcatatgtcgcagaagacaaaacaagactgaatgtcttctcttttttttccccctccgagggaattagtaatggtgaagtgagtatatgtagtaccaattagtagcaggataatactgcatccgctgtatagttgttgtagcttggttgttacccaccctttggagatgatagtagctgtaaaggataatttccatgtaaccaatttgggggct

SEQ ID NO: 31392 - DNA, 557 bp, Sorghum bicolor
  Clone ID: 18067940
gaatgcgaagacaataaaaccagacaaacggaagctggtcttatcttttgatgatcccaatatcagatgggatcagttcaagcagaacatgcaggaaatactgcatcacagcgacatgaagagcattgcattcaggaaaccaaacgattcggtgtacacgttcccaatgcctgaatgcatgtgtcagcaagatgggatgatataggcctgacagaataaacatgaggcaaatccttttgtgttttggttttgagactgataccacacagataggtaggtgtaggcaggtaacttgtacattcataataacctgtaggtagtgtcaccatatgcttgaaagactgaccagggattcgctgattcatgttggttccactattctagggtggtctatggaggacatacagttgggggttgggttgggctgggccgtggatgttgacatcaatcacaacacttggacttgagagagggcttctgacaaaatgagaccctaccttcttgattgtatatgtaaaggggatgcctaactacaaaggggaaaaagactttctgat

SEQ ID NO: 31393 - DNA, 607 bp, Sorghum bicolor
  unsure (1)..(607): unsure at all n locations
  Clone ID: 18067944
cctagatgataacgcaaagcaggccactggtgttggcactgagatcaattgcttganaaggagagaggagctgctgaactgcatctccagcatgtcgaaaagcgctgaaaggctccggttggggttggactcactgtcgaagcgggtgggtgacttcttccagatcgtacttacagggcgtgatgcactactttgcaatctcaggatttcagatgggggcaaggttgctgcagaggtcaggtcttaatatgctatctcatgtttgtgccatgtaatgcgtgcataaacagctcaccagcccatccttatgcgtggtgcttctgacttctggcccctgctcagccccaccaacactaagccggggccagatctcagaagcattgtgcataatcatgtgcctctagctgtggtgtgcaaaagcttatatagcttctctttttggtaagtaggaactagagtgttgttgagtaaatagtgctgttaagttggtgtcggtggaatgtacaccatctagagtagagcaactgtatgaatgctcatgttgatccctgtttgtctgttggataacttaaactggtatgtaaaactttctatgtacttgtacatc

SEQ ID NO: 31394 - DNA, 612 bp, Sorghum bicolor
  Clone ID: 18067947
atctatggccatataattggcatgtttgagatgaacaatcttgatttagttgtcgcatcaccagttgaagactatttcatacacattgatgatcttccagagagtgagaaggaggaagcagagaaggtaacggggccattcctagatgctttaggtgaagactattcagtcccttgtgagggaacggcgttctttcctttgcagagttgcatgaaccactcatgctgtccaaatgctaaagcatttaagagagacgaggacaaggatggccatgcagtgataattgctctgaggcctatcagcaagggtgaagagattaccatctcctacatcgatgaagaccttccatacgaggagaggcaagcacagcttgcagattacgggttcacgtgtacatgcttgaaatgccaagaagagcaaccggtctgaaaggagaactcagtttgtattttgtggcatttgggaatcttcatgtattttatttctctgggtaatttttgaaagcttggaaaaagtgaaagtgcacaaacaaggggagtttctttttgggttgcaacttgcgaaagatgatatgttcttgttcaaaggatagtggcgaccatgttaaaatgc

SEQ ID NO: 31395 - DNA, 621 bp, Sorghum bicolor
  Clone ID: 18067955
cccggcataagatcaggcgctccccgcaggcagcatttgacatccctgatacaagtgctttggcagaggatgagacctcttcattggtttgttcttcaggatttcgctcaccaaacgagatacaaaatcagcatcagtcaacatcaaagagacctattgaacatctagaaaatcaaccttttttacaccttttccatcaagcagaggatgatagcatgcagcaagtacaacattgtactcagttcccacccattcaccaatgtacgagcaatccacatctatcagataacccccaacaccagcagcaggcttacttatctcagcagatatcttgcttgcaagttgggcaaggtcatcttggtggacgcatgcatattgttccaaccagcccagcgaagttctgcgatgagtgtggctccccatatttaagggcgacatcgaagttctgctccgagtgtggcaccaagaggctagggatgtgactgacttgatcaatgtgtatatgaatctgatgtgtagtagtattgtagtcttatgtatgatatagttagtactcccttgaagctgtgcgggaagtgtatccttgagatgactcaatagagagtatgcagccaccttttt

SEQ ID NO: 31396 - DNA, 107 bp, Sorghum bicolor
  Clone ID: 18067959
ttccatttccaccttttttggcacagggctgcccggattggttgttggcggctaaattttgtaaacttgttccggtgaaaagaggggaaaataccccttgaccactt

SEQ ID NO: 31397 - DNA, 591 bp, Sorghum bicolor
  Clone ID: 18067960
cgtcgcgcccgcggcgcgccgcttcctcggccgcgcggaggcgttcacgccgctgcagctcatggggctcggccacggcgcggtgatcgccgcggtggccctcgcagcgtgcgccgagtcgcgcaggctggcgaatgtcagggccggggcagcgctcttgggcattgcgtggctgctgccgcagtacgtcgtgatggccgtctccgatgcgtcgctcagcgtcgggcagctggagttcttctacgaccaggcgccggagacgatgcgcagcgcctcgacggcgttctacttcctgtcgtgctcgctcgggaacctcattagctcgcagctggtgacgctggtggcgtcggtgaccgagatgagcgggaggacgggatggtttccgccaaacctggacgatgggcacttggattactacttcatgctcattgtcggcatcaacgcagtgaactttgccgtttttgtttacctcgccaagaattacacgcccaagagggttagataggattctctcctgtcttttttcctgttagttgtcatctgcatgtatatagttcatataaaaatgcataatataaatttgtttttttt

SEQ ID NO: 31398 - DNA, 557 bp, Sorghum bicolor
  Clone ID: 18067974
cactgttgcttgatcagtggatatcccaggaatggcagatgagaagtcgattgcaaaaacttttatgcctccagaaacttggttggctgacggcgacgcccgtccagattatgattacagtacaaagagtcacatggctgtgtgcttgagctgtattgcttgtggaccagaagttgtatttagtcctgtggtcctgcaagatatcgacagcatcgggcggcacattgttgggacggcccggggaagatggatcccatcacagaccaaacaaactttgcgcaaagattggggtgtctggctgcaattgcaatgccttgatgttgttccttttctctgtttcgggctccctttggggcggtcctccgtaaatatatatagttggatggatgaacataatttttttgcccgtttgagttccccttgcctgatccaagatggtcgacaaggcgagcggggaggtagtagagttcactgttggataggaaaaattagttggaggggagtgcacatattggattcatttcatttgttcatcacataccatcaccatcattcat

SEQ ID NO: 31399 - DNA, 676 bp, Sorghum bicolor
  Clone ID: 18068003
tcttgagctaattgcttacactatctggaatgcacttaagtattcttatgcctttgaaggaatagctgagcaactaaaaaaggaacggctggaacagttggcattgaaaagtggtcaggccagtgatgaagtgactccattggatgctgacattgataggagtaattttgattcatctgatcagtctgcaaatgtcaatgttgcttctggcagtggggctggttttatgagtgaagcagctttgatcagcagcatccacctagaggataaaactcaaaccatatcctcagttaagacctctgagaccttgtcaggcctgatcagaccagcgaataaggatgtcctgagcacatcagcaggcactacattagtcgaagcatcgctcctaggtcacagcgccaccgtgtttgatgctgtgatgttgtgccgctcgactctagctctgtcgctgccgcctgacaatgggaaggccacgtcgctcaacctcagtgccactaccaccgtccgacatggagaggccgtgccgctaccatgcaatgctaatatttacatatatactcgaaccttgatatggagattttataagagatttttcaatacatgtgtactatccatgtgacgggcactaatatttacatatatagtcgaagaatggtacgaagatgcggtgaaactt

SEQ ID NO: 31400 - DNA, 569 bp, Sorghum bicolor
  Clone ID: 18068038
gaagaagagctgggtgcccaagctcgtcaagtacagcaccttctcggcggggatgatgacgcccggccgcaccaagaacaacagcaccgacggcctccacatgtcggattaccagtcgctccacggcggcggcatcgcgtcgccggggttcctcagcatgctgtcgccacggcgtctcttctcgccgcggagaaattccaccaagcactagctagtagcttaattagtacgtacgtagtggtcactctggtccccggcgacggcgagctatacattatgcatgtgtgctgcctgcctgtttgcttgctgcatgattcgagtgttcatcagatgtgctatgctcgtattgtagcacaagctaaagctactgatcttgctactgcaggtgtatatgctttcaattgaagagaggtatttctgaagtgtgtatagtagtacgtagtgcaaatagtagggcattgatgtacataagaattaagggtgtccttttttttcttttctttttacatgtgcactaatgcttatgttggagtagtcttaatttttgaaggaaatataattgttcatcc

SEQ ID NO: 31401 - DNA, 622 bp, Sorghum bicolor
  Clone ID: 18068045
gggcaggcgtcgagcggcgcatgtggtgagttgtggagtcgctttgtgggttgtctgtgggagctgcgaaagacgtgcgaagcgtgcctcgagcgccatcgagtgaggcagcgggacaacctgttttctcgaatgaactagattcagatgattttggctgtgacgcgcctgggcagcattcatcgaatctgtgtccggtacggcggtgctgcagcccaactgttcagacgacgattaacctggttagctgatctatccttcacgaaccgcagatttaccgtgagtgatgctgtgctgcattcaagtcgttgcatgggaccagcatagcaccatgagtccacactaacacacaaaaaaagaaagctagactctcggttgagcatttcatttttttaactttttttttttttgagaaaatttcttttttttaactgttgatcatttcatttgaatcacaacgcaagggctccatgaccttctccagcctctggattgggcttaagagcaactcgaagagattctttatattatttctaatcgataggaatagagatatcgaaaaaaaataccctcaaacaacttgtttaagtggttatctaaatatagctatcatctattctgg

SEQ ID NO: 31402 - DNA, 572 bp, Sorghum bicolor
  Clone ID: 18068047
aggcactagctgctagtactatgttgaagaagcttgcgaatgtgaccaaggaattcttgagaaatggtagaactgattctggtaccaatttggtagcatctaaaaattcaaacattagtgaaggtgcttctaaaatgggaccacaaaggaaaattaatgtgattcttgaagctaaaaaggagatcgttgggctattttctttgacagaagagctcgttgctggtgctcaaatgaaggatgctgaggaaccatagcgtcataactgaacatatgtctgcatcatgcatgaatattatgcatgtcaattggaatgatgcagctgaaattgttacctttttttttttttccttttgaggctcagatttctttatattcttttggttcatggatggggcatcaccaaaaggtaaaaaaaggagatttttcagctttggttaaaaggatgatggttgtgttgctagatacaaatattcttttttttttcctttttgagtgcttgaagaagtatatcatcagccgtctattgtattatggatcattactgtcagcagcaaagaaagagtacagaggtt

SEQ ID NO: 31403 - DNA, 638 bp, Sorghum bicolor
  Clone ID: 18068048
ccaatggaagttccttgattgtaatgtctaaaggaactccttacacacagcagtcatacaaagtcagtgaatcatttccttataaatggattaataaaaaatggaaagaaggttttcatgtgacatctatggctacagcagggaatcgttggggagtgatcgtgtcaaggaatgcaggctattctactcaggtggtggagctggacttcctgtatcctagtgaaggtatccatcggcgatgggagactggttacaggataacttcgattgcagcaacacctgaccaagctgcttttatcttgagcatcccaaagaggaagcccatggacgagacgcaagaaattctccgtacttccgccttccccagcagccatgtaaaggaaaaatgggtgaagaacctgtatatttcctcggtctgctacgggcgaactgtgtgctgacgtgtatgttgaagctccaattaagaagtgctaaacgctcattttgatgagctcgatcgacggacgcctcaaccgctggcgccacacggcgatgctgtagattcacccttgtgctcccgtacgtacgttgcttttgacgacgttgctgtaacaggctatgctttgctattgctacctcaaaagcaaacacattcgttc

SEQ ID NO: 31404 - DNA, 172 bp, Sorghum bicolor
  Clone ID: 18068061
ccggtttgttgcaattcacagccaattccctggtgccagcatttttttgcttttccccggtatattttccgttcagtgtcattggtaggggggggtggggtctccttagacaaactggggactgttgcttttcctaaaaattcgattgtattgtggggcatgaaatgatcgg

SEQ ID NO: 31405 - DNA, 566 bp, Sorghum bicolor
  Clone ID: 18068081
ccatttgtatataagcaggttacttatgggggcgtcattattgctggcatcaacatgaaccctggcaaaaataagtccctcaggtgctggctcatcgtcactgcctctgcgatgtttctgaccaactatatatatccagctgccccaaaattccagctgagccctctggagccgatggtcattttcacgatgttcatgtgtgcaatcttgcttgtttttcgcaccataaaagagatgtgaccgagagcgcttcgatcgtgttcatgcttcgcaccgtcgttcagaatggaaccccaaaagtcctacactagtagtatcgcgtcctccaaagtgtgcatgatgaaatgaaccagaaccagactgtgtgtgtaacaataactccagggaccatatgatatgtttggatgactcaatgcccggccagtcctagagcacctgtctcttcggtggttgtttatttgcttgtaaacttcctacatacagtagtttattcaagagtatttggcaaacgatatactgtgattattcgaagatttgaaattcgaaactatgcttatgtttagtct

SEQ ID NO: 31406 - DNA, 569 bp, Sorghum bicolor
  Clone ID: 18068113
aagctggagaaattagatgtaaacaaattaagtggtggctcaagtgcaccgaaagattctgaacttctagtagagaataagcaagtaaactcgttgaagaaagacatggatgtaaaacaatctgaggtggacagtaaaatccaggcagctcgagagcgctaccttgcacgaaaaggtaagaaatgacaaatgacacattttcctgatcgctcaacatccttctggtcatcctgaagcatttctgaagaccatactaacgaatccattcatgttatggtgggcggtgtatacttcaacgaagaacattcatcatgttccattgtgcacagacaagagaaaattccttatttggactggaagaaaacgtgcttaactatgtaaccctgattttcttttgacaactctaaccttttgccgtatttgacattaccgttaccttttccttgggccatgctagttattgatttatgtaccaaatactcttgggtgtccaagacaaaacggacaaatcaaatgtagaatatttcctatatgacactggaagtttaccacgctttcctccgtgggct

SEQ ID NO: 31407 - DNA, 592 bp, Sorghum bicolor
  Clone ID: 18068124
agattccaggactccattgatattgttttggcaacttccttcctgcaggaatttgtggaggcaagacgaacggctgcacttaataatgttccttcttgtatgtggtctccggcaccacctcatgagttaaaaggagtatctgctgatgcactgaatgcaaatgctggctttgttactttcgttgtttaccctcggcatgttgagggtaaaaagctagatagaacagtttggaatttgttgacatttcatgcttatgtaagctatcatgtaaagtgttctgaaggattcatgcataccaggatgaggcgcagggttgagtcgctgatccaggcgttggaccgagcgaagtcggatgcagagaaattgaagaagttggtacatggtggatctttccaaagactgagcctgaagaatgagggcgactcacgttcctgaagggaattgcaaatgatgttgttcaactgtacccgatggatactctccgtgctatttggttaatgaattctgttgtgggaagcttacttccgttcagttttgggagcaaaggctcggaaccggaaccggttaaatccatggcatggaaatttagtgt

SEQ ID NO: 31408 - DNA, 494 bp, Sorghum bicolor
  Clone ID: 18068133
aagaacttgaagggccagcatccagtattgctgcctctctgaggaagaaaggccgatctgttgaccttgtagaagacaaacgtctcaaatgggtatttaagcatgcggagaggatcaacgctagcaggctgattttggttggaaattctgagtgggagcgaggcatggttcgcgtaaagatactttcaaccaggggagaattcgaggtgaaggcaggtgaactagagtgattgtaatttataaaaatgttaacgttatgctagcctcggctaatgctggtgagtgagaccgagagggataaaatcaaacaggagctagctatcctggagtttgacttgcagtaacaattttttggtgagtaacatgttgatgctgtaacagcaattcatattcattcagaattcatgggcacgacccttgccagctagtatgttcatttgactgtaaatatacatcacacatacatagcctccagcttggctaggaaaccattg

SEQ ID NO: 31409 - DNA, 535 bp, Sorghum bicolor
  Clone ID: 18068167
agacaatccatcacttatgtacattggaaacagtggactttgtgggcctcctcttaaaaggaattgctcaacaaatgatagttccatccataccaaccatagaagcaacaggaaagaatttgaacctatgtcctttccatttggcctagggttgggacttgtggtggggctctggacggtgttttgtgctctgctgttcaagaagacttggagaattgcttacttccaactctttgacaagctttgtgatagaatctatgtatttgtggctgtgaagtgggcaagcttgacgaagatagatgaagattagagcaaaaacatggatgtgcaaggcatacatgatcaatacaatgggaccagtgtaggatgagcaatgatgattacttgatgaggaacatcttaatgctatgtatatgtattctggcattgtgaattcatttaaataaagacgagtgcagtttaatccttatgtaattacatgtacactttaattttcttaattactatgaactacaaaagtgaagtttttcctccg

SEQ ID NO: 31410 - DNA, 507 bp, Sorghum bicolor
  Clone ID: 18068168
ccagtgtgcccaaaatgtcatcgcttgtgaaggcttggacagggtggagcgccctgagacatataagaagtggcagttgcggaaccaccgggcagggctgagacagctgtcattggatccagatattgtcaaggccgtgcaggagagtgtcagggacaaatttcatgaggactttgtcactgatgtggatcttcagtggctcctgggagggtggaagggacgcatactctatgcaatgtcgacatgggctgcagctgatgctatctaggattcttagctgctttaatttactggattcagagatatagtctaggtaatggcacccatatttgttagtgtgtcaatgaactggttctgctctgcagctgtatgtttcaaggcacttagttccaaaatgactgggactagagttgaaatttccgaggtagagacaagttcagacatagtgtattgtaatggaaattttgatgtttattcagattagatggtcctgttgctgcttgagct

SEQ ID NO: 31411 - DNA, 591 bp, Sorghum bicolor
  Clone ID: 18068169
gaccccttctcactatgcttgcatgatcgacatgctgggtcggaatggtagattcgatgaggcgctacacatgatcaagaatatgccattcgagcctgatgttttgatttggaagacactattagcatcttgcaagctgcacaagaatcttgacattggaaaactcgcaacagacaagctgatggagctttcagaaagagactccgcgagctacgtgctgatgtcaaacctctatgcgatgcatgaagaatggcaggatgcggagagggtgcgtcggaggatggatgaaattggggtgaagaaggatgccggttggagctggatcgaggtcaagaacgaggtcagcacctttgttgcaagagacacgtctcattcagactccgcatccatctatcagatgcttgcagagctcgttgttgtgatgcaagatacagagttagatgttcatatgcagatttagatgccaaagatgaacatatcacttgcagactttacatgtactaggtagcgtgcccgtgcgttgctacgggatagctaatattttataaaaaaaatacatatatcgcatgataagataacaatgttgggtct

SEQ ID NO: 31412 - DNA, 574 bp, Sorghum bicolor
  Clone ID: 18068197
ttctttgcaagcatttttttttttgcaggtcaggatatatactatggtgtccactcttttttaattctagacgttcagttgaggatataatatttagagctaaatcatcttttttgcaggtctggataagattaagtgttgccccctccacctctgtcgtcttaatcagggctggtgctttccaacaatttcagttctctactatcatccaggatatcattgccgaactatttttcagctcatggtcagttgaactctcaactccccaaaatgaaattcttaggcaagtttgtcatctaagatatcgttgaattcttctaaggttgttccttattcatgtgatgaaagcacatccagactgctgatacggagtttcctatgagagcttttgagatgcggttcaattcttaggttcatattatagtcgttttagaacataaaggcctagtttagatcaaaaaccttttggattttgacagtatagcactttcgtttgtatttgaggactaactacgtttaaaaaattcgtctcgcaaattacagttaaactgtataattagcgtttcaattcttc

SEQ ID NO: 31413 - DNA, 570 bp, Sorghum bicolor
  Clone ID: 18068245
tcaacaaaacaaacggacgccaagctcaactcctgaagcgctgaaaaggaaatcttgcatgaaagtttatccactggactttgacgagaggctgttcccagaggtacccgacttggcctttgagcaagagatgatggatacctacccagatctgtttgagaatatggatgttgatgacttcttaagttgtgattttgcaatgatgaacagggttgagccagtagaggcaacgactgggttactgtgggacgacttagaggaaggggagattccaacattgtgaaggtaatcgaggaaaattttttttgtcgtgctattccaggaccgtgatgcaatgtaatggtagagtactcacatgtacctagctgcaactcgaaactatgcagcctctgttattctttataatttattcagtttctctgttgttatgtacctgtcagagtagcatagagtgtcgggtgttaaggtagcctgtatctccttgttgcagaaattttggggttgtaactttgtatatcccttgtgtctgagtaagagaatgatggatatacctaccgaagctgtttgggg

SEQ ID NO: 31414 - DNA, 482 bp, Sorghum bicolor
  Clone ID: 18068255
aatgccaaaaggtattcctgttgcgactgttgctatcgggaatgcagaaaatgcaggtttgctggcagttaggattctggccgcaagagatccggagctttgggacagcgtaactaagtaccaaaatgatctgagggatatggttttggagacagcagaaaggctggaggacctaggttcgcaggaatttttgaagggaatggcttgaccacttgaagccttggctgggacgaatatatatggatggcgatagctccctgcccactttcattcagcgtcgatcagcgcggatagctggatcatagtcacaaagtttttgggtcgatagggtcgtggtacgtggtacactacttgtgagaaatttttacacttcgggtcgaaaatgaacctgtgaacctgggtcgagggtcgaaggcggtgaacccgttttatgtgactgagctggatatggtccaagattgggagtggtcctgaagttcctt

SEQ ID NO: 31415 - DNA, 650 bp, Sorghum bicolor
  Clone ID: 18068265
agggcaggccagacagaactggtttaagaatgtcaaatgaacttgcagcattaggcatccctgttaaggttctaattgattcagctgttgcttattctatggatgaagttgacatggtatttgttggtgccgatggggttgttgagagtggaggcataatcaatatgatgggcacttatcagatagctcttgtggctcatagtatgaacaaacctgtttatgtggcagctgaaagttacaagtttgctcggctatatcccttggatcaaaaggacatgacaccagctcaccgaccaatagattttggagtcccagtacccactggtgtggaagtggagacgtctgcaagagactacacacctccccaatatctcacacttctcctgacagatcttggtgttctgacgccttctgttgttagtgatgagctcatccaattgtatctatgatctttgctgtggatgctgttgtttcaatggcatgtaacatactgcagttgaatccagggctgaatggggctatgatgtatgcttgccttaatggggctgatgcgatgttaacagttttgtcagagcttaaggtgcaatcattgatgtgaatctgcccccagaccattttcagtaataaatctatttgcaggacgcactctt

SEQ ID NO: 31416 - DNA, 591 bp, Sorghum bicolor
  Clone ID: 18068332
tattatacgatgttcacgtcactaaccattttggctagtgtgataatgttcaaggactgggatcgtcaaaatccaactcaaattgtaacagagatgtgtggtttcgttaccattctttcagggacgtttcttctccacaagaccaaagacatggttgatggtctcccaccaactctacctgtccggattcctaaacatgcggacgacacagctgaaggaattcctcttagatctgctgctgaaggcatcccactcagatcaccaagggcaacagagtcatttcgatcaacgctataatgcttggtcatctctgtggccatgctcagccattctttcatttgatacacacctttgtagattgtattttaggattccaaaaggtaaaaggcgccactacccttgtaattttttgagacactggtgtagagtattgggaaaccttatacatctcgaaatgcccagaatgggctagatccagttttggatacccaccacggtggcatacaagaccgttctcagcaacacagtaactgttgtattctttggatagaaaattagaagatagggaaagaatctgaagaaggctccttg

SEQ ID NO: 31417 - DNA, 237 bp, Sorghum bicolor
  Clone ID: 18068335
ccgtaagggtggcgactacgaaggaggcggcggcggttacgacgggccccgcaaggaaggaggcggttacggagccggtggttacggtggcggcggcggcggttacggcggtccccgtgagggcggcggcggttatggcggcggcggcggttacggtggcaaccgcggtgattccggcggcaactggaggaactgattgtgggggcccaccctggtttcggccaagttatcctagct

SEQ ID NO: 31418 - DNA, 578 bp, Sorghum bicolor
  Clone ID: 18068350
tcaagcctgctgtgtgaggagcggaaggagataggagagcaggtaggaaatagcttcggttggtatttactggggatcaaattgggtcaccatatatctctcgtctccatcttgggatcatcagttttttttctccaaagattttgacttcaacgcgcaccgaaggagacgagagaggatcttttcattggtgactaatgctaatgtaataatgttctttgcagtggactgttgggccactttgggtttaaccattgaagactctaccaatccctttcaaacaatcacctctttcagaaaatcagtcagccattcctttccatgtgttggaccatctcgtcggttagaaatgatgcgatcttaaggcatattcagccgaccattcaaaatgcaagaaggcacttaaaagttatccttcgagcaaagaagaattatgaaccttttattagtcaatggctagaatcatgtgtaattgatttggtcttctttgtaaccttttttgtatcatgatgtttgttgtaaacttttatactcttctaataaaagcacactaggggctcgcaccctcctgttttcct

SEQ ID NO: 31419 - DNA, 577 bp, Sorghum bicolor
  Clone ID: 18068372
tgtaaaaagaaagcctctcatgctgtaacgtttaagtgataatttttttgtaccaggacatgggtttaaatgctgtgacttgtaattgtaatgcacaaaagcaaaaggaaagcaattgaggttggggatttaagttttcaatgctgatgcgaatgttttggactggaaatgatggaacagtgttgtccagagatctgcttgaacaagccaacagtagccagatataaacgattgttggcaagctgcacagtgttggccatttttgggactgtattgtgtagaaaaagtaggaacagatggctcaaatcctgaaatgtgtactaaaattctctccgtctacctctagttttaaagtgtgagaagggatcgtacttgcgaattgtggctatgctaagcaaagatgaacaacttttcccgtcatgatttgttgccaattggatatggtgccgacatggacgcttgagcatgggcaatgagatttgtatgtttagtaactagtcataattggatattgtgccgacatgattatttgttgccaattttggctatatattgttcactaacacatgagttattt

SEQ ID NO: 31420 - DNA, 138 bp, Sorghum bicolor
  Clone ID: 18068376
cagctgggttaaaaggaataaaacctttctgaaagcttcttcaaagggcccatcccaatggtttttcttgccccttgtatacaaagttgtgcgggaaatgtaaaaaagtatgtagtttgtggatgaaagaaacggctg

SEQ ID NO: 31421 - DNA, 474 bp, Sorghum bicolor
  Clone ID: 18068413
agtctttgcgtatgctttctgctgtgcgcccttgatctgggcatctttggtcaagacaatgagctccttgcatgtcctgattgagagggatgcgttcaggctcggagaacctaaccagaacgccgagttcacaaagctatactgagtttgaacagctaatctccattcacgttggcaaattctgatggccaattcaattgtacaagtaatctgcagcctgggagcaagagttgttgtaccttctggaaccatctggaaacctctagaacccatgattgttgtcttagacatgtaggtgacatatacaggggaaaggaggggtagaattggtgcggaactgaagaggaacggactggggtcagattttagttatttttatttattgttcctccgaaaagccaaggcatttttggcttttgtttgtaattgatgtgatcagttccatcaccaatgaagaaaagaggttgaaagttc

SEQ ID NO: 31422 - DNA, 673 bp, Sorghum bicolor
  Clone ID: 18068418
cgtcgagtttgatagtgatttattcaagccaggagaccctgattcagatgatgaagatcatctatgtgacctagagggagaggacggatgggacataggagacactctcagagatgttgagtccatacagatgcatggtataacgctcctgctgcctcacaagttgctgctatctggacccatggaaatgatccccaaaaatgttttgataggagtgttatagtataccccaaaggagaaaagatgcactatatcaaagcatatcattgtttttatgatccattagcatatcctatatttaatcttagaggagagactggatgaaaccaattcatgtcgtacaatgatagtcccacaaattcgtcatctcctaacaatgaggagcatttagtaccagaacctgaagagaatggtgaatgagacaacgacatacaacaagcacgctaacagttggttgcaagattctaatttgtaagagagtgaccatcatattacaagtttggagatgaagtgaggagcagagggatgaaagcacatgcttaaaaggttacaaaccactaaatattaccttgtatcttataataacaatcatgaaattatgccaatgttttgggatggtatgcccatgttacttccctgtaaataatagtttattaggtgaaatgtggatatc

SEQ ID NO: 31423 - DNA, 488 bp, Sorghum bicolor
  Clone ID: 18068442
atgggaaatatatgcagaatgtggtagttttggtaatttccattgtctagacaagtaattataattttatagtccgctacacatttggtctagagctgtacttgagcatattcttaaatttttcttgtctcacatgcatatataatttcctaagttcggaatttatattttgggcatgaagtactaaacatagaggttttctaatatcttaatcttactcttttggcagtaggtatacaagatttcagagggaggctcgtcaagcaacaacattggtgagatgatgacatgtggcgctgatagaaatctcatctcacgggctgcatagatgttaggaagtctagcctagttgcatatttttaaaatttttggaataatgagagaacttcatttgtgattttaactactatttgaatcatttgtcggactattggataatgattgagtataaattaatatatgtgagtgcaatgtcatttgatatggtc

SEQ ID NO: 31424 - DNA, 318 bp, Sorghum bicolor
  Clone ID: 18068480
cacctctcctacctgcagagcctgccctccagagacacggcggtggagaaactagcaattgcagagtttcacctcaacaaattgctgcatcagaaagaaatgcaagagattaaaagatggtggatggacctaggattggctcaagaaatacctgtggtgcgggaccaggtgctgaaatggtacatgtggtccatgacagccctccaaggatattctttctccagatatcgggttgagatgacaaagataatctcgcttgtccatgttgtggacgacatatttgaccttgttggcacactagacggagctctctctctt

SEQ ID NO: 31425 - DNA, 618 bp, Sorghum bicolor
  Clone ID: 18068490
gagtcaggtagtggggcgtctttgggcagcggtgatgaggatgagtccaagttcgacaagggccggcccagaggacgtaagcatgaagacaaggaggagaagagggtgagaactgacactgaacatgatgaatgaccgccgctgacacataatagcaacacaagctagctgtcaaggaggccaagcgtgaaaagcgtaaggagaagattcccaagagcgtcaagaagaagctggtgtctgcttcgtctaggaagaagcattgagccgtgtttttttctttttctttctttcgccctggatgaaaggataccctgcgaggaaaggttggaggcggaggatatgagtgcaatcgggtgatgaagactcgatcggcctaaagacgaagtcagcatgcagtgttttgcccacgggcgtaaccgctgttggcccgtcatcctggctctagaaggcccctcaataggcgccatgatgatcaaggagagctctgacgattgcttcatcactgctgtggtgttgaatttggggattggaagcggacggatagtgaactggaacgtcacactcgcccatcttgcagcaacatagacccagtagtacatcaaaagcgtctttttcgct

SEQ ID NO: 31426 - DNA, 604 bp, Sorghum bicolor
  Clone ID: 18068513
tcctccacaagctcatgatttcaagtgctcctcccatcctcaaaatttagtaccgccatatcttattgtaacagttctggtccttacctgacttttgggaacttctctaaaggccgtgcatgtcttctatgaaggaaccagtccactaacttctgtatggatgctacattgcatactatgggacaactaaatttgtgtaaagattccttcgggctagttcctatccaaggaacctctggtcttctcccccgtgcgaccctcctcacgatccacctcccccaatccaccgtgccgctcgaaggctgctgcacaagattgtggtggacggggctgagctcgcccatgccgcgcgctgcccatggtggctgactccttagggccaagcttggtgctggctggcaggcctgaatctggtgcagggtggttgatcacagacaggggtatattggtaatttcacgtgttccttagtctctccacgggaacatagacggagggagtacatccttttgaagctgaactattggacatgttaatcattgatctcttggtgctgaacaatattatagcatgtcttagcaataacatatattgagttttcttgtc

SEQ ID NO: 31427 - DNA, 120 bp, Sorghum bicolor
  Clone ID: 18068581
ctaactgtagtccccttaatgtcaggtagattaggtaattaattgttggggggtcattttaggccctcccttttgaaaatgggattggttgcagtttagtagaatgtagaaaataggtgg

SEQ ID NO: 31428 - DNA, 666 bp, Sorghum bicolor
  Clone ID: 18068582
tggaatactgtaatacagactcatatgcgctcagtgcccaagaggttgttctctcggatgatcttgatgtatgacattcaccaacgtccagataaagttttggagatatacactgacatggaggaattaggggtgcgtccagatgaggatacagcgagacggatcggaaaagcatttgtggcttttggccaagaagaagaagaaaaacacgtccttgagaaatacttgaaaaagtggaagtacatccacttcaacggtgagcgtgttcgggtgcggagggacggaccattggcataatagtgcccatcttctgaaacgcttgaacctatcagtatcattgccggccggggagatgccattactgccgccgctgtgatgggtcatacacatgttatcagcactcgtcctccactgctctagcctgtggagacaaatggagagcggacgggtggctggctggctactactgacgatgtagtgatttaggtactgtagagtagaggcatccagtgattgtgattgtgatggtcccgtgctatatgttctgatccgtgtttgtgaaattgtgaaccaactccgtatatcatatcatgtgaagaacaatacctgactgttgggcccatgtcttgcagatcgcatgccacgaacctttttttttttctgttt

SEQ ID NO: 31429 - DNA, 159 bp, Sorghum bicolor
  Clone ID: 18068599
ttttctgggtaaaatttgataccctgtcaaaggtagccattgctagcggatttcaggttgttatgttttctgaagggaaaatgctcctcgattttgctgctccagtaaagatatttgtagatctgtttgaacttattgcttgatgtttcgctcattttg

SEQ ID NO: 31430 - DNA, 552 bp, Sorghum bicolor
  Clone ID: 18068618
gaggcagcttcgcttattaatgccattgaatccaagatcagatccggaggggccataatagcaaaagtgccttcaagcaacctgacatctccagttcctccgtctatcgctatgtcatcttctagtgaagatgaggagcatgaccccagtgagcccttgatggtggacatcgatcgcaattttaatcagcagagctctgacgaaatgaagctccaaagcgagccatcagagtcggaaactgaagctgacaactgacctgtgtggtgtgaagatgaaaactatgatattgtttgctaacagatacgaagtgaactattgaagttgctctaaagatcaaagcttcccttcaaggcggcagatttattctatgatttgagacatttttgtaagattcaattaggattctagtcacttatttttgttgagtttatattgtaactagattaactcaagtaaatacctccagtggagaattggtagaaaggacgaaccatgctatgtacatgtcttctgagtaaaagaaaggcgataagttaaaaaaaaaaaaaaaaa

SEQ ID NO: 31431 - DNA, 632 bp, Sorghum bicolor
  Clone ID: 18068636
tctaccgagaagttatacggagagccccacatgaattcaagattgcatgtctggaggacattaaggcgctctttccttctgattgcaatccattttatgctgggtttggcaacagagacactgacgagctcagttacaagaagatgggaatacctaaaggcaagatttttatcatcaacccaaagggtgaagtggctgtgaacagttctgttgacgtcaagtcttatacctccttacatacccttgtccatgacatgtttccaccaacaactctggttgagcaggaagactacaataactggaattactggaaggtgccgttgccagatgttgatttgtagtgtagttttgacagaaacagccttagataccagtagatcttgcaaaagcctagtagtcgagcttcctgtacactaattgcagtcaccactacggggttaggtccaatctgtaaagcatctcaagagttcccagatgtatggtttttgatagccaatggcccagcgaaaggttgccactttctttccttcgacggagctttcacatgatcatacgtcttttaggtagtgatctgattgtcttcgtcgaacttgttgtacccagaggtttgagttctagacccttagttcatt

SEQ ID NO: 31432 - DNA, 291 bp, Sorghum bicolor
  Clone ID: 18068638
tggccggtaaggccgggaatgaagtgctatggagcatgtcgtcgagggtgatggctgacatgtggctcaggccgatgcgcaaccctgacgtgattatccagcagaagtagctccagaaatcctgttcctacagctcgtgattattgtaaattatttcattcttgcactgggactgataaggactgtctagtggctaaggcatgaggtacatatatccttgtgcattttgtttctattttgcttgataaaattgtacgaattcttgcaataaaccatggatactactgttgc

SEQ ID NO: 31433 - DNA, 673 bp, Sorghum bicolor
  Clone ID: 18068647
gcaatgattccaagatgctaccgactttcctcagatgctttccaaatgttgagagactgcatattgtgtccaaaaaaaacgatgaaattgctggcaagatcaacctcaagttctggcaggaggccggtcccattgaaagcatccggtcctccatcaagatgatgactttccgtgaattcagaatggagcgaagcgaggttgcgttcctcaagttcttcttccaaagtgcccacgtgctgaagaatgctgtaattgtggggtccaatggaagtttcacatccattcctgaggtgattgacaaagtgaagactctgattcctcaagatgggcctagtaattcttgccatgtgttggtctatgaaagttcagatccagctgggggtccagtcttgagtttgcagaaagggtttgatttttctgttagcgatcctctcaattaccagtaaagtcaatgctatctccatagaaagcaatgttctagattattaacatgctttttatgaagcttttgttggtcctactgtcacctttagctttaattgctgaagttaatagtactggatttcttgcatatgagtactgttagtcaggttgttcctgctatggaccattgtatgggcgtattcttatttcactgatttaatttggctacacatggcctggaattgatgtt

SEQ ID NO: 31434 - DNA, 158 bp, Sorghum bicolor
  Clone ID: 18068706
ctgaatttgtaagaggcatttagtttgaaagctgtaggtaatatttcattaggaatggggaattacccggcagtgttcccttatttgtataagttaattatattgtcacattctttgtggtaatcttcagaaagaaaataaattcctctagaaagaaa

SEQ ID NO: 31435 - DNA, 560 bp, Sorghum bicolor
  Clone ID: 18068719
ttccattttcatgtgcatccttgctggcaccatcaccgtccagttcatccttgtccagttcctgggagattttgccaacaccgcacctctcacccagctccaatggcttgtcagcattctctttggcctcctcgggatgcccattgctgctgccatcaaactgattcctgtggaacctcatgaagacaacaggcgaatatcataatcatgtagattaagagcaatagctcagttttgccaactgctaactattgtaacccttacctaatgcacaagaataggactataggagcagagcaccaatttgtgaagaaacagttggtttggctgcaacacaaaaaacagaatggcttggttctcggtggcatactaaattgtatattgaattgtccagttattttttttccttacaaatagtgccttgtggcttgtatacactagcatccatttggtattatgaaatgccatctggtgggttacaataacgtggattggtacataagttatacttgcgtcagttgtaagtagactgtaaatttgaatgcaacagcagttattct

SEQ ID NO: 31436 - DNA, 655 bp, Sorghum bicolor
  unsure (1)..(655): unsure at all n locations
  Clone ID: 18068758
ctgatactgggagacatccaaactacttgcagttnggagttgcaggcaactctagacatgacatgaatgaaattaaacaggaccatctacatcaaggattgagcactggaggtttcaaccataattttggcgcctgtatgactgaacagccaaatccaaatgtgtcatatcttatgccacaagtgaagcctaacaccatggcatcagaagataaactaaagcagaggaatgcttatgatttggggattccaaagctcaatggtggttttagctctagtagctgcaattttgatggtcttctcaattccatgatcaaagcggagaaggatgatctctcattcacggataacgacttggggtgcgacttctttccacttggtgcttgcatatgagacctcttaataattccccgtgcagattggtcctctatgggatgggtcgatgggtggagattgtaaagtacactatttaggatagcattagccagttatgctgcctgatgtgttactatgcctagtattgtgcacactagaaatactagggatacaagtagctaaggatatggcttgtaatctgcactttctccttttcgaaagggaaatggaagtgattatggttaggtgaaaaggagccaagtataatgctccaacttcat

SEQ ID NO: 31437 - DNA, 162 bp, Sorghum bicolor
  Clone ID: 18068764
catgatgattttatcaagtgttcagaatcaaaatgatagcaaatccaatgattatggcaatttggtgatcacctggggttatggagatctctggtgtaatatgtaaccatttcaacatggtagcatcctttttttttcatcctgtaagaacatatcagactg

SEQ ID NO: 31438 - DNA, 629 bp, Sorghum bicolor
  Clone ID: 18068773
tcgctggcggcagatggaagcccaagagcaggaaatggaagagggtaagggtaagcctactgaagctgaaggttcagaaacaaaaatacccaattcaaaaaaggtacttaaatttatccccactagttccataaactctgatggctcagtggaagattggtcaaactttgtgtatctcaatgaccatgtcaagcttgtatatgatcgtcgatgtcaaaaaactgggtacgggaagctatatggagcaaaagagctcctggtggtttggcaaaatgccctcacacatatacttgaagattcattggccgaaggaaaacttgagttctatgatgaagatgtggtaaatatgctggagtttgttttgcccggtgtgtttaacctttttcagaaagggatgcactctattggccacgaggagctacctcatctcatgaggataatgagaatgtgagctgtagcgtttcaggatggtcaccataattctgtatcataggtggccaagctgatagaacagagtaattctatgttgtgacaggtggttgatggcaccgaacagtattttagtagttttattatgacgtcctctccctttgtgaaccattcttatttgaaactatctgttaaattct

SEQ ID NO: 31439 - DNA, 575 bp, Sorghum bicolor
  Clone ID: 18068774
agttcattatatccgacatcaagccgtacgttgattgcttcgagaaattatacgtgacatggcctgaccatgttgcccagtacaacctcctatggtacttggcccgcaacaggaaacacaggagcctgcggatctgcagggactacatcgacgaaatctggtgcatgaagccgtgccggtcttccagggacatcaccgagctcgtcttcgaccatgtcgtcgtccatgggtggacggagaacatcaacgacgcggccaccttccatgagttcaacaacaaccggggccagctggctatccagcgcgagggctgcactggggctatgccgctggagagcctgcgaaggccattcgacgagagcttgatcctctggcatctcgccacggatttctgcttcttcgacgtcgacgccgcgggcaagtcagcttcctgcggccatggagatggaggcgtcgacgcccggcgccgcaggagcaggatgatctccaactacatggcctacttactgtttgccaacccagagatgctgatgcccggctccaggcggagcctgctcaaggacgcctacaaggag

SEQ ID NO: 31440 - DNA, 611 bp, Sorghum bicolor
  Clone ID: 18068779
gctagtccttcagtgcgagatcctccataggcttcaactgtagtgctactgctacatacggtttatgttgccagccgttgacatgcaagttttatgtacattcctgtgaattgaagaggcagaccattcaatcatccggtaacacctgtgaagagtcagattgatatggttgctccttaataacttggaacagctgatctcttattagcattggtgacaacctgtaaagatcaataacgcttgtgtatttctgactggagactgagatcatgaatgcttcagagcagctgagccattgataccatgaagaggtactctttggtgtaactagcaatggtgactatgtcttttggtttcgtcacaactgtctcctgtaaagtactaacttcagcattttaggtgtcaatttagttaaaacatttgtgtcatcatatatagcaataggtcataggtttcctaatgtcatgtataatccctcaattatatcctgatgtgtctgttatttattgtcgagaagtagttgattcaactgtatgcttagaagcatgtgtatctagtcgatgtaatatatcagagcaagtactcaacatccaaatgggaacaatctagtc

SEQ ID NO: 31441 - DNA, 541 bp, Sorghum bicolor
  Clone ID: 18068788
cgaggaaccagaagtcatgctggatgctcatgtccaagcagccttcattgttggtgtgccgttctcaaagtcaggcgggcacgattttcgagcgaataatatcacacatagtgtttccaatctcggggctaccatgttgaaacacaggctgacccctccgccggatgaggtatacagcctccatagaaagctgtcaggtgcattccttgcctgcatcaagattggggcagttgtaccctgcagagagatcctgttccaagtttatgagcaatacaatttcagtgaccaccattcagatgtagcatctagtgctggatagtagcgtcaaagaaatctttgtttttgatgtcttgtgtaactgaatagttccttgtcggctgcagctcatttttccaagagagcttggcagtcacctctcactggtaattggggtcaaaagaatgtaaaagaccttattatgggtttggatagtcaatagtggtggtattatttgcacagtttcttagtggaggaataaaggcattggaacaaagtttatttt

SEQ ID NO: 31442 - DNA, 560 bp, Sorghum bicolor
  Clone ID: 18068792
gccagttccaggagtacatgctcgcatggagtaccccctggggtttctactaccgtaacaaggcttatgttgagactcgtggcggcttcaactacttccaacgacgatgggaggagatatatgtgaaactggttaattctgattattcttcaaaaacccagtccggtggttgcgagattgaagcacaaattgacaaaggtgacagtcctaaatatattgcaacaatcaaactcgagcatggtccgtgaagcacgcaagtatcgttacgcaccacctgtctattacctcgtgctatggatagtcgaccccccatttctgatgctccgatgtgtatcggtcctgtttcaaagtactgtattgtttagcattggttttagtcttttctatcttcttggtgtccctacatgtcagagatttgtatttaatttgcgacccatccattctttttacttttgatggaaaacatcaggacgtgattgggattgagaaattatagggcgatccagtccttgttagtgtgtaaccaaagttcacatattttttggcaactccactaggcc

SEQ ID NO: 31443 - DNA, 595 bp, Sorghum bicolor
  Clone ID: 18068793
ttggaaaccaaaaactgaagatgaacttactgaagaaagggccaaacagaagaccaaggaatacatctatggatcaagttcccgaaagaaagcaaatggcaagcatggcaatagtagtggtgatgactctgatggcgattctggcggaaagaacaagaaagcaaagacgactcgcttcactcatgcagtaaagggaaagggcaaatccaaagtctgatgcttggtgtatattgttcggcagcaatttgacaaggaaccagctatttactagctgctgcggcatcttcttttgtaccatcttggccccctcagctaagatgctgaagacccatatccacatgtgcttcggttgcttttgaatcccatatcaacacatgctgaaggcccatatcaaacaaatgctgttgaacccaatagttgcctactacagcaatgctcccaaggagttagccagttaggtctataaataggtttcggttgcttttggatcctgacatgcttacagtcacttgtcaatgagggcttttaacggtttaatctcatatatcaacatatgaaacatcctgacagttggttgaatgcaatttatgttttc

SEQ ID NO: 31444 - DNA, 303 bp, Sorghum bicolor
  Clone ID: 18068825
tattattcaacttgagaaacagacgtgctgctttgtctttgaatgtcaataggattacaggttccactcaagttatgattgatgctctgttattcttgctgtatggattttagcatacaggctccagaactgacgggcattgttataggggtgtcacgactcatgacataacctttgacatcctccatactgtaatggtagtagaaattttttgtttcgttatgaaccagtggtagtaaagattttgtgttactttatggatacgcagatgatgcttgcttctgtaaatatactgagatgtgt

SEQ ID NO: 31445 - DNA, 151 bp, Sorghum bicolor
  Clone ID: 18068842
ccattatggcatttccgggaggattcccaagggccctgcgccgttcaaccttgaggtcccgacctacagttttttggaggagaacaaactgctcataggctaagatttggaaaaccccctgtctatttatttacttcactcaggtgaaccc

SEQ ID NO: 31446 - DNA, 342 bp, Sorghum bicolor
  Clone ID: 18068848
cagttacaaacaatttacccattttatttggtggattggggatgataatgaggagccctttttccatttgcagtagctgccgaagtgcttttgccctcccaagcatgagaattagtgctgttagaacaattcatttggtggatggggcaaattctttttttttcctactaggaggtccttttgtaatgtccctcatttttcaaatgcgatttatgttttcaaaggggaaagacaattttcaaataggaattcagacatgagcccattaggcatttccttaatgatctgtattattggagagttcaaagggaatattcaaaagggaatgcagagttcagcttg

SEQ ID NO: 31447 - DNA, 253 bp, Sorghum bicolor
  Clone ID: 18068857
ggaacaaaatcttttaagcccccggcttagtgtgaagaaattaggcagggcaatgcaactgtccggtgctttttgtttcaagactgtatccagttcgagctgttgggcagcccttcaaaatgtggcagcattcaccaagtttggagcatgcggatctgtacaatttttcctgatgctaacgggtccagggtccagtccgggttttatagttgatgagatagagcatgtacggccccagaatggtttttttggg

SEQ ID NO: 31448 - DNA, 532 bp, Sorghum bicolor
  Clone ID: 18068900
ggaaagcggatgcagactatggcggtgccgcgccatggcagtggcaccaacagctgcaccatactctagtgcccgtgtgccaaccagtcatggtgccaactgccaagtcgacgccgttgcagccgcggcctagcaatctgcaaagccttgctgctgaagctgaactgctggctaggtgctgcttgaatcttgatgccttctcaggaacaggaaaccgtgtggttagttactcatccatgtgtggatatttgttatattattaggttcggttcaggtttgggattaggcgtggaaggttgttaatcttgcacatgtgttctgtggatggatccgagtggaattagtcgacctgtaaatagtactatgaaattaggagttgactgtaaagttggatggatgtacataccaaatatgcttttcttattacattagacactaccgcttctgttctgtccatgatgtaataacttttgggtttcaaaattaacctaatccatttgaatggccataattcaacatactagtcatttat

SEQ ID NO: 31449 - DNA, 598 bp, Sorghum bicolor
  Clone ID: 18068954
agactctaggcccaaaagagtggatgatagccacaaaactggaaattccacttttgaacaccattcccgctctgaacaaggctctggcgagcagacaaggcgagaaagtgaacatggcaggaacaagggtccttcattcaatcgtcgacggggtggtgtcccccatatgtcggaagaggagaggttagctcggctgcgccagatggaggctgatgctgaggtccatgaggagcagaggtggaagaggctcaagaaagctgcagacgatgatgctaaagaggcagcaactgtgaatgtgaaccagttcaaagggaaaaacttcttggaagatgaaaagaagagcatatttggaacagataaaggtggcagcgccacaattgaagagagcatcaggcgccgtgctttttactcccagggtggccgtgatgctgaaggcaatcccttcaggcggtgaatttcctgctgtattgttttgttgtttgcttgactcgtcttgccgtcgtgttcgtgttagtattgtacgtgaaaagttgagggctatgtacaacagctgttctcaataacaggaaatttatgttcaattttaaatttttgatgc

SEQ ID NO: 31450 - DNA, 625 bp, Sorghum bicolor
  unsure (1)..(625): unsure at all n locations
  Clone ID: 18068956
tatgcctntgatgggatttgctcaatcaaatcagatgtgtttagctttggcgtcttggtcttggaaataataagtggaaagaggactactggtttctaccaatatgatggaaaattgtacaatctcatttcttatgcttggaaactctggagagcaggagactggtaccagctggtctgctgtcctataggaaatgatcatgaagctatacaaaggttcattcaggtggcactgttatgtgtccaagagagtgcagaagacagacctactatggaccatgtggttaccatgctaaatggtgacaatgtgagtttgcctaagccaaggcaaccaggttatttctttgtacgttctaacgagtcagaagcccaatcaagcaacttcagtataagtattacattggaaaggtagacactgtcaatccatgaaattgtgaaccatgtttctaattttctatgacactaggaatggtccaagcctaacaagtggtttgtctatatgtacgataatgacattgtcattgtttagccaaacagtgtttccagttttcttctacttcaaagtaaaaatcagcattatataactctaaccttctttggtaatatatataatgttttctgtagtc

SEQ ID NO: 31451 - DNA, 582 bp, Sorghum bicolor
  unsure (1)..(582): unsure at all n locations
  Clone ID: 18068970
caagatgagcaaagacaatgccgatgatagcaatgatgacgatgaatcggaacttgttcgaatcacatcaaagctccaggagatcgatcctacatttgtgtccaaatccgaagctgttcaactgactccggagcctcccaaagtccggccactcaccgcagaggattacagaattgccattgggattgagcggttccgctgccctgaagtcctcttccagccaggcatgataggaatcgaccaggccggcattgatgagatggtcagcatctcactcaggagattaatggaggatgagtctgtgaaggagcgcctctgccagtcaatccttgtcactggcggaagctccctgttccctggcatgatccctcggctggagtctgggatacggcaatatcggccctacctcgctcccctgaagcttgtcagagcagctgatcccattttagacgcgtggaggggtgctgctgcctttgcggcatcaagcaagtttggtaaacaaactttcagcctagcagattacagagagcatggagagaacttgtttcatcggcacaaccattgtttactcactnataactt

SEQ ID NO: 31452 - DNA, 641 bp, Sorghum bicolor
  Clone ID: 18068972
gatatacagcaagtcaaagcagatgctgtaagcttggcaaatagactcgaagcccttgaaaagaccaaacgaaagttcttgggtgaaaatttagaagaatgctccattgaagaactgcacaatttggaggttaaactggcgaagagtcttcacgtcatcagaggaaagaagacacaactgctggagcagcagataaccaagctgaaggagaaggagaggaacctgctcaaagacaacaaagaattgcgcgataagcgcaacctccagcctccaccggaggcgccaccagtcctgaaccgctgtctccctccttggccgcgtaacctgccggcgccaccgagcaacgacgacatggacgtggagacggagctgtacataggattacccggcagggagcgctcctccaacagggactctggttgagccacggattttcagctcggctaaaaggaataaaaactctctgaaagcatcatcaaagggcacatgccaatggttttacttgcaccttgtatacaaagttgtgctggaaatgtaaaaaagtatgtagtatgtggatgaaagaaacggctgggtagctagctgcaaacctgcaagcctttctggggcctgaaaatgaaaatccatacacggatacaccc

SEQ ID NO: 31453 - DNA, 234 bp, Sorghum bicolor
  Clone ID: 18069006
gtttgcaaaaagatgcaaggattaacaggggcaggttccccaactgtaaaccccatagagagtcaaggggaagaataaactgtagggtgattcccccccccaagatttggggattgttttgatttatatacaagatcagatcacgggatgttgcccccattgttttggccatccaaatgtaggaagggtgccattgcatgcaagtatattttttctgattttgtaagctgtacg

SEQ ID NO: 31454 - DNA, 446 bp, Sorghum bicolor
  Clone ID: 18069012
aagtaggccgcctgattggcatgctcttccctggggacatagaggtattgaaaacaccgatctcaaagtcagcagctagtaatatatcagcagcagctgctgctgcagtgctgctacaccaacaacagcagctgttgctccagcagcaacacatgtatatgcagcaaggcctccttcaccagccggagatgcaaccaatgaaacaccagcatgaaagtagacgtgccgctccagcaatagcagctacagcagatgatgcaagggaaattttggttgaaaagggccgggccaaagtcgccaaacaggatgcctgaggaaggcttcctattcctaccgtcaaagggttagagatgtcacctttaattggcagttttagagaggggacttgtgtaaacttacatgatggataatacaatctattccaaagtgataacatatcattctcc

SEQ ID NO: 31455 - DNA, 536 bp, Sorghum bicolor
  Clone ID: 18069014
ataagcactatatgagctttaatgtgatgacaagaaggtttcatacaattggtttctggcttgtctgctgtcatgaacaaggccctttttcgccaagtacaactatcagcacttaagaacaaggtccgacgtatgaggtctttacactgggaccacagtctcagcaattagtattcaggattgcctacaacagcaatatcgaatactcagacattggctaattaagaggatcatttatactggtaattgaagtacaaactcatcttaaaacatgatatgtgtccttccattaaaacaacatgatatcttgtcatgccttgggacattcttttataaaatagaaaaaaggaagtcatgacaaatcattgtgactttcttcttagtctgccaagtttgcttcatcaggcttcactgacaagctcaacgacattgtgcttaaacctaggaaattcgtttggtggatactttgaatgtgtgattgcttaacattttgtagacatgcaatggttaatcaaatgtacaggttgagaaagctg

SEQ ID NO: 31456 - DNA, 267 bp, Sorghum bicolor
  Clone ID: 18069019
tgcactagaatccatgtccaagtcttcaaactcagggggaggaggcaatttccggtcgagaggcagaggtgggtttggtaaccggggtcatatgtctggatcaaatacctttcctttaggaggagggagaaggccatattgatgggtgcaaaagaagtttgggacttctatttgtaaactactaggcattaagtgcattctttgggaaatttctgagaaattgccccttactatggattgacaacaagagtcaattttcgctagcaa

SEQ ID NO: 31457 - DNA, 184 bp, Sorghum bicolor
  Clone ID: 18069022
cattgtaattctaccttggataatgctcatgtttcagttattgacaaggctgtaatgcgttattagagagatattttttgaatgctttaacttatgatccttaaggatggattaatctgttcgagtctaatttgatggagcataacaatctttggtgcctctaaattgtgcttgagaatgttgt

SEQ ID NO: 31458 - DNA, 372 bp, Sorghum bicolor
  Clone ID: 18069024
gagagcagaagggttccgcatcgaacagctagaagacgtggtagtttcgtcggattgttatgatgtgcaaagcaccaataatattttgtccaacctaggccttagctcccttacactgggaatcgatttttttagttaggttagaagcaataacaatccatttgcggttgttgtacgttaatttgtagcctgccacagccactgccaggaaatagcaaggtagctgtagcaaaaaattgtagcccgccacagccacggccagatagcaaggcagctgtagcaatttggaatccatcattcattcattggtttagtcatgttaacattaacattattattgatcttggggtacccctgaggtttcgggtgctg

SEQ ID NO: 31459 - DNA, 634 bp, Sorghum bicolor
  unsure (1)..(634): unsure at all n locations
  Clone ID: 18069027
attgcgaagggcttacggccagaggcacttactatatcaatgtcgaaaagctagggcatggagctcacnggcgtcgtacatatggccagcaagtctattctccttttctccttgcttttactcatgaggacgcgacaagcgcgaaatcttacaatgtggccaaagctactatgatggatgtgaattacagtcttcctgataatgttgcaattatcactttgcagaatcttgatgatggtaccacactactccgcttggcccatctttttcaagctggtgaggacccgaaatattcagtggtagcaaaggttgatctgaaaaaggtcttcggaaggagaactatcaaggaattgaccgagactaacctttccgcaaatcaaaagaagtcagagatgaagaagctcaagtggagggttattggggatatggaaaatggtactacctcagtaaaaggtggcccggttgattgtcgagctctagttgttgcgctgggacccatggagatacgcaccttcttgctgagattttaattgcatttaccatgtttgtaaagaaaaaagaacaataaatggagaagttgctacaattatttccacatgtaaaaaaatagataaagtacacaaaatctgagttc

SEQ ID NO: 31460 - DNA, 221 bp, Sorghum bicolor
  Clone ID: 18069032
cccgtcaatttgggggttttggggagtatcaataagactgggggggaaaattttgggttaggttattcccggggggtattgcaccctgcatgattgccttttttaagcaatttggtttatgttttgccaatatgcaacccattatgattgtggtaatagggaggtttaattaatactttaggtttcccccgtcccccgttaggtagttaatgggctttggg

SEQ ID NO: 31461 - DNA, 623 bp, Sorghum bicolor
  Clone ID: 18069053
aagataatcgatttcgagaggtggagatatcttgcgaccaaaccaggatttgcctcactgaatggcgagtctgtcaacagcattacagattctcggcataagcgcttcatggacgtccaggccaacacctatgctttcggcgtgatcctgctggagctcatcagtggcagagcctcggtttccaaagatacagggggcttagtggattgggcaagaaagcacctggagcagcccgaggagttcagcaagctggtggacccgaggctgcagagcgtgaaccaggagagcctgggcatcgtctgcaacgtggtgaacctgtgcatcgacccggagccgtcgcggcggccgtccatgagcatgatcgcggccatcctggaggaaggcatcgaggcgtcggcggccaccatgctcaggaattcgtctctggcctgggccgaagccgagctggccatctcctagatgccctttgctcgttttgctgcactcgctagactgtatagttgcttggacagtgatggtttgacccattgttactaggtttggcattgtaatgttttttttttcttttctggagggagaaaatggcagataaatctgaattaaaaatgactcaaatttgattt

SEQ ID NO: 31462 - DNA, 452 bp, Sorghum bicolor
  Clone ID: 18069068
ttgtgtacttttgtgtgccagaaacaaaagggaaaaccctggaccagatggaaatgatgtttgaaagcggggacgaatggggaggaggtgaaattgagcttgaggatacacagcatttaatgccgagtaacaagaagtctgtgcctcttggttgatattggtagtaaccataaacttgttattagctccatgtttcaatgaggagccaacctgaccaactgaattttgaattttgatttaaaaaatgatctggtcacacggagccacgcccgaaatgaaaacagagaagcttgataggcataagtgcaacatagaagattaattgtgatgttagtctaaaatgtcaatgatttttctgggagggggtcagtcatgtatgatcttacatctgttgtatctcccacggaaagaatgtactcgcaaaaaaagttcttctacaaagtccatttttt

SEQ ID NO: 31463 - DNA, 286 bp, Sorghum bicolor
  Clone ID: 18069087
ttttctttgcaagtgcttcatttaattgggggcaaaccaaatttgatgaaccaactacaactcaaggatggaccagaatgggataaagtagctagtattcccataaaacaaatacgttgattagaagctttttatgcagatcaataggtatatcgtgtcccattaggaagttttagttgtttgtttcatcattattaagaatgtcagctttcttgggaaataatatctgtatctgtaatcagtaaaatgtagaactttgccctctgcactcatgagttaatcttct

SEQ ID NO: 31464 - DNA, 527 bp, Sorghum bicolor
  Clone ID: 18069089
ctctgtgaatcaggaagcatttccaatcaatggcatatgcatccacatgcctctggaagatgattgccttgacaatgaagaagacaagaaccagaatgagaagacaggagagagctccaccgatatcggtgggagtttgtgacatcagtgatgagagcaaacaggatcggaatggccatatatataaatctaactgtctagagagtatccacccccaaattgtataaaaagcgaggaaggttgatggttagcgctgaattttgtggtctggtgtggcatggcacgtctattggttttagtcgcaacagatgtcgcccccggaagcggaagctgaagcgagcgagtgagcttagaactggagctgggagcttgcttgtcgcacccccttcacactttagagataaagatgtgggggggagggaaccgttgctgctcatagttgtgcttgattttggttggttgctgtaaaaaggtgaactgaactgaagaaatttagccaaactgtacagtttagaacttttgtgctt

SEQ ID NO: 31465 - DNA, 485 bp, Sorghum bicolor
  Clone ID: 18069122
tggcaagcaaacaagatgcatttctcgccgccagatccttgagagctaccaagcttatggtgattcaataattgaccagtacgggcccagcaggccaaacgtgagacaacttgtcaagccactgttaaacttattccactcagaacctggcaacagcttgtggaaacgcaaagctgactctgcattgcgtcattgcaagacagtgaaaacattcttggaggagactcttgacgccataccggacagtgttcttgacaagccagtaaacagggaaccatgcagtgacgaaggatattttgctaatattgattctctgttgccaccaaaatacacgacgccgatcaactgtagctatggaagactagaacttgtagccgcatccacctaagcatccggaaggttttcttttttgagaagccagtaaacagggaaccatccagtgccagtggcgaaggatattttgctaatattgattctcggttgcc

SEQ ID NO: 31466 - DNA, 531 bp, Sorghum bicolor
  Clone ID: 18069131
tagaaggctgtgcaccgccgcctgccccaaggtcagaggttttgaagaacacacgggtgaagttcaacctgtacccagggacatccttaggtggtggaggtggaggtgcaagtggaagtggaggtggtggtactgcaggtggacatgatggacactctcgtgaagctatgctattaggttacgttgttgaatcaccgtcttcatctgattcatcatcagattcagattccagccaaccggacagcccatgccagtccgatctatttgccgaaccaactttgagagtatcaactagcgacactgtttcccaagtacctgagacgccactaggttcaggagagacagaactcgttcccgcctacaactactaaatgtgcttgttatgcatttgaacttgagatgtatttgaacttgtgatgtggttgatacttgggatgtatttgtgaacttatggttgtggactttggtttgactattgtgaacttgttatgtatttgaactatagatgtatctgtaatgaatgtttatggt

SEQ ID NO: 31467 - DNA, 491 bp, Sorghum bicolor
  Clone ID: 18069145
cccgtcgagatgtacatcaagcagcgccgcgttccgcggggcagcaccaagtggttgtgtctccagacgcttagcgtcacctgcctcctcgtctccattgccgccgccgccggttccatcgccgacgtcgtcgatgccctcaaggtctaccggccgttcagcggttagcttcggagaacgtggagggagattcgtgaaaaacgacagaggactgtgagcatctacaccaaatctctgctggaccatttccgaatactaacgagcgaggtgacctggcgactgtattgctccattagttggttcgattaagcaggatctagctctaagaaattaggtctatattcctaacttcgctggtagcgataagctgctatactttttgccacttacttgttatgatcatctgcagtgcacgggatgtgtgtgcgagtgagatcatgtggaattgctagtttgcgtctgtgaaccatcccaaaactatgttagaaatg

SEQ ID NO: 31468 - DNA, 522 bp, Sorghum bicolor
  Clone ID: 18069149
cccccaaatcaagatcaatattttgctgcagaagatattgcatcaaactcatctgttggtagaccttacttctaccagggatatcctgcgactgttgtttcaacaagtcagattcaagggcatacaaatatgcattctgagcctcagtgtgcatctcaggaatattctgcttatggcgcagttcagccaccatcgcaatttggtggtggaagcaatttctgaaaggtgtagtgtcattgacgtgtgaatatctgaagctcatgtctcttatactgattgttgtatgttaatgacttgttcatctaggcagtaaacatagacacccaacctagcaacagaagaaataggttgctatcttccattttgtgaatgtactaactgtaaatctgttattcacttagctgtatggaatatagaagcatcatgctataggaaactagatgaaatttgtttttgaaatgtatcatttatgtcattatgtgctagctaaacaaatcagtaagcattataatagacttctcc

SEQ ID NO: 31469 - DNA, 565 bp, Sorghum bicolor
  Clone ID: 18069152
acatacctctggggcaaggatgctgaagaattcaaacctgaaaggtggcttgtgaatggagttttccagcaagagagcccttacaagtttgcagcttttaatgcggggccccgcatctgcttggggaaggaatttgcatacaggcagatgaagatcatggctgctaccctgttacatttcttcaggttcaaactagaagatgaatccaaggaaccgacatacaaagtcatgtttaccctccacatcgacgaaagtcttcacttgtatgcatacccatgttcagcatagactgccaaacaagatatcctttgccgatgtacatattccacaaattatagtgttttgccagcctctttaggcaagtcactgcgagtacatacaagagcaatgaagcaacatgagcatgggacaattttaggtaaaattaaattcttcttttcacgatcggggaatatagcccgtttttcattgagagtagtgaattacacgacgcatctacgagagatgtaacatccccgatgttacggttactaaaagtgagatcatgtcatcatgagtattgcat

SEQ ID NO: 31470 - DNA, 599 bp, Sorghum bicolor
  Clone ID: 18069212
tcaattcgtccgcgataatcgtctcgtgctgggagatatctgtctgttcgagatggagaaggccacgaggtgtctcaggatgaaagtgcatctcattccgaaggcatgagcacatatatggagctgtatctggtgcagtcagaaagagctggagcagagtggacgcactgcagttgctgttctgtccatgcctccatggtggaagatccatatgtgaactccatctgtgattgctagtgccgagcatataattcattagaagaaggatgcaagtgcaggtggatacatcaagagcatccatttcatctagtattcttgcataactattcacacgatcaattgggcgctatatggcttgcacacaactgattcagtgtatcattgcagctgactatatgcaaagtacatatatagcatgctatgcaagaatcaagtgcgtaagaagaactgattttttagtgctgtcgtgtgctcaagaagaatcaaattagaaaaaaatatgtcaacaggtgaagcttgagaacagagagaagtaaacatgaagttcggaaaagaagacatgacacagttttttattcactatatacaactttatttgc

SEQ ID NO: 31471 - DNA, 600 bp, Sorghum bicolor
  Clone ID: 18069227
cttcccattcatgatggggactattccacctgagtcgtgggttcttgagaagcagctcgatctgatatctaatacttctatattgtggacagattatggccttcgatcgctttctagaacaagttcaatatatatgaagcgtaatacagagcatgaccccccttactggagaggtgccatttggataaacatgaactacatggttctttccgcactacatcactatgcacatgaggatggaccatatagcagcagggcaggggaattgtatgacaagctaagatcaaatcttatccggaatatcgtgcagaattacaatgaaacaggattcttctgggaaaactatgaccagaagaacaaaggaaagggaaagggtgcgcggtcatttactggatggacttcacttattgttctgatcatggcagagtcctacccaacattgcataggtgagatatacattgcaaacaactagagcagaagctagctatgtcagttggaatgaaggggccgacagctggccgttgtttagcttgatttccaaccagaatactgggagaacttgattcatagcattagctgccttaatcatgatgattttg

SEQ ID NO: 31472 - DNA, 610 bp, Sorghum bicolor
  Clone ID: 18069257
cgagcatctgcatgatcatgaatgtaatatttacaccagcaactgcaaatgggtactcccatgtggctctgttaccacactgtttctttagaagtctctgaaatgaggcctgtggaagtaaaataagattgttactcaccagcaagactagaggacattcaaataatgaaacaaccagtacatagtgcttacggagaatgtcttggcaaagaacaaaagattctccagagatatgaatcctgcacctctgacacatgtattcaaacgtcacttgatttggtactaaaagctgcatgcacttccaaagttactctgagaaattttggttcggattagtcattgtgtacctaaagtcagttgatgggtctcttccttgccaacccatgtccttccactgttcagatatcaaaccttgaagttcttgatcagggtatgttgcatgccaaagagctttcagggcttcctgtcattgttagtagttgagtgagatagcaaaataaacagacataactacccaggtgcaaaaactacagccaagctgagaagtcagctgtaacattttgcaaaagaaaatgtgtacttgctgatttctggtatatgcataattttc

SEQ ID NO: 31473 - DNA, 181 bp, Sorghum bicolor
  Clone ID: 18069261
ggtgtttttttgtggggggcaatagggagtaaattaatttgggctttgaaaaatccaagtgatgaagctagagtttgatggggagcaaccaagtgatatgttcccccccaggggggggtaggcattttatatgttttggcttaggaacaaatgtttgggaaatttttgtttcaaaaagggg

SEQ ID NO: 31474 - DNA, 470 bp, Sorghum bicolor
  Clone ID: 18069273
gatggactgagcagcaccattttgccccagcctttcccttctctgtttgagttatttgtatagaatcacagtctgggcaccaaagtaatcccataagaagcatgcaagtggaagaaattaggggaaagccatgaaacaacattggtagaaggatatgcgtgtaccatgttgaagatcaatacttctctcctaattgaagtcctcaaaggcttttgaggaatgaccagaagggtagagtgagtggttgcttggtgatctaagcagtctaatagttcgttacgtgcgcacgttttatttggaaggaagaacagttcataggagaaactgaagaaaatcccagagctatatatcagattcattggcgtcattttctttgttggcgtgttttcaattccaatatagcaataaataaactgtatcagatcaattattgcttttggatatgtggcgggcaaaagtccaatttgtgt

SEQ ID NO: 31475 - DNA, 564 bp, Sorghum bicolor
  unsure (1)..(564): unsure at all n locations
  Clone ID: 18069289
ctagccatcagagatatgtcgagtagtgacccttatgtcgtcctgacgcttgggcagcagaaagcacaaacttcagtaatcaatggcaacttaaatcctgtctggaatgaagaactgaagctctgttcctcagcactatggacctctgaagctgcaagtgttcgatcatgacatggtgtccaaggacgacctcatgggacaggccgagatcgacctccagacgatgatcaacgctgctgcagcattcggcgacccagagctgctgggcgacattcagatcggccggtggctcaagtccgaggacaacgctctcgtcagagacagtgccgtggtggtctctggcggcaaggtgaagcagggggtggcgctgaagctgcagcacactgagtccggtgagctggagttggagatggagtggatgccgctcgtgtagaaatctgctgtcaagatgcaacttttactccgaaatttgaaatcaaaattatctgcctattgccaggtaatgggtgttgtacaatggatttgtattgcttttgttgccgcaaganatatgcagtgttcgct

SEQ ID NO: 31476 - DNA, 544 bp, Sorghum bicolor
  unsure (1)..(544): unsure at all n locations
  Clone ID: 18069304
cctggcagaaatgaagatagcattctttattcagtatcaattctgagggccacaccttttattgaggatttggaggttcattttggtggcactacatcattatggttggcagacgtgggtcctcgtaggcaggacattgggcaatgcaatccctacaatcgtttgaagaagatgtggattactggattcaaaggggtaagaggacaagtcgaatttatgttacacgtcgtcgaaaatgctcctgcactggaggttttaactgtagatacacataaacgtagtacttctggtggtgatagttggacgaaaaagagtggaccgccgccctttgaggaagctaagagaattgctttgacatgcctaagtagagcaatctcactaagtaccaagcttgatgttatttagtttaatgtgtgatgccaggaaaagatcgcagtgtaactctttaaatcttgggcatagtagtagtatgtagttcttggtacatcaangtgtattttaaatttgtaataaataactgccgttttggcaccgttttcatttg

SEQ ID NO: 31477 - DNA, 532 bp, Sorghum bicolor
  Clone ID: 18069316
ggatgtgaagatggggtacaggaggctaaaggagaaggtcaaggagtacaaaagaagggatgccaaattgtatggcaacatgatttccaagctgagcaagcttgaagacacggaagacaatgaccaaatgagtcaggcactaaacaagaagcatgggctcttatggccactgacagaaatgcttaggagattcttcactaccgatggaagcaaggggtccacgctgtggctcgtgctgaggctattgattccggtaatgctattggttgcagtttgtgtgggttactacatgcacagcagtgttcaagagatagactgcataaactgttagttgagcatggtatctgtgctcgccgtctctgcttttcacgggacaagtgtttatcgtcgtatagatatgagtattatacgtatttgttacctgtgggggttgaggagttgggtgaagtcttgacttgtactgtactgttcaactgacttgtctaatagttacttcctgtctcaaaagaaaatatgataatctcgttttttc

SEQ ID NO: 31478 - DNA, 214 bp, Sorghum bicolor
  Clone ID: 18069326
ggcgtttgacaagttttgatttagttaattacccatcaagataggtaaaagatgggggaaaaaaatataatgcaggtagtcatgtaaagtgaggtagatatattctgtccatccatatagggataaatatatgcgggcggtaatcaatatgggaagtttagtatccaatagcaacttccaggtaggtaataatcctagtatatcacgggcgtcc

SEQ ID NO: 31479 - DNA, 646 bp, Sorghum bicolor
  Clone ID: 18069373
gcagtagagagaaacccagatctgtctacagcgttgattgcaatgggacaaaccctgttctcaaataaattgtttcctgaagctgcagtttgttttgaacatgctataccaaagattcaagaagatgatcctcttctcgtgcttgcatattttggggcaggtctttcaaacgagcgtcagggggataatgagacggcaatcaaactcctgcagagattagcagagctcaaggaacccaaaaagcccatcaacaaaacctgctacttccaagggatgcttactttgggaagtatattatctagagaaggccggaattctgaggctgccaaatacctgcggatggctattgcttatgatcctgctgtagaaagacttcttaaagaatgcgaggaaggaatggatgatcaaccaaagccagaggagaaatgatgtggtggacctgaaaaagccacattaacagagatagcatactgcttttgtttttgaacactaagacatggtttgtctggaattgaaattctggaacgcgaacaagcaaatcctgggcaattagtgctatagaagaaatatgaaaccagagggtgacaattgcacggtcataatatctaggacatactgctgcctttgaagtctgcggttacctccc

SEQ ID NO: 31480 - DNA, 619 bp, Sorghum bicolor
  Clone ID: 18069387
actggaggagtccatcaggacgttcatggcgttcctccgcgccgacaagaggagccactacgagatgttcagagagatggtgaagaggagggcgtcggcgaggagcgccgtggatcagacgctagtcgtcacactcaagaaagccaacaagaaaaagaagagccggctcaaggacctgacgcggccgcggcggtgcctgaagaggacgaggctgagggaggaggaggagctgtccatcctgctgggcctcatcgacctcaaggtggtggcgcgggtgctgcgcatgccggagatcaccgaccagcagctgcactggtgcgaggagaagatgaacagggtccggatcgatctggagggcaagctgcagagggaccctacccctcttttctaccctgcacattgacagcgacggacctgtgctgtctgctgctggtgctggtgctggtgttggacaacaacagtcttgtgcaataatcttctagtagctcttttcttttctttttttacttttttttttcgtatcttcttttgtccaagatatgtagtagtgggagaagggaacgaaagataaagttgcattgcatgcatagacatgagaatatgcatggcacttagcctc

SEQ ID NO: 31481 - DNA, 109 bp, Sorghum bicolor
  Clone ID: 18069411
acaaatttggatgggtggcgctggagagccctcccccatgagcaatggggatatcagagatcctgagataaaagacgtgtacgcgttcgtagtgcaacacaatttagtg

SEQ ID NO: 31482 - DNA, 145 bp, Sorghum bicolor
  Clone ID: 18069431
aggctaacgaggatgatgtggttttgtcaaacccccttaatgaggaggcaccaggctgcatacgatgagattatgtcctcagttggtcccgaacatgggggtttattttttggggatggtcctaatgggcccggaaaaatttatt

SEQ ID NO: 31483 - DNA, 504 bp, Sorghum bicolor
  Clone ID: 18069455
ccattgtatacagttttcaagcgtgaccgagaaaatgttagattggccagcatcaaggaacaggagcttatatgaaaagatttctgacgaggagcaatgatgtggtttttcatttggctgacatctgtttgtagtttggattattaatatttacaacaccgccaaccctgaagttttgattgaagtgctttggttgatgtctaggatactcaggttttatgtttctgcagtcacatatcatacaagagtacacattttgtacaagtgatagattgattgacctcatcgttcacaatgtaactggttcagtatacaatgcagaccttaacctggagagtggattgaagatgttgcaacttttctagtggattgaagatgttgcaacttttcattgaactttcagcatatagatacagttctttctcattttatttctatttacagtttgtaacttgttttaaactgcctgaaccatcacgccagtccaatgctgaagtcattagg

SEQ ID NO: 31484 - DNA, 628 bp, Sorghum bicolor
  unsure (1)..(628): unsure at all n locations
  Clone ID: 18069461
cgttcctgagacgggtcgtcttatcgtgctcgagaacagtgccaccggagctgaagacatcatcaaactcaagcaggcgctgctcccgacgactggcgtcaagcactggaaccacctgcccaacgtcacctcggtggtctctgagactgcaactgagaaggtttacaacgtnttcggtgtcattcaatcgattttcgacggtggcaactgctccgccgcatactactctagccgcttcactgtcctgaaagacagcgccggcagcgttcgtaatgtgcctcatagcggcagcctcgtgttgtacgatgattacgtcgtgagcccttcccactcgccgacagacattccgtgctgagtgaagaaaagagttgtagcaactgggcgcttggacacatagaagtgaataatgcatttataagacggcatcattatatgtaacgagaagaaaagttataagcctgcataaaaatgttcttaatgtgtcgtgaagctggaatagcttcgtgtggctagtttcagtggtgcttagcttagatgtggcttatcacccacacggaccacttaggatgtgtatttctacccgtcctccggttcatacatagattcttaataggacaactactttcac

SEQ ID NO: 31485 - DNA, 596 bp, Sorghum bicolor
  Clone ID: 18069469
ttgtgtggaatatagaatactagccacagacacaagtgctacaactaacctgcaggctcaatgtaactagaaacaacttagccaatacagaaagaaataaggctacaaggcctcagggaatagctgcttttttgtttattattcagactccactttagctcccgggaatgttcggaagcgtaccacaacataacacctgaggataaggttggctcacaacctattacatctatgcaaaaaaagaaactgggtgttgcagagaaaattaattcaatgcccttcagcctccacacagggagtccacgacgtgatgaaagcaagtaatgatggtgtttcaaaggtgccttatgatttgtacataaaagcatcgagattttttatagtgctataagtaccctgtcggatgaatttgtgcactgcatctcacaaaaaaacagcacctatctaattgtgttctctaatataagagcccacaaccatcccataatgcttccatatgtccaaggaagcctagcatgtacgggatataagcactatgaatatcatgtattgtaatttgtatgaatggtcgcccctatgtgtggtactttgcacct

SEQ ID NO: 31486 - DNA, 648 bp, Sorghum bicolor
  Clone ID: 18069478
agaagccttcagctggacctgtgaaggacgagcctgtgaaaccatcggagaagccttctgctgaccctgtgaaaaaggaacccactgagccagttccagctggagaaaacaatcaagctcctggggttagccagactacaattcctccaaatgatgcaggtgttggtgcaccagtagtcaagcatgataactcagaggcgcagaagtgaagatgatagaggaaacccaaagtcccgatccattgagatggcagatcatgcaaatctgctcgacaaaaatgcagagtgattggttgaacccctaggggctcagattttcttgcctcttctggaggtaaaattgattgctttgggctaatcgacgaagagtggtgggcatatcaagatccaaattagatggtgttcagttgttcgcattcattcattctgtactgtgttgctaattgctcatggataatttaatctttaaatagttaccctgtaactggatcattctatacatcacattgccctgttgtacgaagtattagccagtcaatttggggtgtgtggggttggccgcttgagttgggttttgttgactcgactctgtagtacactgtccttttctctctttatatgaaatgacacgcagctctcctgcctcttg

SEQ ID NO: 31487 - DNA, 603 bp, Sorghum bicolor
  Clone ID: 18069502
aacaattctcaatcaaacatcctcattgttgttatcacttggtaaactcaaaagtgggaagtcgaacaactctgaagaggctaggtcaagtgtttttactactaggacaggaaagtaaacatggcggtgaactctaattgggagcgccaaacctgagtgcaactgacaatagcaacaaaaaggggtatccacttcatctcgattagaatatatatggcagcacaagattgaactttatatgagcaactagtgcccttcagtatatgtggaaacggttctatcttcctcatgataggcacaagattgaagtttatatgagcaactagtgcccttcagtatatgtagaaacggttctatcttcctcatgatagcattttgtaatttgggtggatatttctggaaggaaaatcgactcttatcatgtaggagtaccatctcagaaaactcaaaacaacaccagcttctcgattcgttgctaatcctgttccggtttgatgcaaaaatcctctttgcttttctgtatttatttgcttatttggcaacattttctggattgttgtacagaataatgttcattactctttgatctaatttacataattt

SEQ ID NO: 31488 - DNA, 451 bp, Sorghum bicolor
  Clone ID: 18069524
aggtatcccaggagaaaatggagcatgtctccatattcacagatccctcggatctgaggaagatgcaaggacagcagcatcacaagatgaagagagtgacgatccaaggattcacatctgcaaagagtcttgtcgagcttacttgccattttgttgagagcataacatcacttgaacaccttaccgtggaagcctttcagagtagtataaggtgttctatgcctgctcgcaaacgtcgcaagtgcttcccactgcccattgatgttctcagggaagctcaacgaggactcttggccatcaggacatacattgagcctaaagttccttccatggtaaagctacgtgttattgaaccttgctgccgatgccatgctgttgttgaactttagatgtgtaactcattactcaagttttgttatctagtctttggtgtcattagttcttcaagttc

SEQ ID NO: 31489 - DNA, 559 bp, Sorghum bicolor
  Clone ID: 18069542
caccagctcagagccaggcccaacagcagcagcagtctcctcaggcgccacagcaatcaccaacatcagctggattctttcaatcatcaggcatggggttctttccgcctgtgcagctgcagcaatctccgtctgcccaacgacagtgattccaatggtggctatggcattcatgggcttaaaggccacaccttttgttaactttgtacattaaacagtattcaccgagtatcgagcttaaatgtggttggtccggcaagcgaggcagggccaatggccacgaattagaagattgtagaataggcatgcgtcttttgcgatgtataactattccttgttttgtctgaagagttttcactcttcctagttatgtgaagtagttagacttcgtttttccctgtttgcattgatccccagaggcaacaggaagtgactttggaaaactgttgcttaagagttgccaactgatagaacagttgtagggctgaaacagttgtagaacttactggtcatagtctcatggatatgatctgaactgcaaatattttccatgctgttt

SEQ ID NO: 31490 - DNA, 562 bp, Sorghum bicolor
  Clone ID: 18069548
acgtgtttcgagctgactgaggaatacgcagattttcgaaattgaaaatcacagggaagatggattcatcgcaaggaacgtttcaacatgtgttcgattgctcacgccaacatttcataacagattggcagattttcaaaaggatgtgcggaccaagccaaagctactacaagagcatcatgcattcaagaagccaagcaagcagcatcaaaaccagcgtcgaatccaccgtggcaagaattcacagtagaaaccgcctgatgtggctggatagcacattcagcccagaaaggggaagaacagaagaatgaggaaggcaggcttgattcccttcagattgttcagagagtttagtttaggtctgggctttagcgctctcttgggccttgctggaatgacttggccttccttgttctgcttcttccgtcctttagacattctttgctaccatgacataaaaagttaggctttgttcagtttaagaaaaatttttggttttgactgttgtagcatctttgtttgtatttaacaaattttatccaatcataaactaattaggttt

SEQ ID NO: 31491 - DNA, 581 bp, Sorghum bicolor
  Clone ID: 18069551
cttgagattggcaaagtggtggaacccattatgcacaatacctacatatttgaatttcatactaatattgttgattatatttcataaccccaacatatttcactctagatttggttttggcttatggtgtatgtatttgggaaaaaaactggctattttagatagaagaagatgtggtgcccttgaagtggattgagctcgtgaaggataagcctagccatgctcaattgagtcataggtgattggctacaaattatgtgggtcaactagaacccaacttggtcttcacatacccaaatcaaccatcatcggcttagaatgcttaggcatgaaccaagtgaggttttgatagttttattctaaagataggtagagatttttttagaaaaggaaaaggcaagatatgtattatctttatggggtatatttggaaggttttgaggaatgagcccacttgtaagtggctctaaaggctccaaaagaactctagaatcaatatagaatttatttgtgttgaaggatgcaagagaagacaaatggaagttgagctcatcaactccacccattgaaccgattgactc

SEQ ID NO: 31492 - DNA, 502 bp, Sorghum bicolor
  unsure (1)..(502): unsure at all n locations
  Clone ID: 18069612
ttggaaatcactatcattccagctatcacagcaacaatgggttagaggagggaaacagagagcgagatcaaagagataacagccctcagaccatgtccaagacaagtttcatggatgatgatcccgacctagaggagggccagagtttccatttcaccgatgtccctccgaacaatgatggaaatgaagatgaagatgatggcaacagagtaggcagtatctgtagctctatgctagccaaccttcatgtacggattgtacctaggagcagtgacccagtttagttgaaacaaacacacacacaccaaaaaaaagtcatagttgtccagggacgccatccctaaattacataagaaacaaaggatgcatatttttagttttgtacgagctggcaaaggcggcaaaggcagacattcttttgtacacatgaactgcaccctaatataatctaagccctcnccctttgtggaggagagagatggcaacagattcttttttccgt

SEQ ID NO: 31493 - DNA, 548 bp, Sorghum bicolor
  Clone ID: 18069653
ccctgaagtgcagagtgcagtaccaaaatggttcttgctatggcctcaagtggtactgctgcgttccatgcaaaacatcggtggcggtaaaataacctctatgtaaaagggaaaggagcaacgtggaagcgtcaatggtaactgtttccatgcaagggacaaccatatagccttgacggtgcttggacggtgggtgcatgcgccccgcatgcaaaggtcagctacagctttggacggtgccatgcatgcatgttcatttaatggacagtgtaaaaagataaagaaggaagtaggcctgcatggtaaacctgtagatgcaaaggacaactacatagttttggacggtgggcgcatgcaccccgcatgcaaaggacaactacaactttggacggtggcatgcatgtatgttcatttaatgctagactcatgcatgcacttatgtgtactatgtaatgcatatgctgaaccctgcatcgagctgcctgccatggcatttatggaggcagtactctatgtggggcatggaggtacactttcatttaaaccgt

SEQ ID NO: 31494 - DNA, 543 bp, Sorghum bicolor
  Clone ID: 18069660
aaaagctgccaaagacaccaagccactctttgctgctttgaagaaggaaggaaagagcattgctgttggcggttattgctggggtggaaaatttggtgccgagatagcaaaaactaacgatataaaagtagtttgcctttctcatccatcaacagtgacggctgaagatatgaaagagatcaaatgcccaattgagatccttggtgctcagaatgacacgtccacaccaccaaaactagtgtaccagtttgtgagtgctttgcgtcaaagaaatgagattccatacttcgccaagatctttcctggagttgcacatggatttgcttgcagatataataccactgatcccttggccgtcagaaccgctgaagaagctcttgcttacatgcttgattggttcaagaaatatttgaagtgaagactacagatatgcatatacaaggttgttcctactgaattaaagggaacaataactgtttgcaatccattgtaaacttgaagacatgccagagaatgaattcaggacatacacactattctttt

SEQ ID NO: 31495 - DNA, 606 bp, Sorghum bicolor
  Clone ID: 18069703
agtattccatatgatggacccagatggaattgctaactggtctgtaacccatgttgactggtctgaagggaagtggcatccgaaagcttacagggcaaaggatgtcactttcgagcttctgaagaatataacatcaattgacatgaaccaccatgtcactagtgatagcaagaaagtggttacagagaaaccctgcctatggaatggagcaaagagaccatgctacctgtttgcgaggaagttctaccctgaatccataaataatctcttgaccctgtttgcgaattatacacttatttgagcttctaggggcggctagaggcaacagggatacacaggaaatcttttgttatagaaatccttgtacattggatagcaacagaataggagattaattaacagaatagcaattggtgaggagaaggctttcgctgcagcaacagtggcctcggatttaccacgacaggccattgctactcctttagcctcgtgttactttcatagtttttcctccccacatttttagctgcggcgttttaccatgtacatcaagcttattttgacaaaggaatggtcgttaaatggaaaatctgatatcatggtctt

SEQ ID NO: 31496 - DNA, 144 bp, Sorghum bicolor
  Clone ID: 18069747
gtaaaaaacattcccagtgctgtgatttttttccctaggtatccaaagttttcttaggaaaggggggaaattctttggggggatacaaccccatgtttttcccaattccaaaaagggtttcggtatgattgtataccaatatca

SEQ ID NO: 31497 - DNA, 149 bp, Sorghum bicolor
  Clone ID: 18069752
cagtttgccagacgactctttcaacttgcagtgttacatgccctctccctttccggaccgtactgagggcagccattcatttggcaaagttgttgttgggtggctcaagatcaaggctgcaataaggtgggggattttggtcaggaaga

SEQ ID NO: 31498 - DNA, 313 bp, Sorghum bicolor
  Clone ID: 18069759
cacgaattccgttatgcccctcggatgacgagatgttcccgttccagttcaagaggaagcagtttcctattagactcagttttgccatgacaattaataaggcacaggggcagactctccccaatgttggtgtgtatttgcctgaaccagtgttctctcatggtcagctgtatgttgcgctatctagagccactgccagatcgaacaatagaatccttgttatcccacccagtgataagaaggataagaaaaaaacgacaaaaacaaatggtgcatacacgaaaaatattgtctacaaagaggttctcactcc

SEQ ID NO: 31499 - DNA, 497 bp, Sorghum bicolor
  Clone ID: 18069760
cataacactaagcagaacaacagcaacaactatcctgctgtttcatcatcagcaccagctagagcaatgagggagcaaaagaacactcttttggattctgagaagctagattcagccaggaagaggcttcaggaaaactatcaggaagcgcaaaatgcgaaaaagcagaggacaatacaagtgatggatatccacgacatacctaagccgaagaataggaacaccttcatacgcaagagtggtggaggcggattcccggcaaagcaccggtgatctgcctaactgccatcgttcatgcctataacggacttgcatatttattttgtactatcaaaaaaaaaaaggaaatctgaaagcaaaactcttgtgtttccagactgttttgtagcatttcagtccagtttgatacatactgcctagtccatgaggctacgcttgtacttatcttaagactggagaacagaaaggaaaacaaatattgtgttatttttcatgcc

SEQ ID NO: 31500 - DNA, 180 bp, Sorghum bicolor
  Clone ID: 18069779
aagagtccccctcccctcccgttttccctttaaatttggaagtcagaaaaatgtaaaggctcccttttagctgggaatttttccagtaaggagaccattcccattttttttatgtatcatgtatagggctcaaatactttttggaggtagtcatatactcatattcaggggcttggccct

SEQ ID NO: 31501 - DNA, 156 bp, Sorghum bicolor
  Clone ID: 18069783
ccagggaaattgaagccgagcccacccgtaatgggcaaaagccccccgctccttaggaagaggggcagacaccagttcttttgaatcccctgaagggtatgtacccctgattttgatgtatgcccctgggaatcccgggaaaccattgatatcccc

SEQ ID NO: 31502 - DNA, 166 bp, Sorghum bicolor
  Clone ID: 18069797
ggactgagaagggggcagtttatttttgcgcttaaggagacatactttggtcaattaacccacacatccctgagtatgggggaatcgtttgttttgaagccccggtggtttgtgttttttgtattgagattatatgatgaaaaggtgcccatttggggtttgatag

SEQ ID NO: 31503 - DNA, 303 bp, Sorghum bicolor
  Clone ID: 18069830
atcgccgtgccagcagggtaagacaaggaaggagtcccctttgcgatatactttggtgggctcaagggctacgatccaaggttgattgagattgcttatgcattcgagcaagctaccaaagtcagaagaccaccatctttcaagagctagctaacaggaagtaactagcatgatggcagctggcaggtcatatggaatttaatggaaataattccaggggaagtaatcaccttggaaaagaaaatattggagcgtttttatttgagcaatcacttgatatacaatagaacgactcattgtgag

SEQ ID NO: 31504 - DNA, 601 bp, Sorghum bicolor
  Clone ID: 18069870
tcattttgatgaagcaagtagccatgtgccagaactcaagaaaagccgatccagtaagttaaatggtcaaaaagatttggttgcagaaaggaaacgacagcgtgaggatgtcaacactttgctttcttcagctcttataccatcaatgaaaccttcctcaactcgtcatactaagaaacagaaatgagaagactccagcaaaggtggctaatctcgtgggtatggcaccttttgtgaagcaattttggtagcaatggtgcttggattatgagtttccatattccaaagcaatatagtagaggaaagctagctgcctgttatctgggagctatatgtgtagcaactgacaaacatccagtgcccccaaggagccctccatccatacagtagcaactgatttttccaagtactggaattttttggacagctgtaaattgtttcttacgtcattttctttcccattttcatccgtttggatgcgagcaaaaagggagcatacagacaaatagagcaatcatactgcttgttgaagcgcaagccaattttgcaatgtacatatttgtaaataacaccttcgtagcaagaacgcagattagcattg

SEQ ID NO: 31505 - DNA, 583 bp, Sorghum bicolor
  Clone ID: 18069881
aacttgttcataggtggctttccccacgggttctggcatattggttcatgtttgggggcttcagactgcaatcaggtgatattgttcttaaggtcagtggcgggaacatcgatggtgttgagagaattgtgaaatccttgcaaacacaatctttaacatgtaaagtgaagaggaaaggaagattcttttggataggttttcagggaagcaatggcgactctttctggaaaatagttgaaccttatgtgttggacagttttgcaagttctactgaggaaagtcacaatgtaggttctgatggcttgcaagatagtgatacatattatgatgatgatacacagaggcatgatagagaaagtgatgagtgaggacagacttcgttcacaagtagtctacaggctctgtaacttcatcagaattatgacaagtctataaatttggttagaggtacgtcatgcatactttccaactaacacctgtcgcccagattgatctatcaccaacccagctgatcggttgcagtcttgtactatagacagtcctgagcagaaagatatatggtagcttggtggattcccttttc

SEQ ID NO: 31506 - DNA, 506 bp, Sorghum bicolor
  Clone ID: 18069887
tcgcagacctgtagaactgaagcgaacccctgatgagaggatcacaatcagatggactttcaagaaattcaatgaaggcaacatgagagagatattggacccgttgctggaagatcatgtggacgatgaggtgcttgaaaagctccttagcctggctttccaatgcgctgctccaacacgggacgaccgcccgactatgaaggaagttggggagcagctgtgggaaataaggaaagagtacggaaagagcattaggaaggtgtgaagatcatggacaacattacctgtttttcaagccttcccctcaaggcctcaaccaaggaataagcatgcttttcatcaaaaaaggaataagcatgctaaccattcgtgcccattggataaacatttatggtatgtttcttacttggaagatgtggtctgaacaatgtacagtgtgataacaacacccccagtatgtactttcttgtctatcggtttgcagcgcactcctctgtggagaatgt

SEQ ID NO: 31507 - DNA, 557 bp, Sorghum bicolor
  Clone ID: 18069896
ggccaacccagtggagatgactccagcaaggatctcacatttccagatgctatttgagaccttactacagaaagatgactcacgggtgtggaatgtctttactcgcgtcgctggactcccagagctcgagatactgagggatggcattgtgctgttcatcaagcagcatgtgatcgccgaggacaccgggaaggacttggctggcaaattcaagattgcaaagaaggcacttgataatactgctggagttctgatgtaactctgtctttgtgcaccattctggacacacctttagagttcagtcctctgttctcgtttttccttttccttcagagttcagagaaacgaaggattaatccttttctgtaatgcatgctagaaactagagaaaagttttggtagattgatgccttggttattagaaagcttctccaagagacctttcatgggtttggaatgcctacaaaaagttttgatgatgagtggacatacattatacaatttcgtagaaatactttctgactgcacgtgaagaagatccatacaattgaacagct

SEQ ID NO: 31508 - DNA, 556 bp, Sorghum bicolor
  Clone ID: 18069946
attcttttgtgtatgtaaccaccaatcgctagcatcaagttctttaaggattttggatgcgatgagaagttccccattacagatgatagggtcagccacttgctacctgcgtacaatgaggatagaattgtgagggtgtatgccaagaagcctgagttggttgatgtggtgtcagaagcctttgagaatctccagatgagaatgtatggtgagaagactcaagtgcacgagacgccgaagaaaaagaggattagatccaactaggcagttggtcactctttaggtagcatacaaacacgacacaggaaaataggttgacaaacaagaagctctatagataaacgtatcctagaattaacaagttgtagatggtagtatgcactggtaaggtgtaggtattttgtgtacaggtgaagatacaaacaacattgcgaagttaaaaactcacgctgacgtacgaggtgcgatgctgcacgtgcgcggatagctagccaaatactttatgatgtggctggaattttaagtacttaatatgcatgattggctctaagcgacc

SEQ ID NO: 31509 - DNA, 190 bp, Sorghum bicolor
  Clone ID: 18069978
caatacttcgaaaccttcgagaaggaaagggcgacggagcttggtttctttgggttttgattagtagctggggacccttgactttggctaaagttgaatttttttgtaagtcccctgtagttcttagccagttgtaacttaaaagagtttttatgtttaggttgcctttttggggccccaatcatgtagc

SEQ ID NO: 31510 - DNA, 639 bp, Sorghum bicolor
  Clone ID: 18069980
gctaagattggggcatccgcttataagctacagttaccgccacattgccttatccatcctgtttttcatgtctccctactgaaaaaggcaattcctcctcataccacggtaagctctgccttgccagacaatactgatgaactgcaggtacctcaagacattctggatcgacgtctacaacaccgtcatggcactacggtttcacaagtgctggtgcggtggtcctatctacctgatgacctctgtacctgggaggatgaagttccgcttcgacaacagtttccacgagcaccagcttggggacaagctggttctaaaggaggaggagatgtcaccgtcccaagtacaccggtgcctactctgaagcaagacacaagttcagcccaggaaaagagaagccgacggcccagctctcgcacatcaggtccagagtggacgcagtagagagacagccctgcgtggcccattctggaaggcagccatcgtgctccttcatgtatcgtggaaggaaaacagaggagatcgaacttggtcatattctgaaccgtgcccagagggcgacggcggcggcggcgagccaggcagtgccggcggaccgagaccttgatccaccaattacccaatatacctgagattcgt

SEQ ID NO: 31511 - DNA, 151 bp, Sorghum bicolor
  Clone ID: 18070006
atgaatatatagcttagttcctaatttgtcttaatagcatgctggttttcctagagaagatcattttaacttgggccaatggctggtaagttcagtactcaaatttctgtaccttttgtcaaaatattatatgcgcatatagttcagcctc

SEQ ID NO: 31512 - DNA, 559 bp, Sorghum bicolor
  Clone ID: 18070009
ccttcaaccaatatttcgacgtagagctccaaagttgcatcatatactggagcatctgcactatgcataactcctaactactattgtatcaggtttgttcaactttgaagctttgttgcacttactcatggaaaaaaggaataaaaggaaaagaaaaagcatattctatgcattatcaagtcatagatttgctcattctaagaaaaaaaagatttgctgactcttgtggttggctgaccatgtagcttgcattttgctgtaaagtttactgggtttctaatcatctatgtagtaggtggcattatatatcctcccttgagggatattttgcatagtgctacacttccttctgttttacttgtggaagtgctaaaaagagaggctttgtactcttaggtcactataggaatggtagactcatgtattttacttagagagtttgttagtagatcacccaaagtatgttacactttaacggcatgtggataattgatgttcaaaacagtcattgtaacttgtagcacagatgctagagcatagtgccttttaaattgttctt

SEQ ID NO: 31513 - DNA, 435 bp, Sorghum bicolor
  Clone ID: 18070013
atggccttggtggacctcattgcagctgatttcctcagcaagagaatgagctgtaacctgaggcttcaagtctgctcatacattcccttgttccttggtgccatgtccatgtcgtctttggccatctgggcttagcaagtagaatggaagtaaggcaaaggtttgaggggggctgcttaattccctttcgtagcaggcggttctctccggcagctagttggttgcaattcttcatgagaatgggggcaattttttttttcttttcctctattcttttgtttgtctatttgttctcttcatgttggtggtgggccgtaagattcagtccttttggtgtaacaaatcaatgctcttctttgggatacattgtactggattagaagacagatggacatagtagttcagggtttcaggaaataaatggttcttgactcc

SEQ ID NO: 31514 - DNA, 684 bp, Sorghum bicolor
  Clone ID: 18070014
tcaagatgatgaacttgagagtttcttatatgatgattgtgggcctgataaaaatgaagtaaatgagttagacaaatatatggcagagccactgttgaagcaaaatccatttgatattttagcttactggaagaacaatacagacaaatatccaattcttgcacaaattgctcgggatatgatggcaatacaagtgtcaacagtagcttctgagtctgcattcagtggggctgggcgagttgttgatccccatcgtaatcgtctagatcctgagatggtacaagcactgatttgcgccaaggactggatacatgcagcaagcaaagatcccaaaacattcctacaattgtggctgaactaacaccaccggagacggtttctattagtactagccccccccaccaccgatgatgatgagggagaaggacaaagtgtttcagttccggttgcactgaatgaagatggtgtgctgtgaaaaactgatgtgtcgtagtgttgtgtgtgctgtttcactgttgaggatggtgtgctttctgctgtgaaaacatgtttgtatgagcgctggtggactacttcaatttctatttgtgaacacttgttgtattgctattttaaacttgtgacttgtgagcatgtggtgtatggataattcatatttgtgtcaattatgatctatggttttct

SEQ ID NO: 31515 - DNA, 615 bp, Sorghum bicolor
  Clone ID: 18070029
tgtacctgttcatttaatttaccccttgtatgatgctccatttttaaatttcatagttcctgcactgctaaatcatttaggaagaaatagagttagtgcatttgcttgtttacactgttgtgaaattatttttccctcagcacttgattttcccttaccccccatttcatgtttgagtttttcagtatagttacataggttgttcatacacaagtaatgctttttccctttgctttggtgtaggaaatccgaatacaatagtggctcttgctggaaacaaggctgatatgctagatgcgaggcaggtgccagcagaggtatgcgattccttcttccctgtctttcctcctttccacattcattccgcactatcttatctctaatatgtgtagttactaattggttaccttatatgaaactaatatttaactatgtaaccaattagtcattaaggtctacttttccattatagcagtgcatgcactcatcaccgtgtcgtagaatgtaattgttttttttttgtgtgtgtatgacagttttggccacactatgataaacctgtttgggagtggattttaatgcagcctgcctatttttgttctttaggagctcttt

SEQ ID NO: 31516 - DNA, 508 bp, Sorghum bicolor
  Clone ID: 18070048
tcttgagccagaagtcaagcaatttatccaggagatggaacgcaaaggtgcattggtcactgttatgagaggaaaggcaattggtggagacccatggccaagcaacatcacgaccactatgcagtagttgtagagggagtagagattagggagcacaatgtcagtctgacataacaatgtgattgccacgtagtgctgttaccagtgaagcaactgcaaatgtgctgggccttttgaggcgagatagtcaggtagtggacatggatattagctcttgttcagttttttgtaaggtgcctcttaaaggacacctgcttgcaaggttcaggtgcatgtagtggtgttattatagtctaacgcaggtttggtcatataataatttctccagtaagacataccttagcacctgttttctgaatgcttgtcatttccccagttgcagttgtgtgtacgtggcatctgaattctgatagctttcacgtctcttgtaatattgcttccaacctgc

SEQ ID NO: 31517 - DNA, 610 bp, Sorghum bicolor
  Clone ID: 18070050
catcagtctgtccatcactggtattacgtggcattggtgagactatagcatcaagatctgtccccaaggtacttcttctgaatggatcacatgacagagagactgctgggctgtctgcctctggctttgtcactgcaattactgattctctaaatcgaacatatggtgatcctcacaaaagattaaagaatcatcccaatgactatgtaaatgctatattggttccagaaggaggccaagttcccatagatattgaaaatttgtcagttcaaggaatctttcatgtcgtaactgtgaagtctattcatgacccgaaagttggcgccatatttgatgcacggtcattgatccaagccctaaccattctcatatctgaacagatggatatgtgtctctcagaacgtggtcatctaactgaaaatgtaaaagttgtaaattgagcgttcatgtaaaaaaaatgaatgtatagtcctccataccaatttattgttttaccaatcgatccatagtgttaaaactcataattgtatttcagctagcactagtgttgcaattctccatgacttgacatgattaatgaaaaatgaggacatgtatttttcaatttctt

SEQ ID NO: 31518 - DNA, 521 bp, Sorghum bicolor
  Clone ID: 18070061
tcaacattcagcaatgatcactttaaagtttaacagccacgacagtttctcaaacagtcctagtctgctgaaaatagtgcagcttaaccttatctgttcttatttctgggaaatattaagtttggaacctgatggtggttgcattgtgataaatgacggttttgaccattgtaatcaactaaccaccaccattgtcaaatccagctgctgggaactttaagatttctcggtggtggttattcggtagatctttagttaatgttgtttatttataggccgatttaatggtctcatctatcagtcattcacctaaacaatagctaaatgaatgcctgatgtttttgataattgattgtagtagttccttgatgagaaaccagtcgtggttgcggccgttgcccgttcctgtattgaataacttcttgtgactgtatctgtactgctaagcatggacaacataccagtcgtagaagcagaaccggctgtgtatcttataattattagtggcagaggaatgtttc

SEQ ID NO: 31519 - DNA, 226 bp, Sorghum bicolor
  Clone ID: 18070068
cccttacaggttgtattttggtgttacaattgaatcagtgaccacacatgcctaaatctgacaagttaagagtgtatatgacataatagccgtgcaattcagctatgtagctttaggtataatgggcccataagttggaagcatttccctgttgcagaaaatgacaatgttgtatgcaaacagtgtaactgaaggtatacaaatattttaggtggttccttagtgc

SEQ ID NO: 31520 - DNA, 570 bp, Sorghum bicolor
  Clone ID: 18070073
gttctaaaaaaaagtgtcgttttaaacgtggtataagtttaactcgattcatagataatacgtgcaatatttgtatctttaaataaatttgttaaaaaactagacttaaaaatctttccaatgatactaattatgtactataaatattaatattttttatatatatttagttaaagttatttctcgagaaacacaaataatacttatttttagacggagggagtatgtttcaatggctatatttgtatgttgtagttatagcttccaaatgtttcagctgttttatttagatgttgcacttttttatctagatattgcatatgttgcagtgcctatatacgtatgttgcaaatgtatgttcgaatgtgttaagtgtgtttagctagattttgcatatgttgcaataattatacgcgtatgttgcaggtgtttgttccgaatgtttcacatgttttagatgcatgtttgactatacgcgtatcttataagcgtttgttccaaatatttttacctgttttagacgtatgttataagtgttttatctgaatcagtgactatatgcgtatattt

SEQ ID NO: 31521 - DNA, 438 bp, Sorghum bicolor
  Clone ID: 18070089
agacagtgtcatggagaagctcaggaaattatgatggagaagatgagatttattctatatcggctgcccacatgttgaatgagcagttaaggaaatcaagtttggtttcagtgtgtttccggcttgcaatttgacttggtacataggacagagcaagtgcatctcgccgctgatactagcctcactttttggtgtgactcatgttgtggatacgcggcacttgaagttgtgaaaagaattttgggggtccattctttctttcttatctttggctcgagttggttgatttttttcaccggaacagttctggaactgctggggttgtggttttatcatgtaggcaaagttgcaaaatgtgtacacgtggaaatataggaataatacagtctgtatcatgcgttcatgtccattccagcatgatgtcttcttcgtttgtct

SEQ ID NO: 31522 - DNA, 419 bp, Sorghum bicolor
  Clone ID: 18070114
tcgagtacagggttcatccatttttcacctagcctgtttgagtatctcgagctgaaggatttatgagacaaaacatttctggaacgaactttgcttcctgaggtgttgtatctgtcattggatactttgaaccaagatgatttacattgataggatatggcagcttttccccctgtttgttgtgaacatgagggttcataaaattatactgcaaaagtaggtcttatagcttttggcatatgtttctgagttggtcctcgtgtagtttgtagaagggtgagaaattgagggctctaacttggtctttgtgatttcttttttcctcgggaacatgtagctgaaaaaaagcagaaaaattctgcaagcttattcataccaattaatgtgcgtttaactggattggggtggagattaccctc

SEQ ID NO: 31523 - DNA, 481 bp, Sorghum bicolor
  Clone ID: 18070123
ctgttgcaatgctccacctctccagctgcagagccacctcactttgtggaaaatgaaagaaggatctggaaatacttgatcaataacccggactgggaagaaacattcccaaaacacaggccccgggttttccataggaccagtgacggaagctggtcaaggtactcatagagtcatagtgcaagccaagggtttccattatcattggtgctcccacacatggaaccagaacggaagcctccctctgccttgattagatctccatttccacgtgacactgtgcttgggggtaccccatgagtcattgattgactgattctctcagctccatgtgttaaccttggctggttggtaattgctatggatcatgtcgttgttttgtggactcagtagatatacgtcgacatgttgccgatagcgatcatgtttggtgtatgagataaaactgttggagagagaaaagatatacaaactgtttttt

SEQ ID NO: 31524 - DNA, 422 bp, Sorghum bicolor
  Clone ID: 18070125
caaggcttccagctgcccatcatcaagggattctccgtcatagatgcatatgtcctcacttcttactcaagaatgattgttagctgcaatgttgcgttccctgagccagaggttttgtctcctatccaagaatccaagaccaacgaagatttgtcacatgaagttggtttgctgattggatctgccaaaacttggcagccaccgataactagtgtaaaattcctgtaaacagtaacgctattcgtcgcagtgttttgtttttaaaaatgtgtaaataactgtgcactgtatatatgtatgtatgtatgtatgtatatatgcatattaaatcaacagataggagccattccgtagcctttaagtggaatcgttaggtactacagtttcctttatcccaaaattataagctgttctagtttttt

SEQ ID NO: 31525 - DNA, 523 bp, Sorghum bicolor
  Clone ID: 18070145
ttagagtatcagttgatacttgctaggattaaaataatagttttccaatatgcatatgcaggaagaatcgttatcggtctggtgctggctgcatacacagtgtgctatgtatgaataaatgaagtttcttattcattggtcacaaaaacttttagattattggtttcggaatgtgcctgcaggaaagacttgccatattgttagtagtatgttatacctgttttttagtttttcagcctctccgtacatttggagggattttgtaattaaatttttcgtatagcctgaaacatagtatgtgtatatatttgcttgcagagtatataggtatgtaagtatgctctgtcaaaaatttgtgtcaaaaattagtacagatactttattgtagaaggtatgcaagcatactcttttttttaaataaaaaagaggtttttacgcatacccttgttgaaaattggtatatgcacataccattttttttaaacaatatgtgtatttatcaaagcaataaaatagtatgccc

SEQ ID NO: 31526 - DNA, 664 bp, Sorghum bicolor
  Clone ID: 18070195
agctccagatggcgccgtcgatgatggacgccgccggcatcgacgtcatggactccatcgccgacgtgtatggcgacgccaagcccatgatgtccggcgactccacggggagcaagggcggctttgacgtcaagctcgagaggccgtcaccgcggcggccgcacatgggcggcagcccgtcggtgatcggcggaggccagcagacaaggaacctgtcctacgggtaactagctcactgatgattaaccatccgatgcagtgcttaattaacttgcagtgaaattaaaattaaagcaggcgattactattaaccggtgcaatggataaaaataagtaaaagctagctggagcagatataatggcggagatacatatatagcatatatgtgtcattgatcaggatgatcttactgtggtgcatcacttgttggatgatgctccaagattatctattttgaggagatgtacctatatgttccattgtaattgtgttgttgagatgggtgtaaatgcatgtgtaacttaattggtaattttgcatgctgaggaaacaagctttctttgatctgaggcatgtatatttgtatccagctgagggacatgttaatggaactgtatgataccttgtattgtactgatgattaattctttttggtttatctgt

SEQ ID NO: 31527 - DNA, 587 bp, Sorghum bicolor
  Clone ID: 18070227
cgaacttgagatgctagaggagttggacatcagtagtaaccagatacgagtacttccagactcttttgggcatctctcaaagctacgtgtgtttcatgctgatgaaactccactggaagtaccgcctaaagaagttgtaaaattaggggctcaggagctggttaattatatgaagaatatggttgctgcaagggaagtgagccagaaccaaacaaataagaggagcttctggacctggttcgtctcactgtttggttgttgcaaaaagaatgaaggattgggaccagttcctgtttagctgaaccatttcatctgcttgaattgtcatgaaattcttcaggtttggtccatctctcaagtcagcgatgaaatgaggcatggctattattattattttccattttatgtttgtgtatacaatggatatatgtatcgttttcttgtacataaggttcatttatgtgtaattcatctgtatgaaacactatcatgttagtccatgaaactcgagctgcccaacatttctattaagggggtgttttgttccccataaaatacaaaatacaaaatgccgactacttggaatg

SEQ ID NO: 31528 - DNA, 502 bp, Sorghum bicolor
  Clone ID: 18070251
tcaaagtctatcatcttgctcacatttttagtacaggaagcacctatgttgccactaaatccaccgctttccctttcgccgtcagatcagcaacgcatccataggtacatagctaacttgaagagccatctctgctgtgctcaggttgcagggcaacagcagagatcagtttataactgaacatggttgctcaaggattgaaaagattaatttatctgcatctggtgaggttttcttgtgctctggtgcagcgttagtccagcattttatttttttttgggttctataaggaggtggggtgttcaattctttggtgtcatgaacctttgtaaaattgtagttgccgaacaccatgatccttccccctcttttgtatatagataacacctacaagctctatatggtcgtcccttaccatgcatatgttgcaatgactctgaacttgtatatatttgtgactttgtaagtgccttgtgcaaacctgtaaatagaaacgggttcg

SEQ ID NO: 31529 - DNA, 225 bp, Sorghum bicolor
  Clone ID: 18070271
agccttttgcgggcattttttttatgagttccaggattagtgccacccctttttttttaatgagaaaagagatttccagggatgtttcctatgtaggggaaaaaggtaaattttgtagtccttgtagagagtaaaggtacagtcccttaacacgttttgggaatttatgatttgcttgaattgatagggggggcttgtttagtagagctcccctccctgtttttc

SEQ ID NO: 31530 - DNA, 484 bp, Sorghum bicolor
  Clone ID: 18070280
ctactgctgaatcaacagctgctttcaatgaccaagaaatggcaccaccatccccaaatgtatgcaatgaagaagaattggctgcaccagccccaaatgcactctccagcccgacaaggctcacaagggaacaaattatacaaaacagccccgttagggtgacaagagggcatgcaacatactaattctcattctttttatacttgtacacaagagctacaaatgacatatttcatccttttattgcagccggctccaaaccctgctaggtgaaggtgttgatcccatccttgttgcctcaccaaagaagactgtgcaaaagaggagcccaccgaagaaactgaagccaaggagactgaaaaccaattgatcacaaaacttaaatgctacctatgctattgtgatcgtgaaattgtatctggaccctatgttattatttttgagacaatgtatctggaccctatgttattgtatttggacaacc

SEQ ID NO: 31531 - DNA, 149 bp, Sorghum bicolor
  Clone ID: 18070301
cgttagccagtggtagacaaaaaggatgtaaaaaaaatgctttcatttagggattattagtttttgtagcttgaacagtggcagagatttaggggttattagcgacatgtctatccaattctttttgctctgaaagcagcaagagcaat

SEQ ID NO: 31532 - DNA, 487 bp, Sorghum bicolor
  Clone ID: 18070311
caaaactcaagtgatggtttagcaccttcgccttttagcgcacatggtgccattggttcaggaccaagcaccagcaatcttgaaaattcactgcagaaggcacaggaaaactttataaagagccagatagagatgttacaaatccaacttcaaatgattcggcgcggtgctgctgtgtcggtgactaacagtgggaatgacgagcacaaaaggaatgactgaagctgtaaataggcaggcggaaatgaggacagaattaaacgacaagaattggtaaatacctagggggcaactgttacatgatgcctcgttgcccagattttgtactttcatgtttctgcactcttactgataatgtttcttttctctttgtaataccgctgatagatagaggctgtcgtgttgtaacaatggttagtttcacagtaattatgagattaaacaaaatccatctgccgataaatagaatggagctttttgatccgtg

SEQ ID NO: 31533 - DNA, 645 bp, Sorghum bicolor
  Clone ID: 18070316
aatggatgctagattatcagcactggctggatggtttgatgttcattttcgaggtagtgctcaaaaccctggggtggaggaaattgaattaactacagcgccagatgagcatggtggaactcattggggtcagcaggtattcttgctgactccacctctgagtgtgactaaaggagacaatgttaatgtctccttctcgatggttcgctcaaaggaaaatcatcgacttatggatatggagttcacctatgaattgcatgagttatctggaaggaagcacccagcagtcacaaccaagatgtacttagagtagacaagagttgattaggcctgattcatcatcgttaaatgaaaagacggaaccggcttccatgtgccatcaggcactgttactgaacctttgctcagaagctgagcatatgtaagtgcctcagggcccctgtgtgcttgttatacccatgatgtgtacattgagaccatgaggcatgttgacatgccaaagattctgttgtattggtaatatcttattgtttgattgctcaagtaacgggaggagcaattgcttcacaacattttaatgtggtagcagatattgaccgacgttacagttactacaaacattcagtgcagaattttgttgaattc

SEQ ID NO: 31534 - DNA, 496 bp, Sorghum bicolor
  Clone ID: 18070361
cggtcaagcaggtggccatgtacaagatcgtttgcaaaccctgaaattttttcccgcgacaagaacagcaatgagaagggaaattctccatcttcagcagcagattcctctgccaagaacaactctccacccttggctggtgaagcctcaccaaaaaataatgctagtgcttcggtcacagaaaacaatctaacacctggaaagagacagcaatccaagaagaattgacctgatggattaatgtaggataatcaggttatgttctgttcctctgtagcctgaggctagcaacctgaagtatacgcctagcaggaaagacaaattgacgccaaaagtgcttgtaacctggtatttaaattcagtttgttgtacctgttctagaaagcatctgtagcgaggaatactgttttttacttggtatttaaattgatgtattatagactatccctattgagccattgattggttgctcaaatctgaataccaaattttcttc

SEQ ID NO: 31535 - DNA, 624 bp, Sorghum bicolor
  Clone ID: 18070418
actataagactactaataaaataggaaaaaaattcgaacgattaaattacttctcccgaatatccaactgactgattaatttcttataacgtactctatttttctttgccaaataagccagcaaacgttgacgttttcccaaaagtcttcgtagacctctttccgatgaaaaatcttttttgtgtaattctaaatgtgaagcaagtctccgtatcttattggtgaaactgaatacttgaaattcaacagaacccctgttttcttgtttttcttctttaaccataaatcaacaaatttttctacctcctttctttttcatgtatttttctgatcaggaaaaataaaaaattatgtcagttatttttaagttattctaatctcgtacacacaaaaatttgcaattattcatctactgctggaatctggaatttggatttattttatcgatgcaaattggatttggatagaagggtacattcttttattttagatagaagaaacatttcttctatctaaaataaaagaattttgctgatttatttattgctatatccaatttatagaattgatataccatttaattgatatcatttagcaaaatgaaacacagcatatgcatccatc

SEQ ID NO: 31536 - DNA, 595 bp, Sorghum bicolor
  Clone ID: 18070437
tggtaggaccgcatcgtgtccatacaccaactgataaggtgaaactttaatcgatccattacatgccatctgatatgaccataaagcgtctcccaacaatgtatgccacctcctaggattttcctcaatctttcgtgtgaagagtttaataattcccttgttagacgcctcggcctgcccattggcttgagcataatatggggaaaaattcaacactttaatccccataccgattgcaaattcatcaaactcccctgatgtaaacatggtaccctgatcggtagtaattgtttgaggaataccaaattcgtaaataatatgctctttcacaaattcaatcatattggccgatgttactttcttcaagggagtagcttcaacccacttagtgaaataatcagtggcaactaagatgaacttatgccctttgcttgatggtgggtaaatctggccgattagatcaatagcccactctcggaacgaccaaggcataataatgggattcatagccgatgcgggtgccctttgaatattgcaaacttctgacatccttgacaccctttgaaatattaaagcaatcctcgagggggggccc

SEQ ID NO: 31537 - DNA, 242 bp, Sorghum bicolor
  Clone ID: 18070456
ttcggaggtggtaaatgccccaattcctgtgctggtgacgacttgttttaatgagaatatctgaatatgcccggcgccaagggaacagagagctaggcaaaggattcttgaatcttggcttgcccccccagcgccaagaagagaagtactagcaaccagtcaattaagtttgcggagtccaattttccccggggatcgtcgtttgcgatttttcctcggtcctgagcgctcgctgtttccct

SEQ ID NO: 31538 - DNA, 240 bp, Sorghum bicolor
  Clone ID: 18070458
cattacagttgctgtgaatttttgttctgtgttgtgatcttactcccagccctggggttgtgtccagcatcagctgttgttcccctgtctatggatcaaaccttgtggtctgatataggtaatgtaattttatttgttcggacccaaatgcagcatccgagggtggctatagtcgcattacataatctcaattgatctttatactgttaaaaaaaaaaaaaaaaactcgagggggggccc

SEQ ID NO: 31539 - DNA, 319 bp, Sorghum bicolor
  Clone ID: 18070462
ggacttgcattggcataatcatcctcgggataatcatcctgatcgtcatcctctccttgaaaccttggtcgtggggcaaataagcagcaaccaagaagcatcgttcccatgttgattttgtttggtgatattacctttagtattcttgttatagctctgtgcatatgtcagaaggtgcgagatggtcctgtacatggtattggaaacttggtttccttttctttttttccccttgggaagagaaactttgggtgtgaactttcagagtttgcttgattcaaattcgatatattgggtgtgcaactaaaggcctatacct

SEQ ID NO: 31540 - DNA, 519 bp, Sorghum bicolor
  Clone ID: 18070466
atacaccatttgcagccccccagttaatccagcataacagtcctgtgggttcaccaagcaatgggcagactgcaaatcaagcacaactgagtgtgaatcatcaacaaccaaaagattcttcggcagcatctaccagaccatactacatacctgataatctattcagcgatttgatcgatgtgaaaagttttggtggtggaaataagatgggcggacccactacaatgggtagctcaaatggtggtcagcctatgattggtggaaagaaatagggttattggtctatatatatatatatatatatatatatatatagctgatggtgatcgctagatgccttgttatttattattacttggtccggtgtacatttactgtatatcaccattccctcttttgacagatttggctgcattggttgattcgtgggtgctactgttaaattttaacagagatgtggacaattgctcatgtacataaatgattaatagcattgctccactgaggtggatggttgtg

SEQ ID NO: 31541 - DNA, 530 bp, Sorghum bicolor
  Clone ID: 18070496
tcattgggctatgtttttccgtgatgaactgttatcttggtcgtggagacggcctctaggcattccatcagtccctgtcgctgctggaatgatcaacccatcggatttccaacagaaggtggtaaacaatgtggatcatgtcgtcaatcgtatcaagtcaatatcaccacattatctggctgaggaggaggagaatgcaaccgagccaccgcagtcggtacaaagaggcgtcaccgagctggtggagtcggcattgtcgtcgaggaacctgtgcatgatggatccgacatggcacccatggttctgaaggcatccagcacctttctgatgattgtagcctgaccaaacagccggcgtgtgcctagtcgtagtatctggtagtcttctcgtagatactgtacatatttccttgtccgacaacgctggttgagactagaaactccttgtgttatttatgtagataaagacagggtgccatcctgccctgtattggcgcagcttagcttaatctaatctaaggttaattaaag

SEQ ID NO: 31542 - DNA, 632 bp, Sorghum bicolor
  Clone ID: 18070498
taacaaggaagaaaccagtttttattgacgacgccggtatgaaacaaagcttggctcattacttcatcgaaggacttcaagaaggagcccttatggaaataatagatcaacagattttggaagaggctgaccaaggagaaatcgatgatatcgccttactcgcacaagcatgcttgaggacgaaaggagtagagaggccaactatgaaagaagtagagatgaaattgcagctcctaaggacagggaggctaaaaaaaaagataccattcactggtaaataatggtgagcctgagcatttgctgtgcccatcacatgctagaaactcccatgcacggctcgatcttgccaatgctactcgtttgccttatgaagagacctctcgcggctacagcctagagaaagagtttgcatcctcaatcagtttgccacgctagctatgagatacatgtatatatatatgtatggtcaaaacaatagaatccaaacaagtacttgctatgcacccgagctgtttcacattttcagtctgctcccattagataagatcgagtatgcagtataccatctggttgtaatatagtgtacttttggcccaagtttagaattggtgatgaatatatttgcatggcag

SEQ ID NO: 31543 - DNA, 569 bp, Sorghum bicolor
  Clone ID: 18070518
gaggtgcttccagagctagaaaatatcctaagcagggttactgtttctctcaaactcgaaaatatccttgcaccaagccacttcttctgtccgatactgcaggagataatggaagatccttacgttgctgctgatgggcacacctatgagcacagggcaatcaaagcttggctcgaaaaatacaagatatccccagtgacaaatcagaggcttccacatttatccataattcccaaccattccttgcatgcggcaatacaacaatggaagttacgggcatcttaacaaaggcatgaggtgactgttttgtttgttgtatatatatagtttgattcatcactgtccttttgagttaagatgtaaataaagagcaatagttctgtagtgaaagaagatagtattgtaggaataagttgtgttactagtctagatttgttagagctggtttaggctaaatggcctatatcttgtactcagataattgaagtcacaactgaattcagttctgggatgctgtatgtttttgtagctatagcctaccaatacattttcttggagggtcggattcc

SEQ ID NO: 31544 - DNA, 366 bp, Sorghum bicolor
  Clone ID: 18070521
ctcggcctcgtggacaacaagaccatagtgaagtccctggctaattgcgaacgttttgcagtgcactatcccggctggctgccgactgaggaggacggcaaagcaacgcaagagtagcttccgcttcctgtagaagaagaggatcccaagagatgcaagatggcaaccgatcctgcctttccaatgtttcttttttcatgtgaggtagctcatatttgttggaaccctttactttcatggcttctatgaacacatcttgtagcgttagaaagatccggtttgcacggtgtggcgagaactccatgaacgactgcaaaatagttgaacaacaagtttgagtgaatgagaaattttatggaccaattg

SEQ ID NO: 31545 - DNA, 607 bp, Sorghum bicolor
  Clone ID: 18070523
accaggcaattcatggatatgaacatttttgggatggaaattgtgtgctgtttgaacatcacaatcaagtgggaagaagatatggactgtttgaggaattggatgacgatgaaggttctgatgatgaagatctagaggagccagagccagagccagagcctgaaatggtatggggtcatccatgtccaatgtgtggccggcggaatgaaaagtttggcacaaacaatcatatattgtgcatgggttgccgaggccactattgcgcgttatgccggaagagggttacaaaaagctcggaacactatggaccaagaggttgccaacaacacacggatccctagtgataccaaaagtgattccaaatcttgttgtacagtacagaatctgctttatacataacattttgccacttccagagttggcatcgacttgttgagttgtttcccaaaatgagaggcttctcgtggtagggtcaatgtgaatttgcaattggaagggtccattgcatttagctaggatcgttgacgtcaagaacagatggctcgccatgtaatgaacagggcattttattgaaaatgactctgcagattgaggattcagttcactt

SEQ ID NO: 31546 - DNA, 609 bp, Sorghum bicolor
  unsure (1)..(609): unsure at all n locations
  Clone ID: 18070524
ttcatgaccagttccacgtagtacatatagctnatatgtatatataaatctgttctgtactatgcataaggagttgtttcagctcccacggttgtattttgcaggcctttctaggtctactgcaccctaatctagatttggttcctcgcttgaaaatcgccatcttagagcaagtattatagcaagctgtaagctagctaaatgctaaggtggagaagaaagagtaaaagcgggttgtaagcttagagcaagtattatggtgggctgtaagctggctaaatgctgaggtggaggagagaagtgatgagagagtgtagaaggactgtaaacttcttacagtcagcttaggcacaagaaccaagaaactttgtgagagagataagtgggccatgtattaatagtgaagagctaattattgtatggtgggctgggagaaagctgaagtgggctatattattaaacttgctcttatagccggtttagacacaaaaatcaagaaagtctgtgagacagatatatgagtcatgtattaatagtgatgagttaaccattatatgagtgggctgtaaaaagactataaagaaatcttactctgtattataatacttt

SEQ ID NO: 31547 - DNA, 589 bp, Sorghum bicolor
  Clone ID: 18070535
cggggacgatactgacaccatcaatagctggagctctaatgggttttagttccgtcggtgtgatggccaactcgctgcttttgagggtgaggctgagttcaaggcaaaagcaagcgagccaggctgacaccaggcgagggccacataaagccatcttttgatggtccatcagaaactactgatgaggttgagaaaaattactcatcgaaatggaggagtacctgagtagttcgaatcttagaccatgttcgttcattcattcatgatgatttggacacgatttggtaacatgggccactgaaaagaccacctctgggtgccaatgccacggtccacggattcctcgaaagtgtatgcatggttcgatactgtgtgatctagcttcactagctgtctagttcccttggccatagctggtagtcgtcagttcagttgaacaaaacaaaacattggctgtaggataggatagatgtgatcagcatctgtagtttctggtttgatacgtcttcgtggtgatcctctctctccttgtttgttactggccccactgtacaaccttttatatgtaacggttctgcctagctctttg

SEQ ID NO: 31548 - DNA, 250 bp, Sorghum bicolor
  unsure (1)..(250): unsure at all n locations
  Clone ID: 18070543
tcccatgcgatatgtatttttgtgttgtcttgcctggtggtagctcatcaatcaatgctgtaaggcaagtttaagttctaatcctagaccacaaaccctaatcttaacgttgtctactccacccttgttttgtgtgcacccagcacccctgttcaggtaaaacagggtttggctactccaaattcttcagaangacaacatgttcacatttcnagattcccctacaatattctctattcaagtgtgatga

SEQ ID NO: 31549 - DNA, 569 bp, Sorghum bicolor
  Clone ID: 18070563
gaagttggtgtcaatgcaaagggatcaagagtcactgttctgacggccaataatatgatgcatgaaaattccttcagcaacccaaataatgttgtgttgactaccgatgggcaacaagccatgatgctaaaatttagtttgttcaactttttgtaaagaagccaaccttttgctagctgttgttgagacttataggtacttcacaatttcttctgtggtcattgtgcttcttgtagagtagtagcagcacctcttctggcaggagcagtggtattggcttgtagagtagttacaggacgagggtattgtggcatcgacatatggtggcagagctatgcatagatatgaggaccaatggatatgtgtgcatcatcgacctgctcaaactctccatatctttgcaaatcgcaatcccacgatgtggacgagatcttggaggtattagcaatactgcttcatgattttattctatattgatgaactattgtcgaacttattaggctctcagtgctacatgcttttccaatctattggataacaagtagaggtttaaaatataaaatttattt

SEQ ID NO: 31550 - DNA, 600 bp, Sorghum bicolor
  Clone ID: 18070583
cttctgtgcaggagatgaaggataggttcgtcgctgttgggctgggtcctcgccagcttgctgttatgtcagcattccttggacctgaccaggctgctaccgaggaacgactgatagctgatccagattgccgtccatgggtggagaagtaccagcggagccgcgagactgtctcccggactgactacgaagttgacctgattaccacactcacaaagctgagctccttcggccagaacataaactatgaagcctacacataccctaagcaaaagattgacctgggcaaattgaaactgtaaagatatttgccaggcacctgcatcggccatacccaggattcaggagctcataatatggtaggctctggctgctaaagagtgatttgattcggcactgacgttcatgtattggctactcatcagctgtcagacattcttccccggcaattaggatggtccctgtacatggtgaatttggttctccgattttgttttgtgtgagccaaacgcttgtgagaaatgtggtgttgtgtaaattcctttacgtacgtgagactattgaagaattaatagaaacaaagtgcaagttatatgactg

SEQ ID NO: 31551 - DNA, 121 bp, Sorghum bicolor
  Clone ID: 18070591
cctttttccccttgggccatggcagaacgtttttttggtatacgtaatgccacctgaaaggaaagaggtaggcggcccaacattttttgggtttagtgtaggatggacaggtggattcttt

SEQ ID NO: 31552 - DNA, 602 bp, Sorghum bicolor
  Clone ID: 18070627
aaataaacctcgtcgatactcggagatgaactttggccaatgaacatagtgatgatagtaatcagtgaggacccattggagctttggatccaagtaagacctgtgcaagagacccaggccttaccaagtctttgcaacatttcactgtctgatgtctagcactttgggctatctcgtaacccaaaaaatgccaggtttgacagttgaaggtgttcaaaccatcactatggtcgtttgctgtgattattctgctgggctggtggtgttacattattaggtgagatttacatggtactctacgtcaccacaatatcagtcgcaacaatatcagacgtcgtcgcagcatattgcataccagtccataagtgtgaaggtcttggtggaaatcgtgagaggtctccgtactgtaaagctcgtgttccattgtgtacatcagtctgtgtacttgggtgtgcgcttgcttctgtgcctctgcctttagctctttggtactcggctgacttgcatccgttatatttatgatgaagatcctgtaaacttgttatctgatccactgtgttgaagatataattgcccaggacaatggtacggtcttggcagtt

SEQ ID NO: 31553 - DNA, 596 bp, Sorghum bicolor
  Clone ID: 18070670
aatataccattattggcaagatttgaatgaggatcgtaagctgtggaagctgggtacattgcctccaggtttaattactttctacaacctgacatacccgttgaatcgtacttggcatgtcttgggcctgggctatgatccagctgttgacattgctgagatcgataatgctgcagtagttcattacaatgggaattataagccctggcttgaccttgccatttccaagtacaagacatactggtccaagtatgtagatgttgacaactcgcatgttcagcattgctacgagggcaaacaatgacatgtaaatcttcatcaacttttttttttcatttcagagcataagttattccctagaagggtgttaggcaaagtagtggcgtgcttagcatagttaagtcttcataatctagtcattatgccttgtagttatctagctattcttatatgaactggtgcataaggtgatttataccacacagcaaagtagatattcttttgtttactttagaatttgctgtaccttgaatgaattggcaaaaagatgaaaaagttcaactgcttatgtcctgcagtatgaacactgtccagtt

SEQ ID NO: 31554 - DNA, 571 bp, Sorghum bicolor
  Clone ID: 18070691
cgcctagtaagacagtacacggaggcagatctatacaggcaactgtcatacttttgctatgtacttgatgcaacccggtgtcttgaaaagctggaccagaaggcaaggctccccttcgagagagagtttgtagcagtaggccaaacaattaacttggcactgcaagagatccagaaaatccgagatagatgtgcatttggatgggttcagctaaaggaccttgccgtgtcaatatgatgcttttttggggggaaagagctcatttagatgaatctgattctagccgcacaagaaattcatcgctgtctgtaggtcgtgttgattctagatcgcgtcctgtaaatggaacaggacacgctaaatggtgagttgaaacaccagcgtcctggtagtatttccttgcctgtagagttccatttggatacacctcatagcagaccttgtctcatgtgttttagtgagtggctgtgttgtactaaacttgtaaatatgttgtgtccgtctccttaggcgtcggtgcctgcgcccaatgtacactagtatcatatatagtcatctgacagttgtttct

SEQ ID NO: 31555 - DNA, 507 bp, Sorghum bicolor
  Clone ID: 18070695
ggggccgtgtgacaattgcctcggtgaagaacttccagctgattgccgcgacaaccccgccacctgcaggtgctccaaccccctcccagcctgctccatcagatccagacaaggtgattctgcagtttggaaaagtggcaagggatatgttcacaatggactatcgctaccctctctcggctttccaggcatttgccatttgtctgagcagcttcgatacaaaactggcctgtgaataaatggagagcaaaggtaaaagacaacaggttgccggcattaggcctttagtgtacctctttccatttgactctcgtgttatcttggttgtaattgtgcttgctgtagccatgaagtggtcatatatggtggacgcatgtgttgttggcccctctcgtaaagtgattacaagttgcatttggaccacatgttaccagatctgtaatatacttgcagtggcattgccgcgtgaaagaaagctcccattcgtgattgggcttgtatgatttc

SEQ ID NO: 31556 - DNA, 499 bp, Sorghum bicolor
  Clone ID: 18070701
ccccagattaagattgcgtttgatgataagagggcctcccagtttgctgatcgcgcggcacgtctcaacgaagccttcctggtagcgagacgtgtacctatgctaagaacatcatctggtgctacgcttccatggtcaatggttcaggacagatgagtgaagctgctcaaagttccctaggaaggttcctacaagcaaccattctggatgatgaacatcagtacgagcatcaggattggccttgcctaccttttgttttagatgacgcatcaaggaggatgccaatgttgatgtccgttgtctctctttctcttcttttttcttccttcaatttttgtttcttttttgaggaaccgcttggttttcattttttttagcctttactctgtttagtccatggtcagtggtggtgtcctaaaatttaccattcctacaacgttttttttttcttgttaatttggatgctagtgtgctcagttttcatgtgctcccttttgcc

SEQ ID NO: 31557 - DNA, 321 bp, Sorghum bicolor
  Clone ID: 18070702
tagcgagaatggaagtgggcgagcactagattttcttctcccttatggaggttatcacaatgatgatgacgaggaagatcacgccattagataggacagttgagcttttgctcaggattagtgtgaagaggtggaagggaagataaaagttggcgggaatgagacagttgtgtaaatttagtaaaaaaaaagggagtaaaactagagctgctcttcttgggctatcccgattggctgattccctcactcactcacctgtatcaagaatagtgtcaactgaaatacaagtgcacagaggtctgtcttcttgctgttatagca

SEQ ID NO: 31558 - DNA, 425 bp, Sorghum bicolor
  Clone ID: 18070741
gaagagtttgcaatggccatcaacatctgttgtttgtctctggttgatgcaatggggaatagtggaaggcatggtgttggagctcttggaactagcataccgctaaagcttggctcaaaaatcagccccacactatgagccgggacagatggggtgatctgtgagtgcatccaagtgatgttgctccccttcaaatttggttcatcatgagagactggaggcgccaagcttagccaggatgcagcatctttaagctcctttcctttcaggtttttcctggaaacagtgaaacgtcagttttcttctcatgtactctgatatgctagcgttcagaatgccatgctcgttctactaaatgtcaggccggagcatatggaaattgattatttgggagtaataagtatagctaccagaattctgttgtc

SEQ ID NO: 31559 - DNA, 463 bp, Sorghum bicolor
  Clone ID: 18070766
cttgtggacagttaataggcttggcacatcagataatatccctaacataaggtttgaaaatttgagaaggctagaacttgtaaacttaccatggttgaaaaagtgggttgtacatgctccctgtcagttgtttcgattcttggaagtacttatcatcagtggttgctctcaactagaggagttgtcctttcaacatttggcttgttgtcaacaaaggaaagagccaaatgtaaattcatttcctaggctcatgaagctcaagatcaaggaatgtccacagctactatcatttcctcccattccttggaataaggctctatgccccatcaatatagaaggaatcggaagttcatgtcttgataaatttgtttgtgaaaaaagatttttcagtcctgaatatgatttgacaatagagggaaaggatacaatttttgtttatgaaagaaagaaggatacaattcat

SEQ ID NO: 31560 - DNA, 239 bp, Sorghum bicolor
  Clone ID: 18070777
ttccttcttttttttcccccttccctttataatggatagatcattcaggagtcgtctgtagggtgttaatcttagtcatgggtggatttggtatgtggggtgttgtacatgataaattggcactggactcgggactgacgcatttgacattcctttagcaggacatttctagttgtgtttagaatgactggggacagcaataatatatttctgggagcttgtttcaatgtttttgtttc

SEQ ID NO: 31561 - DNA, 449 bp, Sorghum bicolor
  Clone ID: 18070787
attttcgtcgtccgtcagtggaaacactccagcaggccactcatcggctagtgatgggacggcggactcgtcggtgaagagtgacacccaagggagacgctcttttgtcacttccaacacgaggaatacagcaagagacagtgtacgagaatccacctcgtcatcacccagtcgtgtctcggaccggtccagcactcgttcaagcggtggacgtactctcggacaggactgaggaatttcgtaccacactctattcttcgtagcttgtatgattttgaataggcctatatattgcccgtcgtctatcatgtgccttgtctttgtgcttgcagctagccatcaattcgggtattcgtctatatatgatataattgagattaagttttttcgtttgaacagaccactacataactcaatatggtatcatagctatgaactatatttttttc

SEQ ID NO: 31562 - DNA, 498 bp, Sorghum bicolor
  Clone ID: 18070823
ctgcagtccctgtgcatggccgtgacgtagacaagctacagcaccaggggtacggaactctattaatggaagaagcagaaaggattgctcaaaaggagcaccgttcaaagaaattggctgtcatttcgggggttggtactcgccactactaccgcaagttgggttatgaactagaagggccttatatggtcaaaactttggcataataccgtttcatttttttcgtgcacaatcatgtagagcagactagtgtttgtaatgtagcatgagtagttttttcaaaaaatgttcgttatatcctccgttttaatattgagtagtccagatgaatatggagacaactctgtatgtatactaaatggtagcagaattcccatcctagcccctaaaaacttcatgtgccatgcaacaagggtgctagtcgagtcaggatttacactttggtgttcacaacgttttatccataaatgaaggaaataatctatcaccgattgtgtt

SEQ ID NO: 31563 - DNA, 114 bp, Sorghum bicolor
  Clone ID: 18070844
actatgtaaacattaatttttagatttctagatttgccacagatatctagaagttcatgtgcacccatgctcgttgattcttgaagttatgctaagaatctatgtttcttttcc

SEQ ID NO: 31564 - DNA, 182 bp, Sorghum bicolor
  Clone ID: 18070845
atattgccattgcaaaggtcgtcaggacattgtaagaattaagttggatgtatttcctgtggtggcctctgcaaagatcatcacaccgtcttaagagcccagatggcggtgtaaataatattagtttctcagaacaaagtttgtctgcgtgtacagtacttttgaagatggataaatatgag

SEQ ID NO: 31565 - protein, 311 aa, Sorghum bicolor
  Clone ID: SORBI-28MAY03-C20_1.pep
CVPAGVAKFDPATGKQFKSPAKTLSYTNYFAESLIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGIGVPLPPNYKGTPLEVGKGRILMEGDRVALLGYGSAVQYCLAAASLVERHGLRVTVADARFCKPLDHALIRSLARSHEVIITVEEGSIGGFGSHVAQFMALDGLLDGKLKASYDDDTCSLSPSSP

SEQ ID NO: 31566 - protein, 165 aa, Sorghum bicolor
  Clone ID: SORBI-28MAY03-C17422_1.pep
MAAEKRTIGMGMDYSPSSKAAARWAVDDLLKAGDRIILVHVLPKGADASHKELWKSTGSPLIPLPEFMEMNVQARYGLNPDKEILEILQAASKSKQVEVLAKIYWGDAREKLCEAVDDLKVNSFVLGCRGLGPLKRALLGSVSNYVVNNATCPVTVVRGPTGSSA

SEQ ID NO: 31567 - protein, 255 aa, Sorghum bicolor
  Clone ID: SORBI-28MAY03-C10080_1.pep
MKILVAVKRVVDYAVKVRVRPDRTGVETANVKMSMNPFCEIAVEEALRLREAGAAAEVVAATVGPAQSADTLRTALAAGRDRENGARERGRERERPRAVAVAKILRAVALQEKPGLVILGKQAIDDDCNQTGQMLAGLLQWPQGTFASKVILDTEKQKATVEREVDGGIETICLDLPAVITTDLRLNQPRYATLPNIMKAKSKVIKKVATRPLGVDIRSDMEVIEVNEPPKRKAGVILSSVDELLDKLKNEAGVL

SEQ ID NO: 31568 - protein, 193 aa, Sorghum bicolor
  Clone ID: SORBI-28MAY03-C10107_1.pep
MITGALQVAAGGQPLLLTRRGQQRRRVFRPPQAVASDAAAAATANEEGGKVALGGSGVAVTKLGVGAWSWGDTTYWNEFQWDDRKLKAAKGAFDASIDCGITFFDTAEVYGAGISGAINSESLLGRFIKERQQKEQVDVAIATKFAALPWRFGRGSVICALKASLDRLGVSSVELYQLHWPGIWGNEDYLDGL

SEQ ID NO: 31569 - protein, 57 aa, Sorghum bicolor
  Clone ID: SORBI-28MAY03-C10089_1.pep
CQQNLCMKTYLQYLKLNLENYRKKGTIAASALHHKLPQAQPIKFSYTIISLDISFFS

SEQ ID NO: 31570 - protein, 59 aa, Sorghum bicolor
  Clone ID: LIB3478-010-P1-K1-B4.pep
MQLMTILFSREIARQDQRDREKKFQFSARNKRLSSSANLGYAGADMLVKNIIIVTKANI

SEQ ID NO: 31571 - protein, 115 aa, Sorghum bicolor
  Clone ID: SORBI-28MAY03-C10095_1.pep
NIFVVKDNVISTPAIKGTILPGITRKSIIEVAQSKGFKVEERLVSVDELLNADEVFCTGTAVVVSPVGSVTYMGKRAEYGNQGVGVVSQQLYKSLTSLQMGNVEDWMGWTVQLNQ

SEQ ID NO: 31572 - protein, 90 aa, Sorghum bicolor
  Clone ID: SORBI-28MAY03-C10066_1.pep
RPGRDLRPPSLPPLHASNSRRLCRPQINHRRCACLTRCKLANPTVALYLPITQGQIEPGCCDSHQQVQRFRQQSFYSDRIWQQRDPVPFL

SEQ ID NO: 31573 - protein, 74 aa, Sorghum bicolor
  Clone ID: LIB3478-009-P1-K1-G8.pep
ALLPDPIGIEALLLKSLHLPVRIATPWLNLSLGDGKIEGRRWDGQALACGRVLPFASVHHTLVEWNALAGGGGG

SEQ ID NO: 31574 - protein, 134 aa, Sorghum bicolor
  Clone ID: SORBI-28MAY03-C101550_1.pep
SINLFIVPHKHVSYSIHTHPLVPTLYHYFNFSLSSPNTKTTLSLPLSSHPFSTSSNRYFFKPSLPTPTSTLNIPTVSAPSFLGSHDPGPEPRTVTSLRRSPIAEISPPSPAMLPMLIQVIAFFAAAGLGLNRKA

SEQ ID NO: 31575 - protein, 172 aa, Sorghum bicolor
  Clone ID: SORBI-28MAY03-C90266_1.pep
MAAASHLLSFFLLLLLPASNAIYCDEDDCYDLLGLKQDANASDIKKAYYKLSLKYHPDKNPDPESRKLFVKIANAYEILKDESTREQYDYAIEHPEEVFYNTAQYYRAYYGHKTDPRAVLIGLLLIVSAFQYINQLTRYNQAMESVKQTPAYKNRLKALEFERTGGIASTKK

SEQ ID NO: 31576 - protein, 178 aa, Sorghum bicolor
  unsure (1)..(178): unsure at all Xaa locations
  Clone ID: SORBI-28MAY03-C90302_1.pep
ARGCRWDYVQDGNSTYRDMDRLTAFSRXLSTWARWVDADVDASKTRVFYQGISPSHYDMSKQQQESQAAGMAPGLVGGGGSCLKQTRPLQEATDAAGGGGTTTSLLAPVQAVVRGVIDAMTAPVSLLDITAMSQLRIDAHPSVYGGPGRDGMDCTHWCIAGLPDAWNHIMYAMLLQQT

SEQ ID NO: 31577 - protein, 203 aa, Sorghum bicolor
  Clone ID: SORBI-28MAY03-C71066_1.pep
SALDARKNLQSDSHHGAVNDLEQGAAETVRRAAAAQHQGPRGAWAQGRWRPAGGSAAGPDGRPAAPPASSNRAASEHRTPARQCTLAASTSQRKAYTKRLSRGIATQLPASPSGTEAPRGMGGRGPPESAAPAKARSPHGAEAPAAEARRPSGPERARAPMEEKRRTGGSAPTGSEGAEKRPSITSAEMRTTEAGPRHGSSAT

SEQ ID NO: 31578 - protein, 129 aa, Sorghum bicolor
  Clone ID: SORBI-28MAY03-C46306_1.pep
MDINVEVKVGVNGEVKDTDKDSCIDLDDLFRSPDAAFGGFSVLHDPSTFEPDSVSLLRVGIGARKLGSGSLFLYGLIMRKHVVVLAAIEGDEQRLSTMYRDFGSNLVGLDSLGHAGESLISRIKAAARK

SEQ ID NO: 31579 - protein, 64 aa, Sorghum bicolor
  Clone ID: SORBI-28MAY03-C30785_1.pep
MSTVNVMLSSSTVTLQAPSRPAFCIPKSGFSEMNSEGYPPGASQSASRSPMSLNDVSITELEPR

SEQ ID NO: 31580 - protein, 177 aa, Sorghum bicolor
  unsure (1)..(177): unsure at all Xaa locations
  Clone ID: SORBI-28MAY03-C10012_1.pep
PVVDGSATFNRAIVNSPFLRTPLTNFAGTIQVISNRLCISSMESRVGRKGRLSMKGTLPLKNSEPSANDKIDLKCEVLDIRAKNILSGQVDSQLQVTGSILRPDLSGMIRLSHGEAYLPHDKGNGAAVTRLTSNKSGYLLSGFDQSTTSQDVSRILGXLSTSADSMYSVKFELHSYI

SEQ ID NO: 31581 - protein, 196 aa, Sorghum bicolor
  Clone ID: SORBI-28MAY03-C100245_1.pep
ESLSGKESNEKVTHSGNVLTQIELVSVATSHKNCNLGEGQEKFKDSIASDTVLNSAKEVPALFHSTGISRTEPSADTPLEYSPLKPVCDIMDPSLKCQSIPTSNSENRGLVEKSEHCPDDYNLETKRKRNDGIKGSGSKVPSYIEGLLCLLEQAIDSGRALVLSEDELVDSDLVYEKSVAFTKSIPRRLIFEHTQR

SEQ ID NO: 31582 - protein, 288 aa, Sorghum bicolor
  unsure (1)..(288): unsure at all Xaa locations
  Clone ID: SORBI-28MAY03-C100159_1.pep
LLDQGAEVNAQGGVYSNALQAASLRGYEQVVKTLLDNGAEVNAQGGRHGNALQAASYRGHEQVVKMLLEQGAEVNAQGGEYINALQAALYRGHKQVVKTLLNKGAEVNAQGGFYGNALQAASARGYEQVVKTLLDKGAEVNAQGGHYSNALQAASAGGYEQLVKTLLDEGAEVNAQGGYYSNALQAASAGGYEQVIKTLLKQGAEVNAQGGRYGNALQAASLMGHKXVVKMLLNQGAKVNAQGGYYGNALQAASLMGHKQVVKILLDAGAHQPKGDEIVEDLKSPALS

SEQ ID NO: 31583 - protein, 85 aa, Sorghum bicolor
  Clone ID: SORBI-28MAY03-C100177_1.pep
TKVLNKGDVFVFPQGLIHFQFNPVHDKPAVAIAALSSQNPGAITIANAVFGSKPPISDDVLAKAFQVQKGTIDWLQAQFWENNHN

SEQ ID NO: 31584 - protein, 219 aa, Sorghum bicolor
  Clone ID: SORBI-28MAY03-C100009_1.pep
MNLDEEIESIIYIGREVMVYKIPPLKANEGHRAGDWGDLAQPLWKGRLRIVEKGKEVALLFEDPNTGDLFARAPYDPAKPSVEAVLDSSRYFVIRVEDGGRKAYIGMGYAERADSFDFNVALQDYTKRWRAAQNPPSPTSEDGPSPHVPVGPKKDYSLKEGQTFSISIPGRAAKNSSTTTGSGTDLLGGASTTATSTGSGGSSGFMPLLPPPPSAPKRR

SEQ ID NO: 31585 - protein, 69 aa, Sorghum bicolor
  Clone ID: SORBI-28MAY03-C100294_1.pep
VIFNTLCQGPMFSCSLRLPKFGHTACNKICMWVGRFSINPQRYYSFRYSTFDAAYRIMHAADRLKKYKQ

SEQ ID NO: 31586 - protein, 146 aa, Sorghum bicolor
  Clone ID: SORBI-28MAY03-C100302_1.pep
YDYNIVELASPVTAYAPVKLLTADPLTYAGSTATVMGWGTTSSGGSQSSVLLRVNVPILTDAVCKASGLSGTISSTMFCAGGATNKDSCQGDSGGPIILEQSGGDVLIGAVSWGDGCGVAGKPGVYAKVSSVKSWILSLAPNATFV

SEQ ID NO: 31587 - protein, 247 aa, Sorghum bicolor
  Clone ID: SORBI-28MAY03-C100312_1.pep
ARGLSIVCTGHSLGASLATLCAFDIAVNGVSRVGGADIPVTAIVFGSPQIGNPEFKKRFEELPNLRALHVRNTPDLIPLYPSGLLGYANAGDVLAVDSKKSPYVKDDSTNLGDYHNLQGILHTVAGWNGKDGEFKLQVQRSVALVNKSSAFLKDDNLVPESWWVERNKGMVIGETGLWELEPPAEENLPVPPVVTGNGKVIGDDDAAATTTTTTATAASMETKTPAKDKKGPGTKLFSACFRVRGVN

SEQ ID NO: 31588 - protein, 154 aa, Sorghum bicolor
  Clone ID: SORBI-28MAY03-C100328_1.pep
MRFTYIATALFAAGAANAQVDSILSQITSAVGSLPSGAASAAESLASDLTSAVGGVPSNAASVASSIRSEITSGAGALPSDVNSRLSSIASSVASAGSSIRSEAESAARSATSSAGSAASSAASSAGAGATAQPNVLPAMGAVAGGIFALAGLL

SEQ ID NO: 31589 - protein, 265 aa, Sorghum bicolor
  unsure (1)..(265): unsure at all Xaa locations
  Clone ID: SORBI-28MAY03-C100353_1.pep
HAVLDRLNTKMVQDAYELQARKDSPFNYNKGNIQQDPPMTEEWFSNEIFIHPIVTQVTSTKLGPKPSLRFMSGNTALPPTETSPPMSQPTHTDADFDHLSIPFALVVNVPLVTMTPENGSTEVWLGTHNDTTIADQEGEHGDRASGRIKKHLLDARREIRPPSQPVVKKGSIIIRDLRLWHGGKPNLSTEPRVMXFTVHFAPWYRNSMVVEFAQELTERLSPESCGLDVAAQFISSEQLLKNYLNRAYGNAYDFDQSDKIEGILV

SEQ ID NO: 31590 - protein, 122 aa, Sorghum bicolor
  Clone ID: SORBI-28MAY03-C100431_1.pep
RRNPSCAGANLDLNYPSFMVILNRTNSATHTFKRVLTNVAASPAKYSVSVAAPAGMKVTVSPTALSFSGKGSKQPFTVTVQVSQVKRNSYEYNYIGNYGFLSWNEVGGKHVVRSPIVSAFAQ

SEQ ID NO: 31591 - protein, 75 aa, Sorghum bicolor
  Clone ID: SORBI-28MAY03-C100461_1.pep
NNNWSGADASCLVSAAKNLNIPGLRVCDSENTCSIIYPGGTGKNAYLAGMEAEDGIGINTPLKQVRLTVDIDYSA

SEQ ID NO: 31592 - protein, 75 aa, Sorghum bicolor
  Clone ID: SORBI-28MAY03-C100515_1.pep
QRSNHEPAPYSNYNLTNCKAQAPAIRREAERLLPNSDTTPDLTHRGQNKKTKQKQTTPCANSKTTSTDADFQHIC

SEQ ID NO: 31593 - protein, 155 aa, Sorghum bicolor
  Clone ID: SORBI-28MAY03-C100560_1.pep
AFKRLVVPEQRTLWIAHNIPSLLYPAATHRPVPSSAPAMHVLQKMMAMPKTIENKSRQQGIYESIHRDLLVAFGSWEFDPMNITNPFPQNEGSVHIWQGYEDRLVLVELQRYISKKLPWIKYHEVPEGGHMFMLVDGWTDRILKALLLGEETLDV

SEQ ID NO: 31594 - protein, 134 aa, Sorghum bicolor
  Clone ID: LIB3480-015-P1-K1-F3.pep
LHKVEGRAVHYQIGDSDGEVRPDEEAQYLTFNGTSLEELLERLKEETGLHDVIMCSRSPINGKLLPLRLQLPPNNAAVHIVLVHQSSKGTYIRFSSSSIHTIPLHRIDDITHQSFFFPFIYKTETHHICISHMH

SEQ ID NO: 31595 - protein, 62 aa, Sorghum bicolor
  Clone ID: LIB3480-022-P1-K1-F10.pep
PTRPEELLERLKEETGLHDVIMCSRSPINGKLLPLRLQLPPNNAAVHIVLVHQSSKVAKSFA

SEQ ID NO: 31596 - protein, 86 aa, Sorghum bicolor
  Clone ID: SORBI-28MAY03-C100618_1.pep
RPREDPNWVSTSFWWVGLGVNGVTWSKLFMRSIPGERIGSAQLASDGIVRFTMTWATLADLGLGGSDLADMCATLQDGSTGQNVGL

SEQ ID NO: 31597 - protein, 134 aa, Sorghum bicolor
  Clone ID: SORBI-28MAY03-C100627_1.pep
LYCTEHQGDRLTNSITRTRQLPGKFIPSESSNVTGLTKCHGRRTFYIGNMTGPTSSAALTAIGQVRYPARVLFCCTTSVLVRTNRSGALESRGVRSGVQRNATHHFQVKVENAYGRRFGGDERLFGVIGLCFAV

SEQ ID NO: 31598 - protein, 153 aa, Sorghum bicolor
  Clone ID: SORBI-28MAY03-C100660_1.pep
EAMRLHPSTPLSLPHFSFDACDDDVAAGGYRVPANTRLLINIWAIGRDPAAWKKPLEFRPERFLPGGGAEKVDPMGNCFELIPFGAGRRICAGKLAGMVFVQYFLGTLLHAFDWSLPDGEEKLDMSETFGLALPKAVPLRAVVTPRLVPEAYA

SEQ ID NO: 31599 - protein, 49 aa, Sorghum bicolor
  Clone ID: SORBI-28MAY03-C10069_1.pep
PCANYEVDLQQRQLLASPTTTPCSYLHLINYCPLSNCCFFSRLPMGGIS

SEQ ID NO: 31600 - protein, 63 aa, Sorghum bicolor
  Clone ID: SORBI-28MAY03-C10075_1.pep
SFVALILPLLPFQLLCFWPVKIHLFVRGKSWGFLRNLGPNYALVLLCSRIISSVLNYTMQYVI

SEQ ID NO: 31601 - protein, 139 aa, Sorghum bicolor
  Clone ID: SORBI-28MAY03-C10079_1.pep
GFDSSKSMRLSWHPRVFLYEGFLSDMECDHLISMAHGKKQSSLVVGGSAGNNSQGASIEVFMAHSKDTIVSTIEDRISVWSFLPKDFGESMQILKYEVNKSDYNNYESQSSSLFDFCRTVLMYLSDVSLFNNLVGVFCL

SEQ ID NO: 31602 - protein, 263 aa, Sorghum bicolor
  Clone ID: SORBI-28MAY03-C100753_1.pep
MAVKAAFIGACGATLRHVLAWTLLDGHKAAALVRNHSKLKKILLDLGVSEKIQQSQLIVVEGSSRDVSTVRNLLLNDPEIIFSGITSTWKLRFNPFHPIAMDDASITGDSAAAVMQALKDLVSTNSITNLPIYAPISSTGHGSHRDQPRSLMPLYWWLLKEAQADTAVLERVTREAATQKQSCLGGYVMLRPPLLTDGEMKGTKEVRVGWIWEDDIFRKSDEQETGVKVGYTISRMDLARWMFEELIQGDFRSWNGKYVNVTY

SEQ ID NO: 31603 - protein, 113 aa, Sorghum bicolor
  Clone ID: SORBI-28MAY03-C1008_1.pep
MDCTLSKGSHLSMEELRMMHVVKWRKVYQHNRLCHWGVRRCPKIQLFPELRLQKSSAAITSDSMSTPTKEQSSQKSTGSLDITKLLDELEIPSRSQNSISSSVLLVKKLLQFE

SEQ ID NO: 31604 - protein, 126 aa, Sorghum bicolor
  Clone ID: SORBI-28MAY03-C100813_1.pep
MTSKVPVILGQIIEGNGKLDNDTPREQQSKLTGFGSRALGAHNNAFEALIGFGIIVAVTLLRINGDSSERASLLALSLVKESICFIAARTVFQIVYVLGFPGFIRTLVWAFGWISVLSLYIQNAVY

SEQ ID NO: 31605 - protein, 70 aa, Sorghum bicolor
  Clone ID: SORBI-28MAY03-C100880_1.pep
DLNFAVFDLVMLILAILTVGRFLQDQKSNYLEGFLLIILYVAIAVAAFYYPNPTGHGSEGAAEGSSEGGH

SEQ ID NO: 31606 - protein, 120 aa, Sorghum bicolor
  Clone ID: SORBI-28MAY03-C100869_1.pep
RAWCALNPNAKDLGKLGANIDYACTFADCTPLGYGSTCNGMDVAGNASYAFNAYYQVQNQKDEACDFQGLALPTETDPSTATCNFTIQIQTGAAAMASLGARSAGAAALVLALLQLLAMW

SEQ ID NO: 31607 - protein, 77 aa, Sorghum bicolor
  Clone ID: SORBI-28MAY03-C100905_1.pep
RRGRGRGRGRGRRNIRLLFGLVGCFTPFQDVSIQSEVAKKQVQSWVLSSRKHLNGLSIYLRDGPSFFIPPWQHEKGS

SEQ ID NO: 31608 - protein, 130 aa, Sorghum bicolor
  Clone ID: SORBI-28MAY03-C10092_1.pep
MALLAIQGMAMSTAAAALPSHNHGAVSSSVSTSSYALAASAAFPRVRAAFAVGAVTSAAVTPVLDVYCGRGDKKTKRGKRFNHSYGNARPRNKKKGTGPPRLFAPPAPPRKDQFDDGEIISIEIDEDILE

SEQ ID NO: 31609 - protein, 142 aa, Sorghum bicolor
  Clone ID: SORBI-28MAY03-C100970_1.pep
HEGDVYSFGVVLLELVTGLKPVGEHLGDGDGAVDLVQWARGRSSSGGGVLGLLDPRLGGDVPVAEAAHVLFVAMLCVQEHSVERPTMREVVQMLQQAKHKHEGPGPGPSLAAATVPLPARPAQRHAQRPDIDMHLVVHCHGM

SEQ ID NO: 31610 - protein, 110 aa, Sorghum bicolor
  Clone ID: SORBI-28MAY03-C100982_1.pep
YDFGYLLKILTCSSLPDTQAGFFKLMKIYFPAVYDIKHLMKFCNSLHGGLNKLAELLHVERVGESHQAGSDSLVTSCAFWKLKDSFFAGSTEKYAGVLYGLNAENGVSAH

SEQ ID NO: 31611 - protein, 107 aa, Sorghum bicolor
  Clone ID: SORBI-28MAY03-C100986_1.pep
KRKIGFGDYIRIGSRRALQHDPHDERGNQEFSAPYLEFGENTAGDVQEQAVEQRMTFKDVFNLPHNPIPTVHEGQLAFRDGKKIHGRLSRSRTVYKMGRIFGSSLRL

SEQ ID NO: 31612 - protein, 270 aa, Sorghum bicolor
  Clone ID: SORBI-28MAY03-C101008_1.pep
HEASITLLSLAPTATFLHIPASTSSSPFVAAPGILAGRRAASRALPLRARPPRRITVVCSAAAAAAEASDAAAPVEKFRLDNLGPQKGSRRRPKRKGRGIAAGQGASCGFGMRGQKSRSGPGVRRGFEGGQMPLYRRLPKLRGIAGGMHIGLPKYVAFNLKDIVRGGFKDGDEISLETLKSRGLINPSGRERKLPLKILGDGDVSVKLNIKAGAFSASAKEKLEAAGCSLTLLPKRKKWLSQNYLKNQARAEEYFAKKKGGAGESDSGTV

SEQ ID NO: 31613 - protein, 131 aa, Sorghum bicolor
  Clone ID: SORBI-28MAY03-C101022_1.pep
SFPRSPSYLKQKLLSSLYAEAFSLFLGLHLIIDSLQVHECDFLADSSELITLSKGNGVPAQNQACNLMSRAFISDSISHSMYSDSTPESSPLSAPSASPLFLRPRPSPRNSSLSSDPPRPLPPSSSHPPSC

SEQ ID NO: 31614 - protein, 73 aa, Sorghum bicolor
  Clone ID: SORBI-28MAY03-C100607_1.pep
YKLLERSFLYEGGLDGRDWFKHVVFAPGIWTGYSGAVFPGWVESIDAKDSVNGLKWSAIIGRSIKNAIDSLSD

SEQ ID NO: 31615 - protein, 168 aa, Sorghum bicolor
  Clone ID: SORBI-28MAY03-C101039_1.pep
PFAQETFQGPQVSKLQFDRIMSYIEDGKKSGATVETGGKRKGDKGYFIEPTIFSNVTEDMKIQQEEIFGPVCTIAKFKNKEEVIKIGNSTSYGLAAAVHTTNLTTALEVANALRAGTVWVNSYNALHWPLPFGGYKESGIGRELGEAALENYVQTKTVSIRLGDVLFG

SEQ ID NO: 31616 - protein, 187 aa, Sorghum bicolor
  Clone ID: SORBI-28MAY03-C101055_1.pep
HEATVRVGQTGTAAASPGGEEDHDGVNGGLVAAGVIAGIFGALACYLGFCAWLYRRQVNAYRQHLAESNRYSVASHSLLNPSALAAAATTRPKRAISQRSLFGWVGPSRDQGYATEPKWSPEDEDDTTPGAPGSSSGSGGAKRSEDMRPGTSHSGGSTEGLLEGQEPSFFSVVMGPRRALRVVNNAE

SEQ ID NO: 31617 - protein, 67 aa, Sorghum bicolor
  Clone ID: SORBI-28MAY03-C101117_1.pep
KSGNVAVLLCAKSSQDINITCLCLLYCSRQVSNVANAAQCYAENGYSQCHTRKFRDLWAPIARSVLL

SEQ ID NO: 31618 - protein, 102 aa, Sorghum bicolor
  Clone ID: SORBI-28MAY03-C101192_1.pep
YQPDPSNSQIGVALGGDDSSVNSGNSKGKGLQGEEYEMTPVENPHAGMGIYQTGINPYGESSRTTAPQPGYFPEGITHMNQSYGYPNPYGHHEDNGRMGREP

SEQ ID NO: 31619 - protein, 129 aa, Sorghum bicolor
  Clone ID: SORBI-28MAY03-C10122_1.pep
AAGHQARTPGHRRPSLVKQLIAGFLKTACAVLFSRTAATSATAASSCGGPWRSVVDPLWCGEPSSRRQPRQKQRPGQTSVSPRRPAQEDVGSARTHVQEGKWGTPGSGGTKSLMLDQVLIHSFMTWFGI

SEQ ID NO: 31620 - protein, 115 aa, Sorghum bicolor
  Clone ID: SORBI-28MAY03-C101256_1.pep
EVIREEYYNEKIDMWSLGITIIEMMDRVPPHYAIKDEEELFDIIATEPSPTFTYSYPTMYMRGLVAWLLDEEPETRPSARDALLEIEAHVQSNLLPCSSAQDLVRFLNHVLPSEH

SEQ ID NO: 31621 - protein, 163 aa, Sorghum bicolor
  Clone ID: SORBI-28MAY03-C10131_1.pep
KLMLAHAASAQGISVVEQISGKDHILNHLSIPAACFTHPEISMVGLTEPQAREQADKEGFEVNVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 31622 - protein, 161 aa, Sorghum bicolor
  Clone ID: SORBI-28MAY03-C101322_1.pep
MLGLRGLPAAPPAAAAPPKGRCSAAAPPPAMTGRLSLAVPAAVSLSLVLWSSPVNAGILSGFSGLESTPGPDLPRLEFLEKWNAENQKKYAEFDNRFKKSKVLQDLLEKSKKNKEKNERMIQDKYCLRGAEWGVGDCSTEGMPDQEREDFISELKKRTGAE

SEQ ID NO: 31623 - protein, 203 aa, Sorghum bicolor
  unsure (1)..(203): unsure at all Xaa locations
  Clone ID: SORBI-28MAY03-C101316_1.pep
MRRRRAPPPRKPTPASASATASRALRLPRRAASSPRRTPRATCTPPCRRRSPSPRTAPAGYSTTRPTREQQRRRPGPGPARASCLPRARATPRTSWRPSSPGAPXPRRPXTCSTGGGAATAPRRRLPPPPRRPPAPPRRSPPPAPAAPATATAAAATTTTTVASSTSTSASSSPFRRHRRLPTPRLFLIMCRRPIRTLRVSLN

SEQ ID NO: 31624 - protein, 251 aa, Sorghum bicolor
  Clone ID: SORBI-28MAY03-C100845_1.pep
PLRRFCSPAPPHASAAPDSQPPPRLPSPIMDAQFELFRAQLDDSSTLRDRIRAVVAEIESASRVATDALLLVHQPVPLADVLVKAKAQVEVIKGLYARLAEVLKECPGQYYRYHGDWRTETQMAVSMLAFTHWLETGGLLMHAEAQEKLGLSSGEFGLDVEDYLTGLCFMSNEFPRFVVNRVTAGDYDCPKRVLGFLTDLHASFRMLNLRNDFLRKKFDGMKYDLRRVEEVYYDVKIRGLVPVELKQETQS

SEQ ID NO: 31625 - protein, 150 aa, Sorghum bicolor
  Clone ID: SORBI-28MAY03-C101345_1.pep
QDIPHVVEEGAKVIRENNEPSIANRIQFQEYDFFQKQPVVGADIYLLRQIFHNWDFENSVKILKNTVESMGQNSHVLIMDFVVPEPGTVSSVTERVLRSRDVGMMQLFNSLERDLEGWKAILEAVDSRLKINAVNTPYGSFMSVIDVVLG

SEQ ID NO: 31626 - protein, 64 aa, Sorghum bicolor
  Clone ID: SORBI-28MAY03-C101376_1.pep
AVMKSVDPMTCYGHQGGGDGGCAPPGQSQEPACPVMLWWQCLGKMVAFQYTSGCLQRQMSQSPS

SEQ ID NO: 31627 - protein, 120 aa, Sorghum bicolor
  Clone ID: SORBI-28MAY03-C101373_1.pep
MRSKFKDEHPFEKRKAEAERIRQKYSDRIPVICEKVEKSDIATIDKKKYLVPADLTVGQFVYVIRKRIKLSPEKAIFIFVDEVLPPTAAPMSSIYEEHKDEDGFLYITYSGENTFGDAWE

SEQ ID NO: 31628 - protein, 91 aa, Sorghum bicolor
  Clone ID: SORBI-28MAY03-C101382_1.pep
MSAVNGAGHSSTSKATDQDGSSAPGFQPQNKMTVQPPRGEDLQVSYAAEIGGEANPKGWYGSMINNLGACIGTCGAIPCCILCPNPYKHVN

SEQ ID NO: 31629 - protein, 107 aa, Sorghum bicolor
  Clone ID: SORBI-28MAY03-C101385_1.pep
MEPTPAAPRVHLQSPQTAVPTRAVEPGCTRHIAVASPPLPAAALQRRTRVVLYYRVDGASASARLWEEAMWTKESLSEAVADHPEMAGRLRRHADGSWEVKLNDAGV

SEQ ID NO: 31630 - protein, 46 aa, Sorghum bicolor
  Clone ID: SORBI-28MAY03-C101389_1.pep
ADALGAWHASPVRVSPPPSVDLCFPSRPRLQACATRRLAGLFIPRA

SEQ ID NO: 31631 - protein, 125 aa, Sorghum bicolor
  unsure (1)..(125): unsure at all Xaa locations
  Clone ID: SORBI-28MAY03-C101394_1.pep
RLLSSSLLLASLPLRTLVVNPSVLSNVSRRTSPRPAASSRTPPANAPPISRRSSSPLSPLAXPRPARPKTSSRLSPLPPRSARSSLRPPAPALASLPLLQLLPPPAPSPSASTPPSQAPPASPPS

SEQ ID NO: 31632 - protein, 146 aa, Sorghum bicolor
  Clone ID: SORBI-28MAY03-C101466_1.pep
RQKEVFRKYNRLPKAVTLPTQHIHKSLKMKVSSSVVILAAALGVSAHPSGHAHQRAHAKRDFVVANKPVTVIEYATKVVTADAAPATAVAEAPASPKVDADTVVPKASTSVPAPAASAPAKNKGKKHSSGSGYKAFCGGKKAKRAI

SEQ ID NO: 31633 - protein, 158 aa, Sorghum bicolor
  Clone ID: SORBI-28MAY03-C101736_1.pep
ATRLFFIRPERREKEAEGRNAPPEQDILMTMSGLQNGISNSEHPVVETPVAVSTSSLDNANTESEIREALASLHAHEASITSRLDALVASQADLSRDLGRLDLLRAGLGAQVIAARSIGNDMLATAADTAGRLSDRVKELDLEKSRVEETLGVVEQVA

SEQ ID NO: 31634 - protein, 72 aa, Sorghum bicolor
  Clone ID: SORBI-28MAY03-C101029_1.pep
RICSRQGYGKYGYCYFDGLVRSTGLSAVCLHVHAETRVCMILPSAISLCWRWYTRSEGYFYAILSPVLSYMT

SEQ ID NO: 31635 - protein, 81 aa, Sorghum bicolor
  Clone ID: SORBI-28MAY03-C101474_1.pep
HILRSLPPSYEDYILTRQVMCLAMLFDMHFDEEYEKRKVTSVIDVGLCKPVSGTMLTRSVRGRVRRQTIYWRGADCSSSYL

SEQ ID NO: 31636 - protein, 204 aa, Sorghum bicolor
  Clone ID: SORBI-28MAY03-C101477_1.pep
VRLKKEQEETEHKKKEKAEAHLYTIIKVARDEDLKEQIGKDMYFDLVDHEKVRNFRIQKQMPFSSFKEEVAKEYGIPVQFQRFWLWAKRQNHTYRPNRPLTLHEETQSVGQLREVSNKAHNAELKLFLEVEVGLDLRPLPPPEKGKEDILLFFKLYNPEKEELRFMGRLFVKALGKPSEILAKLNEMAGFSPDQEIELYEEIKF

SEQ ID NO: 31637 - protein, 107 aa, Sorghum bicolor
  Clone ID: SORBI-28MAY03-C101493_1.pep
CLCSKEFQYGELRFEGPCRRLWVLEIDCNCRLKTVKFRGTWFSMPQLEVLKIRCQNNVSSLEFSGLQQLRKLREVSLTGSYDDKVKQQLKSQLGENQRDIKPVLKPN

SEQ ID NO: 31638 - protein, 179 aa, Sorghum bicolor
  Clone ID: SORBI-28MAY03-C101553_1.pep
GGPVKSGDDDDDEDDPSPPNGAHHPAVAPPQTEGITLSGLLNFIDGLWSTCGEERIIVFTTNYKDRLDPALLRPGRMDMHVYMGYCGWEAFKTLARNYFLVDDHVLFPEMQELLSAVEATPAEVSEMLLRSEDADVALRGLAEFLREKRRRTRKETEGRETEDKKDAAEDKEEVAEKDV

SEQ ID NO: 31639 - protein, 136 aa, Sorghum bicolor
  Clone ID: SORBI-28MAY03-C101561_1.pep
MESPLSRRSTFSSQGEIAGYTSKSESPNIGAQTVKLEGTTRSAPQESPGASSGILATNIGSGAKAASESVINDSEKIWLYMDPSNKIQGPFSVIQLRKWNSNGYFPPSLKIWKASEKQDDSILLTDALAGKFEKDL

SEQ ID NO: 31640 - protein, 59 aa, Sorghum bicolor
  Clone ID: SORBI-28MAY03-C101662_1.pep
RFDAVHQDRRRRGNGKAYKKRGWRQPSAVGKRSVPLPRHDSQSMSETLFSRGKGGGAPR

SEQ ID NO: 31641 - protein, 170 aa, Sorghum bicolor
  Clone ID: SORBI-28MAY03-C101683_1.pep
ILEATYPAVAKRLHGDWILDPAIPVVTGFLGKGWKSGAVTTLGRGGSDLTATTIGKALGLREIQVWKDVDGVLTCDPNIYPHAKTVPYLTFEEATELAYFGAQVLHPQSMRPAREGDIPVRVKNSYNPKAPGTLITKQRDMDKVVLTSIVLKSNVTMLDIVSTRMLGQYG

SEQ ID NO: 31642 - protein, 194 aa, Sorghum bicolor
  Clone ID: SORBI-28MAY03-C101706_1.pep
GMGLVSVFGNDVDAYYDRLLAGESGIGPIDRFDASKFPTRFAGQIRGFSSEGYIDGKNDRRLDDCLRYCIVSGKKALEAAGIGLGSKPMEKIDKTRAGVLVGTGMGGLTVFQDGVQNLIEKGYRKITPFFIPYAITNMGSALLGMDIGFMGPNYSISTACATSNYCFYAAANHIRRGEADIMIAGGTEAAIIPI

SEQ ID NO: 31643 - protein, 142 aa, Sorghum bicolor
  Clone ID: SORBI-28MAY03-C101685_1.pep
MPAEDEMVLLAADEASWPISSPPPAWFAALVAIGLYIVVRSAATFLLWLHRAFLRPGRDLAGWYGTWAVVTGATDGIGRAVALELARAGLHLVLVGRSPDKLARVAKEVLAAAPPSCKVRTVEFDLAVTGDDDARRGVARVV

SEQ ID NO: 31644 - protein, 64 aa, Sorghum bicolor
  Clone ID: SORBI-28MAY03-C101332_1.pep
FRLSGTKERDITQTGIRMKNELSICNHFVLEQWMNGKCRISSCNSLNSGSFCYGIQSARSFFSA

SEQ ID NO: 31645 - protein, 278 aa, Sorghum bicolor
  Clone ID: SORBI-28MAY03-C101341_1.pep
MSTVSTYISSSCSQPFPSKMGKRFLHQLLAVVLALFLSPARSGDWLPATATFYGGADGSDTMGGACGYSDLYEQGYGINNAALSTALFNDGASCGQCYVIICDSSKTRWCKPGNNWVVVSATNFCPPNWDLPAVGDLPAGGWCAPPRPHFDMSQPAWENIGIYSAGVINVLYQRVKCWKSGGVRFTMAGFNGFYMVLVTNVAGSGSIQSMAVKGNSTDWIPMYRNWGANWHCLSGGLVGQGLSFALVSTGGQNLVFKDVVPAWWQFGQTYTTYQNFDY

SEQ ID NO: 31646 - protein, 165 aa, Sorghum bicolor
  Clone ID: SORBI-28MAY03-C10175_1.pep
KPLLETSRRGYLAAISASSYSYVSLLQHFLPIMNPGGASISLTYIASERIIPGYGGGMSSAKAALESDTRVLAYEAGRKGKIRVNTISAGPLGSRAAKAIGFIEKMIEYSYVNAPLQKELLADEVGNTAAFLASPLASAITGSTIYVDNGLNTMGLALDSPTLST

SEQ ID NO: 31647 - protein, 148 aa, Sorghum bicolor
  Clone ID: SORBI-28MAY03-C101771_1.pep
FSGAVTLYYATHTRPSPQKYDRMEVLPAGEQIINMMLPGEVHSYYFSVGGISAADYTITISTSQVPATLRDGVSMYWTYVPQYYYRQFYFEADDFDQSDVSITVDPRLGDVDLYVSTEDYFPTKTNYTWSSDRYSKDTVLIKSNDPLA

SEQ ID NO: 31648 - protein, 161 aa, Sorghum bicolor
  Clone ID: SORBI-28MAY03-C101776_1.pep
MKNQSTPTPLPDTPTPTTSGDAGTPGGGGGGGHEQATASPRRLAALLPSRGSSSRGTMAKRPGVLWAAALAVVVLAACTAAAAAVTISRKQHHRGGSSASSAARSCAPFAASGAWVVDESYPLYDSARCPFIRDEFACARFGRPDTMYLKYRWHLDAPCAQ

SEQ ID NO: 31649 - protein, 100 aa, Sorghum bicolor
  Clone ID: SORBI-28MAY03-C101806_1.pep
RVSAPGAGSASRRGGAGGAPPSALPGGFFSGCLPARSEEPQQPIGWPSAAAAYAWRGRPCACGAGLGSSPGLTSSRAGEEGRESKSKEEEEGNLRGGARA

SEQ ID NO: 31650 - protein, 149 aa, Sorghum bicolor
  Clone ID: SORBI-28MAY03-C101841_1.pep
ARGPPGSASAPPPTPTGHGPTASTGTQSTFPTCSSTEPPSKRTVGTVIGWNLGSTERTCRVNYMGSRRRGGRHKGGGVGPGSSQSVSTCAPGERNGCVVSRSGAFVYYIHSFRGVSDFVSRCVHISLSTLIIYVCFSYFFQTHYSSSIP

SEQ ID NO: 31651 - protein, 255 aa, Sorghum bicolor
  Clone ID: SORBI-28MAY03-C10187_1.pep
NSYGARLGLSGSQQSSKSHEQAGLRDRLLLFSVGVSIGILSSSLSNKKEFDTLKGTLKQMENLVQDLQDELEMKEGLTVKELPNETSSEHDEPMSKIEAELEAELARLELNITSKRLQEETSDFNEVDEEFIGDIVCGELKADMIPRDHTDYSSECDHGRDSRESSPDYTCGANYPVSPRDLSIRLHKVIQRRLEDRIKELELAIVHRQKQTQVQMMVTDQIFSERIRSNSESSSSGQGSPIFIQETSSLAEPYC

SEQ ID NO: 31652 - protein, 70 aa, Sorghum bicolor
  Clone ID: SORBI-28MAY03-C101914_1.pep
MSTPRTKRQFAGASADPSQRQITSFFNASGRTSAESPVAAAEKPMQPTLPSNVQANLLSVGMRVRKSVPE

SEQ ID NO: 31653 - protein, 97 aa, Sorghum bicolor
  Clone ID: SORBI-28MAY03-C101924_1.pep
LVVPLTPPRTFPRLTACPALPVILRLCAHRMLGPASVRDSHKTLRVSSPAGHLALVRSTACWTPPVILDHHRPRRVPSPASHLAPARSTACLAPPSC

SEQ ID NO: 31654 - protein, 117 aa, Sorghum bicolor
  Clone ID: SORBI-28MAY03-C101934_1.pep
MSESQTKKFAKGERSIPHPSQKASKFYPAEDSQVPKKARKSIRPAKVRPSLTPGTVVILLAGRFRGKRVVLLKHLEQGVLLVTGPFKVNGVPLRRVNARYVIATSTKVDVSGVGEDV

SEQ ID NO: 31655 - protein, 90 aa, Sorghum bicolor
  Clone ID: SORBI-28MAY03-C101946_1.pep
ASSVTKISASASPLTSSTRSPLPLLLLLDDKLLDLSVLHDPRSDYTPPSFFDTRQLPHRRFTEVLPLAEEESRRPRQSTEGSVCYRSRPP

SEQ ID NO: 31656 - protein, 95 aa, Sorghum bicolor
  Clone ID: SORBI-28MAY03-C101949_1.pep
LTCLAINNLSKPAYASDSDSDGQARGGRRSQKQQFVVPLPTSTGLSQPAGQLLKGATDENGAQKSAALLVGIKLDLEAEVHLTARVKGDIVVGLY

SEQ ID NO: 31657 - protein, 86 aa, Sorghum bicolor
  Clone ID: SORBI-28MAY03-C101978_1.pep
RPTLVLPSLRPTCNHPSFAANTISIDTPLSLALSSTRSARLHHIVRSSSSQFRLAFPSPSIPSKVAYNPRTSGARRYTTTRTCEPS

SEQ ID NO: 31658 - protein, 149 aa, Sorghum bicolor
  Clone ID: SORBI-28MAY03-C10198_1.pep
EDVKVIEKTAMYRSTARDEDARILNKAPKDENLDTSRDGASDVIFSQNLVVRSFPQSAPAAPTEVGGVNFKRFRKRETVSGNSFKDLIPFAREPYRESDYERGTLNDFMREEKQRKQMEAIADDLFNNAKSKKRAAAGSSIHTLLTGYR

SEQ ID NO: 31659 - protein, 165 aa, Sorghum bicolor
  unsure (1)..(165): unsure at all Xaa locations
  Clone ID: SORBI-28MAY03-C102013_1.pep
MEVVGGVSLRPSPAPARIRRTTLSCVDVGRRLVLRPAGAPLGQLPARRALVVEARGRSWSERQMQQQRRMPQLPKIEDDGNPRFVIFIRTANVYFWYPLNIITGGTTAKIMLAAKDNFLGKYIYKDTLARNLAAVIYKDEDEIIDTAKEQYRVLKTEXEFRYGYK

SEQ ID NO: 31660 - protein, 118 aa, Sorghum bicolor
  Clone ID: SORBI-28MAY03-C102021_1.pep
HEGRVPPPEQRGAEAATAAPESAAAAAAPLQLMAGKGILHFDGASKGNPGKAGAGAVLMTEDGRVVSRIHEGLGVATNNVAEYRGLTLGLKQAIDHGFTSIKVHGDSQLVCNQVSFSL

SEQ ID NO: 31661 - protein, 94 aa, Sorghum bicolor
  Clone ID: SORBI-28MAY03-C102023_1.pep
MSKECVVNALLSCFMHVGLALVLLVYLPIAFIGRLLKRLFVRPFAKGEDLRGKVVLVTGASSGIGEHLVYEYARHGACVAVVARTEIALRAVAK

SEQ ID NO: 31662 - protein, 120 aa, Sorghum bicolor
  Clone ID: SORBI-28MAY03-C102033_1.pep
HEAPPKPLDTAHNVQLFKSSDLAPVSSIFASPHVNPAKETKVLIRDESVQLPQELHSPSSVRTRICPSGSFRMIRCKDIVSESCNITCQLNEASIDSSDHTSNSTGQLSQSIQDAAGSME

SEQ ID NO: 31663 - protein, 235 aa, Sorghum bicolor
  Clone ID: SORBI-28MAY03-C102045_1.pep
TRPAAAAEEHVAYPRMSPEDIAPPPPPVVPPAGANPYVLSAPSSNPPSKGARENLRDMFGMVGKKFNEAARKTEGIAGDVWQHLKTGPSIADTAMGRIAQISKVISEGGYDKIFQQTFECSPDEKLKKAYVCYLSTSHGPIMGVLYLSTVKIAFGSDSPVKYVTEDNKTQSSFYKVVLPLPHLRSVIPTASQQNPAERYIQVVSVDNHEFWFMGFVNYDSAVKNLQEAVRGVHGA

SEQ ID NO: 31664 - protein, 175 aa, Sorghum bicolor
  Clone ID: SORBI-28MAY03-C102062_1.pep
ARGRGSLNWGPTSWLNAVYKTYGWWTMRRDSYDKAFHTYALEWTEDWMRIYVDTRLHHMLDLRFNKPFWQRGDFPAVIQNGSNSVALQNPWAANFTVPNAAPFDQQFYLIMNVAVGGTNGWFPDNKGDKPWIDQSRTAMYDFAKSQDTWYETWPQGADIEDRAMVIDSVKMWTEC

SEQ ID NO: 31665 - protein, 142 aa, Sorghum bicolor
  Clone ID: SORBI-28MAY03-C102078_1.pep
ARGPPVSISFSPFPRLVFARTRCASTFTTIMKYSLIAALPALAAASPTFSTETIHKDAAPVLSSTSAKEVPNSYMVVFKKHVKDASKHHDWVQSVHSKNTQERMELRKRSSDLPVSNEVFAGLKHTYELAGLKGYSGHFDDE

SEQ ID NO: 31666 - protein, 152 aa, Sorghum bicolor
  Clone ID: SORBI-28MAY03-C102145_1.pep
MLSSKSSYAAAAVVLANLAAVAHAQSSGASAFTPLASQSFAYTALPYQADTGTGERGPQSGYNICNSTTENQQSLCQTAIINSIDDFCLWAPQDPNSLIGNVEGECVAWCTKPGHGTRLIPAGALTAVQFMKTPDYVQVTGLINQALINIAS

SEQ ID NO: 31667 - protein, 184 aa, Sorghum bicolor
  Clone ID: SORBI-28MAY03-C102180_1.pep
MEFTEAFKQTGPCSFSPDSRFLAIAVDYRLVVRDVVSLKVARGFSCVDKISSVEWAPDSEYILCGLYKRPMVQAWSLSQPDWTCKIDEGPAGIAYARWSPDSRHILTTSEFQLRLTVWSLVNTACVHVQWPKHGSKGVSFTKDGKFAAICTRRDCKDYINLLSCHSWEIMTVFAVDTVDLAGVE

SEQ ID NO: 31668 - protein, 170 aa, Sorghum bicolor
  unsure (1)..(170): unsure at all Xaa locations
  Clone ID: SORBI-28MAY03-C102293_1.pep
HEAKAKSTYASSADLGWSFDDTERLYTIPFSKFSGLNTAKLTTILFSGFTGTTSFGPMAFYCGTSGEYVPPPPASDPGASATVPAPSNPSATGLVIDKFANANTNAMGNWHGGDEGMTLKYNNNKLTITSPDADYAFYTQVSSGCSDFTKYKGSYLHIAYSGTTDFTVAX

SEQ ID NO: 31669 - protein, 81 aa, Sorghum bicolor
  Clone ID: SORBI-28MAY03-C102297_1.pep
HEARLFPCACFEIGCDSYCCFCWRLKVQLISGTFAATLPHSFGIFGKAPYPVRTTISRFASPSLSSEAFHCLSRRDGVLEA

SEQ ID NO: 31670 - protein, 232 aa, Sorghum bicolor
  unsure (1)..(232): unsure at all Xaa locations
  Clone ID: SORBI-28MAY03-C1023_1.pep
RIDRTRPHGLAYLHHECSPRIIHRDVKSKNILLDKDYEAHLADFGIAKSLCVSKTHTSTYVMGTIGYIDPEYARTSRLNEKSDVYXLRHCLVGVAYWQKACXDECNLHHLILSKAAENTVMEMVDQDITDTCKDLGEVKKVFQLALLCSKRQPSDRPTMHEVARVLDSLVCPGPLPKQAQPQALEKSSTAPSYVSEYVGLRGGSALSCANSSSASDAELFMKFGEVISRSTE

SEQ ID NO: 31671 - protein, 154 aa, Sorghum bicolor
  Clone ID: SORBI-28MAY03-C102302_1.pep
MQLCEVFTFGGSGDARWRGKKAAQDRVDMSPLSRVVIDGVVYFLLDEDLINRQVLPKGIASFDLLTEEWRSILRGPVSIPAYYSNLSLAALNGSLVLVHCMLHVSMDLWFLVDTEKNLWVRKHTVEINLSIHDEFLAHPLVILKNGSIVTYIGS

SEQ ID NO: 31672 - protein, 59 aa, Sorghum bicolor
  Clone ID: SORBI-28MAY03-C102379_1.pep
MSAYYHYNAHPAPVSHNHHGGRNRRAPRLSVSQQAQRQFRGVRSMKELNETASLTAFRT

SEQ ID NO: 31673 - protein, 47 aa, Sorghum bicolor
  Clone ID: SORBI-28MAY03-C102404_1.pep
AAHSCLLVDHAKVVDSCWSTAMPLPFSQQLSFYFNMKIFIDISALID

SEQ ID NO: 31674 - protein, 143 aa, Sorghum bicolor
  Clone ID: SORBI-28MAY03-C102409_1.pep
MAPTAEPSSPPPQRRPRTGPPPGLKNLGNTCARGSVLQCLASTPPLATFCLASRHSILCKKVFPNRDKECAFCVLELQIARLLRADAGALDSPAKVIRCMPLFAEHFRWGRQEDAHEFLRYVVDACHTAGLRIRKRLPAAGAS

SEQ ID NO: 31675 - protein, 147 aa, Sorghum bicolor
  Clone ID: SORBI-28MAY03-C102487_1.pep
MEVVDEVVRALGAGFDLTSDFRLRFAKASEGRRLVELGDETRDVPLPGGAGATLRGVPRDVGVDKGDRIRFRSDVLEFNQMSELLNQKSSVQGKVPSGYFNALFELSGAWLTDAKETKHLAFDGYFISLYNLHLKASPLVLRDEVKK

SEQ ID NO: 31676 - protein, 113 aa, Sorghum bicolor
  Clone ID: SORBI-28MAY03-C102508_1.pep
LGLKNSSRKLQVNCAISYLFYLYSVFHACAARFDVTKNLEKIWKLNNAVVFRCLRFSLKATFPLPPVCGKYNQEQLNINHTYNNARNTISITTHRNLVKPIYLSLSAKSIVIQ

SEQ ID NO: 31677 - protein, 98 aa, Sorghum bicolor
  Clone ID: SORBI-28MAY03-C102520_1.pep
MLIQLSRASRARSAVAAVSRVARPNAAQVRGFIAPTVSRKADFVQELYLKELKAYKIPAVKESDAEGNVQTFNVPKTPASPEETDLAGNLKEYESMAV

SEQ ID NO: 31678 - protein, 149 aa, Sorghum bicolor
  Clone ID: SORBI-28MAY03-C102513_1.pep
HEVQFRTRHSYFTSRAVLLLVVLFAGCMIIQAAICRWHIFNSLFSISLLALTLPAASSTTLIYVTSYAGTVTTLNLTTSVSGDSGLQTTLAQVAVSHGCAGNTSWLTLDPTNDILYCLDEGFGLPNGTLVAFRTSDNGTLTQLGEAPTL

SEQ ID NO: 31679 - protein, 128 aa, Sorghum bicolor
  Clone ID: SORBI-28MAY03-C102535_1.pep
MKAPPSSPFLLLLLLFFPSSGLAAPKDFNYEVQVLMTIKSLLKDPHGALKNWDPYSVDPCSWSFISCSPENLVTALEAPSKYLSGPLSPSIGNLTKLEILLLQNNNIIGPIPTEIGKLAKLRTLVLSS

SEQ ID NO: 31680 - protein, 115 aa, Sorghum bicolor
  Clone ID: SORBI-28MAY03-C102579_1.pep
MANTQIPSWSLEGKVAVVTGSGRGIGKEMALELARRGASVAVNYANAKEAAEDVVKQIEAMKTGAKAVAIKANVANVKETQHLMDEVVKHFGKLDICCSNSGVVSFGHFKDVDEA

SEQ ID NO: 31681 - protein, 151 aa, Sorghum bicolor
  Clone ID: SORBI-28MAY03-C102635_1.pep
MDVTGDASGGRRPNFPLQPRGKKKEEQPCSTSPAAVVGAGANGSAGSGEMLQMKKVAPPKRTSTKDRHTKVDGRGRRIRMPAICAARVFQLTRELGHKTDGETIEWLLQQAEPAVIAATGTGTIPANFTSLNISLRSSGSSFSIPAHLRAA

SEQ ID NO: 31682 - protein, 144 aa, Sorghum bicolor
  Clone ID: SORBI-28MAY03-C102654_1.pep
ARGRLGKFVEGTLVYRQQFVIRSYEIGPDRTATMETLMNLLQETALNHVMCSGLAGDGFGATLQMSLRKLIWVVTRINIQVDKYSRWGDVVEIDTWVASSGKNGMRRDWIIRDRNTKNMIARATSNWVMMNRETRRLSKIPDEV

SEQ ID NO: 31683 - protein, 156 aa, Sorghum bicolor
  unsure (1)..(156): unsure at all Xaa locations
  Clone ID: SORBI-28MAY03-C102655_1.pep
SGALPDTRCLLKPSTPPCDVCSMGVSLPPERNPNYRLNTSLLIDYCHDETHKYILIDIGKTFREQVLRWFVHHKVPSVDSIILTHEHADAVLGLDEVWVVQPRNGRNDIEQIPIFLTQFTMDSISRRFPYLIEQKPEDGDEDAQAAXIDWKIIEDD

SEQ ID NO: 31684 - protein, 163 aa, Sorghum bicolor
  Clone ID: SORBI-28MAY03-C102940_1.pep
TRRTTSILTVLLSLHTTSTLAKPSKPVEISRDVAIIGGGASGTYAAVRLREDLNKTVVVIETRPNLGGHTSTYHIPDSNLTVDYGVQSYLPYGPATSFFARFGIATEIFAPERLTPLNVDVETGKVLGDYRAPSTNGTNEALARWLAITSKYSDYLEPGYWNF

SEQ ID NO: 31685 - protein, 116 aa, Sorghum bicolor
  Clone ID: SORBI-28MAY03-C102098_1.pep
MSANGQHGGEFFPGINKIQYNPKAAPTDTLVFRHYNADEVILGKPMHEWLRFAACYWHTFRGVGLDIFGGGTIKRTWDDGTQSVDNAKRRMRAAFEFFSKLGVKYWTFHDRDISPE

SEQ ID NO: 31686 - protein, 111 aa, Sorghum bicolor
  Clone ID: SORBI-28MAY03-C102659_1.pep
MLKSGFQRSLRAASPALRRAAFQPIRKNFAPSFAARYASTDAAKDGKIHQVIGAVVDVKFDTEQLPPILNALTTDNGGQKLVLEVAQHLGENVVRCIAMDGTEGLVRGSKA

SEQ ID NO: 31687 - protein, 72 aa, Sorghum bicolor
  Clone ID: SORBI-28MAY03-C102681_1.pep
NIIIHPEPQVQSKFQAYLKNTLPRLSGLPSLNSKASYIPEWSIVQRKNIKILHIDVKHMEFEATTESPFQTK

SEQ ID NO: 31688 - protein, 41 aa, Sorghum bicolor
  Clone ID: SORBI-28MAY03-C102677_1.pep
TVTIIYVQVCHSDFVINSQYVKLMVYWVNILTSESNINLSK

SEQ ID NO: 31689 - protein, 67 aa, Sorghum bicolor
  Clone ID: SORBI-28MAY03-C10269_1.pep
LRLLPVWASGIIFAAAYTQMTTTFILQGDTLDPYVGGFRVPAAVLSVFDTLSVMLWVPLYDPRGPCA

SEQ ID NO: 31690 - protein, 165 aa, Sorghum bicolor
  Clone ID: SORBI-28MAY03-C102683_1.pep
APRGLDEMDSVVSGANFLLQNIPGAAFTHMNGQRNPVDVSPNNLFPYLLVNIGSGVSILKVTGNKKFERVTGTHIGGGTMFGLAKLLTGCKSYDEFLQLSQKGDNFVLDLIVKDICGELVCQKQGLSTSTLASSFGKVITSEKKLTDYKPEDIASTLLSAFTYNI

SEQ ID NO: 31691 - protein, 116 aa, Sorghum bicolor
  Clone ID: SORBI-28MAY03-C102690_1.pep
MADRGLSQILSQLKQSPQMSYPEASALLSKAKLSLLSLNALTPTPSTPSNLLALARETYEQGALFSIRAKNADAFTRYVQQLQPFYELPSATLPPNLPERNRVTGLSLLLLLTQGR

SEQ ID NO: 31692 - protein, 69 aa, Sorghum bicolor
  Clone ID: SORBI-28MAY03-C102773_1.pep
HWFCSTFSKARYLNISNNQIGGGLPANMEHMSVERLLIGSNQLTGPIPPMPISLTTLDLSGNLLSGPLQ

SEQ ID NO: 31693 - protein, 103 aa, Sorghum bicolor
  unsure (1)..(103): unsure at all Xaa locations
  Clone ID: SORBI-28MAY03-C102786_1.pep
HGGSAWGAGTFAGADGSRQPTALELQIAETQGKAFYEAVAKVNHQXLYGSAESKPETPAPAAGAAAQKPQQPVQQQQQGNREAATDRDSEGGPCGLPKKCTIL

SEQ ID NO: 31694 - protein, 72 aa, Sorghum bicolor
  Clone ID: SORBI-28MAY03-C102807_1.pep
IIRTIDNMRSAFIVATFALSALAVPVPVAEPNLPSSIKAYVQERGLHRANDGSLTNTRDAQEDVLEVRSVKE

SEQ ID NO: 31695 - protein, 148 aa, Sorghum bicolor
  Clone ID: SORBI-28MAY03-C102810_1.pep
TRLYLGIFPKGHQIKSKSLVRRLKAEGLVNEGCKCFDELIDRCIVEPVQICNNSVVAKRCQVHSVVLEYIIQKSVAKNVVTLIQDLEPVLKGSTEACVRRLSIQSSTKERFDELDDDKSALRSLTMFNTEPCDLQKCKMLRILDLEGC

SEQ ID NO: 31696 - protein, 165 aa, Sorghum bicolor
  Clone ID: SORBI-28MAY03-C102484_1.pep
MATPITSRTETLQKYLKLDQKGMIMAEYVWVDAEGGTRSKSRTLPEKEYKPEDLPVWNFDGSSTNQAPGDNSDVYLRPCAVYPDPFRGSPNIIVLAECWNADGTPNKYNFRHDCVKVMDTYADDEPWFGLEQEYTLLGSDNRPYGWPAGGFPAPQGEYYCGVGTG

SEQ ID NO: 31697 - protein, 122 aa, Sorghum bicolor
  Clone ID: SORBI-28MAY03-C102823_1.pep
SDRKIAVKAGQVMLRPESPEKIGQKQQTWGVETRLHGYTRKAKVFPGVCAAADGVLERRPKGTRRGRGRPTEPLVIRGVENSQGLVVAQGENREEEDRLAGRERRDLRCQMHRRRRRWASCR

SEQ ID NO: 31698 - protein, 189 aa, Sorghum bicolor
  Clone ID: SORBI-28MAY03-C102829_1.pep
TRHECVAGRTNSHSAPVWCVDANQRRARAASDWAREAADSDQRLGNSRVRISSSLSRGLSKPHCRSRAIVWACVRVFVRCSVGRQHSIASSSCSDGWPSCLAASFKRSNSSWAYLYNHHSHSAGRSGLSRSASTNAASMRVWSTAWLLYRNKSCSDELTRSAAATARYVAEPSWLNDKPRDSTVELAAK

SEQ ID NO: 31699 - protein, 206 aa, Sorghum bicolor
  Clone ID: SORBI-28MAY03-C102839_1.pep
MHVPPKAVFFSQIFGSFIGVPINYAVIKWVINTKFDYITGATEDPTHQWTGQELASSLTIAVQYVLLGPKRLFEIDMFRPLPYGFLVGAIAPVFIYGLHRLFPKQKFRLWNTTIFFSSMSSFYGNISTGNFSSFVGGFIVMYWAYRYRYDMWARWNYILAAAFDAGFNLNMLLIFLFFGAGKVISMPNWWGNDAESSEKCYALDDS

SEQ ID NO: 31700 - protein, 190 aa, Sorghum bicolor
  Clone ID: SORBI-28MAY03-C102854_1.pep
HEAEIKKIKEANADDEEFPDEVETPLDVPAKKRFAKYRGLKSFRTSSWDPKEPVPPDYARIFAFDNFTRTQKHVFAKIAELDGGMKDCAQVGSYVRLYVKNVPTDIASKLCQPSRRIPVVVSGLLQHESKMSVLHFSIKKHDSYEAPIKSKEPLIFNVGFRPFTARPLFSSDNINCNKHKMERFLHHGRF

SEQ ID NO: 31701 - protein, 82 aa, Sorghum bicolor
  Clone ID: SORBI-28MAY03-C102875_1.pep
VPRLHAERPRTMNGRQTDKPPWKQLFCLNILFMADPPVPHLIYILQYMPIYISIFTRGRCYYHSTSTSTSLWSNHAVPFFLF

SEQ ID NO: 31702 - protein, 107 aa, Sorghum bicolor
  Clone ID: SORBI-28MAY03-C102903_1.pep
MSAKSILEADGKAIINYHLTRAPVIKPTPLPPSATHNPPSKLASLHFAQGADVKGVLDQAEATYPWLLASGAKFVAKPDQLIKRRGKSGLLALNKTWQEAREWIEAR

SEQ ID NO: 31703 - protein, 146 aa, Sorghum bicolor
  Clone ID: SORBI-28MAY03-C102902_1.pep
MAAAPAVRFPVFGLVRLLGLAAAAGILFWAVHYRGGMALSTDEESKLPLFNVHPVLMLIGLVALNGEALLAYKTVPGTKKLKKLVHLAVQFLAMFLSLIGLWAVWKFHDERKIDHLYTLHSWLGLTCFIFFSLQWAAGFWTFWYPG

SEQ ID NO: 31704 - protein, 153 aa, Sorghum bicolor
  Clone ID: SORBI-28MAY03-C102916_1.pep
ATGENDGARTYSGRQTIQRSSRQSQTTYTQATPAVNGDTDIQRDTRRRTAGGASGRGGSHEPATRTGPIRHPDEKRAEGKGATATCVPLSAAMALSAAKTINAGAGGASPRRHKGRREEGGEGDGGQAEPGVCGPGGRREGGGGRGAGGAGLV

SEQ ID NO: 31705 - protein, 56 aa, Sorghum bicolor
  Clone ID: SORBI-28MAY03-C102935_1.pep
NTMVGSRNSKRLPGQTEESRTNIELNRGLGRSRCGEKRWVGLSSSGRREAYCRCLV

SEQ ID NO: 31706 - protein, 141 aa, Sorghum bicolor
  Clone ID: SORBI-28MAY03-C102948_1.pep
ARGPSKESLAAATEFSEVGSISRTSEVDATLRKPTVYQSEDDDLKSKLKIKPNINLKMRKDMNEDLTNISLLQKPDVAKDTSNPEQDNASASPATVSATEDNSELEPESNGLDEKLVTENVYESSGLDDDSTAGLQPSGQT

SEQ ID NO: 31707 - protein, 96 aa, Sorghum bicolor
  Clone ID: SORBI-28MAY03-C103013_1.pep
HEAAAEFKKWLKQFDADGDGRISRRELREAIRRRGAWFASVKAWCAVRRADRDRNGFVDDCEMESLVEFAENELGFLISKEPTSTPNRRAQPPLRW

SEQ ID NO: 31708 - protein, 97 aa, Sorghum bicolor
  Clone ID: SORBI-28MAY03-C103020_1.pep
ALRILSHFSPRKVCEFREFPELPTFHERCVTLTCPLFTRPSSLAPSLASACSENALSLVRRTRTVQARSPSSQRDRCAKHPSKRPWPRSWMPAGTAP

SEQ ID NO: 31709 - protein, 131 aa, Sorghum bicolor
  Clone ID: SORBI-28MAY03-C10295_1.pep
MAMAPPTNDSEAPCTQRLPAEDELLQQQTPAASCGGDRAPAAGTSWTEPDHQQAEAEGAEKKSSSALAAGSGGGEPMAARRTEEISARERLKRRRTEMAGRVRIPDMWGQERLLKDWVDCAVFDRPLAGTT

SEQ ID NO: 31710 - protein, 257 aa, Sorghum bicolor
  Clone ID: SORBI-28MAY03-C103028_1.pep
MGDVVLSAFLQVLFQGIAHTMKEELKKSDCLEKERGLLTSKVEMIQAVLRGAENMQLSEPQKLWFGKLARGSYDAMEVLDKYLYEDHRRQHLSSVRNNKVSSAMNPKRQYFRITMAREIKDVAMRIDDLLKTAAGFKFQVEVHGQTSLQTQGSSSSSHPSSSFPPPDAHCRQEDHERIVEMLLSSDQNHKVQVLPIVGEACIGKTTVAQLVITDERILLHFKLRPWVHVSNEFNIRRITADIIESIEGSSPRFNNLD

SEQ ID NO: 31711 - protein, 150 aa, Sorghum bicolor
  Clone ID: SORBI-28MAY03-C103055_1.pep
HEGGIPRRLGRNGRLQLVDLSSNRLTGTLPPELCAGGKLETLIALGNFLFGSIPESLGKCEALSRIRLGENYLNGSIPEGLFELPNLTQVELQDNLLSGGFPAVAGTGAPNLGAITLSNNQLTGALPASIGNFSGLQKLLLDQNAFTGAV

SEQ ID NO: 31712 - protein, 111 aa, Sorghum bicolor
  Clone ID: SORBI-28MAY03-C103085_1.pep
QTNKRVLLLLSHGFYPVRRGGLCRDKSSARRCRLLASGALGLRCPQSGDGLAFHTSGRRSPRSFHAWGHRSRAPRRPAPRTVPQELGDGSVASHSAKKGHGGAGGGWGPRA

SEQ ID NO: 31713 - protein, 81 aa, Sorghum bicolor
  Clone ID: SORBI-28MAY03-C103237_1.pep
HLVVKVQLGWRSLMRAALLKPRAFKASISPLVQVVERPLILLMGSRPLIRVIGSASRPLMRLMGSASRPLMRLIGSASRPL

SEQ ID NO: 31714 - protein, 224 aa, Sorghum bicolor
  unsure (1)..(224): unsure at all Xaa locations
  Clone ID: SORBI-28MAY03-C10322_1.pep
TRVAYVGKRGIGKSPAPSLXEKVHDSKDPSAPEVDLPGAKVGKVCVRFAPEPSGYLHIGHAKAGLLNKYFAERYQGRLIVRFDDTNPSKESNEFVENVLKDIDTLGIKYDVVTYTSDYFPKLMEMAESLIKQGKAYVDDTPKEEMRKERMDGIESRCRNNTVEENLSLWKEMVNGTERGMQCCVRGKLDMQDPNKSLXDPVYYRCNTDPHSCVQDRLSHILAAI

SEQ ID NO: 31715 - protein, 146 aa, Sorghum bicolor
  Clone ID: SORBI-28MAY03-C103248_1.pep
ARGGIDLEHKHRKNKNRSSPKTEDPYLLLLVKLYRFLARRTGADFNRVVLKRLCMSRINQPPLSLIKLARFTKGKEDKIAVVVGTVTDDARLLKFPKLTVCALRFTEGARSRILKAGGEVITFDQLALRAPTGGNTLLLRGRKTAR

SEQ ID NO: 31716 - protein, 75 aa, Sorghum bicolor
  Clone ID: SORBI-28MAY03-C103262_1.pep
RLHPTAARHVASSSARRARLGTVRAQSAPAAAAALTHDDLKRLAAVRAVEQVQSGMVLGLGTGSTAAFAVAEIGA

SEQ ID NO: 31717 - protein, 149 aa, Sorghum bicolor
  Clone ID: SORBI-28MAY03-C103314_1.pep
MAAETTDLAPPSPPPPVAPTAAPSRPRLSGFEQLDGRVKELTSSQAELLERIQKLKQEVQNWRSNIETQVKTCQNELQGLKKGLDSEVEQLKSEMKAMRSAIQEEKGNLPAQITSLESNDDTEQAWQTQDQVLKVTTDASMEDQTATQA

SEQ ID NO: 31718 - protein, 171 aa, Sorghum bicolor
  Clone ID: SORBI-28MAY03-C103348_1.pep
HEALPMKEEHKLFLARALIPLHKPKSVGIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRGAIFPIIFEALERNIQSHWNQAVHGLTANVRKMFLDMDSEL

SEQ ID NO: 31719 - protein, 149 aa, Sorghum bicolor
  Clone ID: SORBI-28MAY03-C103362_1.pep
MGSSSEPLSRGLYALVEPYDSGFLKVSDVHTIYYEQSGNPQGHPVVFLHGGPGAGTSPGNRRFFDPEFYRIVLFDQRGAGRSTPHACLEQNTTWDLVADIEKLREHLDIPEWQVFGGSWGSTLALAYSQEHPDKVTGLVLRGIFMLRKK

SEQ ID NO: 31720 - protein, 127 aa, Sorghum bicolor
  Clone ID: SORBI-28MAY03-C103372_1.pep
MPICSPSSDSSSSSGSGSRAWVLHGLVLGAAAAAAAAAYLYRRPSGFRSRAVGIIPARFASTRFEGKPLVHILGKPMIQRTWERVMLASSLDHVVVATDDERIAECCRGFGADVIMTSESCKNGSER

SEQ ID NO: 31721 - protein, 245 aa, Sorghum bicolor
  Clone ID: SORBI-28MAY03-C103389_1.pep
ARGEDIKPQRNPGSGIMPTYSVGRAVLSDAVTLVRSDRFNTIDYTVSNLTAWGYNEVQQDYKTLGGSMLYKLIQRGVPHGVPFNSIAVMQPMYTKKANEQIAKEIGTFDQYTLDDPKAPPKVAVLTSGPAIKQILNNTKQYVVPWLKPLNTLFPGKKDFGWFMLAGDQPQNYTHRANFAKAMIKIPNMHNAVHDFIEREGAKLIKKETFTLKKGLDQIDIIRDVAIPLNTQLLADLFYFDLRTDE

SEQ ID NO: 31722 - protein, 79 aa, Sorghum bicolor
  Clone ID: SORBI-28MAY03-C103444_1.pep
TRLNLVDRLSRFGCCRLVPCPYITLGIFTCLHVQTMSTLGTSRNLCKNYSSSLLNFFYQYQFVYSLVCLSVNGYLSLEW

SEQ ID NO: 31723 - protein, 109 aa, Sorghum bicolor
  Clone ID: SORBI-28MAY03-C103461_1.pep
MDSHSSPSAAPPAAAEAGRYTYSPRLRWQPEVEEYFAAAYGRDHFARISEALAHPSCYSCIRVNTLKSSTDAVMHKLMDLVCENELSAAINGVEAVELNGGEQPHEGSS

SEQ ID NO: 31724 - protein, 156 aa, Sorghum bicolor
  Clone ID: SORBI-28MAY03-C103492_1.pep
ASGLLDAPKGATLPMSVFWLVPQYAIHGVANAFMDVGRMEFLYDQAPESMRSTATALYWLTFSIGSYLGTLLVTIVHDKTRRSGQWLPDNLNRGKLDNYYWLVVALEVVNLVYFFICAKYYTFKPLEMVSGEEVELHHHGNGNGTDDAKKQGASFK

SEQ ID NO: 31725 - protein, 183 aa, Sorghum bicolor
  Clone ID: SORBI-28MAY03-C10364_1.pep
IFVLAAGNVDNESLQVALVLTGLFLCFFGLLYGGFWRIQMRKRFNLPENNFCCHNPDASDCFQWLFCCSCSLAQEVRTADYYDITEDRSPTGQVTGETPRVMMSPLQREDGLALFKSSPSSPYRSGNASPSIFILESPSAPRRSSGSSPQGGSPTMGDRVMKAPAPSVLQREGGPDHGKGVIQ

SEQ ID NO: 31726 - protein, 94 aa, Sorghum bicolor
  Clone ID: SORBI-28MAY03-C103635_1.pep
SVTVEEHASYQHLRQKNGALYSLYLDFSTVVSHNNDQPATGIPWICKFEFLSAPKEEASSTLCHECRIDRCSNITSKHNATSTHQWRSYQKYIH

SEQ ID NO: 31727 - protein, 89 aa, Sorghum bicolor
  Clone ID: SORBI-28MAY03-C103658_1.pep
MSCGSGSTGEVEGGKSAAAMASWHESLAAPPRVLISHRPSDASSQGTVLSLQHPRSGDETGYLFIDGQLQEINWFKERYGAWFLGDYVC

SEQ ID NO: 31728 - protein, 121 aa, Sorghum bicolor
  Clone ID: SORBI-28MAY03-C103659_1.pep
RITRTQPRKFSTTSTPFPEVHTPAAMAEILPAVGAVAGVLRVTYQLITLAIESGQVSDEVRRSLELVRTCERDLQHLVGLREEYLDILERKPIELDRVNTIIRAAHQGLAEVCKIVEKCRP

SEQ ID NO: 31729 - protein, 181 aa, Sorghum bicolor
  Clone ID: SORBI-28MAY03-C103668_1.pep
ADDVVDRLYIHYDNSKARKDNLVKSLTPSFTPSLNKTTRRIVQRIANNRQNDYYDNPHHHHHHEFADAESVAMPNSARRNESSSSDMELLGILKQFNTMLKQKNEGPINLKQLNALMASCAEKRKGGRNHEDIEEQEENSDFEQDQDQDDSLNRRCETEPSQMTDSNVRNIERNLAQLQNN

SEQ ID NO: 31730 - protein, 231 aa, Sorghum bicolor
  Clone ID: SORBI-28MAY03-C10367_1.pep
SIFMDDFSSTKRNIIGHVSGWLLSDSRDDKIDDFVQEMEMTKFWPLERREAIAEVLLKNVDLKTKFHCPEKYENEERLADHKEQCSFRPVVCPNDGCRAKVSVRCMKDHDAACLYKVLQCEQGCEKKLLRRDMDRHCVTVCPMRPMKCPFGCDSSFADRDLEKHCAELLQDHLVKVLKAIHKKRSEEELKEIAQKLEKFDADGKLAKALDARPLTNLVKDLEAKMKGYHSS

SEQ ID NO: 31731 - protein, 289 aa, Sorghum bicolor
  Clone ID: SORBI-28MAY03-C10369_1.pep
QSVKLGPCLLGDAPKINVIPAGNEVNKEEGCSEGFPPIRIYDEDVNMKFLVCGAPCTLDACLLGALEDGLTALLNIEIRASKLQSRSSATPPLQAENLPHGVVTMRCDISTCSSAHVSFLVSASAQTRFDDQLLESRIKNEIIEKRQLVRALSNTEDNKPSYEPLPSMCVACGASTFEVWITLPKWAAQVLKQLAPEICYRSLVALGIAWVNGTPVSSFDRQDADRLLFFCSNQCKDKAIQNVSYAHLSSWSASLTKDRTTGSIESKQMSFGAKGVGGDNKMSLSSLKP

SEQ ID NO: 31732 - protein, 166 aa, Sorghum bicolor
  Clone ID: SORBI-28MAY03-C103740_1.pep
TRQETQFWQVASAMLDYIMGIPNILAWGNVLNATCSAVKHFCSHAPRISWRLQTDKWLSLLVSGGIEGFKNSEICLIDLFCTMLNHSEPEQRSVAVQQLGRIINKTSSTEADLKYPNYDQNFLISGSTVTSLLVTHTWDRVAALALHDSSMLLRNHAMALLTEYVP

SEQ ID NO: 31733 - protein, 114 aa, Sorghum bicolor
  Clone ID: SORBI-28MAY03-C103748_1.pep
MRPPEVAVVAVAALLLVAAAAAAESAAPLPAALRLERAVPHKGVALEELKRRDAARHRVSRRRLLGGVAGVVDFPVEGSANPYMVGLYFTRVKLGNPAKEFFVQIDTGSDILWV

SEQ ID NO: 31734 - protein, 169 aa, Sorghum bicolor
  unsure (1)..(169): unsure at all Xaa locations
  Clone ID: SORBI-28MAY03-C103779_1.pep
TRVILNRRFIEYCILAWENLPRILLMYFHNVIQPQEGYFQSVICNSLDFRNFTVNNDLRFMVRDDSAEAKPLFLSREHYGHMVDSGAPFARPFQENDPLLDQIDSNILKRWSHGTVPGAWCTGRKRWFSDPCSQWGDVNIVRPGPQAVMLQQYVNRTLEEAXSGSNSCR

SEQ ID NO: 31735 - protein, 175 aa, Sorghum bicolor
  Clone ID: SORBI-28MAY03-C10381_1.pep
TSPTLQLQLQLHRRHGHLPQQPQAARRARWPRLQVAAAAGGGSIKAATDAEFFQPSDTRPIMLFDGVCNLCNGGVRFVREHDPNRSIRYIPLQSESGRKLLQRSGRSPDDISSVVLVEKDRSFIKSEAVLRIMEYLNLPFPQLAIFLNFIPLFLRDFAYDNVANNRYAMFGRSET

SEQ ID NO: 31736 - protein, 55 aa, Sorghum bicolor
  Clone ID: SORBI-28MAY03-C103814_1.pep
MLHAHGSQQALAATQFSGLQPADVLGDLGDISTGFASAFLLIFFSELGDRTFFIA

SEQ ID NO: 31737 - protein, 122 aa, Sorghum bicolor
  unsure (1)..(122): unsure at all Xaa locations
  Clone ID: SORBI-28MAY03-C103820_1.pep
MLDDNMCIKIFFMIASNKLLFPSSDNNIRAKDVYLARNLSRLPTMNWCKAVTDEIQEAARTWRLDRTTKVSPSITGCAFFLLXVYLDNLRCKHQINHKDIPRAKYFNQDLIKKIIAADKTKD

SEQ ID NO: 31738 - protein, 165 aa, Sorghum bicolor
  Clone ID: SORBI-28MAY03-C103847_1.pep
AAAASSSDSDSSVQDLLALIYFGSLFDVKQQSDFVSLVYASELERSSCITYDYVGDEPEDSLAETDLNAVSALASLAAARPPAAAGVSHRDALQACAHHARLWLRRADEPIHPDSTVTYAGVRAKLDRIMASGYYTAQLEMRPPLDLAAAVASFGAGGAQMQESM

SEQ ID NO: 31739 - protein, 147 aa, Sorghum bicolor
  Clone ID: SORBI-28MAY03-C103876_1.pep
MEEIAPEYDVIVLGTGLTECILSGVLSVKGRKVLHIDRNDHYGGEAASVNLETLFKKYGNFRDGEEPWKQYGRLNDWNIDLVPKFLMSSGELTNILVSTDVTRYLEFKQVAGSYVQQGASAKATVAKVPSDAAEALRSPLMGIFEKR

SEQ ID NO: 31740 - protein, 120 aa, Sorghum bicolor
  Clone ID: SORBI-28MAY03-C103919_1.pep
KFEGRGKETMALLNSPHPHKVVHRCQAHLARSTHSEGSHCLHVVDKNPAPRAAVLDVVLVVRGGRGSTALVALDDLDRLEHLVVATSTSCACPPPGEGAPPMTRTQPRESTTSALHKSRA

SEQ ID NO: 31741 - protein, 129 aa, Sorghum bicolor
  Clone ID: SORBI-28MAY03-C103931_1.pep
ARGQPLADSLNGRGFKTVITTISSTGKTPPDSPNMDDDIANIAKDLAPVVEEAGDEGVVAVMHSAGGFIGSGALKGLTSQARQDSGKAGGVKKIIFITAGVAPEGYEQGPMEFFDYHVRPSISFSCPCF

SEQ ID NO: 31742 - protein, 118 aa, Sorghum bicolor
  Clone ID: SORBI-28MAY03-C104056_1.pep
MSSFEQVVVIDGKGHLLGRLASIVAKQLLSGQKIVIVRCEALNISGEFFRAKLKYHAHLRKITRYNPTRGGPFHFRAPSRIFYKAVRGMIPHKTARGAAALERLKVFEGVPPPYDKTK

SEQ ID NO: 31743 - protein, 204 aa, Sorghum bicolor
  unsure (1)..(204): unsure at all Xaa locations
  Clone ID: SORBI-28MAY03-C1035_1.pep
PTRSAVYVPFLVDDLAQFLNTYSSPDFAGFSCTIPHKEAAVRCCDEVDPIARDIGAVNTIVRRPDGKLVGYNTDYVGAISAIEDGIRASEQTDSDTSPLAGRLFVVIGAGGAGKALAYGAKEKGARVVIANRTFARAQELGNLIGGPALTLADLENYHPEEGMILANTTAIGMHPNVNETPLSKQALKSYACXFDAVYTPKETR

SEQ ID NO: 31744 - protein, 77 aa, Sorghum bicolor
  Clone ID: SORBI-28MAY03-C104141_1.pep
LLAKSFCTFPPNCVFELHISSPYIGIRLLSLITSSVVLKGCHPSNLPSEQAVAIQNLRRGTPLCHQRIVYYTNQASC

SEQ ID NO: 31745 - protein, 197 aa, Sorghum bicolor
  Clone ID: SORBI-28MAY03-C104108_1.pep
ARGAARAAAPRPQLSPLSGGGGATISSLTLQTLAFISPLPTRRRRRCVLRSNASSSPSPPPSQEKEAAAEVVPTAESCVNLGLQLFSKGRVKDALEQFENALELNPTPVEAQAALYNKACCHAYREESKKAAECLREALRDYNLKFGTILNDPDLAPFRASPEFKELQEEALRGGEDIGSGFRRDLKLISEVQAPFR

SEQ ID NO: 31746 - protein, 177 aa, Sorghum bicolor
  unsure (1)..(177): unsure at all Xaa locations
  Clone ID: SORBI-28MAY03-C104151_1.pep
CWQYNMALTALPSEEXFEHLTKPRGLAVRGCWCLRSLGGSHAAPSLSRLYCIDCPSLDLAGAVESMSFNLAGDLYICGCILAADSFINGLPHLKSLSIACCRSFPSLSIGHLTSLESLSLLRLPDLCSLEGLSSWQLDGLSLIDVPNLTAKCISQFRVQKWLSVSSFVLLNQMLKAE

SEQ ID NO: 31747 - protein, 87 aa, Sorghum bicolor
  Clone ID: SORBI-28MAY03-C104164_1.pep
MSSSASSAGGETAGEFTEVVIVRHGETSWNASRIIQGHLDAELNDIGRQQAVAVAHRLSKEVKPVAIYSSDLKRAAETAQTIARICN

SEQ ID NO: 31748 - protein, 113 aa, Sorghum bicolor
  Clone ID: SORBI-28MAY03-C104233_1.pep
MAAAAPVAPGSGCLSRPRHRPPWVRLRGARVAAAAAAAAEGPSCLFVGPIETASQEKLEALYHQARDSYYSGQPLIVDDMFDKVELKLRLYGSKSVVKYPRCSIIRQSTYADA

SEQ ID NO: 31749 - protein, 113 aa, Sorghum bicolor
  Clone ID: SORBI-28MAY03-C104275_1.pep
PPVGRSAAAAATGGEEGSGGARVRVASPLAVPLRSRCGHGREVVGGRKLLGFGRHASSPPLLFIELLLPPPLGGWRAMPCLPRCGGGCLFLPLRERRMPFLIAPGALRLRPRA

SEQ ID NO: 31750 - protein, 275 aa, Sorghum bicolor
  Clone ID: SORBI-28MAY03-C104278_1.pep
MTVEDVKLQAAKANGGGHGAKDQFPVGMRVLAVDDDPTCLKLLEKLLQHCQYHVTTTGQAATALKLLREKKDQFDLVISDVHMPDMDGFKLLELVRLEMDLPVIMLSANGETQTVMKGITHGACDYLLKPVRIEQLRTIWQHVVRRRSCDAKNNGNDNDDSGKKLQVVSAEGDNGGGNRNKRTSRRGRDDNGDDGDDSDENSNENGDSSTQKKPRVVWSVELHRKFVAAVNQLGIDKAVPKKILDLMNVENITRENVASHLQKYRLYLKRLSADA

SEQ ID NO: 31751 - protein, 116 aa, Sorghum bicolor
  Clone ID: SORBI-28MAY03-C10437_1.pep
MGQAFRKLFDAFFGTSEMRVVMLGLDAAGKTTILYKLHIGEVLSTVPTIGFNVEKVQYKNVMFTVWDVGGQEKLRPLWRHYFNNTDGLIYVVDSLDRERIGKAKAEFQAIINDPLM

SEQ ID NO: 31752 - protein, 137 aa, Sorghum bicolor
  Clone ID: SORBI-28MAY03-C104373_1.pep
RKLAPKLVFVLPVVLLGLVLQAILRPPPPKLCGSPGGPPLTSPRIKLRDGRYLAYREDGVQKDKARYKIITVHAFDSTKDFPLPVSKELVEELGIYILAYDRAGYGESDPNPKRDVKSEALDIEELADQLGLGQKFY

SEQ ID NO: 31753 - protein, 245 aa, Sorghum bicolor
  Clone ID: SORBI-28MAY03-C10375_1.pep
VGLQLAVSFSGEGSILAIGGEDGHLRVWKWPAMGSVLTETDTKTSIKDLTISSDEKFLAVNRSSGPCRVWDLQSSEVVASLSREAGEIFGFCRFCNKTDNSHVLFITVMQGDYGKIVSWNTTSWTRIGSKKITREAISAFAVSPNGALLGIGTIEGSIIILSSKDMRTLVTVKKAHLGIVTTLAFSQDSRTLLSTSFDSSARVTSVGSPKSNGTSIWPMLLVIILAILVYYCMQHKEDILAMLPR

SEQ ID NO: 31754 - protein, 87 aa, Sorghum bicolor
  Clone ID: SORBI-28MAY03-C104484_1.pep
HEGIVGFFVWSCSLLFLAAVPCCLTRLSGFSISVFECFRSSLKLHKFIKFCQKSGNILRYFNMRYCFFLLIFRPKQNFDTICDYNIY

SEQ ID NO: 31755 - protein, 159 aa, Sorghum bicolor
  Clone ID: SORBI-28MAY03-C104469_1.pep
TRLKAWIACMYGNLPKAIVTDYCRGIQSAVAEVIPGVRHRMCLFQIMRKAAERLGGLSEYRAINKAMHKAVYDSLTIDEFEGEWNTLITYSGLQGNDWLRSLYECRSSWVPVFIKDTFWAGMSATQRNETITPFFDGYVDLKTTLKQFLGKYEMALQSK

SEQ ID NO: 31756 - protein, 171 aa, Sorghum bicolor
  Clone ID: SORBI-28MAY03-C1045_1.pep
VQIARYTAMVVLPILFLLLGSPTSRAADEELELTVVDVSLLQEPRASCSGHRVMPPHPYNNSWVPLFRPLGPCSPSFKAAAAAAARTKPSLADVLRQDRLRVHHIHRRVSGSSRGARASKGSFKEPVSVEETQLHHQAAISVEVGTSQTSSEPSSGIHPAAATDGSSSPPV

SEQ ID NO: 31757 - protein, 148 aa, Sorghum bicolor
  Clone ID: SORBI-28MAY03-C10451_1.pep
RAQSLLPKFQSPIHRPRFHKAHPPPPPEHHRRPISRPPTPSPALPSLQPSLQPPLRCPCPRPPGTASTGAAATGTGTVTCGREGSPPSHGERGSAAEGGGVLLLLFDSAKARRQVGYSVERDEVWDMAPGRTGDTKGDDRVIELSRLC

SEQ ID NO: 31758 - protein, 124 aa, Sorghum bicolor
  Clone ID: SORBI-28MAY03-C104542_1.pep
HEAFLEENNVDLANVKRCSVDDDEYPSFKKPAAAAAEAPAPVASTEEGDAHAEAEAEQPPVVELPAVDIVKEEATDVQEPAKMMMASRRPSFKWSTPTGARIGCLQNYPADVQSMALEQVNLSP

SEQ ID NO: 31759 - protein, 105 aa, Sorghum bicolor
  Clone ID: SORBI-28MAY03-C104545_1.pep
DHNCTCLLGRAAVGMSNKRREQDGQNPRVAGGGDKKPRRGREHLYLLLDDWDKGFSIHKIDADSFDTTTNDGLQSGVAGHLPEPPALRLESPAGHVPRNGMSFAA

SEQ ID NO: 31760 - protein, 210 aa, Sorghum bicolor
  Clone ID: SORBI-28MAY03-C104584_1.pep
SSDCSDVPIIKALQRGVRVIELDMWPNSTKDDIHFLLGRTLTTPVSLIKCLISIKEYAFVASPYPVIITLEDHLPSELQEKVAKMVLDVFGDILYYPPDSDHLKEFPSPEQLKGRVLLSTKPPKEYLEAKADDTMKEGDADLHLAKGANDDAAWGKEVPDFQTEIQSAKKHDDDAPGHQREDDDDDDDEEEEPEMQPHLAPQYKHLITIR

SEQ ID NO: 31761 - protein, 166 aa, Sorghum bicolor
  Clone ID: SORBI-28MAY03-C104642_1.pep
MVMEEAVDGEMSLSNMVLGFMEDFERDHQRRLENDDDDDEGSSGGDTAESKAFWQTQHSQLHEALAKTSPAESRIRADTEEAVKSMRAAAACSCTGRGRPAARDCRLCMLRHVADRLRDAGYNSALCKSKWTRSPDIPSGELRSARRVVLARSSFYCTCTSSPVFR

SEQ ID NO: 31762 - protein, 161 aa, Sorghum bicolor
  Clone ID: SORBI-28MAY03-C104735_1.pep
RPPPAPLCTAFFERFFSFYFSFSLGFHSSPTPPPHPLPFRRRFRSRANPLTTAEPSPKETLAQPPITAAHSMASPARPTAASVSGAFGLSPDPKRCSFDQALRQKDFQENRLLMSFVNFHEQEKISKEIVTDAIESCMKKQADNLLNSLEVISGRLSQLEL

SEQ ID NO: 31763 - protein, 183 aa, Sorghum bicolor
  Clone ID: SORBI-28MAY03-C10407_1.pep
KLLYHSSLHGQSFNTFLGKVTNGDAQTVLIVKDREGSIYGGYASQPWERHSDFYGDMKTFLFKLYPQASIFRPTGANRNLQWCAINFSSENIPNGIGFGGQPHHFGLFLSANFDQGHSFTCSTFTSPPLSKTNRFRPEVIECWGIQMRGAQDEKLELVKGTVLERFKEDRNMLKMVGLANASD

SEQ ID NO: 31764 - protein, 171 aa, Sorghum bicolor
  Clone ID: SORBI-28MAY03-C104821_1.pep
MAMSDLTATMIPKPDEADDDESVEIREGWADNLEEEFALIRDIVDEFPFVAMDTEFPGIVCRPVGAFRSPADYNYATLKANVDMLHLIQLGLTFSGPRGELPALGAGRRRCVWQFNFREFDDARDIFASDSIELLRRSGIDFRRNAERGVDARRFAELLMSSGVVLNDSVY

SEQ ID NO: 31765 - protein, 147 aa, Sorghum bicolor
  unsure (1)..(147): unsure at all Xaa locations
  Clone ID: SORBI-28MAY03-C104787_1.pep
ADADASEYDAVTGCLKEPNEIATLHNSLLRDAVDEXELRAEHPDVAVVHTDLFNHVTEMVMSPEQFGLERDVLTACCGGSGRYHYNLSVACGDDAATVCEYPSKSLFWDGVHLPEAPYHYIAKDWLNTILSSVSADARATIMAYASI

SEQ ID NO: 31766 - protein, 355 aa, Sorghum bicolor
  unsure (1)..(355): unsure at all Xaa locations
  Clone ID: SORBI-28MAY03-C104858_1.pep
ARGFARYLTGSYRRPQSDTASILSKKDTADGDDAASVKETESNDDLPLKDKDLTNAVLELNSYLAGTRARLQRVIDPVTGNLKPQSDRNGSTEEIAEKFLRIGLDDSEKKLEEELRNTFRLVDTTLFRAYMFSRPTLASSLFRIPNFCDPNVVNEKLLEHNRYTELVDFFYGKRLHXEALELLRRFGAAQEPDEAAPTLHGPQRTIQYLKNLPPSEIDLILDHAEWTLKASPDEAMEIFTGDTENAETLPRERVVSFLHDVDTQLEGRYLEHIISELEDMTPDLHDRLVELYVENLKKMDKGDKWDEMMTHFIEFLRQPGQVYSLSRAFRLIPRDDPVFYEAQAVVLSNMNQHKQ

SEQ ID NO: 31767 - protein, 174 aa, Sorghum bicolor
  Clone ID: SORBI-28MAY03-C104999_1.pep
LPVRLSTNRIIELVQLRDITRPVILAGSKASVTRALQRAERYRTELLKRGVLLIPVIFGASQKDQTKPRGFGTRRAAASVPSVGGDFEKRTESIAAKSRLKSEVRFKADIVSPEQWESWIRDQQESEGVTPGEDVYIILRLDGRVRRSGIGMPNWNDILQELPRLEDLMSKLER

SEQ ID NO: 31768 - protein, 234 aa, Sorghum bicolor
  Clone ID: SORBI-28MAY03-C105018_1.pep
HEGESRLNKIKDFMQKMEKENVWTLDVRQATSETILESIDMKCIFHCPEKFDEQDKLADHRSQCKFRVVDCKNDGCSISLSAIRIEEHDSICPFKALPCVQLCEQHVMRCEMEKHCATVCAMKLINCPFYHVGCETAFPQGNLENHCSKLLQTHLLYVLQASTRQNAAVNDMNQRLQLLEKAQSLNEISGALDVRSLTLIIKEQEAKIKNLESGIKVQEAKVKKLENEFRSRNA

SEQ ID NO: 31769 - protein, 226 aa, Sorghum bicolor
  Clone ID: SORBI-28MAY03-C105082_1.pep
VSVFRCYTCTNISITVYFLVRFQYSTLNQNLFVSPVLPLHEPMGNEMALPIPCIYSQYWVSHLSVNRMPKIQRGIQRASKTPPSLRSLQSISAQKTSVPGAHLFLFLCCTSGQLPVCTLISCNLKVGKIVVSPNSGSFLPCVYQEAVLLLYFFDLLTQCQAQNQTGTRTSASLQVHNGSLQLQCYILEAVCSKVCCPAALSHSSELFGSKHCHCAFQHLDKMVLPH

SEQ ID NO: 31770 - protein, 68 aa, Sorghum bicolor
  Clone ID: SORBI-28MAY03-C10505_1.pep
HRLTLCHVAKVTHLIGSRSFVNVSVIKGNIFLFLWECVVCVLYTVFALFSTYMCSTQKWDNNRLNENS

SEQ ID NO: 31771 - protein, 80 aa, Sorghum bicolor
  Clone ID: SORBI-28MAY03-C105102_1.pep
WIAAPLVAVGLPRRGGARSCSGPGFVGRWSGKRPCLCRLPFWVFDLNRGDSGLVRVPRVAIFPRVHWIVIVGYLAPVSGS

SEQ ID NO: 31772 - protein, 189 aa, Sorghum bicolor
  Clone ID: SORBI-28MAY03-C105122_1.pep
GGANGTDSLALAFRSDSAQPIAFFEDGFPGSSLAAALLLNILLPAVTSPPSPDTPPVDHRMLTVIMCVELVVAFGVALSCVFLSVYFVANRPREKRPARASTAETRRSKRNTREPRSDRSDSLSGALSSSVADSQSSFGSSADLEEGLLSEEEDQAYGSFNRQRATQGASSPGGTWQVVKEALASISPW

SEQ ID NO: 31773 - protein, 80 aa, Sorghum bicolor
  Clone ID: SORBI-28MAY03-C104391_1.pep
ARGKQVAFNPTTTRHSTSHQKLRYTYTATRTTLLVAHSKMIGDELDSEVVVRYFRGKSILITGSTGFLGKGTVPLFFMHE

SEQ ID NO: 31774 - protein, 278 aa, Sorghum bicolor
  Clone ID: SORBI-28MAY03-C105185_1.pep
MSQLPEALALTQEDARMMLACNVHIGSTNLDSAMERYVYKKSSYVREKEREGAYIIDLRKTWEKIVLAARAIVAIENPLDIAVVTVQGTGEPLAQRAVLKFSQYTGAAHYAGRFTPGTFTNQIQKQFAEPRLLIVADPLKDHQPIIEASYVNIPVIGFCNTDSSLRHVDIAIPCNNKSRFSVALTFWLLAREVLRLRGTISRSEPWDVMVDLFLMRSAAEQEKAQSQAQASQQVQSQQQASYDEFIAKGTATGTGIVGASTNWADTHEDADEPPADYE

SEQ ID NO: 31775 - protein, 149 aa, Sorghum bicolor
  Clone ID: SORBI-28MAY03-C105200_1.pep
NAPVHHISFVFCRLSRSQNTQYIGSGFRKRMVEELVRYHHRSCTCIISSTTYVHAKGFNLPCRKWRSRAERIDQTPAPTSRALLSSLASSVPGKNRRPEQEDSMGRGAGAGDATAAPIRSLGAALTATATIWIQSTDPPPPPPPAAAAC

SEQ ID NO: 31776 - protein, 116 aa, Sorghum bicolor
  Clone ID: SORBI-28MAY03-C105211_1.pep
MVNHRVTYRRRNGWNTRSNTTRTIRTPGGELRVLHIKKRGTVPKCGDCGSKLSGIPALRPREYSQISKPKKTVQRAYGGSRCGNCVRDRIVRAFLIEEQKIVKKVLKEQEQSQKKK

SEQ ID NO: 31777 - protein, 214 aa, Sorghum bicolor
  Clone ID: SORBI-28MAY03-C105209_1.pep
MAFFPRNFYNSDASFTPLFRLLDDFDSYSRQGQQNGGTRRSGLTHWQPKFDVRETGEAYELHGELPGMNKENVHIEFTEPQTMTIRGKTERTYTAGTPPAGLVEGSQSQGAIAEGESNDENKNSHHAKVEDEAEAKAHESTEVTHHQQSKEVEKKPGDQSKYWLTERTFGEFSRSFNFPTRVDQDNVSAKFKDGILSIVVPKAKKHESRRINVE

SEQ ID NO: 31778 - protein, 126 aa, Sorghum bicolor
  Clone ID: SORBI-28MAY03-C105236_1.pep
HEAPVLRNTHELSIVELEREVASAAKKARDGKLTMEDMEGGSFSISNPGIFGSMFGTPVINYPQAAVFNMNGIRQEVVAIKGEAVIRPMMYISLTYDHRLIDGREAVTFLNTVKKYIEDPSRMLLV

SEQ ID NO: 31779 - protein, 157 aa, Sorghum bicolor
  Clone ID: SORBI-28MAY03-C105250_1.pep
ITIASRHTNNPRRHFHLSNRPRNKNRRRSLFHHIRVTKHRNRLTKEWDRLSQRDGLFMARLVGPKTIEERSVANGRGPGFGSTGRDDGFLELGRGVVGGQRGLGPFDGPGPKVRPGNDGCGCEACEGGKGDGRELHYELLLNWYTLRVCASGIDPRA

SEQ ID NO: 31780 - protein, 70 aa, Sorghum bicolor
  Clone ID: SORBI-28MAY03-C105259_1.pep
LMGTRTTNLTLRIQKIARGSEDHHACVTGDVRELRWMECTWYYLQWWAVLDRFTAAAAYHHHARAANHHR

SEQ ID NO: 31781 - protein, 293 aa, Sorghum bicolor
  Clone ID: SORBI-28MAY03-C105276_1.pep
ARGSLYMFNAGAFSSITDGNKSTVDGHGLGKLTEDAFVHHFQISPQNPMVGVASRIELLNNFGKSLLSIPEIFGETGRPGLLVDYLLKDGKDKELNYEALWSILQRILLPAWSSNRPRINDQPIGDAWPLRVLQDKSGDSGNPTAGIHPFHKLTQWLGYSLTVPFMKVLKLKWINIETGTGLPEYRNGGLFVDMGVLKLKPEVLSKGIEASGQALPLFSSTGDVIVEWRAMTVALLDELHKLVNNILAPQGVSLSLPQLLEAGSWKSGRELAAKYRPETRSSPILIDGDGTLF

SEQ ID NO: 31782 - protein, 169 aa, Sorghum bicolor
  Clone ID: SORBI-28MAY03-C105301_1.pep
ARGVPNANKTDKASMLDEIIDYVKFLQLQVKVLSMSRLGGATAVGPLVASMASEGNGNGNGTSDSGNGNAANGENGGGSLQVTEQQVARLMEEDMGTAMQYLQGKGLCLMPISLASAISSATSSSLLSRPSMGAMGGARGPLHDGGSPASPPLVNGGDDSRTIKDGGKQ

SEQ ID NO: 31783 - protein, 136 aa, Sorghum bicolor
  Clone ID: SORBI-28MAY03-C104779_1.pep
HRFLFHIETKTYWWNTAHYLLHGCHHKHPMDSLRLVFPPTATAILCFPFWNLVAFFATPSTTPALFGGGLLGYVMYDCTHYYLHHGQPSTDPAKHLKRYHLSHHFRIQDMGFGITSSLWDAVFGTLPPSMTPGKKN

SEQ ID NO: 31784 - protein, 279 aa, Sorghum bicolor
  Clone ID: SORBI-28MAY03-C105324_1.pep
MLPSSMRRVVSSAVSSTPQTGVVSVLASATSKTTPVFVRNQQRRCSSSKPSKSDNGANEISAGQSVPAATSPKSGNEKRKRKSSKDASDRAASMRKLPSVPNTHHMSQEALGLSSFFSLHRPISVTQTMPRAVSDEHFASIFASRTRSNKMADTDSTLSSAIEQLEGPMAQMTIGGGHEGQEGMHKVDIKNPDGTESSMYLQIDTMSGEFLPFRPPPLPQPQAAGQADSAVADIEAAEDVPQHRMYKALFTIEESIDPDGQVRIMAHSPQIVQDNQPRS

SEQ ID NO: 31785 - protein, 241 aa, Sorghum bicolor
  unsure (1)..(241): unsure at all Xaa locations
  Clone ID: SORBI-28MAY03-C105325_1.pep
MKLNIANPTTGAQKXLDIDDEHKLRAFYDKRMSQEVEGDILGDEFKGFVFRVSGGNDKQGFPMKQGVLTNSRVRLLLSKGKSCYRPRRXGERKRKSVRGCIVGPDLSVLNLVVVKTGENDVPGLTDVQVPRRLGPKRASNIRKLFNLTKEDDVRKYVIRRKFESKTGKKNDKAPKIQRLVTPRALHHKREILAAKAAQREKVKREAAEYSRLHAQRVKEQKERRASEVAKRRSSRKSSVKA

SEQ ID NO: 31786 - protein, 120 aa, Sorghum bicolor
  Clone ID: SORBI-28MAY03-C105347_1.pep
NFNDYPSGMVTLFNLLVMGNWQIWMESYAHLTGSSWSLVYFVSFYLISVLLLLNLIVAFVLEAFFAEMELEKAGEADMQDSPPEGRNKRRSMRVRTKGTMVDILLHHMLSLELDGSQNSD

SEQ ID NO: 31787 - protein, 133 aa, Sorghum bicolor
  Clone ID: SORBI-28MAY03-C105369_1.pep
GPIYYQKLKHMVLDKMHARASGPRVLLTRQPTEGRSRDGGLRLGEMERDCLIAYGASMLIFQRLMLSSDPYQVQVCRKCGLLAYYNHKLKTSYCSMCKNGENMAKMRLPYACKLLFQELHAMNVVPRLKLTEV

SEQ ID NO: 31788 - protein, 120 aa, Sorghum bicolor
  Clone ID: SORBI-28MAY03-C105377_1.pep
TRLKPLPAIFPPGLAADPGNRGVLHTLWARQRLAAIDREVADELRNNAEGVGVEMALAERQWILDTFINTPQLPSDSIPLSVATRSPTGRLGDKLKGLKLATSPADLTPSTTANTFMSPD

SEQ ID NO: 31789 - protein, 200 aa, Sorghum bicolor
  Clone ID: SORBI-28MAY03-C10541_1.pep
NIDQATGERQYLSAGASALPSFYFLFCLAYAGLAAAWVAILLRKRAAVFRIHYFMLAVLVLKALNLLAEAEDKSCIERTGTAHGWDVLFYIFSFLKGISLFTLIVLIGTGWSFLKPYLADREKKVLMVVIPLQVVANIAQVVIDESGPYARDWVTWKQIFLLVDVVCCCAVLFPIVWSIKNLREAARSDGRLPEPMKLHS

SEQ ID NO: 31790 - protein, 72 aa, Sorghum bicolor
  Clone ID: SORBI-28MAY03-C105416_1.pep
FTVASLLVEISARVEGVVDAVDELATLASFKQVDDDDDDADKKGETEMTIKVHPLNEPDTDEESPENKTRKA

SEQ ID NO: 31791 - protein, 96 aa, Sorghum bicolor
  Clone ID: SORBI-28MAY03-C10542_1.pep
YRVTAKEEKCGWEILMQRCMPRLKTSEAKPISKFWSYSKHPHTHPHPHPQINLNLKAWNQIAWQMTAQFQTLFCSYTKKKLTNEASYGSLHSSRWW

SEQ ID NO: 31792 - protein, 222 aa, Sorghum bicolor
  Clone ID: SORBI-28MAY03-C105471_1.pep
ARGRVVLTSSAGSVIVRPELQGDGHVLDEESWSDVEYLTANKSGLWAYPVSKVLAEKAASRFAEEHGISLVTVCPVVTVGAAPARSARPSVLNCLSLLSGDEAAFGALRAMEMSGMLALVRVEDLCRAEVFLAEEEAAAAGRYLCCGLNTTILQLARFLSEKYPQYTVKTNLLAGELLEKPRVCLSSAKLVGEGFDYKYKTLDGMYDDMINYGKALRILPGK

SEQ ID NO: 31793 - protein, 90 aa, Sorghum bicolor
  Clone ID: SORBI-28MAY03-C105474_1.pep
DSTTTVTHTRTLTSVGGAGTYKVSTALAAAKGVAVDVEPAELEFTKVGEKKSYTVKFTSKSQPSGTTGFGRLVWSDGKHSVASPIAFTWT

SEQ ID NO: 31794 - protein, 100 aa, Sorghum bicolor
  Clone ID: SORBI-28MAY03-C10516_1.pep
AVPSDLVVSVAAFASYDARTDDDGVQQRPPRAGSRRRQPQVLPAAEDRGRRRLEEQQRIAAAGSWEAPGRGGQQRRLVGGDLASQRHGYWLKLGEGLLIA

SEQ ID NO: 31795 - protein, 299 aa, Sorghum bicolor
  Clone ID: SORBI-28MAY03-C105504_1.pep
TRYASLIQLLSTAKLPKKAIYYLEKMKVVKLLSDCIPYSVVISSFAKIGDLRMAEYLFREMVMSGVRPDVFVYSILIDAYAEVGNVQQASAYFGLMKKDGLCENVTIYNSLIKLYTKVGYVAEARETYKLLKSLDANAILYASNCMIDLYSDHCMVKEACEVFEGLKVRGIANEFSHAMMVCMYKKVGRYDVAHRICKEMQALGLLTQLLSYNSVIQMYASGGRMEEALKIFKKMLASNTAPNDATFQALKVILVRSGVTKNETRKLELLRRNNTHDCLRQWYRALSYSCKIQVQILFT

SEQ ID NO: 31796 - protein, 205 aa, Sorghum bicolor
  Clone ID: SORBI-28MAY03-C105523_1.pep
TRIVWSQILPTAGAMVPNQAQVFAQTLDWYLSPAGEKYRPELARIAALETGDETDALLLGYAMEGIRMAGTFGLYREATGPDTIHEDDGRSIPVNAGDRVCVSFVQAAQDPKIFPNPGVVDPKRPLDKYIHYGVGPHACLGRDISQVALTELFRAVFRKKGVRRVPGAQGELKKVPRPGGFFVYMTEDWGSIWPFPTSMKITWDE

SEQ ID NO: 31797 - protein, 112 aa, Sorghum bicolor
  Clone ID: SORBI-28MAY03-C105641_1.pep
TRRWYTFPLGCLESGFEVPINLHFASMSPIHRYTRHLLANSKPAASFPCQYLMFYLARHWEIVQNAISMICQLIIGSSPSHLNYTLSPVTQSQSPTQKSSTHYQSMKYPAPR

SEQ ID NO: 31798 - protein, 137 aa, Sorghum bicolor
  Clone ID: SORBI-28MAY03-C105671_1.pep
HEAATSYPVRHFLWPDGTASPRFSRGVSLLPSSSSSGACPYLAIRSCSHGTFLSRGPITYLGCRPRALSVPRRAATATATAVAAGYVLPAWRTGLASRVAVSASPTFFSGCASIVQPPEHQDVICCLKSYRWQQPTH

SEQ ID NO: 31799 - protein, 238 aa, Sorghum bicolor
  unsure (1)..(238): unsure at all Xaa locations
  Clone ID: SORBI-28MAY03-C105739_1.pep
ARGESIVCKLKMLKTASSFVNSRLHAVKAQTLVLASGNDELLPSSQEAERLRGALEKCRTRLFRDNGHKILLEADFDLATTIKGAGYARRTRKTDFASDYLPPTPDEFQQAINHDRILKLVTDPVMLSTLPDGKIVRGLAGLPREGPAVLVGYHMLMGFELGPMVTGILSSTGIHIRGLAHPFMFDKSTELLMPDSAHFDLHRIIGAVPVTGASFYXLLADNEIVLLYPGGAREALHR

SEQ ID NO: 31800 - protein, 183 aa, Sorghum bicolor
  Clone ID: SORBI-28MAY03-C105742_1.pep
MDGGRAGPEGSDHNMDLEEGNAATRVKRAKATNWPRVMSKFLLDWYLDKKKGMPPKTKFKKNHHVWCTSAVNAKFRTTYSVDQVHRHFRRFKEIWIIVTRYVNESGSRFNNKHKMLILPPAKMASLPIAERAILAKPIPFFDHLLHLFNDGQLDAVCMRDPITTDDSDEELEAQIALNIIASG

SEQ ID NO: 31801 - protein, 93 aa, Sorghum bicolor
  Clone ID: SORBI-28MAY03-C105767_1.pep
MAEICCEEAKSTPATAVAAASVSAAAAAVAVASSALERRRRRLEMRRFRVATDPEAPVAEDVRATKRQRLLARTVSGSCPDAGSDSDRPALPE

SEQ ID NO: 31802 - protein, 143 aa, Sorghum bicolor
  Clone ID: SORBI-28MAY03-C10580_1.pep
MRKKGRAVPEWLNSPIWSATPPAPTPPDPYGVDLAPPPPPKPPPPAVPPPPSYEQAVGVGGGRRDEDEYEGAGAVIRAHLLSDFKAALSKKVVNMGELQRLACLGVPDGGGGVRPVVWKLLLGYLPTDRSLWAYELENEAGSI

SEQ ID NO: 31803 - protein, 143 aa, Sorghum bicolor
  Clone ID: SORBI-28MAY03-C10586_1.pep
MDIVDKFFVLCSTDGQAKSSAIGKGFVKILDSISAPPAFAGEFPANHRKSLAHISGARPNTLHVSAEVIRIGSLAVPSGADKWALQKDQGMELLFSADFEPDTRIHCGCNTITAVLRGGFCLSSVSAIMLLVSYEVGMCIHGK

SEQ ID NO: 31804 - protein, 112 aa, Sorghum bicolor
  Clone ID: SORBI-28MAY03-C10581_1.pep
MPLALQLRLPLPRVLVVQRCRCRLPPSRLSVRAEAAAGVAVAAAAAPSSVVHDELCMLPFSPELASHHRELAAAVASVERACRLCVDVKASLLSGDKKVLEKNDETPVTIAD

SEQ ID NO: 31805 - protein, 309 aa, Sorghum bicolor
  Clone ID: SORBI-28MAY03-C105314_1.pep
MRVFVTGATGFIGQAVVQELLDAGHSVVGLARSDASAEALKSKGVAVIRGSLEDLEAIKQGASESDGIINLAFNHDFTKFAENAKVEYGAIMAMGDILAGSNRPLVLASGTMMLPKGELATEDSRPDMNSPVNVRAASEQELDILASRGVRASAIRLAPTVHGDGDHGFIHMITQVARAKGESIYIGEGLNRWPAVHRRDAARLFRLALEKGVAGTRYHAVAEEGVEWKDIAEAIGKSAGVPTVSKTFEQAMAHFDGSFIGFAFGADNPSSSKKTQEQLRWTPTAPTLLADIKAGVYTQDDGVNNGFVA

SEQ ID NO: 31806 - protein, 176 aa, Sorghum bicolor
  Clone ID: SORBI-28MAY03-C1060_1.pep
RLPDPSTPNLKIDLLAEISIAPRIMSDVDGALKSKQLKTEVDEYLKRPEGSSFLSDLKQKLLLPQNEATVAGTRYNVPLINSLVLYVGIQAVQQLQLNKANASASVQQINHMPPMDIFQIETATEMFRNLITSLDTEGRYLLLNAIANQLRYPNSHTHYFSFIILDLFAEASQEII

SEQ ID NO: 31807 - protein, 169 aa, Sorghum bicolor
  unsure (1)..(169): unsure at all Xaa locations
  Clone ID: SORBI-28MAY03-C10605_1.pep
MVIMVENGVQLTLTSTLKSTGKTRISADGLNNGNGSQTTKEKHEYNGTLQPSKGQKPQLCTTCAKGHTCQSVINRTRQMRALIDSNKPYQAHSVFKHLMEEGHKPSLVTYTILLTALTNQRMFESIPSLLAQVELAGIRPDSIFFNALINAXVEAKRMGEAINTFWKMK

SEQ ID NO: 31808 - protein, 224 aa, Sorghum bicolor
  Clone ID: SORBI-28MAY03-C10610_1.pep
AEIPQADGEGIVLEYSAGHEILTIGDGADAWKRKATVDPPYAISANTPIRLPGFFYCSALHCITRHGIRKVSSHVILKFSLHDETFTVHSHPPTYGFLTNNDTLCNLGGKLCYVGSSSPWEVEIWLAEDGPNLAWLRHCCICLPVPRLLKVFACASGDRNKIFLSIDAFRLLRCDLRDGSLEEIIEMAQDLLYDHRNGIKFSTGLHSVAHYMVPCVESLLCIRP

SEQ ID NO: 31809 - protein, 206 aa, Sorghum bicolor
  Clone ID: SORBI-28MAY03-C106112_1.pep
HEGYMRYNLILGRGAFKTVYKAFDEVEGIGAAWNQINIDEVMQCPDNLDRLYTEVHLLKSLKHGNVMKFYYSWIDDQSKTINVITELFTSGSLRHYRQKHPRVNLKAIKNWARQILHGLDYLHSHQPPIIHRDLKCDNIFVNGNHGEIKIGDLGLATVMQTPRARSVIGTPEFMAPELYDESYDELVDIYSFGMCLLEIFTLEYPY

SEQ ID NO: 31810 - protein, 234 aa, Sorghum bicolor
  Clone ID: SORBI-28MAY03-C106209_1.pep
WRHYLIGNKCDIYTDHKSMKYFFTQEDLNMRQRRWLELIKDYDLEIHYHPGKANVVADALSRKSYCHTLITESMPPELRREIYDSQLEILPHGLLHELRVEYDLTDRIHEAQKDCEKIEYIRGLMKLGYSLEFREDEKGVIWFKDRICVPDNSALRKEILSEAHDSKYCLHPGGSKMYQDLKKHFWWKNMKADIARHVAECDICNRVKAEHQRPAGLLKPLDVLEWKWGSISLV

SEQ ID NO: 31811 - protein, 123 aa, Sorghum bicolor
  Clone ID: SORBI-28MAY03-C10627_1.pep
MPALAVDATTPVAHAIASCDAAARFPAPPVVGPAAAAAADPVPWSADLSAALYNVDGWGAPYFFVNDDGDVAVRPHGPATLPGQEIDLAKVVANAAGPREGGGLGLPLPLLVRFPDVLRHRVE

SEQ ID NO: 31812 - protein, 76 aa, Sorghum bicolor
  Clone ID: SORBI-28MAY03-C10635_1.pep
VIQTNCQKISTVYTFTHMWDTWRRRWLEEKAHLSAKHGQDGSEQTFTIINRRNIGHHTSTLVLPTATPLGGACYQP

SEQ ID NO: 31813 - protein, 345 aa, Sorghum bicolor
  unsure (1)..(345): unsure at all Xaa locations
  Clone ID: SORBI-28MAY03-C106357_1.pep
ARGNNALIALYEHMDQDDVXRSSITHIEIEPLSILGVVSGLIPYPHHNQSPRNTYQCAMGKQAMGNIAYNQLFRADSLLYLLVYAQRPLLTTKTIELVGYDKLGAGQNATVAVMGYSGYDIEDAIVMNKSSLDRGFGRARASYRYTVLKDNYVDGVSDRIVKPQRDKDGVLMKQNMRALDDDGIVAPGQIIRNHDIYVNKQTPMNTSKGIGRPLTDSCYKDSPAIYKGVDGETTVVDRVMLCSDTNDKLSIKCIIRHTRRPEVGDKFSSRHGQKGVCGTIIQQEDFPFSERGICPDLIMNPHGFPSRMTIGKMIELLGGKAGVSCGRFHYGSAFGEPSGNADNVA

SEQ ID NO: 31814 - protein, 131 aa, Sorghum bicolor
  Clone ID: SORBI-28MAY03-C106442_1.pep
MDAAAREAQSGLEWRVTVPEGATVTMEEHEAGGAAARACAWLLACFATAWSWVAGFARKVWRIAADDPRKAVHGLKVGLALALVSVFYYTRPLYDGVGGAAMWAIMTVVVVFEYTVGGSVYKCFNRVVATA

SEQ ID NO: 31815 - protein, 202 aa, Sorghum bicolor
  Clone ID: SORBI-28MAY03-C10649_1.pep
HEAEASEGGKGGTLYNEGGRKELEQYEAAAMGGTGTGVREVDPDDEYDDGIDAQDDLEDAHLHSSDGGRKLGGGSHEGAEKDEVATERHTEAGGGSTDSHHDISSPDKKKASGTGDKKRVSKKKPKRKKSGSTCEMKFLNSTAQLVEPARNEKFSSFNLEYAEVEERPVGSEYWEPRFAVHQSLQEREESYKAHDQQLKCAF

SEQ ID NO: 31816 - protein, 148 aa, Sorghum bicolor
  Clone ID: SORBI-28MAY03-C10653_1.pep
ADQPVVPSVSLSQRQEIALKQEQDSPDSLFSFAIDIFEEEGEEASSSRAIGTVSVETRAKLEELSAILHQDTAQLVNDSDPAKALFKTLRGQIPADAEETLFHAAYLESRQLQYQRATRRLADRAAQIQLSEEMMKEKLLADEKHNTL

SEQ ID NO: 31817 - protein, 191 aa, Sorghum bicolor
  unsure (1)..(191): unsure at all Xaa locations
  Clone ID: SORBI-28MAY03-C106538_1.pep
APRPALPPVAGPPPASLAAVPGPSPGPSAALLALLPGVPPQRRASHPSPPPXAPPPPLARAARGQRRPPRRPPRPPPPPLPPPRAPRPLPVPAPPRPRATAPCPGCAPSGRRRRARRPPSPTSPSAPCPSSAGATPGSPATSPARRRRAPPSPPRGPPASPTPPPWRRASPPARSSSRSPARRRRTTSSPS

SEQ ID NO: 31818 - protein, 80 aa, Sorghum bicolor
  Clone ID: SORBI-28MAY03-C10652_1.pep
KGHKMLIWLLSIFFILQISEYSSSKIMSYYIVLACATTASLQLYGIIRHLDICVISASTANIFLTFLLPKGPTLLGGYTV

SEQ ID NO: 31819 - protein, 129 aa, Sorghum bicolor
  Clone ID: SORBI-28MAY03-C106566_1.pep
MGMTTTTTTRLMLTLAAAAAMLQLLASAPAPASGQPGPGVVVGAVSCTTSLVTSFTPCLNFITNGSASPTDDCCRSLGALTKASAGCACLILTGSVPLGVPVNRTLAVTLPRACNSTSLQLQCRGDPSS

SEQ ID NO: 31820 - protein, 126 aa, Sorghum bicolor
  Clone ID: SORBI-28MAY03-C106607_1.pep
DFKSCLSIEVNFLVPHYLRLLMLSMPPLLLFLHRPLQPSHLPLLLQVLLLLRQPQEGLYRKETQAESINIMLQVTPRRTNRLILWIWIHRVVRAPLVRPEDGRLSSSVAALLGSFILLVLVTYKVV

SEQ ID NO: 31821 - protein, 357 aa, Sorghum bicolor
  Clone ID: SORBI-28MAY03-C106610_1.pep
HEASMLFLFPFMRRFLESSNVKVITIMMWWSQPRLFVGRGMHEGAFSLFKYTMFWIILLAMKLIVSFYIEIKPLVQPTKDIMREPIRTFQWHEFFPHGTNNIGVVISLWAPIILVYFMDTQIWYALFSTLIGGIYGAYRRLGEIRTLGMLRSRFESLPEAFNERLIPSDANKSKGLRAAFLSRPKVPGDEREREKRAARFAQMWNVIITSFREEDLIDNREMDLLLVPYCKDRELDIFQWPPFLLASKIPIALDMAADSGGKDRDLTKRIKSDPYFSFAIRECYASFKNIINTLVFGQREKDVLAKIFTVVDEHIEDGTLIKDLNMRNLPALSKKFVELLELLQKNKEEDLGQVVIC

SEQ ID NO: 31822 - protein, 130 aa, Sorghum bicolor
  Clone ID: SORBI-28MAY03-C1067_1.pep
MAAAAASTAPSRKTETYTDTKRRDDVRGANIAAARAVADAVRTSLGPRGMDKMISSGDQAQEVIITNDGATILSRMALLQPAARMLAELSRSQDAAAGDGTTTVVVLAGSLLRRAQSLLSAGAHPTAAAD

SEQ ID NO: 31823 - protein, 92 aa, Sorghum bicolor
  Clone ID: SORBI-28MAY03-C106701_1.pep
WIYHESKRSSGVTLFFCLLCDQSIISLYVEETTGSRLFSSILIPPLVLQGMKCVRVPSALHIAFVTFSTISNYLDYSMSYLRGANGWTQVPG

SEQ ID NO: 31824 - protein, 116 aa, Sorghum bicolor
  Clone ID: SORBI-28MAY03-C106703_1.pep
MDNVESAPDSPAQAPPSSASSLPKEQSQVELELRLLQALEFYPPSKLKGIHRHFVLYGLMEFLRKSLDRQFSPDEVLQLLDRFFNLEMLKPEDDEKDNFSQGEEFSLPESFLNKEE

SEQ ID NO: 31825 - protein, 143 aa, Sorghum bicolor
  Clone ID: SORBI-28MAY03-C10672_1.pep
GLGQYLRRLNAVTCPTFGPLQRPQHHSWARCFASMLLEAIRDAEDGLVSLPYSEVRAQLKRHWDRLDSVSEARLTVTELPADGVVFDERSGEVRGLVDYGSAMWADPMFSDCFVRASEGFMEGCGAADGYYHKVRLLLDIVYH

SEQ ID NO: 31826 - protein, 128 aa, Sorghum bicolor
  Clone ID: SORBI-28MAY03-C10676_1.pep
PVPGARQHGTLCDDGAGAGARGRPLGLGAPGPQLFIGEIAAYHLFIKLATAHDHTSIIKLPATTHFLPQLSSDQRSNSFHHMAPSGYRYGPGCRRAGANISERARRAGIRPAPQPGGREELDRYQEME

SEQ ID NO: 31827 - protein, 251 aa, Sorghum bicolor
  Clone ID: SORBI-28MAY03-C106849_1.pep
MKKAVDLALSAAAAAGGRLGCVLSTGMTIAEAAEALGACGADPAAFDALICSSGAELCYPWRDVAAADEEYAGHVAFRWPGDHVRAAVPRLGKAEGAKEADLAVDEAACSVHCHAYAVAGASKVKKVDSIRQSLRMRGFRCNLVYTRACTRLNVIPLSASRPRALRYLSIQWGIDLDKVAVLVGDKGDTDRERVLPGLHRTLVLPELVSHGSEELRRDEDGFLAEDVVAMDSPNILTLAEYQAAADILKAI

SEQ ID NO: 31828 - protein, 147 aa, Sorghum bicolor
  Clone ID: SORBI-28MAY03-C10686_1.pep
VRNISVRTGVLDEKAAATQAIGFFALHTESAYAPYLEESLKILIRHSSYFHEDLRLQAVISLKHILTAVRAIPPTHADVLEKQKDVLDTVLNIYIKTMTEDDDKEVVAQACMSVADIVKECGFAAIEPYMLRLAEVTLVLLRQESSC

SEQ ID NO: 31829 - protein, 182 aa, Sorghum bicolor
  Clone ID: SORBI-28MAY03-C106905_1.pep
ARGYFLVRTWTAALERFGVVSKPFTKQENTASQTCVVACYGLAFSGGFGSYMLAMDQRTYELIGPDYPGNRAVDVKNPSLGWMIGFMFVVSFLGLFSLVALRKVMVIDYKLTYPSGTATAMLINSFHTTTGAELADKQVRCLGKYLSISFIWNCFKWFFSGVGDSCGFDNFPSLGLAAFKNT

SEQ ID NO: 31830 - protein, 241 aa, Sorghum bicolor
  unsure (1)..(241): unsure at all Xaa locations
  Clone ID: SORBI-28MAY03-C106910_1.pep
MVVLGGADDPTHKLGDIVDHTRQQHATGLPEKPSNVSCHNGNGHAPRRSSASDSYKYYYDADAPSESDWQSTSPASSSSTRQMLGDGHRNNGSSFRSSSIASSQTQRPSSSSSSSSRRFTVPFVKKIDWGSLWDKSKEWIRNPMNMALSVWILAVGVSGAILFMVMTGMLNRVLPSKPQRDTWFEVNNQILNALFTLMCLYQHPRRFYHLALLCRWRAGDMHQLRQVYCXDGTCKPNERKH

SEQ ID NO: 31831 - protein, 211 aa, Sorghum bicolor
  Clone ID: SORBI-28MAY03-C10694_1.pep
MALTTSTNQALLDAQLELWNTTFSHIKSMALKSALDLRIADAIHNHAGAATVPDIVATVKLHPSKIPCFRRLMRVLAATGVLSAWNPSGSSTELVYALTPLSRLLVGSHNLVPITAMILHPSFVSPFLELGTWFQQELPGPCVFKQTHGQTVWEQAARDASFDALVNDGMVSDSHFIMDIVFEGCADAFQGISSLVDVGGGLGAAAQAISK

SEQ ID NO: 31832 - protein, 75 aa, Sorghum bicolor
  unsure (1)..(75): unsure at all Xaa locations
  Clone ID: SORBI-28MAY03-C107018_1.pep
VWGSDAGEFDPLRFRDGVGRAAAHPNALLAFSLGQRSCIGKDFAMLEAKVTLALILRRFAFKVAPEXVHAPAAFL

SEQ ID NO: 31833 - protein, 50 aa, Sorghum bicolor
  Clone ID: SORBI-28MAY03-C10702_1.pep
TFCSSTDHRCDLDFSTSRQFLACKWHRVKAKFQNALADGNACLRCHQSHS

SEQ ID NO: 31834 - protein, 83 aa, Sorghum bicolor
  Clone ID: SORBI-28MAY03-C107021_1.pep
KRAHDMHSGRPCIALHHALKSLAACCSLTLPHCGVDLLIALAPRTKPVDISDPPALCLPACALCTVQKLACLCVLAFAFTGPG

SEQ ID NO: 31835 - protein, 85 aa, Sorghum bicolor
  Clone ID: SORBI-28MAY03-C107046_1.pep
QRGGFAPMFAGHAAAMPGLELGLSQDGHIGVLAAQSISQFYHQVGAAGGSGQMQHPHGHQHHHHQQQEDGEDDREDGESDDESGQ

SEQ ID NO: 31836 - protein, 128 aa, Sorghum bicolor
  Clone ID: SORBI-28MAY03-C107092_1.pep
TRDSPALAAADVGMAIGAGTDVAIEAADIVLMKSSLEDVITAIDLSRKTLSRIRLNYVWALGYNVLGMPIAAGVLFPFTGIRLPPWLAGACMAASSVSVVCSSLLLQLYKKPLHVEDAPRPEDGSDLV

SEQ ID NO: 31837 - protein, 82 aa, Sorghum bicolor
  Clone ID: SORBI-28MAY03-C107126_1.pep
MKFTIALAALVSLAAATPLDASTKGCKPGTYSCTPDKTGWQVCDVNGKYVAAGVCPPKTSCVFYKPSGSPYCVPPGFKFPKA

SEQ ID NO: 31838 - protein, 99 aa, Sorghum bicolor
  Clone ID: SORBI-28MAY03-C107150_1.pep
MQTEARVGVVVDGGGGGAGAAVGRCQRQRHISTAGHLAAGGFAGAVSKTCTAPLARLTILFQVAGMHSDVATVRKYSIWHEASRIFREEGFGAFWKGNL

SEQ ID NO: 31839 - protein, 102 aa, Sorghum bicolor
  Clone ID: SORBI-28MAY03-C107193_1.pep
MLRNTLARSAWRTSRRAVNVSRTFTTTSQRPAEVELTIDGKKVSIEAGSALIQACEKAGSTVPRYCYHEKLMIAGNCRMCLVEVERAPKPVASCAWPVQPGM

SEQ ID NO: 31840 - protein, 144 aa, Sorghum bicolor
  Clone ID: SORBI-28MAY03-C107199_1.pep
VAVSYKVRSLLEPSINVTGPNGERMSRRNSSGIVHPHTSFDQGGSGFSTPVHSDHEDELAEIKSAQQLSLNISPIQSSPEAHRCVRQIIRGNYVQFAEDATKGLRRQRVYLVSTDLSDEAAYALEWTIGTVLRDGDTLLAVYAV

SEQ ID NO: 31841 - protein, 155 aa, Sorghum bicolor
  Clone ID: SORBI-28MAY03-C10725_1.pep
PTRPRTRGLKPAKFCELALSLPDHARIYDDGVYRAVDIYLKAHPRLTAEERDRVVGVVDCRKLTVEACTHAAQNERLPLRAVLQVLFFEQLQLRRAITGTLLASSAGGPPRASTSEAVAWRGATALAHESQVLRLDMDSVASRVHELERECCSMR

SEQ ID NO: 31842 - protein, 125 aa, Sorghum bicolor
  Clone ID: SORBI-28MAY03-C107288_1.pep
TNLTYLWMDSMNLTGEIPEAFSNLTELTTLSLVSNRLNGSIPAWVWQHQKLQYIYLFDNGLSGELTPTVTASNLVDIDLSSNQLTGEIPEDFGNLHNLTLLFLYNNQLTGTIPPSIGLLRQLRDI

SEQ ID NO: 31843 - protein, 79 aa, Sorghum bicolor
  Clone ID: SORBI-28MAY03-C107221_1.pep
ISPAASNWSSAVAEGSFSRPADLRCCAPWKPPLLAIRLLDRSIFPSPPHESFQGIENFQPARRGGYSAISTAPLGAEVL

SEQ ID NO: 31844 - protein, 134 aa, Sorghum bicolor
  Clone ID: SORBI-28MAY03-C107289_1.pep
RHEVSDCQLDLWKQSYVAACAAVDDELRRSRRFDAVQSGCTALSIVKQGDLMVVANVGDSRAVLGTTSDDGGGAIAAVQLTVDFKPNLPQEKERIRRCNGQVYCLADEPGVHRVWQPNRESPGLAMSRAFGDYC

SEQ ID NO: 31845 - protein, 60 aa, Sorghum bicolor
  Clone ID: SORBI-28MAY03-C107290_1.pep
MGGVASELVGASRERQSRKRKQFHTVELKVRMDCDGCELKVRNTLARMRGTYPFLVLPES

SEQ ID NO: 31846 - protein, 142 aa, Sorghum bicolor
  Clone ID: SORBI-28MAY03-C10731_1.pep
MGRTIKRAKKAKSKKAKKKTEASSSSNPAVASGPAKVWQPGVDALEDGEELQFDPEAYNYLRGFGIGWSCLSFDVVRDQLGLVRSEFPHTFYGVAGTQAEKASWNYIGVFKLSNISGKKREPIPASAVDGDTDVDSDSSSDE

SEQ ID NO: 31847 - protein, 78 aa, Sorghum bicolor
  Clone ID: SORBI-28MAY03-C107318_1.pep
RRVRTTMMSWTRMRPVRAMRTSRWATTPSRRTSLASLPTRPSPRLWCTKSFVSSGSSRSFPPFTHRPYSSFSLSPHVL

SEQ ID NO: 31848 - protein, 124 aa, Sorghum bicolor
  Clone ID: SORBI-28MAY03-C107342_1.pep
MLRATHFAFRRDKGTAAGAALRGLVGGFSTASDSQRLAGKVALVAGAASGIGKATAAEFVRNGAKVILADVQDDAGRAVAAELGPAASYTRCDVTDEAQIAAAVDLAVARHGRLDVLYSNAGAP

SEQ ID NO: 31849 - protein, 136 aa, Sorghum bicolor
  Clone ID: SORBI-28MAY03-C107366_1.pep
AQSRSHELLAAIGWPLLPQQQLLVVVPLLVLPLLCLLSASRRRRRRSREQGAAAAERRRAPPPGPAKQLPVLGNLLQIGSRPHRYFQAVARRYGPVVEVQLGRVRTVVVSSPDAAKEVLRTNDLHCCSRPNSPGKS

SEQ ID NO: 31850 - protein, 96 aa, Sorghum bicolor
  Clone ID: SORBI-28MAY03-C107367_1.pep
MGLLDQLWDDTVAGPRPDSGLGKLRKYASFSPSSSSAAAVPPSPTAEGAAAAGSGSGSGSATPAVTRSITMLRPAALSVITSPRSESSSAPSSPSP

SEQ ID NO: 31851 - protein, 78 aa, Sorghum bicolor
  Clone ID: SORBI-28MAY03-C107448_1.pep
DIADQIRNGETGIVGVMIESNINEGNQKVPPEGPSGLKKGVSITDACIDWETTVDTLENLAAAVAERRANKATANGTH

SEQ ID NO: 31852 - protein, 101 aa, Sorghum bicolor
  Clone ID: SORBI-28MAY03-C107374_1.pep
MASQDQAASDDVRVLGYDPLIPPQLLAQELPIPAHAQQTVVQGRREAASIITQKDDRLLVMVGPCSLHDPELAIEYCQRLKALADKLKDNLCIIMRAYLEK

SEQ ID NO: 31853 - protein, 177 aa, Sorghum bicolor
  unsure (1)..(177): unsure at all Xaa locations
  Clone ID: SORBI-28MAY03-C107513_1.pep
ARGTPPPAYSRHTRKAMAPVQTQTMTTHQFDNPVTVIRASGRISKPPARSTRTQTKALLSHSPQIPTAHPDINISLLRNKLLLQCRKYLPSDLLHEALADGLYSRATHWITPCSSAASKFGKRKRYYVLDSSTFMFQSLGSAWEARILSGGSQPIDAGNGVVIFVKERKEWNAFMAX

SEQ ID NO: 31854 - protein, 99 aa, Sorghum bicolor
  Clone ID: SORBI-28MAY03-C107550_1.pep
MGNCQAAEVSAVIIQHPGGKVDRLYWSTTAAEVMRNNPGHYVALVILRVPADNSKPAAGDAGAASSGGGGGAKITRVKLLKPKDTLLLGQVYRLITAQE

SEQ ID NO: 31855 - protein, 104 aa, Sorghum bicolor
  Clone ID: SORBI-28MAY03-C107551_1.pep
MKSSRFLFLCAMFCLMARLGAANVVLMGNNLTLSFDDIEASFSPGVKGSGVSGVVYASEPLNACSPLTIKTVNGPPSPFALIIRGGCTFDEKVKNAQDAGFKAA

SEQ ID NO: 31856 - protein, 106 aa, Sorghum bicolor
  Clone ID: SORBI-28MAY03-C107572_1.pep
MSNESLQETNNKALGTTAGTFPIVTLPDGRKLPTGTVGALLVNIKSYDEATEERRAELEPAIQSAIPTLVKVGMFDLFTPQEWASQRSPGRSLVGKLAREFLEASQ

SEQ ID NO: 31857 - protein, 120 aa, Sorghum bicolor
  Clone ID: SORBI-28MAY03-C107585_1.pep
LSPPISIRYWSSHVAHSGYGSPSPHVSSSYISNSGYGSSSYCYLGLGGSSHSQHGTYLRRCGESGPSLCTMVPQQLQWETNVAAGASSAKSLRQSSYLRHCGDSDASLSDMTSAQSLPRC

SEQ ID NO: 31858 - protein, 112 aa, Sorghum bicolor
  Clone ID: SORBI-28MAY03-C107595_1.pep
PADVHPHPARPGFCPLRLTLTAQSAKTLVIHLTVSGLALDNLRNRALDQHPHGAGIDFFATALLHTALALPGVSPPSLRVLLLQLHQLPRSLALPPVPRHKGVPFLSLLDED

SEQ ID NO: 31859 - protein, 161 aa, Sorghum bicolor
  unsure (1)..(161): unsure at all Xaa locations
  Clone ID: SORBI-28MAY03-C10777_1.pep
GTRMWRRGADAEGYAANFVESEQIXQSKGFTASYVQVRGSMPFLWEQIVDLTYKPSFDVVRQEEAPRVLERHFHDLQKKYGAVLAVDLVNTSGGEGRLRERYAKSIEPILSEDIRYVHFDFHRVCGHIHFERLSQLYDQIKDYLQKHKYFLINDKQEKIEQ

SEQ ID NO: 31860 - protein, 102 aa, Sorghum bicolor
  Clone ID: SORBI-28MAY03-C107847_1.pep
RPPQCVVFSVGKLKVNGISALCSFGVAAATVCIFLVGGRLQHHHHRQQEQQKIQLQFYGDDKRIQQVVQQTSRLNQAMSSVMGAGGASTRANISFGGFYDGF

SEQ ID NO: 31861 - protein, 82 aa, Sorghum bicolor
  Clone ID: SORBI-28MAY03-C107873_1.pep
ELKPPPGWKPGDPITLPPDEILPGIKGEEPQAPVPQPHVPVRPVAPMGAEPIQVQPVQLDFDSSSSDEYSSDVGSSEEDDED

SEQ ID NO: 31862 - protein, 176 aa, Sorghum bicolor
  Clone ID: SORBI-28MAY03-C107889_1.pep
ARGAAAPSSAMAFKYIVFAACVAVVRAGVLAPAPLAYAAAPVLAKAAVAVDTDYDPNPSYNYAYDIHDSLTGDAKSQQESRQGDVVQGSYSLVEPDGSRRTVEYTADPVNGFNAVVHKDGPGVAVAAAPVVAKVAAPVAYAAPAPIAYSTPIAKVAAPLAYSAPLGYAAAPAIYHH

SEQ ID NO: 31863 - protein, 200 aa, Sorghum bicolor
  Clone ID: SORBI-28MAY03-C10791_1.pep
MEARSLLVVIVVGCCACWGCRAQIPIPARMDGFVYGGKPPPAWGETVVVEAFLDPVCPDSRDAWPALKKVVDHYSNRVSVVAHLFPLPYHSYAFIACQSIHAVNKLNPSFVYPLLEKFFKDQEGYYNRPTYGKSRATVVDEITKNLVAPIIGETNLAAYKAGFNDSQSDMATRISFKKRCARGVTGTPYFLVMAYPITIP

SEQ ID NO: 31864 - protein, 266 aa, Sorghum bicolor
  Clone ID: SORBI-28MAY03-C107895_1.pep
ADFIVEEDEIDGNGQVVRRKKYKKKVPRQAAGVSSSALQEAQDIFGDVDELLALRKQELEREAANSSELRGARLEDEFEPFILAEKYMTTKDEQIKENDVPERMQLSEELTGYPPTDKTMIEEESLWIHSHLTGDGFLSFFGNERMNKDIDQKDIVNVVTMLHVNKFEIPFIAMYRKENCPTLLKSLDSDEGNTIIDPYHQLSGVKWLREKPLSKFVDAQWLLIQKAEEEKLLKVTVKLPEDAKKKLMSEARENYLSDCVSKSAQL

SEQ ID NO: 31865 - protein, 92 aa, Sorghum bicolor
  unsure (1)..(92): unsure at all Xaa locations
  Clone ID: SORBI-28MAY03-C10792_1.pep
APSYSPTSPVYSPTSXAYSPTSPAYSPTWASYSPTSPSYSPTSPSYSPTSPSYSPTFPSYSPTCPLYRPTSPSYSPTSPAYSPTSAGYRPTS

SEQ ID NO: 31866 - protein, 128 aa, Sorghum bicolor
  Clone ID: SORBI-28MAY03-C10810_1.pep
MVTCSDDQTLKIWDTSADLSQPKTGEGHESWQHLSTLTGYHGRTIFSAHWSSEDIIASGAGDDAICLFTEEKSTMVERPSYRLILKKEKAHVMDINSVRWCPQDPRLLASASDDGMVKLWELRGNVLD

SEQ ID NO: 31867 - protein, 102 aa, Sorghum bicolor
  Clone ID: SORBI-28MAY03-C108137_1.pep
MSYYGQQQPPVGVPPPQGYPGKDAYPPPGYPPAGYPPPAQGYPPQGYPPQQGYPPQQGYPQQGYPPPYAQPPPPQQHQSSGPSFMEGCLAALCCCCLLEACF

SEQ ID NO: 31868 - protein, 107 aa, Sorghum bicolor
  Clone ID: SORBI-28MAY03-C10822_1.pep
MALPLQHASPGSSTLTTTGRHGRSSAAVLRRPPTDSSSRWRVHAQKPAAGSRGAGAETTTATSSSSSSRSDNAVLKAAWYGSELLGIAASLFRPRRVVSGGGRCRWR

SEQ ID NO: 31869 - protein, 150 aa, Sorghum bicolor
  Clone ID: SORBI-28MAY03-C108232_1.pep
HDMECSAIQTTGGRTWRRRAMERRTDSIEVVVVHVRMASVASRQAAAACSSFSSCSLISRLNLAMNSSTRRLSSSSDSLEYSLSFSSIISSSDDGGGGGGGRLSVVAARRRCRLSFSSLITTLLSCTGTSACECDGRCPTRWCRRLVARL

SEQ ID NO: 31870 - protein, 125 aa, Sorghum bicolor
  Clone ID: SORBI-28MAY03-C10828_1.pep
MDAFRKQLDVLMGANRNGDVEEVNRNYYDRDVCRLFLAGLCPHDLFQLTKMDLGPCSKIHSLQLRKDYEEAKAKGTENFDRELEDMIERLIVECDRKIQRALKRLADDDAKAAIAISVSEVTLTE

SEQ ID NO: 31871 - protein, 150 aa, Sorghum bicolor
  Clone ID: SORBI-28MAY03-C108304_1.pep
MTSSLAVLHLAPVPTVKKKVERSHEGHITEIIYKGAHNHPKPTPSRRPGVQVQPVHPFGDAGGAQQADAAADNNLGSQQANAAAEANHQPWRAGVQDGMDAAASSPSVPGELCDSSASMQQVEYAPPTDQTPRGRGSADHDVAVADAASC

SEQ ID NO: 31872 - protein, 146 aa, Sorghum bicolor
  Clone ID: SORBI-28MAY03-C10829_1.pep
RTHTKTTNTGASRDSTGLLLCVFAVISTTTVMAKAQVAAARFMTEVAPPPVVSVMRRRKQAPWCLDTIAEDTIAEQLVACGSPSSTDYGFAAAWSLKRMPPPHAHAQPRERAAGFVGKYFSDAHGSQQLVSRRRDVHAQELHKVGA

SEQ ID NO: 31873 - protein, 171 aa, Sorghum bicolor
  Clone ID: SORBI-28MAY03-C108436_1.pep
MATATTCRLVLLLPLLSLLLLHTVSAFDSGNQPQPSAYEMLEGFGFPRGILPEGVTGYTYRPSDGAFEVFMGGDCEFEVDGGYRLTYRRRISGNVEGGSIRNLGGVSVRMFLFNWGIDRVVMEDADRRLMFYVGPISQAFPADNFVQSPQCRRHGGGNGGVDAPPVGMAAM

SEQ ID NO: 31874 - protein, 160 aa, Sorghum bicolor
  Clone ID: SORBI-28MAY03-C108450_1.pep
MKVELTARTSQTSKAGEETPPPSPSASAASPPAEDAPLLPDAGVRRRPACGRFSQRSGSFRREVSRAAAETFLLTRLTLILLRYLGIGYRWIRQFLALCCYTLLLMPGFIQVVYYYFFSSQVHRSVVYGDQPRNRLDLYIPTSTTGLKPVVAFVTGGAWI

SEQ ID NO: 31875 - protein, 87 aa, Sorghum bicolor
  Clone ID: SORBI-28MAY03-C108453_1.pep
ARGDDETTGMSMDEAYALALQARRRPEREREEEARRSEVDAKADEFIRGFKEDLRQQRLNSIFNYTQMLKQRALGGAAAARRQPDQL

SEQ ID NO: 31876 - protein, 105 aa, Sorghum bicolor
  unsure (1)..(105): unsure at all Xaa locations
  Clone ID: SORBI-28MAY03-C108464_1.pep
IFFFFFFFFXXXTASSLTLSHQVASPQQPSPPPAHQVVCPCFRSSRRTASSLRRCRRQQERGDTDSGIRKGLGFRRVWAEVAGGRGGAAAGGRVRVRVRAAGGSD

SEQ ID NO: 31877 - protein, 243 aa, Sorghum bicolor
  Clone ID: SORBI-28MAY03-C10855_1.pep
HEGALFYWLMEASGVPADSAPLVLWLNGGPGCSSVGYGAMEELGAFRVNPDGATLSLNPYAWNKVANVLFLDSPAGVGYSYTNTTNDLYAAGDNKTAHDSYAFLINWLERFPQYKYRDFYIAVRSYAGHYVPQLSRVVYRNNKGTENPTLNFKGFMVGNAVTDDYHDYMGTFEYWWTHGLISDETYVKLWSTCKYDAAQHPSEECQKIYEVAYDEQGDIDFYSLYTPTCKKTSLLKRRQIRGR

SEQ ID NO: 31878 - protein, 142 aa, Sorghum bicolor
  Clone ID: SORBI-28MAY03-C10870_1.pep
MPPPSAAATSTTAAASAARDDMSPAEARLAMMELANMVSVPMALMAVIRLGVPAAIWAGGANAPRSAAELLPAGHPDPSVLERLLRLLASRGVFSESTSTSEDRTTTTRRFALTAVGRTLVPEGASGASYADYVLQHHQDAL

SEQ ID NO: 31879 - protein, 142 aa, Sorghum bicolor
  Clone ID: SORBI-28MAY03-C10867_1.pep
TTGGLPPPPPPYTRCPGLLGLFAGDEHPPGSTGTMDQEQKLEVSDAVYTYKHHCSVGVDVHEVFVKRSRLRVVLSYIGIIFLLANVCQPLLAKESLSLGSVWNITFAVLVAKCLQYKPVKRESVVIMPAFGVQLEIHFWRYA

SEQ ID NO: 31880 - protein, 126 aa, Sorghum bicolor
  Clone ID: SORBI-28MAY03-C108799_1.pep
GDAVGRASLPPDQFIQSFKKPLQTPVIQFTPRLRTTRRRHSGGAGPMRSARLAAKSGHREPKPEAQARKIMMKKLGVHVQTEAPDEASFDEFQTAFIEPVQQTPREAMDALFQVRKQRPLGPVSAD

SEQ ID NO: 31881 - protein, 178 aa, Sorghum bicolor
  unsure (1)..(178): unsure at all Xaa locations
  Clone ID: SORBI-28MAY03-C108815_1.pep
ARGLIDVVGRVKEVSMDQYGSRFIQQKLEIASLXMFGKKIFPEILSNAIALTTDVFGNYVIQKFFEFATESQLIQLADKLKGHILELSLQMYGCRVVQKVLEVVDMDRKIDIVHELKNYVLKCIGDQNGNHVIQKCIECVPEDRIPFVIDPILSQILVLCTHQYGCRVIQRVLEHCHD

SEQ ID NO: 31882 - protein, 188 aa, Sorghum bicolor
  Clone ID: SORBI-28MAY03-C108852_1.pep
MKVQLVEQEGSKRMGSSGCSEIVELVDEPKDARPGGLTHLRVRVKPVGQEHGARSCSVEDDLDQLIRSINVRTSARASGQTSTDRRLIALGKSPVSSSEIVESVSLKQALRKMCISQASEMAAMKRLSKPTGVSTPSDSGPIKKLYGSVAVQINEEQDDKSKAGKVSMLPEKLAGSSVGKPSGIGKGQ

SEQ ID NO: 31883 - protein, 195 aa, Sorghum bicolor
  Clone ID: SORBI-28MAY03-C108873_1.pep
MEEEMEAALLPRPESPLCAVDHLGRPASRGDSGRWRAALFIIGVEAAERFAFFGVMGNLMIYLTGPLGQSTSSAAAAVNAWLGTALLLPLLGSAVADSWLGRYRTIVCASILYIIGLGMLTISSVLLPSESVGRPKYSSSVPMALFYLSLYVVAFGQGGHKPCAQAFGADQFDENDPAELASRSSFFNWWYFAAY

SEQ ID NO: 31884 - protein, 134 aa, Sorghum bicolor
  Clone ID: SORBI-28MAY03-C10914_1.pep
PGGSRPSAGCGQRGPRPWLVWPRRWPAAPAARLRQPGQRRGPGSRRWPARPGARAAAGPSRGRGGPGQGARGPPLRARFPGAGRARGSPMAGAGRSRGHGPPGGGGSPSATVRGGQPASSRPGAWQWRPARLGQ

SEQ ID NO: 31885 - protein, 181 aa, Sorghum bicolor
  Clone ID: SORBI-28MAY03-C10793_1.pep
SWCTVRIDVFGGFVLQRITKEKSFFRAIANMDIKLDFVPPWLINFISRQLIGSGHKLYQKAVSTVATHDDDYRKALRGPLYVRIREYQDSDDKAKVTAAEENATEVPSANATIQNHLSLTNTISNSEIVEETEQNTSINVDNLTTSHPYEPVEQAQQVENKPYISPEVERAMCILDTAIAV

SEQ ID NO: 31886 - protein, 76 aa, Sorghum bicolor
  Clone ID: SORBI-28MAY03-C109193_1.pep
ARGSFLPRAHTNETRSSFASCSRSVFSFRAHPTQGDRSMGNCCLERPRRGGGGSAGAVHYARTNPVWVEEEVRGRK

SEQ ID NO: 31887 - protein, 130 aa, Sorghum bicolor
  unsure (1)..(130): unsure at all Xaa locations
  Clone ID: SORBI-28MAY03-C109228_1.pep
PXYEKLVRRHEYHITKGKLIVRSWKLAHNDYVYKTRHDKMFNSYNAHEWHRRPNLVSDYYSGLRGPALIAAQQQQANAWRTEDHQAGHACSSATTLQPAHGGGQTGGCGGQNGGVWPQPPQWLPWLQPSC

SEQ ID NO: 31888 - protein, 121 aa, Sorghum bicolor
  Clone ID: SORBI-28MAY03-C109307_1.pep
ARGHLALLCPLSPLLHSRNARGDRISKMVRFLIRPPACLCRFLIPPPVCASRSFPLRGAPLEIGAGAAERHRPAQPAGRAASSSLPTLSSWYTFLYLFIYDLFSFCVIGWCKSWPYAKNKA

SEQ ID NO: 31889 - protein, 98 aa, Sorghum bicolor
  unsure (1)..(98): unsure at all Xaa locations
  Clone ID: SORBI-28MAY03-C109315_1.pep
MALPPGRGFCSPRAALPGAWGLRAPGWVAGLPSSLDPGLGGFASVLLLVVSGRGACWCIQDEEDDRPSMXKDTGIPPVPFSFMNLIEGESSSTFSEEG

SEQ ID NO: 31890 - protein, 112 aa, Sorghum bicolor
  Clone ID: SORBI-28MAY03-C109321_1.pep
MGSLGSAAQQPHAVCLPYPAQGHITPMLNVAKLLHARGFHVTFVNTEYNQARLVRTRGAAAVAGLPGFRFATIPDGLPPSDDDDVTQDIPSLCKSTTETCLEPFRRLLADLN

SEQ ID NO: 31891 - protein, 92 aa, Sorghum bicolor
  Clone ID: SORBI-28MAY03-C109331_1.pep
RDTTAKRNSDLGKRHPACHLAVRSQATRSQQEAPQRSKWPRGGNRVPRGHTREKGSNGSLPARWPACTASRPPAHQAGAPGAPHDGQALPRA

SEQ ID NO: 31892 - protein, 160 aa, Sorghum bicolor
  unsure (1)..(160): unsure at all Xaa locations
  Clone ID: SORBI-28MAY03-C109334_1.pep
MAEEAQAPPSATMAKEAQSPPSAAVAEATATPQLVLFNSLTKREEPFQPRVEGKVXMYVCGVTPYDFSHIGHARAYVAFDVLYRYLKFLGYEVEYVRNFTDIDDKIIKRANERDETVTSLSSRFINEFLLDMTELQCLPPTCEPRVTEHIEHIIELITKI

SEQ ID NO: 31893 - protein, 58 aa, Sorghum bicolor
  Clone ID: SORBI-28MAY03-C109349_1.pep
MSGALRNSRTASTGRSGLGGGGAKSTTDLAAASFFRWGHRGGRGHGAGGKYGRATAPR

SEQ ID NO: 31894 - protein, 207 aa, Sorghum bicolor
  unsure (1)..(207): unsure at all Xaa locations
  Clone ID: SORBI-28MAY03-C10938_1.pep
LNVAQGQATLTMKGVEDDEDDLKTLNMELKRDWSRGTNAFELAFRRNKEISAFLDQRQKTKVPEVQAAAEESSEELSSLSEVATDVPAPVSDASSQVVIEDSTSVATAAEGQTVESESSPVISVELSSNGIPDSTSVSPVSETAEKPAEPEESSAVEEVLVTASSEVEKEPAAAAGVAQTSTTTATISPALXQQLREATGAXMMDCK

SEQ ID NO: 31895 - protein, 88 aa, Sorghum bicolor
  Clone ID: SORBI-28MAY03-C109467_1.pep
PSRRTRRCALSSTNGPRPATRALRPPSSPSPAPRPPRSPPPPPPRPRTAPPPAPRRPSGSRRLLRVPCGAHRLCAAASFVLPSSRPVA

SEQ ID NO: 31896 - protein, 161 aa, Sorghum bicolor
  Clone ID: SORBI-28MAY03-C110308_1.pep
LLGHLPLLPVALDGLQIRSAADLAAPAASLADCQEPAAPLGPRLKAAADFRGLLPVPEARGPDAAAPSPGVAVLCQPAAARLPSRSRRGPLPGFSAPVGERRSGTRVPWLPPRRGRAQRAVAVPPCSCMVSLTVWWCASLLMHAPRWLGGRRICGALASAA

SEQ ID NO: 31897 - protein, 174 aa, Sorghum bicolor
  Clone ID: SORBI-28MAY03-C109496_1.pep
DDAKACCEITSNIQCHRCKGYGHMMRDYPNKRVMIVRDDGQYSSASDFDEDTRNEDQIEEHINAGEADHYESLIVQRVLSAQMEMAEQNQRHILFQTKCVDGGSCNNLASSDMVQKLALNTKPHPHPYYIQWLNNSGKAKVTRLVRINFSIGSYKETVGWEVVPMQACNILLGN

SEQ ID NO: 31898 - protein, 165 aa, Sorghum bicolor
  Clone ID: SORBI-28MAY03-C109739_1.pep
MVSAANFLAMVVTCALLMTSRDTCHAARHLADTTAAAAAPAAAAAAVPGLPAVPTMPQAALPPMPAVPAVTVPQVTLPPMPPAPKVTVPQVTLPPIPAAPKVTVPPQVALPPIPAVPSSVLPKLTLPPMPAAVVPSVGPKVALPPMPSVPAVNVPMPFAAPPPSA

SEQ ID NO: 31899 - protein, 107 aa, Sorghum bicolor
  unsure (1)..(107): unsure at all Xaa locations
  Clone ID: SORBI-28MAY03-C10967_1.pep
MAAQEEKTATAVTTEEPAPAAEPQPKPAAAARRAGPSASANPFDFSTMMNLLNDPSIKEMAEQIAKDPAFTEMAEQLQKTVVFSXATVAAVGGFCAAVAQLDPHKYV

SEQ ID NO: 31900 - protein, 119 aa, Sorghum bicolor
  Clone ID: SORBI-28MAY03-C109763_1.pep
MANLAPTWVTKAGLGVLTLNSGLAMYRARGDPASILFVSGSYATLLLLFRCLRDYERAAPGSPARERARRAVWPLTTLLTLAFSWKVAAVMPSAVAAAVVWALAVATTAGGFFALFVPG

SEQ ID NO: 31901 - protein, 111 aa, Sorghum bicolor
  Clone ID: SORBI-28MAY03-C10974_1.pep
PRVRLAGENHVEEINNHVDFTCYAPRIFATLKAIESVMMAAPAALVRKKAFVALKKVISMVPSSQRFDILQALVNNSTSPSLTAILLDLVREEVSRESLRADNDCVEDDGF

SEQ ID NO: 31902 - protein, 83 aa, Sorghum bicolor
  Clone ID: LIB5048-006-R1-XP1-D10.pep
MAAGAAPTNLQKEQMFGLAEKEMEYRVDLFNRLTHTCFDKCIEKRHKDAELNMGENSCIDRCVSKYWQVTNLVGQLLGNQPKM

SEQ ID NO: 31903 - protein, 69 aa, Sorghum bicolor
  Clone ID: LIB3478-021-P1-K1-B7.pep
MFGLAEKEMEYRVDLFNRLTHTCFDKCIEKRHKDAELNMGENSCIDRCVSKYWQVTNLVGQLLGNQPKM

SEQ ID NO: 31904 - protein, 256 aa, Sorghum bicolor
  Clone ID: SORBI-28MAY03-C10978_1.pep
RFETKASPTELRDLRNRLESMLSSEASSSNQSKSIAYVGREGEGIIGAIAISDILREDANLTVERLQQESITTFLLSGDREEAVTSIGRTIGIRDENIESSLTPQDKASIISTLQGKGHRVAMVGDGINDAPSLAAADVGIAMRTHSKENAASDAASVVLLGNRLSQVVDALSLSKATMAKVHQNLAWAVAYNIVAIPIAAGVLLPQYDFAMTPSLSGGLMALSSIFVVSNSLLLQLHGSFQNTEKRQGDLSSRLN

SEQ ID NO: 31905 - protein, 265 aa, Sorghum bicolor
  Clone ID: SORBI-28MAY03-C109802_1.pep
KLYTSNFQAWGKIYRAEGVRGIFTGWSPTLFGYSAQGAFKYGWYEYFKKTYSDMAGPEAAHKYKTGLYLAASASAEFLADLALCPFEAVKVRMQGSIPNPYTGTVQGISAITGKEGVAGLYKGLYPLWGRQIPYTMMKFASFETIVEMIYDRLPGQKSDYSKAAQTGVSFTGGYLAGILCAIVSHPADVMVSKLNSNRQPGEAFGGAMSRIYKDIGFGGLWNGLPVRIVMIGTLTGLQWMIYDYFKIFMGLPTTGGAPPPAQKQE

SEQ ID NO: 31906 - protein, 92 aa, Sorghum bicolor
  Clone ID: SORBI-28MAY03-C109831_1.pep
MDGQPGAVTACLGTRVKANLVLGSESFAISPESGILSEQLAAMKEKSMAILKEYITKHNAPNDVPDEPVEGESDGEGEALVNNPPKKFKKQK

SEQ ID NO: 31907 - protein, 124 aa, Sorghum bicolor
  Clone ID: SORBI-28MAY03-C109852_1.pep
EPITLAEYSLAGTGGDQFDISLVHGFNAPMSFLPSGGGGGASRCARGAGPSCPVQEITFDCPSEQRRVAGCGNPCDGQSSSCGPNNGTEYFKKACPQTVTYPRDTSNTIFTCPAGTSYEITFCP

SEQ ID NO: 31908 - protein, 117 aa, Sorghum bicolor
  Clone ID: SORBI-28MAY03-C109859_1.pep
MVKKRKNNGRNKKGRGHVKPIRCSNCSRCTPKDKAIKRFTIRNMVESAAIRDISDASVFAEYTVPKMYLKLQYCVSCAIHGKIVRVRSVVGRRNRAPPPRVRYNKDGKKIVPTTPKA

SEQ ID NO: 31909 - protein, 163 aa, Sorghum bicolor
  Clone ID: SORBI-28MAY03-C10993_1.pep
AAFLYLAGFLSDSSGGASVLTETEKTTVLKLQVGLLGMARSFQKELDQIAEKADTSTPAGLSYVLTETTLALLRHPDCCISAYSSVDVKRSMDDGEKRFNQLSIEERGKFDEETLVNVNSIKRNKGGSQRSSGFSNEYIVITILVAAEGVHKLPVINSSNDLK

SEQ ID NO: 31910 - protein, 139 aa, Sorghum bicolor
  Clone ID: SORBI-28MAY03-C109952_1.pep
MALSRSMRTCLQSGRLALLAILVSSGIVLQILACALYNNWWPMLTVLMYLILPMPLIFFLGSDTSSIMSNGGDSWVNFTKFLTGASIVGSIAIPSILKHAGVIGWGALTMELSSFVVFGVAILWFIQMNGEEDEYSGVF

SEQ ID NO: 31911 - protein, 156 aa, Sorghum bicolor
  Clone ID: SORBI-28MAY03-C109985_1.pep
YVLTSRVCMYSTSQIKMPPAPSRASTVHADLYLYGATLPKRILLAEIQYKQQQLLLEQNDLSDCDDRSMLRKNPDAFFFPRPRPRPRPCILDPLTLMSMICCCCCCWRLAWAAAMHPSASPSVGSDEQQADAGDDERRREAELEVGEEGERVAVVL

SEQ ID NO: 31912 - protein, 150 aa, Sorghum bicolor
  unsure (1)..(150): unsure at all Xaa locations
  Clone ID: SORBI-28MAY03-C109962_1.pep
LAHEPSYSYPPGTADGSWCAYGGAGHGTGASAGAGASMGGAGXAAGAAAGGRGARRAEGEAAGVEPRVGAARARPAEGAARRAVVARGRAPRRERAAGRGAEPRGGRARAGGAGERAAQRGGWRTAGEARGRRGRRCCGSGGQGRGGEGR

SEQ ID NO: 31913 - protein, 199 aa, Sorghum bicolor
  Clone ID: SORBI-28MAY03-C11002_1.pep
TRVSTRANHPYSQLQQIFKQVGVVAVVGALSRNLAYLQDHQGYLANIYDYPSLILKDPVIEQINHSVQKLTHSTSFLQFLGQHALIVPEDMQSGSDLDDDKDYHFLSLLLNLVNTFLYMVNTYIIVPTADDYSVSLGAAATVCGVIIGSMAVAQIFSSVYFSAWSNKSYFRPLVFSSIMLFLGNLVYALAYDLNSLTAL

SEQ ID NO: 31914 - protein, 70 aa, Sorghum bicolor
  Clone ID: SORBI-28MAY03-C110023_1.pep
PDLLNYEGCELLLIAASDDVEEELGLQLEGEVDVEDGEGETQQPAASCSDLVKMFGEVADVKPLLSGSWD

SEQ ID NO: 31915 - protein, 192 aa, Sorghum bicolor
  Clone ID: SORBI-28MAY03-C110034_1.pep
GARTALSLHHELDPARLPAASAAVRPHGHTPSGRYVLAGGRADEEDGLCQAITPGALKPRVTYRVAGWISVAAAGAGVGGTTTAHHHPAVHVSIRVDGGRCVMDGGAVACSAAASDDASSSRWAEIKGGFRLKESPRSAAVHVHGAPAGVDVKVMDLRIIATDRKARFRYLKDKTDKVSEPRFLFSFIYVWK

SEQ ID NO: 31916 - protein, 79 aa, Sorghum bicolor
  Clone ID: SORBI-28MAY03-C110065_1.pep
MPPLAPTTTSSSEPEPPFRPREKILEKQRYFQSVRRPTYLKGRHDVITSVAIPLALALSSMYLVGRGIYNMSHGIGKKE

SEQ ID NO: 31917 - protein, 142 aa, Sorghum bicolor
  Clone ID: SORBI-28MAY03-C1101_1.pep
GRPRVRADQAAHIEAEARAVAAARAEVDQVHADVQVLAAARTDLVNRLQGLREKLAHKKAEASKTDSVRAQIETMRREIQKGRAAVDFEKKAHSDNLEQSKAMEKNMISVASEIERLRGELANAEKGATAVNPVAAVVTLVC

SEQ ID NO: 31918 - protein, 172 aa, Sorghum bicolor
  Clone ID: SORBI-28MAY03-C110104_1.pep
ARGDVEARSGRARREQQQVVRLGHGNGGHHEEEEGRACSTGGGDHGGGAVLGRARRRRGGAALERRRRRRLGGHRGRAAADDRRRLHCRDAPAAVPAAARGGTVVPDQQPQQRLPAAIGYGVGGVGGARRRRRRRRQRRVSGSSRALMISSCAERAVRGVGCHVPEIHVRPS

SEQ ID NO: 31919 - protein, 88 aa, Sorghum bicolor
  Clone ID: SORBI-28MAY03-C110327_1.pep
TTIRRPFSRTTSPQDKKKTKTFSFSIMAKEAYIYPQYSRILVWYEQNIHSRPDEAFQPRRLDGLPLADLEAGGADDVVIGVEPQLQGV

SEQ ID NO: 31920 - protein, 96 aa, Sorghum bicolor
  Clone ID: SORBI-28MAY03-C110329_1.pep
RIGRPNACLYLVPATKLCAGHIGMAVLYTVQRSHGNARSAVMLLTIEKKRQCWMTYLATSVRRIMQSSSSPYITIVTWHVCTCQWMLVQGSRQRYP

SEQ ID NO: 31921 - protein, 156 aa, Sorghum bicolor
  Clone ID: SORBI-28MAY03-C110373_1.pep
DITIGFYAGSHGDGEPFDGPLGTLAHAFSPTDGRFHLDAAEAWVAGSDVSLSSTSGAVDLESVAVHEIGHLLGLGHSSVPDAIMYPTIRTGTRKVELEADDVQGIQSLYGSNPNFTPTSPATSSREMDSSAGAGFRPDGVFVGVVAAVGLLLVIVP

SEQ ID NO: 31922 - protein, 219 aa, Sorghum bicolor
  Clone ID: SORBI-28MAY03-C110380_1.pep
ITIPGALVSGNWNEYNLNPLTRIHWRASLVPAAAVIPATPVVAWEGACTSLMLFSPAQSPAPPVPCRATRQIGLPLHACCTLPFLPVQARQQHIPRPVAQNEHRTQEETCSCDQLIPRWENSIPLQTEQPANFRRPRHRLFAASRTKNENSARSPCNGQLDIAISFYPSDVNFFFPLVIIVFCVILLAAKHVLFRCSQPTFALAQFPYCLKTACRPRFC

SEQ ID NO: 31923 - protein, 168 aa, Sorghum bicolor
  Clone ID: SORBI-28MAY03-C110392_1.pep
TRVARNAPAAVTPPARDSAAMAARSTMLRDLLGVNLRKMFVQEVGSGGTLFATTPRARDSAAMVARPAMLRDPLGAHLRKKGFHIHPPYLRLSRSMKASDQFKAGSRNFSSFNKQRSVFRSSVTVEEIKIKLKAFAKNCWDGLDPRSSAQVWGSQEICLHHHSPLCQW

SEQ ID NO: 31924 - protein, 218 aa, Sorghum bicolor
  Clone ID: SORBI-28MAY03-C110410_1.pep
HEGIISSMEPGEQQVSAWSSFLGACRLHRNVALGEIAAERLFELEPDEASHYVLLCNIYSAAGLWEKSSEVRSRMRQRGVSKEPGCSWIELDGVIHRFMAGESAHPESTLVHAHMDALWERMRDQGYTPDTSSVLHDIEESEKAAILRYHSEKLAIAFGLLRTPPGATIRVAKNLRVCNDCHEAAKFISRMVGRDIVLRDVRRFHHFVDGACSCGDYW

SEQ ID NO: 31925 - protein, 95 aa, Sorghum bicolor
  Clone ID: SORBI-28MAY03-C110411_1.pep
GPTMVVTGDEPGLHRHVHPRQALGPQARGQAHHPVRHARPRRALPRRHGGHELAAGGTASLPFCSWVSCFFFSLSLSSHHSSVTVVISSGYIYNY

SEQ ID NO: 31926 - protein, 141 aa, Sorghum bicolor
  Clone ID: SORBI-28MAY03-C110493_1.pep
VILLAGRFRGKRVVVLGQLPSGLLLVTGPYVINGVPVRRVNQSYVIATSTKVELPQGLDLAKFDDAYFTKDKASSRKGTEGEFFDRESKPAEKELPAERAADQKALDKQILGAVKSTPVLAKYLAASFGLSKGEFPHLLKF

SEQ ID NO: 31927 - protein, 164 aa, Sorghum bicolor
  Clone ID: SORBI-28MAY03-C110484_1.pep
ARGQRVPQPAWPRAARPRAPRRPRGPGRPPRRRRPGRARARRPGGRRPRRVARRRDAPSRLRHAVPGGAVGAGAAGDCGPAGGTRPRRPEAASGAGPGAGRRRGPCASPDRHGGRGRRHGGGQEQEADRRGGVRLRRRRSPRQAQEGGSGRRRRLQGPRRGFCS

SEQ ID NO: 31928 - protein, 120 aa, Sorghum bicolor
  Clone ID: SORBI-28MAY03-C110557_1.pep
GQQGHSSSRGLEISAATLHFGPRKKPVKEKTTEEKALHSATDPCAATVHAAASSTPCARARALACCPSSAALASVPWPPGWLAAPASPAVSPARLLARRPDDRPAASAHTRSESEARLGA

SEQ ID NO: 31929 - protein, 133 aa, Sorghum bicolor
  Clone ID: SORBI-28MAY03-C110584_1.pep
FVVACCATGAGEHLIRGFAARECCISSSLSQSGPASACTKILRSVVQGSSKMSHDTGAGLLLVQADVRKGGDLSELEAAELVAAYSSPSFGVGYFGSNMNNPKVLMLKTPEGPSKTVNQFATCVKFDRESSEQ

SEQ ID NO: 31930 - protein, 133 aa, Sorghum bicolor
  Clone ID: SORBI-28MAY03-C110615_1.pep
RLISLSRGIPASSLPPQDEKTAVSPYELYEKLSTSYPALLQPLIHERDMFLAWSLKRSKAVNKSKTVVGVVGKGHINGIVYALISDQGDLRFRDLVGRASSDTWVSSLIKGLVRDTVIGLVLWALYEQLQAVL

SEQ ID NO: 31931 - protein, 175 aa, Sorghum bicolor
  Clone ID: SORBI-28MAY03-C11060_1.pep
ARGNNNSTSSASSTGSTNSSALYKVDHEADCLDYEILWEDLVIGEQIGQGSCGTVYHALWYGSDVAVKVFSKQEYSEEVILTFRQEVSLMKKLRHPNILLFMGAVTSPQRLCIVTEYLPRGSLFRLLQKSATKLDVRRRVHMALDIARGMNYLHHSSPPIIHRDLKSSNLLGDRN

SEQ ID NO: 31932 - protein, 62 aa, Sorghum bicolor
  Clone ID: SORBI-28MAY03-C110648_1.pep
HEAGMEPWDPTHRLALRWLLGYCTEVGASDEGEGSHCCVGGDLPVVWVWISLFISGGFSRLP

SEQ ID NO: 31933 - protein, 79 aa, Sorghum bicolor
  Clone ID: SORBI-28MAY03-C110709_1.pep
TRILPSSSSSVASQSPYIPALCRLPPPPRCSDPARAASTAPSSRAGPGRSDGVRAHHFTAAAHPDHHRRRRPLHHLPLG

SEQ ID NO: 31934 - protein, 79 aa, Sorghum bicolor
  Clone ID: SORBI-28MAY03-C110811_1.pep
EPSQSKTTREREGGREDEQTKLKANQPPRRPGPSSSGAEAADEAREVQVDVVVMVVVRGAGAGCCRQGAAVEVDEVASC

SEQ ID NO: 31935 - protein, 161 aa, Sorghum bicolor
  Clone ID: SORBI-28MAY03-C110830_1.pep
MNAMYIIMESQFKGYNLWQLDGRPMSGDIGRGATRETVSFATHVASMSERPPGFYQLAGGTNSYTIDCLKKAGLFQSISVAGTAASEIASSPQALIGGIAYGGYARKIVGRALRKIPEQFGRVRIEDHPDHLLEALQEAMSLIGPVKDYNPVLPSLSHDTS

SEQ ID NO: 31936 - protein, 97 aa, Sorghum bicolor
  Clone ID: SORBI-28MAY03-C110950_1.pep
ARGDSTEASDGDLGSTEEVCEFMVPADERQSICALCGEPFDDIYSFEKGNWMYKDAVFLDYPKEESSCGNNVEPEEHVPIVHVRCMPRGSNDGMEVN

SEQ ID NO: 31937 - protein, 226 aa, Sorghum bicolor
  Clone ID: SORBI-28MAY03-C110956_1.pep
MQKRVVLVSAAVAVLGLAAAALGFVAESTKSKAFVGFVGQRCVYQRTPALGCGVAAALLALTGLATATAASGCLRRRDAPAAGRRRAVAVKLSIIAWVVVAVAPVMFLYGAAMNRGGTRDVSASRPGRRYGRGYYYGCTVLKSGVFATASVLSAVATGCAIAAYVYFQRTDEPAAPGQFVAPGVAMGQPQWAQPYPPPPYPPPMAYPAPPQYGHGGYGPKQPAGTA

SEQ ID NO: 31938 - protein, 94 aa, Sorghum bicolor
  Clone ID: SORBI-28MAY03-C110996_1.pep
MASFNQDSRAAPQREEAPVQSKYGGISPKKPLINKDHERAYFDSADWVLGKQGASSNSTTTTTTTVPAAEPLKPKLQRTAYHQLPPRRPACTSE

SEQ ID NO: 31939 - protein, 69 aa, Sorghum bicolor
  Clone ID: SORBI-28MAY03-C111007_1.pep
FFFFFFFFFFRTLPFFQRAARPCDSKFGLTRGKPQAPFSMQKNLSELSVSTKSLTVGHAAIEKKKISPC

SEQ ID NO: 31940 - protein, 90 aa, Sorghum bicolor
  Clone ID: SORBI-28MAY03-C111123_1.pep
HEAISWGSCRGGPCRRRAPRGSTTPSERRTKAIPDDDDDMPVRSMHGKNEAGSRPACLPWCQSMEADRGRYSRVRSRREFSHHHIISWIN

SEQ ID NO: 31941 - protein, 175 aa, Sorghum bicolor
  Clone ID: SORBI-28MAY03-C111245_1.pep
TRGSRELYKSNEMHREALRLLNQLVEESKSEMENADFNKKFNPQMILEYLRPLCRSDPMLVLESSLYVLERNPSETIQLFLSENVPADLVNSYLKQHAPNLQSTYLELMLSMNDTGINPNLQNELVQLYLSEVLDWYKILKEEGNWTEKTYSPTRKKLISTLESNSCYNTDLLLK

SEQ ID NO: 31942 - protein, 112 aa, Sorghum bicolor
  Clone ID: SORBI-28MAY03-C111293_1.pep
MGSILSAANTTAKSMDHHETSGTYPNKRVKVSTYEYGSNPRIIPTLPDEISLQILARLPRIHYLNLKMVSQAWKAAIIGSELSQLRKELGVSEEWLYVLTKVEANKLHWYAL

SEQ ID NO: 31943 - protein, 90 aa, Sorghum bicolor
  Clone ID: SORBI-28MAY03-C111296_1.pep
DYPGPPLVMACAAYSIRGPLKLAARHRLDVLTSNNSCNGFKSSVSYPVAQRWSSNCSSITMRHVASHHHLIVKASAMLHSKASATDAATA

SEQ ID NO: 31944 - protein, 172 aa, Sorghum bicolor
  Clone ID: SORBI-28MAY03-C111307_1.pep
HEAELGAGDESEPAATNSVASDAPSSLAADRVIVVSNQLPIVARRRPDGRGWSFSWDDDSLLLQLRDGIPDEMEVLFVGSLRADVPVAEQDEVSQALLDRFRCAPVFLPDHLNDRFYHGFCKRQLWPLFHYMLPFSSSASAATTSSSVAPSSPGNGRFDRSAWEAYVLANKF

SEQ ID NO: 31945 - protein, 100 aa, Sorghum bicolor
  Clone ID: SORBI-28MAY03-C110420_1.pep
ARGQDVLIKILCKVNHSDLRQLLLVSKPVNEATIVARELHFKFSTPSAKSVFRDEETGDDEDGPGAPKQRRVARSRLRGKNLEGIAVNLSASFESLRSEV

SEQ ID NO: 31946 - protein, 147 aa, Sorghum bicolor
  Clone ID: SORBI-28MAY03-C111308_1.pep
MFTYQTDQTSPIERYLTIACATILEFFVSSILIYFIAFTFGAYLVENMTETFVFSAYMSCLCVMPLLLLTPHTNPFQIIERVLIKSSYHNQIERLMRQVAYGAVIGAWLGALVIPLDWDRWWQEWPVSCIIGCTGGSIVAFRYETFS

SEQ ID NO: 31947 - protein, 113 aa, Sorghum bicolor
  unsure (1)..(113): unsure at all Xaa locations
  Clone ID: SORBI-28MAY03-C111369_1.pep
CRPSSPRWCSASTGRCPSRRASPRRRPWTWRRKRGSSPLGSTTSSSSQHRASTHCRCRCRCRQQEKLPSSSIDXVQQILGCSSSPPSARLLFPIALLIYHHSACSSSSIRVNR

SEQ ID NO: 31948 - protein, 170 aa, Sorghum bicolor
  Clone ID: SORBI-28MAY03-C111429_1.pep
MWFKTTVLAIGIAWSLAGSKTSSRPRVTVKNGTYEGTYSPEYHQDFFLGLPYAQPPVGDLRFRVPRPLNSSFESIHDAKAYPAACVGYGGDAMFYNELSEDCLYLNVIRPAGYQGEKLPVAFWMHGGGFFQGATQDKRYNLSFIVQQSVEIGQPIIGVSVQYRLSAWGFL

SEQ ID NO: 31949 - protein, 141 aa, Sorghum bicolor
  Clone ID: SORBI-28MAY03-C111439_1.pep
HEAKKKPRLEDGTIDHSGSKPAGGHKLGPKANQGAINAGLRALDRSGKPCRRWAKGGFQLKSFTGVAWEIPRWVAPQKKAPESSAEDSTAASAEGSSKENKENGHESNSASNSNTANDVEMQSAPSNHASSPAPLAIAAAS

SEQ ID NO: 31950 - protein, 180 aa, Sorghum bicolor
  Clone ID: SORBI-28MAY03-C111485_1.pep
WLTRLVLPLQCGTSRSAPRDWLNALPRDCLHQTESCGRWPRLLHATSSAFQRQTRQLHAVIQAHGHDVDQFRAERWIPIIGAKSKSLGRWSCQILQDGQPIRRDLWRLYGIPVWMVWLMWKRTLIGRRRSILLTERPQQYSTVDSSFQKFSKHIWRHPVNWRREGRRSMLASQTGERKMR

SEQ ID NO: 31951 - protein, 179 aa, Sorghum bicolor
  Clone ID: SORBI-28MAY03-C111517_1.pep
MAWSAAAVSRFAATSPAAAPISVRLGAAASRSSLSFSSGRRRSVAASLSTSATAVKEAVQTEKAPAALGPYSQAIKANNLVFVSGVLGLNPETGKFVSENVEEQTEQVMKNMGEILKASGASYSSVVKTTIMLADLQDFKKVNEVYGKYFPAPAPARSTYQVAALPLNARIEIECIAAL

SEQ ID NO: 31952 - protein, 121 aa, Sorghum bicolor
  Clone ID: SORBI-28MAY03-C111532_1.pep
MVSIRWISRTSAGSPTVLAASAPSSSARTRTPRDRTRRRSARASAERASQDAAAAPRRASARRSEASSPAHSRRRSSASAGAAARSSGDAKCASRKARTLAGGGRSRGGDGMGWERWVGLV

SEQ ID NO: 31953 - protein, 240 aa, Sorghum bicolor
  Clone ID: SORBI-28MAY03-C11162_1.pep
AMLLAFKEAIKDYTTPPNKTLSRDLTAKISSYVSFLIECRPLSISMGNAIRFLKSRIAKLPHALSESEAKTRLQSDIDRFINEKIVLADKAIVSHAITKVRDNDVLLTYGSSSVVEMILEYAHELGRNFRVVVVDSRPKLEGQGLLRRLVAKGINCTYTHINAISYIMHEVTRVLLGASSILSNGTVYSRVGTASVAMVAHAFGVPVLVCCEAYKFHERVQLDSICANELGDPDVILKIP

SEQ ID NO: 31954 - protein, 74 aa, Sorghum bicolor
  Clone ID: SORBI-28MAY03-C11164_1.pep
LKCWPSKKNFQHCAHWEVYLCYCNSHSTYVTVAHRRMDKDLYKAVDQIGICSQGQICISTFPGIRNWCSTWNPY

SEQ ID NO: 31955 - protein, 224 aa, Sorghum bicolor
  Clone ID: SORBI-28MAY03-C1109_1.pep
KHFAAGTEKGIVSVINVEDATILYQKQFECRLSGGVASLQFEIYSHNRRVRDILIAAMEDSSIFIIEEENGKLLNPNPVQTDKPTKALLLQMLELLPNDTPGVSDNHDTVSKESLLLLCTENAIRLFSLSHAIQGTKKIINKKKLNSSCCFASLIHSSSNDIGLILVFSNGKIEIRSLADLSLLKDAFLRGFVFSRNLNSTSSIACSSDGETILLNGEETYFFS

SEQ ID NO: 31956 - protein, 113 aa, Sorghum bicolor
  Clone ID: SORBI-28MAY03-C111660_1.pep
TRAGQNQSRRFLPGGTPPEVSRSRITQHTALGFSRTGAQTLMRLGLQRSRLATERAGCGTGHPRHALLCFDRLHPPLKLRFALSPLESPRQSFASSLRQGRAPSARRVLFLTF

SEQ ID NO: 31957 - protein, 83 aa, Sorghum bicolor
  Clone ID: SORBI-28MAY03-C111739_1.pep
GAAMSFAKNPKQFGFTEGPLRTCCGGGGPYNFNPKASCGVRGSSVCTDPSAYANWDGVHLTEAAYHAIADSILNGPYTSPRLL

SEQ ID NO: 31958 - protein, 272 aa, Sorghum bicolor
  Clone ID: SORBI-28MAY03-C111665_1.pep
MFATVFTTVLAVSSLVSAAPYTLSNERRSYAQDAAILEPYHDYNTRYIALGCNTQHGKPFFDQCCHPLLKTVSLPSACTPSPSASVSASAVDATQTPPPGTVDDDDDEDCDDEDDDETSSAPAPSSSVQPTTAAAHTAVPVTSTKAPETTKASPTSSKAPAATQPSSSSNSGGFATWFRQNGVAGACGTVHGEYDLVVAIQKDRYGNLGAKSKLCGDQVKITNTNNGKSVVAVVADACPSCVNSNSIDLSMGTFQKIATLDDGMVPISWEFV

SEQ ID NO: 31959 - protein, 118 aa, Sorghum bicolor
  Clone ID: SORBI-28MAY03-C111945_1.pep
ITFFFDYFYIVCNIFYVAPARASLIEMSNGSCRASSTSCSAVPQIAGPLRVVVPSGPCLYGLRVWASAQGTACGLVFVSCRLTAHQTDNISFSLIFSLNTEIFLSLSPIIHHFHEYNN

SEQ ID NO: 31960 - protein, 150 aa, Sorghum bicolor
  Clone ID: SORBI-28MAY03-C111946_1.pep
MTTKWWEIDMKANVINIKSQDDFDEQLLMARDKFTVVHFFSPSCGACKALHSFRQISKKVHQFAEMHPGLQFLMVNCNEQTHICKRLHVCVLPLFRFYRGAEGRICSFSSQITIVMKRWYGCLSLTAANLLCMIPLAGAQPVVKLQRRKL

SEQ ID NO: 31961 - protein, 64 aa, Sorghum bicolor
  Clone ID: SORBI-28MAY03-C112026_1.pep
SSAELKVRSYCNLKFAFYGSVLCFPATVDCLTSLSKCFSFLCFGRRPSADISSYSLCMIASSST

SEQ ID NO: 31962 - protein, 187 aa, Sorghum bicolor
  Clone ID: SORBI-28MAY03-C11204_1.pep
LSSGLNEYLISDKRNADIISQNKEGIYSILGYWGMFLIGVSLGFYLFVDTSSKGKNRNTQVMKIWVLAASFWFLAIIFDSYIERVSRRMCNFAYVMLVFGQNFQVLSILTLAGFASYKKNLVLEDALNQNMLGSFLLANILTGLVNLSVNTLFAFSLTAFMILSVYTFTLCMVTGLAHFCGVRMKFW

SEQ ID NO: 31963 - protein, 144 aa, Sorghum bicolor
  Clone ID: SORBI-28MAY03-C112141_1.pep
ARGPQPPSCLLHTSDAITKFFSFSGGVVVRPVGGGRRRDGDGGRGDARGRGRAVLAGAGDGHGAAGGDVGAAGRGAGGAGHAAQPAAPPAGHRAPPPVPREGGHPVAHRDLLLVLRRGGWLRRRRRELRRRGRGRQLLRRRRGG

SEQ ID NO: 31964 - protein, 286 aa, Sorghum bicolor
  Clone ID: SORBI-28MAY03-C112308_1.pep
ARGEHLVRSGTLPKGRALVPGCGMGYDVVALASPERFVVGLDISDLAVKKAKQWSSSLPNADYFTFLAEDFFKSIPSEKFDLIFDYTFFCALDPSLRVAWAETVNRLLKPDGELLTLIYLISDQEGGPPYNNTVADYQKVLEPLGLKAILMEDNEVAIKPRKGCEKIGRWREMCTPIISVRQSSGIFLNKQRKEVDHVAASIIGCFGAPAPSPSDVNEMLASIGEMHRDLGCLEVSPLVASCATTFVASLRVDSGSVENCMCVIHPCETSFAGILLVLVSLSKLVY

SEQ ID NO: 31965 - protein, 103 aa, Sorghum bicolor
  Clone ID: SORBI-28MAY03-C112343_1.pep
DKNNCHCLCKTRPLGATQIWKTSAPPRVKLFFWLVLHKKCWTADRRWRHGLQEDNLCIMCDQLAETMDHIILGCVFSREVWAACLGRFRLQQVSVVQDQDVPR

SEQ ID NO: 31966 - protein, 99 aa, Sorghum bicolor
  Clone ID: SORBI-28MAY03-C111329_1.pep
SLDSGQIKRYNSEEDTWVTILPQVPVNDFTDAEAPYLLAGLHGRLHVITKAANNTLQVMQAVVQNNSDNAVSGENVVWTTVASRNFGTAELVSCQVLDV

SEQ ID NO: 31967 - protein, 210 aa, Sorghum bicolor
  unsure (1)..(210): unsure at all Xaa locations
  Clone ID: SORBI-28MAY03-C112482_1.pep
ARGCDVLKQCPLLQDVPLPVPARGNWGRILTNFDANCLRDVTISRNKDSIKYVELEFLSREELNATPVSYTDWVRNNSRKYQVIRDGWKATTWNMAIPVGSPEGWHRDCVVDVKDVNMEASDPCLSDLMAMLSSKTTRTLKELPVAYPILSMDDDVVYLLSRTXPREMDKLALMFAIDLRKATLRGLAELDVQKFIFLCNFCTSEICRGT

SEQ ID NO: 31968 - protein, 120 aa, Sorghum bicolor
  Clone ID: SORBI-28MAY03-C112559_1.pep
SISPDVILLFDSYFYIVIHYGSKIAQWRKLGYHKDPNHENLRKLLEAPEVDAEALLVDRFPVPKLIKCDQHGSQARFLLARLNPSVTQKTQLSEGSEVIFTDDVSLQVFIEHLQELAVQS

SEQ ID NO: 31969 - protein, 83 aa, Sorghum bicolor
  Clone ID: SORBI-28MAY03-C112592_1.pep
HEVEVEDGNVLVISGERSKEKEDKNDKWHRVERSSGKFMRRFRLPENAKTDQVNAGLENGVLTVTVPKAEVKKPEVKTIEISG

SEQ ID NO: 31970 - protein, 141 aa, Sorghum bicolor
  Clone ID: SORBI-28MAY03-C112604_1.pep
QSTETTIVALKGHARTRSTQLRTAPRTCPQILLVGSECCLQRASAFLHQCDFFLRSGYRRRRGWRHRGRPRRRWGRRRSGDQRRVHVGVGREVRSDHLREPPPGAGLSGRHHLAPPLCRRRRQLLPDGQQILLLHRVLPRA

SEQ ID NO: 31971 - protein, 73 aa, Sorghum bicolor
  Clone ID: SORBI-28MAY03-C112620_1.pep
TKAHINCKPMLFIDHTEHKNKKHTKEKPKHHSNQKKGKMQRKIGINTFLSFPLWLLMQHVATAALCCNHEASA

SEQ ID NO: 31972 - protein, 68 aa, Sorghum bicolor
  Clone ID: SORBI-28MAY03-C112636_1.pep
ARGSRAPRGCSPAAAAPTDAMSSSVLAYIYIYIYIYITSESSSCVPVFVVAVWCGVVALSSTMHALVC

SEQ ID NO: 31973 - protein, 76 aa, Sorghum bicolor
  Clone ID: SORBI-28MAY03-C112655_1.pep
MSSTAAVTTAPGSGGAKTSWPEVVGLSIEEAKKVILKDKPDADIVVLPVGSKVTGDYLPDRVRVFVDTVAETPHVG

SEQ ID NO: 31974 - protein, 143 aa, Sorghum bicolor
  Clone ID: SORBI-28MAY03-C11275_1.pep
MKAREPKKARGRVKWDEENLNDIESNKPEREKITEPKTPYHPMIDEDEGPVSPLHLSEDPVDQSAHADAIKTALAEAVSSGKIFDRNSWDMCDSEEAIKHGKAFEEHRKVHYDEYHKMKELLQKGTMNDDADEDESEVGNRKA

SEQ ID NO: 31975 - protein, 158 aa, Sorghum bicolor
  Clone ID: SORBI-28MAY03-C112755_1.pep
SPRSLAPPRPVPSRAAARPPGRGSGGTSARAEPAARGETRHHRTKRNAPTGRTAHARRRTGWRTPRPQSSSTRADRLVAHAAAGAAVAGVGVAGSGWGAGAGAVRRRWPRLRPPAAVPACLVPTQPACFLRLRLVDLFNLASWNHGRDLSFTTASFPL

SEQ ID NO: 31976 - protein, 219 aa, Sorghum bicolor
  Clone ID: SORBI-28MAY03-C11276_1.pep
MAKQQNPIPMALSLPLVLVALLLPAARGSGETPQYTTVHAESDFEVRLYRDTVWMSAPTPDIPSFHVATKLGFHRLFQYLMGANLNSSRIRMTTPVLTSVVPGAGPLHSSAYFVRFYLPTKFQASPPVPLPELNLHPDTWPSHCIAVRSFSGYARDKNVVEEAEKLAMSLSRSPWANSTNYPSNSAYSVAQYSSPFRIIGRVNEVWFDVDCKSTGVETY

SEQ ID NO: 31977 - protein, 162 aa, Sorghum bicolor
  Clone ID: SORBI-28MAY03-C112863_1.pep
ARGPSLEHDNEVRGESLDLIKYIDSNFDGPTLLPEDAAKRQFADELIAHANAFTKALYSPLMAHAAVSDEVVAALDKLEAELSKFNDGPFFLGQFSLADIAYVTILERVQIYYSHLRNYDITKGRPNLEKFIEEMNKIEAYTQTKKDPLFLLDLAKNHLKIA

SEQ ID NO: 31978 - protein, 178 aa, Sorghum bicolor
  Clone ID: SORBI-28MAY03-C112900_1.pep
TAADRALRLKANFAARGLRTSVHGVLLVELFDHPHLLLLQVRNSSFLLPGGRLRPGEEEVQGLKRKLSSKLSFVDADDDQTIEEEDDWQIGECIGMWWRSEFEAIPFPYMPPSFRAPKECIKLFLVRLPVSRQFIVPRNMKLLAVPLSQVHGNAQVYGPIISGIPNLLSGSPFSVISD

SEQ ID NO: 31979 - protein, 68 aa, Sorghum bicolor
  Clone ID: SORBI-28MAY03-C112976_1.pep
SPSPAASTRRCPRLSTTSCTPMPAEVCPSPPRRRPASVTPTRVATRSSNFRGAKGRTSGRGTRRKPRA

SEQ ID NO: 31980 - protein, 177 aa, Sorghum bicolor
  Clone ID: SORBI-28MAY03-C113_1.pep
TRSSFTGRFASKLPWKETLSFRYSDDQGDGDVVVDYFVDKLGDAYRHHGEVYGRYCSEMSRLSLELMEVLGESLGVGRRHFRRFFQGNGSIMRLNYYPPCQRPYDTLGTGPHCDPTSLTILHQDDVGGLQVFDGTGPGTGRWRSIRPHPGAFVVNIGDTFMALSNGRYRSCLHRAVV

SEQ ID NO: 31981 - protein, 109 aa, Sorghum bicolor
  Clone ID: SORBI-28MAY03-C113095_1.pep
KIQADVPAHRGLGIFVLVLGILQILAIFLRPNKDSKYRKFWNWYHHWVGRLALFFAAINIVLGIKVGGAGNSWKIGYGFNLAILLITIITLEVLLWTRWKNNSGSTGAY

SEQ ID NO: 31982 - protein, 166 aa, Sorghum bicolor
  Clone ID: SORBI-28MAY03-C11311_1.pep
LVSCAVRLIRAQMIHIKLVHLRSLQHLPKSTPVPQRVREIHDAICKQLKLAELFVFSNGSTEAEWWKPASKSANTAKPRKDVIPPKDERSLRDQDAQPDGLLRRERLSAEVLPRDYHAALHRGGVHGHGVGPPPLPAQLAQERFERVPSWHEVPHDHHEHQHLQRV

SEQ ID NO: 31983 - protein, 176 aa, Sorghum bicolor
  unsure (1)..(176): unsure at all Xaa locations
  Clone ID: SORBI-28MAY03-C11312_1.pep
DAWAKIFGLQEWGNGGSTGTDGSQQNLEETSFFRADGGYWDTPYGHFFLEWYSGMLLLHGERLCMTADAIFSGTGVTISGKVAGIHWHYYTCSHPSELTAGYYNTLLRDGYLPIAQMFAKYKAALCCGCFDLRDVERTNSESSPEGTLRHLAGAAKMCNIPLYXENSVTRLGDASL

SEQ ID NO: 31984 - protein, 225 aa, Sorghum bicolor
  Clone ID: SORBI-28MAY03-C113255_1.pep
MAVQGAAARRLLALAPARSGRAFWSASWAGADPAAPSASSTSPDNNNSSSRKKKAPSGSGHHRLAAVMDAVNERKLPPELRGRGNAVRSETDIVNVVEQRIWHSMEEGHFENLPGKGKPLNLTSNPHADPAEDTLYRILSRNGCAPEWVELNKEIRGMIIGWRLALRKAWANRSEGDDSNWNDDCRVLQEQIRQINDKVFRYNLIVPFGRQMFGLNWDKEVDKLK

SEQ ID NO: 31985 - protein, 145 aa, Sorghum bicolor
  unsure (1)..(145): unsure at all Xaa locations
  Clone ID: SORBI-28MAY03-C113264_1.pep
GAGACPSASGPTLPPPPPPAPPRPPPAHRPRRARSPRTPPRRRPPRXPPRRRPPVERPCAVDVRREXAPGAGPRRRPPRAPPPPRRRSRRSPRGPSGVPPRRCPGPRSGGWTRSSRPCCSSSTASSPCAPTTASPSDPSARRSLW

SEQ ID NO: 31986 - protein, 91 aa, Sorghum bicolor
  Clone ID: SORBI-28MAY03-C113277_1.pep
TGRREDIKTGKGMSCGFTSTVIYCRCRYVYCFLSTMWHMLYNNNVESSWSRAVSIRCYVRRVAHGQGCVWAFPQLSVLLPVSCVFPPAAMS

SEQ ID NO: 31987 - protein, 74 aa, Sorghum bicolor
  Clone ID: SORBI-28MAY03-C113132_1.pep
TRTEWGVGMEVDGDVRREALAATIREAMAGDKGKEMKRRADEWKEAAIRATQPGGTALTNLDDLIKNHVLLPKC

SEQ ID NO: 31988 - protein, 181 aa, Sorghum bicolor
  unsure (1)..(181): unsure at all Xaa locations
  Clone ID: SORBI-28MAY03-C113764_1.pep
TDVPFSATAKQVFDVAVVLSKNMGASFISPEHLAIALFTLDDPTTNNLLRSLGADPSHLASVAVDRLQAELAKDGREPAEPAAFKVPKKAPAGAGRSAFSHSLTKKKDKGALDQFCSDLTTQASGGFIDPIIGREDEIERVVQIICRRTKNNPILLGEAGVGKTAIAEGLALRIXNGDVPI

SEQ ID NO: 31989 - protein, 144 aa, Sorghum bicolor
  Clone ID: SORBI-28MAY03-C113337_1.pep
KHGEVTEEELIKAAKAANAHEFVSSLPQGYDTTVGERGVQLSGGQKQRVAIARAILKDPRILLLDEATSALDAESERIVQDALDHVMVGRTTVIVAHRLSTIKSADIIAVLKDGVIVEKGRHEALMNIKDGFYASLVELRSASS

SEQ ID NO: 31990 - protein, 137 aa, Sorghum bicolor
  unsure (1)..(137): unsure at all Xaa locations
  Clone ID: SORBI-28MAY03-C113339_1.pep
TANQEGKRAESQGRILRVVLIYCRSSXKPQHQWPVRPKNFTLDIIYLHDKPSADNCPQMVYDALVDALDHVSQYEGYILETGQGLARVLFRQMCILLSHPLQRCIQDDLDIPKQVAKKTLGTEAAQNEDGTPVSSQQ

SEQ ID NO: 31991 - protein, 96 aa, Sorghum bicolor
  Clone ID: SORBI-28MAY03-C113356_1.pep
TRATVAAGVGVSAGSSHGGTAAKQEPGPELNGQEMDSIWYDVWDELDAIPGAEMDRREADKGVAGFDVEDFSGRPCGWDDDCSYLAEPMQFVEHYD

SEQ ID NO: 31992 - protein, 62 aa, Sorghum bicolor
  Clone ID: SORBI-28MAY03-C113403_1.pep
MPHRARPMTGLLVFMGVNLALFNTISPVYDFVCFHPYWERRRERRRRELEGLQAKGSLETTD

SEQ ID NO: 31993 - protein, 100 aa, Sorghum bicolor
  Clone ID: SORBI-28MAY03-C113537_1.pep
VYIFWLSDSHHHHHGTVSASSDPAGRRPRFIRSDPIRSGRKSHAIISSGSATNRVRFSFRLALTSGDAYSGVRGSAGHLSGVLGAVAALAGIMNPVPQSG

SEQ ID NO: 31994 - protein, 96 aa, Sorghum bicolor
  Clone ID: SORBI-28MAY03-C113598_1.pep
MERVASSCASLLAQRRGYSVAAAVVKGISGRKAVEKVAKRIMGKEVNTAAAASVSAAEKTPWVPDPVTGYYRPAGGTKEVDAAELRARLLTQRVAN

SEQ ID NO: 31995 - protein, 209 aa, Sorghum bicolor
  unsure (1)..(209): unsure at all Xaa locations
  Clone ID: SORBI-28MAY03-C11366_1.pep
IGTLILQDCAVGLLFALLPVLGGASGIFGGVMSMAKLLLVLSIFVAVTYMMTWSIVPRFLKLMIQLSSQTNELYQLASVAFCLLLAWXYCGLSLELGSFLAGVMISTTDFAHHTMEQVEPIRNLFAALFLASIGMLIHVKFLWNHVDILLAAVILVIIVKSIAVTIVVKAFGYSIRTAFVVGCLSSIGELRLCFEPASISFVGGNVYYT

SEQ ID NO: 31996 - protein, 228 aa, Sorghum bicolor
  Clone ID: SORBI-28MAY03-C11367_1.pep
EELGLPPLLVDQLNKEGLTAPTEVQSAAIPIIAQKHDVVIQSYTGSGKTLAYLLPILSEIGPLKRTMEQDNSEKRSGVEAVIVAPSRELGMQIVREVEKILGPSDKRLVQQLVGGANRSRQEEALKKNKPLIVVGTPGRISEISAAGKLHTHGCRFLVLDEVDQLLSFNYREDMHRILEHVGRRSGATSRDVLGPLARRSERQTILVSATIPFSVIRAARSWGHDPVL

SEQ ID NO: 31997 - protein, 206 aa, Sorghum bicolor
  unsure (1)..(206): unsure at all Xaa locations
  Clone ID: SORBI-28MAY03-C113718_1.pep
TRSSWLSPCCPPPAHGHDATAPPGSRGEPPRRRPCCRASSHSPSSPSRRHACRRTSSPTSPPQPLTKKQKQRSWWRGHHHHPSSRHRHRARSSSHRRRRPRRLQMTRRKRRRTRTRXAWTRRTRWSWRRSSGRSGRGRKRPGGRRWTPRRRSSSAGSRTNCGSSGSTPSPTTRTCSNSVRPPAAARCSPGRSLLISSASDSCVQFV

SEQ ID NO: 31998 - protein, 116 aa, Sorghum bicolor
  Clone ID: SORBI-28MAY03-C113771_1.pep
FFFFFFLRKRVEFLYSGATGEILFSWIYHDLASLSQSRMWLLDTSRGTELNTNNKSTVHYYILLQLPRYDRATWLHASLPEDASLGHGRRRGPRGRQRPWLPRWRACRAWPSGTTR

SEQ ID NO: 31999 - protein, 132 aa, Sorghum bicolor
  Clone ID: SORBI-28MAY03-C113808_1.pep
TEEQNELIESSAEMLYGLIHARYILTSKGLAAMLEKFKNYDFGRCPRVYCCGQPCLPAGQSDIPRSSTVKIYCPKCEELNYPRSKYQGNIDGSYFGTTFPHLFLMTYPHLKPQKPLQQYTPRVFGFKLHKPS

SEQ ID NO: 32000 - protein, 125 aa, Sorghum bicolor
  Clone ID: SORBI-28MAY03-C113855_1.pep
MLVFRGSMNFTSHPEVLIAPRAPIDPECNRTLQRTPSARRNVEGKAQREVLRGVTTLRLENQQKEATVVDPLLFHALTFNQQADYFEHSVLLTVTSVGVPYGARDSERASTHQLRWLRQATTPTR

SEQ ID NO: 32001 - protein, 123 aa, Sorghum bicolor
  Clone ID: SORBI-28MAY03-C113841_1.pep
VAKPKWYERALVLAVQGVFFNAYFLGYLISPKFAHRVVGYLEEEAIHSYTEYLKDVEAGKIENVPAPAIAIDYWQLPADATLKHVVVVVRSDEAHHRDVNHFASDIHFQGMQLKETPAPIEYH

SEQ ID NO: 32002 - protein, 171 aa, Sorghum bicolor
  Clone ID: SORBI-28MAY03-C113871_1.pep
PELPLRDRAAEDEGQTGEGGGGEEEGHRGCRGSRWWRRRSGRRKQQPELVVVLDGDAQPGGAGGAVRGGPGGGRRRPHLHERVRLQQLHEHDGHGPRARRLLRRSSLRSLQLIARYDEHERGRIDRLSARYFRVNGWMDRSICRARVAVVSSNQVTSIISTTSISQCPDGD

SEQ ID NO: 32003 - protein, 274 aa, Sorghum bicolor
  Clone ID: SORBI-28MAY03-C11389_1.pep
MEFLAFSSSFHGRTMGAVALTSKSQYREPFAPVMPGVTFVDYGDLEAAKKFIQSGRVAAVFVEPVQGEGGIHSATQEFLQGLREACDEAGALLVFDEVQCGFGRTGYLWAHEAYGVEPDIMTLAKPLANGIPIGVVLVKEKVAAAINYGDHGTTFGGGPLACQTAITVFDKIMKPGFLAEVSKKGENFKQLLRTKLSGNPHVKEVRGVGLLVGIELDVPAGPLVDACLDAGVIVLTAGKSNVVRLVPPLIILKELEHAADVIRDCLPVLDVAAA

SEQ ID NO: 32004 - protein, 160 aa, Sorghum bicolor
  Clone ID: SORBI-28MAY03-C11394_1.pep
MAFFFILACTLIFLAIAYYFQYARWQKGRGRSGGGHEKQASSSLKSLPPGSMGWPYLGETLQLYSQDPNIFFASKQKRYGEIFKTHLLGYPCVMLASPEAARFVLVTQAHLFKPTYPRSKERMIGPSALFFHQGDYHLRIRKLVQGALGPDALRALVPEV

SEQ ID NO: 32005 - protein, 89 aa, Sorghum bicolor
  Clone ID: SORBI-28MAY03-C113954_1.pep
GRGGPPLKCMPPTLTVIAEHDWMRDRAIAYSEELRKVNVHSPVLDYKDTVHEFATLHVFLKTPQAQACAEDIAIWMKKYISLRGHEFSY

SEQ ID NO: 32006 - protein, 83 aa, Sorghum bicolor
  Clone ID: SORBI-28MAY03-C113893_1.pep
DELITSRSAIYKSLAVDNKFIYIYIDHTVYIWSVQIKYRVHAPIACKLQPPPALHGWRRWNMACTASPKLLRRHAWLQGTDSG

SEQ ID NO: 32007 - protein, 239 aa, Sorghum bicolor
  Clone ID: SORBI-28MAY03-C113956_1.pep
HEGNLDQWLHGDVGEVSPLTWDIRMNIMLATAKGLAYLHEGLEPKVVHRDIKASNILLDQQWNAKVSDFGLAKLLCSEKSYVTTRVMGTFGYVAPEYASTGMLNERSDVYSFGVLIMEIITGRSPVDYTRAAGEVNLVEWLKTMVAERKAEEVVDPKMTEKPSPKTLKRALLVALRCVDPDANKRPKMGHVIHMLEMDDLLFRDDKKPGRDVHPQGSDRYSSKEEGSFSKREHHHHRYR

SEQ ID NO: 32008 - protein, 266 aa, Sorghum bicolor
  Clone ID: SORBI-28MAY03-C113978_1.pep
LRSLHSQAKVVGTVCTVAGAVLMILYHGPVVPFPWSAAGHHHASAAAAAAASQSSASWLYGTVMIIGSCLCWSGFFILQSNTLQSYPAELTLATLICFLGSVLTGGVALVAERHDMSAWVIGFDTRLFTAVYSGIVCSGVAFYVQGIVTQARGPVFVTAFQPLCMIITTVLGSTILKEETTLGSVIGAVIIVVGLYCLIWGKSKDHLGSNGKPGAAAVAGELPLTSAPTANNGSYGKHAALGGGHHVVTGVETTPPPPPCVPKCVH

SEQ ID NO: 32009 - protein, 212 aa, Sorghum bicolor
  Clone ID: SORBI-28MAY03-C114001_1.pep
MLTTLHARPPVASAVDAGGEDHCESCAFYCFVASCVSLLLFIVLAAAVSVSRACAIAGAVVLLLGLVGWLAPTGNDGAAGGGAAQQQQHERQAAVRHQCVCGGLADAAIAALMPTFAYEPPAAAAADKGGDDGKPRGSTSVLCAVCLEDVRAGEMVRQLPACRHLFHVDCVDAWLRAHRTCPLCRCHLSPGNVHAKAPAAVAESSVDALPPV

SEQ ID NO: 32010 - protein, 165 aa, Sorghum bicolor
  Clone ID: SORBI-28MAY03-C114060_1.pep
MAASSTATTIISCCCCCLGPPAPPKESSAGARRPQAPAGVSVSSHALRRACVAAAACAMVGISGGGGGADMALALARGGGAFASRTDVVAVSVGAARAKAPPRWSDRRQCPPWRANSLENIVPENLPRPSAPRRFDSVSASAAAPDLSAPPSFLALRPGTGCFSL

SEQ ID NO: 32011 - protein, 184 aa, Sorghum bicolor
  Clone ID: SORBI-28MAY03-C114099_1.pep
FSVLPETDLPNGIGHMTSLHTLGYFDLSSNSIENVQSLSMLTNLVDLKLTCSTGQPQNMYNKMQFLLTSILGRLSNLKSLTLVPRASTNNAKSTDDAGATGMAISGGFSSLSSAPGLLQSLEVSPQICIFYWIPKWIGQLHELRILKIGLTKIDRDDVDVIRGLTALAVLSLYSQTKPAARIVV

SEQ ID NO: 32012 - protein, 85 aa, Sorghum bicolor
  Clone ID: SORBI-28MAY03-C114243_1.pep
TRLTHTTQLTTSDRASKKASKRSNGVLVPLQRQQRLQQGEEAAAQEGPAQTADRQDPARQPRGAGRQEPGSRLRELISGRRSRVE

SEQ ID NO: 32013 - protein, 176 aa, Sorghum bicolor
  Clone ID: SORBI-28MAY03-C114248_1.pep
ARGKVITPSSLVQLVVKARFVPPGCTQVPAVNELDLEDIDPDEDDLDALMGRKPAKNRATKVVDGKTVENKVETVQPPLAHAPYFARDHSPRWHIFLADAKQGKMAVPPFTFTTFDKPILDEAGKPTFNVQTLKMQFQAPPQVGDFTFVMHMVCDSYLGLDNKMEITLHIDDPAKA

SEQ ID NO: 32014 - protein, 183 aa, Sorghum bicolor
  Clone ID: SORBI-28MAY03-C114249_1.pep
ARGQLDPSNLEAQLLDLSNMTPTTSQISWPTTTASLCELLNIDTDVKKCHALTQKKARCQHPVSKANWAHISCLLEKAVAQGSFPAAQATLQEVSYLIMCPRYEHRDESPHRLSEWETVLKPLKMAHTKNEDKEDTLKTEKETDNTSPTTPVISSQQQIQLKSNTSITTSTPRRRSQSSPSTP

SEQ ID NO: 32015 - protein, 138 aa, Sorghum bicolor
  Clone ID: SORBI-28MAY03-C114260_1.pep
MVQPSYQNTPPFGVSNIPVMGGISGAFGIVDPSRSSGFGDPFRRMNVPSTGASATSGSAAGTTTTSEGAINGNRQDAARTQGGNPPGHPAATRGLPTRTVVAAVPARSSVEAPNHVFSVILPVQVRGQVAVPTQSSQG

SEQ ID NO: 32016 - protein, 157 aa, Sorghum bicolor
  Clone ID: SORBI-28MAY03-C114268_1.pep
TRGNRKGKESPAAQNPYAAPPANDPYAQPPPSYSSGSQDNSYRQEKTPAVTGPGQSYGQRPGGYGAQGGSYGAQSGYGNDRYGGGAPQRPGGYGGLGRTASDDTMTTDAGRNELFGNAAQRQQARPQQESGAYGQSGAYGDSQSGGYGGGAGGYGSA

SEQ ID NO: 32017 - protein, 155 aa, Sorghum bicolor
  Clone ID: SORBI-28MAY03-C114269_1.pep
TRKWPNIVIQFEDFKNPFPALERYQNQYAMFNDDVQGTGAVIVGGFINAVKASGVPVKDHKAIFLGAGSAGVGVAKQIVEFFIKEGLTEEEARRKFWFVDSNGLVTLDRGDKLADHKVYFARDDNNGRQYQSLSRLIDYVQPTILMGLSTIGGAF

SEQ ID NO: 32018 - protein, 187 aa, Sorghum bicolor
  unsure (1)..(187): unsure at all Xaa locations
  Clone ID: SORBI-28MAY03-C114274_1.pep
HEGVTGAGGFIASWLVKRLLEKGYTVRGTVRNPVDPKNDHLRALDGAADRLVLLRADLLDPESLVEAFSGCDGVFHAASPVTDDPEMMIEPAIRGTQYVMTAAADTGVKRVVFTSSIGTVYMNPYREPNKPVDDTCWSDLEYCKNTQNWYCYAKTXVAEQGAWEVARKRGLDLIVVNPVLVLGPLLX

SEQ ID NO: 32019 - protein, 136 aa, Sorghum bicolor
  Clone ID: SORBI-28MAY03-C114281_1.pep
MARLVLSECCGLAPLRLRAGRRGAAIAAPSPAALSVAAAAVVPGRPASAAIHRDWALRVSAPTRLTSAVEEDKRSSPLGEEGVADSGAAGGDGFDPGAPPPFGLAEIRAAIPKHCWVKDPWRSMSYVLRDVVVVLG

SEQ ID NO: 32020 - protein, 132 aa, Sorghum bicolor
  Clone ID: SORBI-28MAY03-C114323_1.pep
ALLHANRLPLWGTLIKPKPNMFMHLQARGYHGVSEKRNLRDHKRRLLAEKYELRGKLYKAVCRDPDLPLDMREKFRYKLSKLPRNSSMTRLRNRCIFTGRSRAVYKKFRMSRIVFRTLANKGELTGVKKASW

SEQ ID NO: 32021 - protein, 115 aa, Sorghum bicolor
  Clone ID: SORBI-28MAY03-C114381_1.pep
DDATSYYHVDDIGADGCEQLRFPAEVEVQNHGPMDGKHSVLMFLRWPNATDGRPVSQLIGFTSQHIKAGEKANVRFDVRPCEHFSRARADGKKVIDRGSHFLMVGKEEVEVSFEA

SEQ ID NO: 32022 - protein, 170 aa, Sorghum bicolor
  Clone ID: SORBI-28MAY03-C114390_1.pep
QTTHVVGTMGYLAPELARSGTASPLTDVFAFGAFILEVVCGRRPVEQSMTDSRLMLVDWVLEHWQKGSLAEVIDAKLQGCYDDEEAMLALKLGLLCSHPLPAARPSMRQVMQYLDGDMPFPELTPSHLSFSMLALMRSEGFDSFVLSASTNPSSSTAMSIGTMTGLSGGR

SEQ ID NO: 32023 - protein, 178 aa, Sorghum bicolor
  Clone ID: SORBI-28MAY03-C114421_1.pep
EAKRSKTNKSSNNNGSLRTEAETDPRSAGKAVSKSLPAAEPPKQDYIHVRARRGQATDSHSLAERARREKISERMKVLQDLVPGCNKVIGKASVLDEIINYIQSLQCQVEFLSMKLEAVNAHANQGVEAFPVKDYGAETYNTAPGLTFDTQTSREYAQGTSTSEWLHMQIGSGYERVS

SEQ ID NO: 32024 - protein, 124 aa, Sorghum bicolor
  Clone ID: SORBI-28MAY03-C114522_1.pep
VAYASQHGHAFYPNAGTVLQGNTSLGIGIRNDCARGSRLDTGAGRCEVVSVEYLGVKEPAWVGFEREWGPREEYDIGREINRAARILPRSVRERLAKLVEKVLVGEGPTGPKMHGNWRNDEKEA

SEQ ID NO: 32025 - protein, 111 aa, Sorghum bicolor
  Clone ID: SORBI-28MAY03-C114533_1.pep
NLRRHPRFSAENLQKTNQIYLKMEELANKHRCSPAQLALAWVLHQGDDVIPIPGTTKIKNLDANIDSLKVKLTDDDLKEISSEIREEDVAGARQNTSFGPTNWNYADTPRK

SEQ ID NO: 32026 - protein, 90 aa, Sorghum bicolor
  Clone ID: SORBI-28MAY03-C114524_1.pep
ESPRDPAQVQHNNAVRSVEQDPLSNIEVVMPNNEAITIEHEPLSAYVPLQSNGDSTDVKEAPSNPSMMQGEESETTRQEAPHTGELVQPN

SEQ ID NO: 32027 - protein, 99 aa, Sorghum bicolor
  Clone ID: SORBI-28MAY03-C114555_1.pep
ARGPFGVATPMLINAWRQGHDDGAADADLDLDITVPSDEEVEKMEEVVRGLATLKGPTLRPRDIAEAVLFLASDESRYISGHNLVVDGGVTTSRNLIGL

SEQ ID NO: 32028 - protein, 129 aa, Sorghum bicolor
  Clone ID: SORBI-28MAY03-C11457_1.pep
MAAADVAYAPPMKSGKAGFEAGLMDPQHRIRITLSSRSVKNLEKVCGDLVKGAKGKDLKIKGPVRMPTKVLHITTRKSPCGEGTNTWDRFEMRIHKRVIDLISTPDVVKQITSITIEPGVEVEVTISDA

SEQ ID NO: 32029 - protein, 203 aa, Sorghum bicolor
  Clone ID: SORBI-28MAY03-C114571_1.pep
ARGIDVDEFIFSPDWAGSSKPTKSMLRSVVTAVKPNIGQVTLGCKDFGPSGRTKHPKEGVTQGYTCRRRAEERHKSLVRLDSVAPSLMNSVHHFKLRPEFKWERSRAVRVNHYKYQAWDEFKVKFRRRVSTYVADWTDRVNHGSKDRTPGLGFEAVEPAGWPHKFCEVEDTLLRDVTRRWFGVGFTNKLAHHRPVGGTTHSSS

SEQ ID NO: 32030 - protein, 165 aa, Sorghum bicolor
  Clone ID: SORBI-28MAY03-C114589_1.pep
MAGRRESPLMRAGGAGPPLSRGSRIAAAVVVGVALGCLCAFLYPDGLFPRAPDSAIHWPRRAESVACDTSREVGRLKSRLVLLERKNAEFKKQINELSMKLQLSGQGKNEALYKAGPFGTVKALRTNPTVIPDLSINPRLANILEQVAVKKELIVALANSNVKEM

SEQ ID NO: 32031 - protein, 107 aa, Sorghum bicolor
  Clone ID: SORBI-28MAY03-C114647_1.pep
PLLMRNSESSLPIIISELSLEFRAILQTTNTKCCVVRDRFSQYTLETDLETMEKLVDFVYSIRRSRDITDDAETLEHLSEFTKGVGNDWSNVQSEAYSSSGPATTIA

SEQ ID NO: 32032 - protein, 190 aa, Sorghum bicolor
  Clone ID: SORBI-28MAY03-C114656_1.pep
TATPLRASTPVARSPISSRSSTPARRRQEGPVGVTTAAIVGTATEQVAPAGEVGCVGEERTVVGHGHAPSVDSLESRAAAWDEAERAKFMARYKREEVKIQAWENHEKRKAETKMKKMQMKADQMKSRAQEKLSSRLATTHRMAEEKRASAEAKLNERAARTSEKANYIRRTGHLPSSFKISCLCGSSFE

SEQ ID NO: 32033 - protein, 131 aa, Sorghum bicolor
  Clone ID: SORBI-28MAY03-C114667_1.pep
VADMVDESVAMAFGYACGSNYVRIQAGKAPAPLQAATASAAAGAMLAQRNVESVLFRGRRLSQRTNAEKVDALAVELVKEQDRRRRSPLPNVAIKQVAPPRLSSATTTSSGTVTARTASTMPSPASWDSRR

SEQ ID NO: 32034 - protein, 148 aa, Sorghum bicolor
  Clone ID: SORBI-28MAY03-C114757_1.pep
PTCPRFLRRSRDSERSATPPPPSAVCSKLLRPPGGGDGSPTGSPRSTCSRNLLRPHVAAEAMPNGWVASARGLIRHGSAAAAKASGFVRGAAAPAGRSPHRAAVAYGSNLGRAIGTPSGCYPRTAQSSFGAGLVVPSGGPLPALPDSK

SEQ ID NO: 32035 - protein, 81 aa, Sorghum bicolor
  Clone ID: SORBI-28MAY03-C1148_1.pep
RPPESLPEPRPPEREIRSRLAMESPAKEEAGGELAMEIESSVTAEDWRRALSRVVPSVVVLRTTAPRAFDTEVAGASYATG

SEQ ID NO: 32036 - protein, 241 aa, Sorghum bicolor
  Clone ID: SORBI-28MAY03-C114760_1.pep
HEVQLQAAVRGLLARRRVQKMRDLPLIQPCTYLQLHHVEDCDLIRCVGDFQNVVPPTGSVHAVFPAGGVLKVFGVGSWKPYALLCAVQTSSRPARRRHGVIGGSALPSAARFRHRPPRGRLRWSLLRPLPGGHTQARISSRWSPWDPGGWCPPYVQGLKLFLVENNKTSRDVKSLFLGVMFVSCGVILSVVVKLQLEDELHVQVGCSVRRVKDLLGLSPLGLISRLLRGQVSLACKSSKPL

SEQ ID NO: 32037 - protein, 150 aa, Sorghum bicolor
  Clone ID: SORBI-28MAY03-C114813_1.pep
LDSIHQSRSGAKSDPKRAHRKLLFDTVNELLLQKFEKETAVYSVSSYTRAKDPPSKTPSGQQLLKLISSGIEDLDMERSSIWQKEGSVIPDAEILQRLQGWSSFSKEFPGMVLEIERSIFKELVDEVVHGESADGPEMKVAGRRRRRLFA

SEQ ID NO: 32038 - protein, 170 aa, Sorghum bicolor
  Clone ID: SORBI-28MAY03-C114820_1.pep
FLPNGGIVQNFGSVQEILFLEVALTENWLIFVTRGGKTWPSWQLVGAILGVDILATLFALFGWLSGTGEVPAIHDNFKQSSNGWVAIVTVVIVWLYSFGVTVVIAIIYFILNKISWLDNLGTKDRRHKDTKLENVLGHLQKLAIQHEVDEKTGKSKFTLAEKAADDDEDI

SEQ ID NO: 32039 - protein, 94 aa, Sorghum bicolor
  Clone ID: SORBI-28MAY03-C114881_1.pep
ARGRSIPIRKDDEVTIVRGSNKGREGKVTSVYRLKYVIHVERVTRDKASGQSVPLGIHPSNVVITKLKLDKDRESILSRSKVGRELRVPNKISA

SEQ ID NO: 32040 - protein, 89 aa, Sorghum bicolor
  Clone ID: SORBI-28MAY03-C114924_1.pep
PPCAVATGGACKGHGETEDARSCCFEPGCSGGRGPQGPVEECRSSAGGEACVLLLPCRHLCLCRACEAPVDACLVCAAAKNASLLVLVS

SEQ ID NO: 32041 - protein, 151 aa, Sorghum bicolor
  Clone ID: SORBI-28MAY03-C114977_1.pep
HEAKKFFLVPDGSGSATSYISIPNISPDMAVYGLNCPFMKCPEKWTCGVEGVSRLYLNEIKRRQPEGPYIIGGWSAGGVMAYEVAQQLINAGEEVENLVLIDAPCPVALDPLPARLHIFFDQIGLLGTGKPGGTPSWLLPHFASAIQNLKD

SEQ ID NO: 32042 - protein, 50 aa, Sorghum bicolor
  Clone ID: SORBI-28MAY03-C114995_1.pep
MCGGAILAELIPSAPARRVVTPGHASGGGGGDDDFEAAFRDFDEDSDEGA

SEQ ID NO: 32043 - protein, 93 aa, Sorghum bicolor
  Clone ID: SORBI-28MAY03-C115014_1.pep
MDPKSAPPVLAIWCTDGVCPNPEDPRPPPGEGEDPAPMKWLLNNRTDFSDNGWAQLLPKENFQYAVMGGNHFTMMKGDHGVTLGKLIQQGLKL

SEQ ID NO: 32044 - protein, 139 aa, Sorghum bicolor
  unsure (1)..(139): unsure at all Xaa locations
  Clone ID: SORBI-28MAY03-C115079_1.pep
GRADRSRTTRRPPMARPQRVYEAWKGNNKFFFGGRLIFGPDAKSLILSXVSLIVIPVLVFCGFVARHLRHHFPDYNAGYAIPAVAVVFMIYVLVLLLVTSAQDPGIVPRAAHPPEEEFSYGNALSGGTPXRLQFPRVKE

SEQ ID NO: 32045 - protein, 141 aa, Sorghum bicolor
  Clone ID: SORBI-28MAY03-C11512_1.pep
MAPLLLLFLLGSICALFSLTTSSRASGKKSDGKEPRCRDGCVPEETTQQQQEEEEGKKKQARADPEKDLGIVFSTFDHDGDGFITAVELEESLRRLGIAVSADEAAAMVARVDANSDGLIDIHEFRELYDSIPKKRKHQHP

SEQ ID NO: 32046 - protein, 130 aa, Sorghum bicolor
  Clone ID: SORBI-28MAY03-C115158_1.pep
MAGRTTEGARCSGETTVCVTGAGGYIASWLVKLLLSRGYTVHATVRDPGDPKNAHLGRLEGASENLRLFKANVLDQNALAAAVSGCRGVFHLACPVPTDKVLDPESEVLAPAVQGTLNILQACSNNNIQK

SEQ ID NO: 32047 - protein, 190 aa, Sorghum bicolor
  Clone ID: SORBI-28MAY03-C14289_1.pep
MDTTSKKAYGVAIIIQLIYTGMYVVSKAAFNHGMSTYVFIFYRQAAATALLLPLAIVLERRNAPPMSFRLFLKLFFYALLGNTLSMNLYNISLKYTSATVASATSNSVPVVTFFLAVLLRLEVVRLRSPSGMAKAAGVALCLAGVLTIALYTGPSMSPVNHHRAFAEHHPQAHADGGGGKGTWIKGTFLM

SEQ ID NO: 32048 - protein, 183 aa, Sorghum bicolor
  Clone ID: SORBI-28MAY03-C115197_1.pep
LAKVLSPGINQGTADCVVGSVGFIAPEYMKNGTFSVKTDVYSFGVMVLEIISGKRWTRPLQRTYYQDLLTWAFNRTTCYGNKMVQRLKGFMHPTMHSIAFCGRTVPRCLSLPTRRRVMSKQREMRRCVRVALLCIQEKPERRPDMPEVTRMLMTSRKPAVPFPRRPGYATESPMYAGDRSTTP

SEQ ID NO: 32049 - protein, 192 aa, Sorghum bicolor
  Clone ID: SORBI-28MAY03-C115235_1.pep
INFCKMNEDWYMVAKVIAEKTALEYAEKNGLNVVTVCPTMALGPLLRPMVNVSHEFLLYIIKGGPTVMRNIPWHIVDVRDVADALLLVYEKEKSARRYICAPNYISAIDLVNMLKKAHPNYNYVNCGNDLVPNSIVTPIMSEKLKNLGWKPRKTLHKTLMDSVECYEKMGLLQDVEGCPCRLPHLFHMAIEK

SEQ ID NO: 32050 - protein, 138 aa, Sorghum bicolor
  unsure (1)..(138): unsure at all Xaa locations
  Clone ID: SORBI-28MAY03-C11524_1.pep
MAAKVASPLAFRRDVRGPLGRPHPSGGCRSGTGMPGVLYWSSGAGGSRVLAARARGRNRFGGGSGRTAKDEAADEDEEEVADVVIVDAGDEEEFACYELSGFRGLALDLSYRPVNDVCXKRAICLEFIREADVLEYYD

SEQ ID NO: 32051 - protein, 220 aa, Sorghum bicolor
  Clone ID: SORBI-28MAY03-C115278_1.pep
MGVGCLGNHMADSPARVLTPSPVRNITRRIQQMDGPSGRLGVAMPPSVAAGHALRATPSPLMLALGELEFVRIFLIYVYHGHQKIEQVLEDVSYIRHLNSLPMDYFESEIWNKFGIKYIPASDRRKNLDWDPNKTRLYYCIIEKRGDNIATIFKGPYVENTRTHLQKIVGDDNVLIVKFADIPDLENNTDNLGIYCQYYSQVADDGIVLGLRRYRFSFIK

SEQ ID NO: 32052 - protein, 71 aa, Sorghum bicolor
  Clone ID: SORBI-28MAY03-C115315_1.pep
MGEEAMDDYELHMVCYGGDDDGRVMEWESGLPGADELTPLSQPLVPPGLAAAFRIPPEPGRTLLDVHRASA

SEQ ID NO: 32053 - protein, 179 aa, Sorghum bicolor
  Clone ID: SORBI-28MAY03-C115325_1.pep
MAAFPKHSSSLAAAFFAVSMAIAAITTTALAQNTPQDFVDLHNRARPADGVGPVAWDATVAKYARDYAAKRAGDCKLQHSGGPFGENIFWGSAGRAWGAADAVKSWVDEKKHYHLSSNSCDPGKVCGHYTQVVWRKSTRLGCARVVCAANRGVFVVCSYDPPGNFNGERPFLTLDAAAK

SEQ ID NO: 32054 - protein, 112 aa, Sorghum bicolor
  Clone ID: SORBI-28MAY03-C115392_1.pep
LKTGEIAMVIGTHSLIADRTDLSSLRISVIDEQQRFGVVQRGRFNSKLYTSSSKLSDENTSSDSTSDSETFMAPHVLAMSATPIPRTLALALYGDMSLTQITDLPPGRQPIE

SEQ ID NO: 32055 - protein, 174 aa, Sorghum bicolor
  Clone ID: SORBI-28MAY03-C115396_1.pep
MAMETTNHPPLLTPYEMGEFELEHRVVLAPLTRQRSYGNGPQPHAAAVLPPRATRGAPLGPDAAAVSRAARGSADAPGLWAPRPGPPGRPCRDAVLPGGAVFFGLPWHVARGATTAFQPGGAAPISSTDRGVTPQVSHDGHVEEFSPPRRLEPREIPSVVDDFRKAARNAIDAG

SEQ ID NO: 32056 - protein, 278 aa, Sorghum bicolor
  unsure (1)..(278): unsure at all Xaa locations
  Clone ID: SORBI-28MAY03-C11541_1.pep
TRHKEYFIAIIAVSGFILTTTLAVVVWLLVYRRSKKRRRSREVLSASAAALVAPQWKVFTSEELRSITKNFSEGNRLPGNAKTGGTYSGILPDGSKVAIKRLKRSSLQRKKDFYSEIRRVAKLYHPNLVAVKGCCYDHGDRFIVYEFVANGPLDVWLHHIPRGGRSLDWAMRMRAATTLAQGIAFLHDKVKPQVVHRDIRASNVLLDEEFGSHLMGVGLSKFVPWEVMHERTVKAASYGYLAPEFIYKNELTTKXSDVYSFGVLLLEIISGRRPAQIK

SEQ ID NO: 32057 - protein, 95 aa, Sorghum bicolor
  Clone ID: SORBI-28MAY03-C115428_1.pep
TRHKASYDPLPHALPRPPLNRPTRRTMRGGSQSGFRSNNFGRRGGSDGDGREGLVGGAGTDLEGGGGRRASGAAARSSQSLQFGYTNLNTSRRDS

SEQ ID NO: 32058 - protein, 171 aa, Sorghum bicolor
  Clone ID: SORBI-28MAY03-C115531_1.pep
SRKDWYSIKAPNPFNVRDVGKTLVNRTTGLKNANDALKGRILEVSLADLQKDEDHSFRKVRLRIDEVQGKNCLTAFHGLDFTSDKLRSLVRKWQTLIEANVTVKTTDDYLIRLFAIGFTKRRGNQVKKTTYAASSQIRAIRRKMTDIIQREASSCTLTQLTFKLISRVIGR

SEQ ID NO: 32059 - protein, 189 aa, Sorghum bicolor
  Clone ID: SORBI-28MAY03-C115538_1.pep
MSAVSEKLPVLASVADGSKEPEPEESKKKKPKTDEEEIQECIEYTANTDPDQILEYEKVVKVIVPHEKSLPSTKDTPFHHEAYYANLHHYHNKLRNPNASFGKSLIYGEVVTSTNTLLEKNPSLLRTLPNGFTMTATTQIAGRGRGSNVWVAPRGALMFSTVLHHSFALSQSAPVIFIQYLAALAIVQG

SEQ ID NO: 32060 - protein, 110 aa, Sorghum bicolor
  Clone ID: SORBI-28MAY03-C115541_1.pep
PSHKRRREASPATADHHHKEDKKATDSHATPKGGGDPAAAAAAVGDGDVDAEELEMMKMMGIPVGFDSTKGKHVPDTDVSGVRVVTKRQPRQYMNRRGGFNRPLPPERNR

SEQ ID NO: 32061 - protein, 156 aa, Sorghum bicolor
  Clone ID: SORBI-28MAY03-C115558_1.pep
MAHAKAGASLPVPNVQALAQTWHGSGEPMPVRYVRTEETSAGEVVAGCAIPVMDLSRLLNPRLSEEELANLGFACQHWGFFQLINHGVPDEVIQDVKRDMIEFFKLPLEAKKVHAQVPGGLEGYGQAFVYSETQKLDWSDMIYLRISPMESRDLRF

SEQ ID NO: 32062 - protein, 189 aa, Sorghum bicolor
  Clone ID: SORBI-28MAY03-C115560_1.pep
NDIYAQLPGSPTNPVVKIGGILVNSSYSGSSYDIVTGIGLNLSNALPTTSLNLLASSLSPPLKPLTHEKLLASILAHFETLYASFCHSGFNRDMEAEYYDHWLHTDQIVTLESDGGVKARIKGITRDWGLLLAEELGWEERPTGKVITLQSDSNSFDFFQGVGAGGRCEGVVESVPSDVSKWRITGVSE

SEQ ID NO: 32063 - protein, 56 aa, Sorghum bicolor
  Clone ID: SORBI-28MAY03-C115562_1.pep
RFSTTQEQFLLVWNHITHKKQKRANWLAPKFASVELSGCSLNLCRCSLLTSSEINI

SEQ ID NO: 32064 - protein, 168 aa, Sorghum bicolor
  Clone ID: SORBI-28MAY03-C11557_1.pep
WPSASNVIPGQVNFTVDIRAMDDQVRETIVTSFSRLVLQKCDDRLVDCKVEHKHSAAATHCDPELTSQLKRAARSTVSTMPGRTAAAAGETPVLMSGAGHDAMAMARLTKIGMLFVRCRGGISHSPEESVMDDDVWAAGLALFNFIDQNVVAVSEQELEAGQNAVAVS

SEQ ID NO: 32065 - protein, 163 aa, Sorghum bicolor
  Clone ID: SORBI-28MAY03-C115585_1.pep
TQKLDWSDMIYLRISPMESRDLRFWPTRPPSFRDSVDRYSAETAKVTASLLRFMPVDLGVESERLLEAFRGQPQSMRTSYYPACKQVADVLGLSPHTDATLALLLHVNDVQGLQIRRDGKWHAIDPIDGAFVVSIGDILEVYIIREMLMPDRHRQLTQNTHPV

SEQ ID NO: 32066 - protein, 106 aa, Sorghum bicolor
  Clone ID: SORBI-28MAY03-C115612_1.pep
IITGKCKGPKFPASQCCAALKEFACPYYMYLNDESNDCASTMFSYINLYGKYPPGLFSSECKEGKLGLSCADVPQKDSATANSGYHAQSSLLVLITVLSVVVALFH

SEQ ID NO: 32067 - protein, 110 aa, Sorghum bicolor
  Clone ID: SORBI-28MAY03-C115615_1.pep
RRHVGGLRVRGASSGKTMAHVVAAASSSAAGGGEAFVVEGSYGRRACAVRDARGDVVAEVRRKEAVGDDVFRLVVSPRFGVPLAMGIVIALDEMFVAGRGSARSWLRIGC

SEQ ID NO: 32068 - protein, 158 aa, Sorghum bicolor
  Clone ID: SORBI-28MAY03-C115649_1.pep
VCFGHQVICRALGGRVGKARAGWDVGVREVAIAEAPAPALPPRRFLDALRECDQLPPRAKITEVHQDEVWEVPEGAEVLASSHKTGVEMFCVGEHMLGIQGHPEYTKDILLSLVDRLLAAGSITIPFAEAVKWQVETTAPDREFWLKLCKSFLKAREP

SEQ ID NO: 32069 - protein, 168 aa, Sorghum bicolor
  Clone ID: SORBI-28MAY03-C115652_1.pep
QRIQSIAEIKHKCDVLAQRGAQRVAIGGFGILATWWFTVYKLTFETDLGWDTMEPVTYLVSLSTLMGGYLWFLYHNREISYKSALDFTVSARQRKLYQQHNIDLQLWESLIDEGKTLRREIKSIAAEYDAEWDERVDEQYERVTQALRSERKQDDRRKSSSDKEEDDD

SEQ ID NO: 32070 - protein, 113 aa, Sorghum bicolor
  Clone ID: SORBI-28MAY03-C115668_1.pep
QCSNQDLEAIHCNKFLLLWPCSERDIPPPETSRLVDNLCLPSVLLSPSSLAHTACLSFDLLISLLTMKQNPERPRSDSRPADPLGLGRFAVDVEPRLSTPLNDDDGVACGPLL

SEQ ID NO: 32071 - protein, 152 aa, Sorghum bicolor
  Clone ID: SORBI-28MAY03-C115728_1.pep
TRGQGRRWRVGGARPVVALLLFIGVTVGFAFGVYHARHSGRDLSFAIVTYFLSVVLACCVAKLRQLRRDPAATAAERRRVRIGVWVISVALGTTVTSRVADAMPGLALKLVVWGVSVVLHGLVLYFLFVRRGAERCDAEDAGRGGLSPEERV

SEQ ID NO: 32072 - protein, 150 aa, Sorghum bicolor
  Clone ID: SORBI-28MAY03-C115692_1.pep
RVLKYIEHGKSEGATLLTGGKPAADKGYYIEPTIFVDVTEDMKIAQEEIFGPVMSLMKFRSVDEVIEKANCTKYGLAAGIVTKSLDIANRVSRSVRAGTVWVNCYYAFDPDAPFGGYKMSGFGRDQGLAAMDKYLQVKSVITALPDSPWY

SEQ ID NO: 32073 - protein, 156 aa, Sorghum bicolor
  Clone ID: SORBI-28MAY03-C115773_1.pep
DHQAPVVDAEHVEDEGLVNPTDEVPSAEAEQETFDADVEDQEQKDQQFTQRRSYQNQRGGGGRGGGRRGYPNGRGGRGGRGGGYQNGRGGGGYQNGRGGGGGYYYESGYYQPRNYNNNRGRGGRSGGGNSYYNNHGGGAQGGGHGNPGRVELGANA

SEQ ID NO: 32074 - protein, 172 aa, Sorghum bicolor
  Clone ID: SORBI-28MAY03-C115783_1.pep
PNDLTNNVHGIGHSEENITANNVARSFSTGFSIGSWEDPNSIVFSNPTSKAGIHNNDDIIASISNSYELQFGVAKEAAGLLQMQQDQVPFRVRAKRGCATHPRSIAERERRTRISEKLRKLQALVPNMDKQTSTADMLDLAVDHIRGLQSELQALKEDKEKCTCRGNRPSGR

SEQ ID NO: 32075 - protein, 121 aa, Sorghum bicolor
  Clone ID: SORBI-28MAY03-C115793_1.pep
EIAHRPITCGGVKAITEAELNYPSLVVNLLSQPITVNRTVTNVGKASSVYTAVVDMPKDVSVTVQPPMLRFTELKEKQSFTVTVRWAGQPNVAGAEGNLKWVSDDYIVRSPLVIPPKGEQQ

SEQ ID NO: 32076 - protein, 80 aa, Sorghum bicolor
  Clone ID: SORBI-28MAY03-C115935_1.pep
CKFRRGYYRCTHRHSQGCPATKQVQRTDEDATLYDVIYHGEHTCVHRPAVPAEHPPPPLPPPLARRADLLFDIDIASYFA

SEQ ID NO: 32077 - protein, 97 aa, Sorghum bicolor
  Clone ID: SORBI-28MAY03-C115863_1.pep
MAPGLRVLALLLVAAAVAVAADAVSIVVTNKCAYTVWPAALPGGGTGLNTGDSGFIDVPAGTRNGRVWGRTGCGFIMNGTLGQCQTGDCGGTLVCGK

SEQ ID NO: 32078 - protein, 124 aa, Sorghum bicolor
  Clone ID: SORBI-28MAY03-C115941_1.pep
LCRCQLFPCSSAATFETGRSAANRRRRRRGAAPRHRRHRPPRGPPRNRRSPRSCGAGSPRCLHPPATSPPLPSPAPAPSGASPAPSPIAARLSLSLTSFAVVTTGPRAAWIGIAWRRRARARGA

SEQ ID NO: 32079 - protein, 143 aa, Sorghum bicolor
  Clone ID: SORBI-28MAY03-C116101_1.pep
TPPSTRSSSPPPPPPPSRAATTSASSWSRTPRSPPSSRTSPCPRWLPRGDSSASAPPAPTPTTSRTRPPSSTSGSRSRPASTPPKASPRLSSRSTSTRATPTPSAPTPGTSRSTATTTSSSRSPSGTASTPSSPSRPGRGSGP

SEQ ID NO: 32080 - protein, 346 aa, Sorghum bicolor
  unsure (1)..(346): unsure at all Xaa locations
  Clone ID: SORBI-28MAY03-C11618_1.pep
WGGSGGTIFDDGVYTGVWQINLTRAVGISSIKVLYDRNGQAVWGNKHGFSGGVIPDKIIFDFPSEVLTHITGFYDSAIIMGPTVVRSLTFHTNKRTYGPYGDEYGTYFSTSFTNGRIVGFHGSEGWYIDGIGVHVQEGKLASQRFVSRPKTATNPSVQYNMLAQAPSNTYTDNEVAYGMVKEPVPMGPGPWGGEGGRAWDDGVYTGVKQIYIMRGAFIGSIQIEYDRSGHSIWSSRHGNSGHITHRVKLDFPHEVLTCVYGYYNMNREDGPRVLRSLTFITNRGKYGPFGDEFGSYFSSATTEGKVVGFHGRSGQHLDAIGVHMQHWLXDRRPAKYVCQVPILITG

SEQ ID NO: 32081 - protein, 63 aa, Sorghum bicolor
  Clone ID: SORBI-28MAY03-C11620_1.pep
NISQLAIFNRSWFELALVGLLSGLAPQKELCQTFFRKAIFLVNSKEIRAILTKPQIITSSKRL

SEQ ID NO: 32082 - protein, 82 aa, Sorghum bicolor
  Clone ID: SORBI-28MAY03-C116279_1.pep
MAAEQQQQPAKAAAAGSRFAVTCGLLRQYMKEQGGSGATRCLAPAVAMGLMPEADAAAAATEERTTVLELFPQQAGTLKDEQ

SEQ ID NO: 32083 - protein, 114 aa, Sorghum bicolor
  Clone ID: SORBI-28MAY03-C116219_1.pep
VSTMLRWEQNTIIFLINNGGYTIEVEIHDGPYNVIKNWNYTGLVEAFHNGEGKCYTAKVRTEEELKEALKAALGPKKDCLCFIEVIVHKDDTSRELLEWGSRVSAANSRPPNPQ

SEQ ID NO: 32084 - protein, 185 aa, Sorghum bicolor
  Clone ID: SORBI-28MAY03-C116281_1.pep
DISSTISDPGPIWDCEPKWDTGPKWDSELTWEPDHPIELPGPQEDMEMGTPMELVPNLDEKWVIRKGHFLGVLVCNHSCKTVQSLSSQVIAPKATHDDNSLDLLLVGGKGRWKLLRFFILLQFGRHLSLPYVEYVKVKSVKLKPGANTHNGCGIDGELCRVKGQVLCSLVPEQCRLIGRQWRQSI

SEQ ID NO: 32085 - protein, 182 aa, Sorghum bicolor
  Clone ID: SORBI-28MAY03-C11630_1.pep
HGAGGVNKQEKTKAADQAEQQLLLHPVPEVQDAKCECCGMSEECTPEYIRGVRGRFAGRWVCGLCAEAVTEEAEKMNGGGGGTLEEALRAHMGVCKRFNGFGRTHPVLFQAEAMREILRRRAKLGPRSRSSINPREVREVAVGAKAGSGGGGTTGIARSSSCMPFITDDFNERATSSSINKN

SEQ ID NO: 32086 - protein, 202 aa, Sorghum bicolor
  Clone ID: SORBI-28MAY03-C11634_1.pep
GGATVVATSVVPDEVDKIKGILIQWSDIDHVNLILTLGGTGFTPRDVTPEATKSVIQKEAPGLTFVMLQESLKITPFAMLSRATAGIRGSTLIINMPGNPNAVAECMEALLPALKHALKQIKGDKREKHPRHTPHAAAAPVDQWERSFRAASAGSGRGCSCDPCPRVRGCEIPTRVGNQDETVGELCSLLQCTTASSLMLKF

SEQ ID NO: 32087 - protein, 112 aa, Sorghum bicolor
  Clone ID: SORBI-28MAY03-C115617_1.pep
SCTAPSVAAANTTASVGGGSFVKVSMDGAPYLRKVDLRMYKGYRELREALEAMFVSSNSGSANLSEFAVTYEDKDGDLMLVGDVPFEMFTSTCKKLRIMKRSEATGLGSARQ

SEQ ID NO: 32088 - protein, 182 aa, Sorghum bicolor
  Clone ID: SORBI-28MAY03-C116516_1.pep
MNGGGSGGASGPDSRVETISRLAQWRIDTFGPCSYRRSDPFKLGIWNWYLSVEKSRSIFVRLFPEPGRVAKEQPPLARFLLRVSWAGPPRRTCVSPVHEHLLRTSDDFVWQVDAMSHGRFTIDVEFLDLRIANNNATESLSVWPTEGMVQKIASKSTLGCLSRMLTDSIHTDVTINTTDGVL

SEQ ID NO: 32089 - protein, 147 aa, Sorghum bicolor
  Clone ID: SORBI-28MAY03-C116532_1.pep
YELHPGHETHTYMITKRRMEGEKLTEESYQISDRVPIADGTEARTHKDQWRLPLALVLPPSLPLPLPPPPPKSLQKPQTATRGDGGSSAAVVLRRRLDLPRDVLVVPHQPRRARPPERLAGPLQPRHAPKRQREPPAPSSPARVCGW

SEQ ID NO: 32090 - protein, 160 aa, Sorghum bicolor
  Clone ID: SORBI-28MAY03-C11655_1.pep
MAPQTRREKAAAKPSSSAPTLAGPGAVEVQRRRVGGGWTSRRISIYASRVFFLLIMLQIPLFRVPCRAGTCTTPIQVTSSQLVSNEIFPPAVVKAMLYPGAIVSSLTKSKTFPSWSDLFDMYNLTEAKNASAVVDLQRLEILAGSYFCVAGALIGIINPG

SEQ ID NO: 32091 - protein, 59 aa, Sorghum bicolor
  Clone ID: SORBI-28MAY03-C116560_1.pep
SPRHSTYPLCVGFYPTANKRQRSYAVSRSKVTETKEDKANCSLFTSHYRREACHAHSTR

SEQ ID NO: 32092 - protein, 186 aa, Sorghum bicolor
  Clone ID: SORBI-28MAY03-C116567_1.pep
ARGTTAPPPHPAGSSSSSNSPRRGATRASERYGRRRRHGVRAPRGRGGGRRRRVLRGHRVPVAPVHGHLRGDRRLLLLLRRRRGRSRDEAVAARAARQRAGVRGRQGLRLRRLQRGRRRLRHLPLLIAPRPPAPGQSTRRVDATADRPGGRRRARAVHTHSHTRHRHGHGRACRNKKLKPLLHFTE

SEQ ID NO: 32093 - protein, 165 aa, Sorghum bicolor
  Clone ID: SORBI-28MAY03-C116598_1.pep
FLWVVKGAVVDRDDAGELSDLLGEGFLRRVQGQGRGLVTKSWVEQEEVLRHPAVALFVSHCGWNSVTEAASGGVPVLAWPRFADQRVNARVVARAGLGVWAEQWSWEGEEAVVRAEEIAELVMEAMGDDAMAEKAANVREAASRAVADGGTSYQSLAAFVRRCTA

SEQ ID NO: 32094 - protein, 158 aa, Sorghum bicolor
  Clone ID: SORBI-28MAY03-C116655_1.pep
MKACAKAAGERLPLVRAPSTSQPLARSFVKVSRLPSQHETKCQVSCSVRVSENTARRIYATAENIFPAMKDHVLKATDAINRGEVIAVPTDTIYGFACDACSAGAVNRIYEIKGRIQTRPLAICVADVSDISRFALVDHLPHGLLDSLLPGPVTVVLK

SEQ ID NO: 32095 - protein, 87 aa, Sorghum bicolor
  Clone ID: SORBI-28MAY03-C116614_1.pep
FFFFFFINKKKIGLVYKGNQDQKLYNKRSTMREKPCQSTKQLLGMLRKSTIKILVPSTVHDYHNYESSLSSSLTPQHSTSDFSTRCN

SEQ ID NO: 32096 - protein, 174 aa, Sorghum bicolor
  Clone ID: SORBI-28MAY03-C11670_1.pep
MACTETIAAATLGTRRPRHSRTAASFLSFRFRPSPQLSVAVAASASLRGKAKAHAEGADSKASAAIDDQHVLDVAESTWDDLVLGCECPVLVEFWAPWCGPCRMMHPIIADVARAYTGRLRCLKLNTDKNQEVATRYGIRSIPTILIFKNGERKETVIGAVTDTTLATTVERFL

SEQ ID NO: 32097 - protein, 110 aa, Sorghum bicolor
  Clone ID: SORBI-28MAY03-C116708_1.pep
ERSLNPGLDSIGVRVPDLDFIRSIARGAGSALALTSANLSGQPSSVSVKDFEGLWPHCSCVFDGGVLPSGRAGSTIVDLITPGVYKILRDGSSRKETAAVLGKFGFVEAS

SEQ ID NO: 32098 - protein, 98 aa, Sorghum bicolor
  Clone ID: SORBI-28MAY03-C116784_1.pep
MGCEEEERLLFPSFVFPESFAEAATPGSGGEQKKARQRRRRKPRPAADGGEGGDEQAKKRRLSDEQARFLELSFRKERKLETPRKVQLAAELGLDAKQ

SEQ ID NO: 32099 - protein, 257 aa, Sorghum bicolor
  Clone ID: SORBI-28MAY03-C11694_1.pep
VQTNDLSWHSNNRDETDTCSQSMSNSYYTSSFAQSYGLHGVLGKPDWFLNFSYSESHLAEEFQHEVALSYNNECKISDQPIHWYHHHCLIQSLDVQVKPPEPVSSERLKYYEHFSTYGDQSDIHILETPAHAHNIQSYTRTSDLPLEPFKPSYSENWGFYDAYTQGNALENDKYSLVSGEYGGIGSLFISPFYPGETESFELVPGDEHASFEHNWHNLRYRNMPMDDVSLITQPAEDSYSMMNGSSWPFEEHSAYNV

SEQ ID NO: 32100 - protein, 198 aa, Sorghum bicolor
  Clone ID: SORBI-28MAY03-C117046_1.pep
HEAHSGVVQFEENVGLPCGFEGDESEQVGRDELWYFLAEIALRRLLNRVSQLIYSKDSIASTTSLDPVVAELDYQLSQWYESLPLPLQFPFTRNALQDPVQTVLRLRFFACRTIIYRPYILAVLDNEQAVLDPAVRENCHKCLEASIRQLEHIHEHHAGHMPYIWQGALSIVSQTLLIMGASMSPSLLSILLTLVPHR

SEQ ID NO: 32101 - protein, 112 aa, Sorghum bicolor
  Clone ID: SORBI-28MAY03-C117049_1.pep
ARAPVSPTRRRPISPHPQSWSVPSKGPNPLAQRREGSRAARRGGRGRRQPHPLMNPSLRASKTGARREEAKGNAPPQHRPILPSVNSDNVENDAIPRFTASVHPCSIWEDST

SEQ ID NO: 32102 - protein, 177 aa, Sorghum bicolor
  Clone ID: SORBI-28MAY03-C117067_1.pep
ARGAHSTPEEPSASSLQYSTEQSKRPSTMASAALPEAVEPGKKGNVRFAFACAILASMTSILLGYDIGVMSGASLYIKKDLGITDVQLEILMGILNVYSLIGSFAAGRTSDWIGRRYTIVFAAVIFFAGAFLMGFAVNYGMLMFGRFVAGVGVGYALMIAPVYTAEVSPASARGFLT

SEQ ID NO: 32103 - protein, 94 aa, Sorghum bicolor
  Clone ID: SORBI-28MAY03-C117071_1.pep
MSGRRVGVVLAALAAALVPLLWAALVRQVWRPYAVARAFARQGVRGPPYRFYVGNNREARAMMAAAAASGEALEWSSNDIVHRVMPHVRAWASL

SEQ ID NO: 32104 - protein, 87 aa, Sorghum bicolor
  Clone ID: SORBI-28MAY03-C117084_1.pep
MGGRQGYLTLPIFSVVAAIGYVYYTTVFVAVPPWLGLSTAAGVANATAFTALAAACLATYAVAVRRDPGRVPPGFVPDVEDAESTVH

SEQ ID NO: 32105 - protein, 250 aa, Sorghum bicolor
  Clone ID: SORBI-28MAY03-C11716_1.pep
VISVFEHPYIFHTLLNPSFRFFYYTAGTGGAGPTILATSFLLLGEDVIAYNKGEEIKLKPYSGALNIDFGKGVRKKNVYLLNLPEVKSAFKILGVPTVSARFGTAPFFWNWGMQAFANFLPVEFLRDRNKVQKLVQSVDPLVRAVDGIAGERVSMRVDLDCSNGRNTIGLFTHKKLSVSVGYATAAFALAVLEGNTQPGVWFPEEPEGIPMEARKLLLERASQGTSTFVMNKPSWMVETDPKEVGLGIYV

SEQ ID NO: 32106 - protein, 130 aa, Sorghum bicolor
  Clone ID: SORBI-28MAY03-C117173_1.pep
MPGLNLPTIPTAEVRTHNSEKSCYVTIGTKVYDVTDFLEGHPGGPELILEYAGKDVEAILKDEISHAHSDSAYEILEENLIGFVATEPVINGAVRSSKPGEIVPLPPSEAGAKELKAMSQNGKPVYAATG

SEQ ID NO: 32107 - protein, 156 aa, Sorghum bicolor
  Clone ID: SORBI-28MAY03-C117177_1.pep
MSVQDRAQAQLSQLDKELSKYPALNNFEKQTSVPKVYMVLGLAGLYFFLIFFNIAGEFLVNVAGFIVPGYYSLDALFSASKVDDTQWLTYWVTFAFLTVFESAVSASYWFPFYYTFKFVLVLWMALPQTAGAQLVFRSFIQPVFSRYFSHSGSTAA

SEQ ID NO: 32108 - protein, 183 aa, Sorghum bicolor
  Clone ID: SORBI-28MAY03-C117189_1.pep
TRVEPTSGNMGLGLVLFAIQKGYRLIAVMPAKYSLDKQILLRFMGAELYLTDPALGFPGMFDKVEQLRKQLPNVHVLNQVTNKANSEAHFRLTGPEIWKDTAGKVDIFVAGSGTGGTVSGVGKYLKMQKPGVKIICVEPAESPVISGGAPGKHKIQGVGPGFIPEVLDTSVIDETVTVTTEEA

SEQ ID NO: 32109 - protein, 139 aa, Sorghum bicolor
  Clone ID: SORBI-28MAY03-C117265_1.pep
HEAVTGVTSFPQVLLTTASFDDGLWFRIGQAIGREARALYNLGQAEGLTIWSPNVNIFRDPRWGRGQETPGEDPAVASKYAVAFVRGIQGSSAAGAAAPLQASACCKHATAYDLEDWNGVARYNFDARVTAQDLADTFN

SEQ ID NO: 32110 - protein, 180 aa, Sorghum bicolor
  Clone ID: SORBI-28MAY03-C117219_1.pep
MLPLRCARSPVALSAQLPSKRVASFSTSVCRQQLNSDVRITRTGKPILTVSGGRSSLGGYTATVFGATGFLGRYIVNRLARSGCTVIVPFREEMAKRHLKVAGDLGRVIFMEMDLRNTASIEESVRHSDIVYNLIGRDYPTKNFDLEDVHVHGTERIVDAVAKYDIDRFVHVSSHSAQLD

SEQ ID NO: 32111 - protein, 67 aa, Sorghum bicolor
  unsure (1)..(67): unsure at all Xaa locations
  Clone ID: SORBI-28MAY03-C117275_1.pep
NGPVYYKGWYHLFYQYNPDGAIWGNKIAWGHAVSRDLIHWRHLPLAMVPDQWYDTNGXWTGSGTTLP

SEQ ID NO: 32112 - protein, 159 aa, Sorghum bicolor
  Clone ID: SORBI-28MAY03-C117285_1.pep
PWPTGPGNLGKFHRDGDSLNRNQWESMVCLVQSEAPWDKKSLVKNGSLNVFHLQEYNATVEFYWAPFLVESNSDDPDIHSISDRMIKPTSIAKHAANWEGVDYLIFNTYIWWMNTPQMKTLHGGSFSRKHVKYDEIERVEAYRKVLKTWSRWVEAHIDP

SEQ ID NO: 32113 - protein, 127 aa, Sorghum bicolor
  Clone ID: SORBI-28MAY03-C117327_1.pep
ARGNSGGKRRLLLSQWWVVLLGSLQLPAAAGGSGHVVRRMRGFDGPLPFYLETGYVEVDEQHGVQLFYYFVRSEKEPGEDPLLLWLSGGPGSSGISGLAYEIGPLQFVDAHGYRGGFPTLRYRPETW

SEQ ID NO: 32114 - protein, 47 aa, Sorghum bicolor
  unsure (1)..(47): unsure at all Xaa locations
  Clone ID: SORBI-28MAY03-C117329_1.pep
XLALPLPCFTSSASWDSPQSRCLQKSKKSECDHWLKGLSFGLDPPSC

SEQ ID NO: 32115 - protein, 172 aa, Sorghum bicolor
  Clone ID: SORBI-28MAY03-C117331_1.pep
PLPSPLPPRRRLSLPSASASASASFPRGAHAPRRAPLRLRALVPGAPEPDAPEPPAAASSAAAAAEAEPEPEAEADSTTVAAQPAAMSGKGQLEDLVDKARAWAVAVAAAVVAAFRRFVDWLASRDWMSWWPFWRPDRRLQQLIDEADANPNDAAKQSALLHELNKFSPEDV

SEQ ID NO: 32116 - protein, 172 aa, Sorghum bicolor
  Clone ID: SORBI-28MAY03-C117336_1.pep
TRLILALKNVPVWSVLLIIAPLIWYLLVHGERKRKEKAIRLPPSPPRLPLIGHLHLMIKEPHRTLQRLAQRMGPVIFLQLGGVPAVVVSSPEAAKEVLKTLDVHCCNRPSSPGAEMLTYNYRDIAFSPYSERWRERRKLFISELVGSKRVQSFSHALEEQVEQLIQSLSCLP

SEQ ID NO: 32117 - protein, 129 aa, Sorghum bicolor
  Clone ID: SORBI-28MAY03-C117339_1.pep
MENLSLLSLVVLLAGSPLAAAAWSESESVVACGGRSGSSSYVANSTYEANLRHLAAVLPAETEASHYHRVDRAIGYWPNRVQASASCWTWTDADGDCATCIAEAFKEVERACPFRREATFSGIDCYLRL

SEQ ID NO: 32118 - protein, 132 aa, Sorghum bicolor
  Clone ID: SORBI-28MAY03-C117347_1.pep
HEADLAAAVAREGNGCYVVAGLRRSRRERRGGRSRRDRKGGANGGAPGTGAVEKTILKRLPPTDLASLVGPPPPLSLPAAPTPPLLVDGGWGYDDYEARLRELQRQRDWYLMSTAAAAAGPDPSYFHLAAAA

SEQ ID NO: 32119 - protein, 155 aa, Sorghum bicolor
  Clone ID: SORBI-28MAY03-C117348_1.pep
PRPPPPRAAARPAPPPPPSPPPSPPPPPPPPPPPPPRRRGAPLGAPGPPPAPSFRPPRPGSLAPPAAPRPRRLHPSPGGNISGMRLPGPSSSGRPPRSPSCTGGLGVLLSLPFRLRWVCTRGLRPVRRYAALGTRSDRWRSASGPDCCSCPSAVV

SEQ ID NO: 32120 - protein, 109 aa, Sorghum bicolor
  Clone ID: SORBI-28MAY03-C117355_1.pep
SSVEQSIVARDPVAMALYAVVVTVCAPIWEEIVFRGFLLPSLTRYMPLPWSILASAAAFALAHFNAQRVMPLVFLGVVMGGVFARSRNLLASMVLHSLWNGFVFLDLMK

SEQ ID NO: 32121 - protein, 111 aa, Sorghum bicolor
  Clone ID: SORBI-28MAY03-C117358_1.pep
MVLIKSFVLSALAATVAAKSAVIELLPSNFDDIVLKSGKPTLLEFFAPWCGHCKTLAPVWEDLANTYEYAKDKIQIAKVDADAQRELGKRFGIQGFPTLKFFDGKSNKPQD

SEQ ID NO: 32122 - protein, 139 aa, Sorghum bicolor
  Clone ID: SORBI-28MAY03-C117365_1.pep
TRPSLLSTRRPPLVPRPPLHLQLRIWKAEEQPHGRRQTGLSRLRRSSLGEGENSGRRTRESLEENSDMDGLPRELCLKIFHLLDHQSLASAPQVCRKWSALTSDGELWRKLFNDRWGADAAAFYAPEGDKSWKDVFVVQ

SEQ ID NO: 32123 - protein, 124 aa, Sorghum bicolor
  Clone ID: SORBI-28MAY03-C117369_1.pep
RSSSRSKRRSRPSRATRTSSSVASKRPWAACWASSGSRRRATSRRRRARPSSRPPWPSSAPWATAAASSARRARAAWARRKRASSGSTPTSSSSARPSSPSSSAWAASSARAFVFVMSSRASPT

SEQ ID NO: 32124 - protein, 63 aa, Sorghum bicolor
  unsure (1)..(63): unsure at all Xaa locations
  Clone ID: SORBI-28MAY03-C117373_1.pep
TRVSMSLKPPTKIDLHKSFDENDTTNKSISRKVSLSSITIPAYTVADLQVATGSFSPDSLIXE

SEQ ID NO: 32125 - protein, 265 aa, Sorghum bicolor
  unsure (1)..(265): unsure at all Xaa locations
  Clone ID: SORBI-28MAY03-C11747_1.pep
DAVQPWVRSLQGHHLMAAIQNRLQSLLSRYRGRFRHHDVNNEMLHGSFYEDRLGRDIRAYMFREAHKLDPSAVLFVNDYNVEDGCDTKSTPEKFVEQVVDLQERGAPVGGIXVQGHISHPVGEIICDSLDKLAILGLPIWITELDVTAENEHIRADDLEVFLREAFAHPAVGGIILWGFWEMFMFREHAHLVDADGTINEAGRRYLALKQEWLTRTNGNVDRQGEFKFRGYHGSYTVEVDTPSGKVARSFVVDKDSPVQVITLNV

SEQ ID NO: 32126 - protein, 49 aa, Sorghum bicolor
  Clone ID: SORBI-28MAY03-C117539_1.pep
ARGEQASKDITRKLREGASRAAKRRSDRGFLPDGGGGACHGAKRTVQTK

SEQ ID NO: 32127 - protein, 174 aa, Sorghum bicolor
  Clone ID: SORBI-28MAY03-C117538_1.pep
HEVKVLRVYNAINERGGAHKLLLAATVSMVTSCCVFGLPWLAPCRPCPTTGPLASPDGTCHALNRFRRFHCPAGHYNDLASLFLNINDDAIRNLYTTGTNDVYHPASMAIFFVASYALGVLSYGVVAPSGLFVPIILTGATYGRLVAMLLGGRSGLDHGLVAILGSAYFLGGTL

SEQ ID NO: 32128 - protein, 125 aa, Sorghum bicolor
  Clone ID: SORBI-28MAY03-C117633_1.pep
ISGAELREFFASMGDDGGSLALLGLNKQDGGAGEHLMTLGFDDFVRIVESKGGEEEEREDLRRAFEAFEAVKGSGRITPRGLQRVLSQLGDEPSVAECEAMIRAYDDDGDGELDFHDFHRMMSQD

SEQ ID NO: 32129 - protein, 105 aa, Sorghum bicolor
  Clone ID: SORBI-28MAY03-C117642_1.pep
EARARRQFPSRCWLPGRLCSDADADALRPAAASRLTDWFSRRNYNGRKRKIPLVFGHAPVCCACLLLVSIKQANNIWVQHTTFLLQMDGWFMQTAPSSAQSAAER

SEQ ID NO: 32130 - protein, 132 aa, Sorghum bicolor
  Clone ID: SORBI-28MAY03-C117653_1.pep
LYGAVPMIARQVTADADLCGVDVPKGTILLIPIAMLHRDEEVWGANAGAFNPLRFRDGMGRAAAHPNALLSFSLGPRSCIGQDFAMLEAKATLALILRRFAFEVAPEYVHAPVDLLTLQPSKGLPIVLKLLD

SEQ ID NO: 32131 - protein, 165 aa, Sorghum bicolor
  Clone ID: SORBI-28MAY03-C11774_1.pep
WSETTQRLFRFFSTLSDSLPHSHRRPTTQRRRRSRRRPRPPPALSTGRPPSPGSPPPSSTRAPSTPAATPTASPVPISHFFNPERRLRSVEHHLRPSILASPGQLRRGVRPLQHRPRSSSGAASALCSTGHSPPWPATTHRTPGILSPWSSLPALPAVRSRAPKP

SEQ ID NO: 32132 - protein, 125 aa, Sorghum bicolor
  Clone ID: SORBI-28MAY03-C117757_1.pep
MPAMVVEAAAAATTTGGRYALLMAAHDSEYVLKKYGGYLHVFVAAFGDAGETWDLYRAIDGELPAPDEVQCYDGFVISGSPHDAYADDLWILRLCRLVRALHGMRKRVLGVCFGHQVICRALGGS

SEQ ID NO: 32133 - protein, 134 aa, Sorghum bicolor
  Clone ID: SORBI-28MAY03-C117759_1.pep
ARARPGRRQASASLCPDGAAGLGPKIPPGRQISRCLLWPATSGQKTGIKKRYFYHTEEMLRGHPEFLNRASPSLDARMDVMATAVLELASVAAAKAIADWGRPAAEITHLIVSTYSSGGHMPGADFRLASLLGL

SEQ ID NO: 32134 - protein, 183 aa, Sorghum bicolor
  Clone ID: SORBI-28MAY03-C117761_1.pep
ISRNMRLAAPSCAPFASARRSQLWLRGFETQSLHARPRSIALKACLGREPEQAASPASMERLWGARIPHFSPFKVPRAFAGQGQARFFRKANYIEKIGDNEKAEQILETLEVKDDERDDRPQRRVLHGEGEKTAPPQKQVEEWSEHMTQGKMLTTPSRLFKLILPLTTTDKGHDKGNRTHCHS

SEQ ID NO: 32135 - protein, 61 aa, Sorghum bicolor
  Clone ID: SORBI-28MAY03-C117782_1.pep
MSSSLEVDNPGGGGGGGGESANRLSLKRHDSLFGDAEKVSGGNYHGSDGSWARTLHLAFQS

SEQ ID NO: 32136 - protein, 157 aa, Sorghum bicolor
  Clone ID: SORBI-28MAY03-C117783_1.pep
MAATSHCGNIQDQDEEASAPGAADLYAVLGLNRECTDAELRVAYRRLAMIWHPDRCSASGSSPARMEEAKERFQEIQGAYSVLSDSNKRLLYDVGVYDSDDDEADLSGMGDFLGEMADMMSQATPTETFEELQQVFVDMFQDDLDDAGFFGGLPTTG

SEQ ID NO: 32137 - protein, 184 aa, Sorghum bicolor
  Clone ID: SORBI-28MAY03-C11786_1.pep
MGAWMSRVWFLMFPAREYKLVVVGLDNAGKTTTLYKLHLGEAVTAAPTIGSNVEEVVFKNLRFEVWDLGGQESLRTSWATYYRGTHAVIVVIDSTDRARINIIKDELFRLLQHADLEGAVVLVFANKQDLKDAMAPAEITDALSLHSIKNHDWHIQASCAITGEGLYDGLGWIAQKVAGKATAS

SEQ ID NO: 32138 - protein, 194 aa, Sorghum bicolor
  Clone ID: SORBI-28MAY03-C117896_1.pep
TINNFQMYRQIMAPGWTVGWTWAKREVIWSMVGAQATEQGDCSRFKANIPHPRSPSPSLAARRPRAPSFPPIATSCRGGVISAYGQDPASAVAAFQVSVGQAGTTNRTVKVPKNFTLLGPGPGYTCGPGKIVPSTVFLTPDRRRKTQALMTWNVTCTYSQHLASKYPSCCVSFSSFYNDTIVPCAKCACGCEHK

SEQ ID NO: 32139 - protein, 136 aa, Sorghum bicolor
  Clone ID: SORBI-28MAY03-C117909_1.pep
MHHIEPSPKGSMASSSVVAAQVAAAPSKNSQAPSLMGGGGPLAAAGKSSKAAIKREGGTAGGKHGAVGASSSDQEGPRTPDPKTLRRLAQNREAARKSTLRKKAYIQQLESGRIRLAQLEQEMQMARTHQGALWGA

SEQ ID NO: 32140 - protein, 85 aa, Sorghum bicolor
  Clone ID: SORBI-28MAY03-C117925_1.pep
GARAYPTHGRRRMRSGVCPSPSPIGQGRRLLVVLFCHWWAGRRTPPLGVPFLVPACLLCALSPASRAGQGRGPRHRLRFTQQYLI

SEQ ID NO: 32141 - protein, 218 aa, Sorghum bicolor
  Clone ID: SORBI-28MAY03-C117938_1.pep
MATAAAMNGHYSRAPKLFGRERTLHAALGGRRAADIILWRDRKASASILAAATAAWGLFEVAEYHFLTVVCYVAMIGMLVFFIWTNASTLFNLPVPRIPDTLVSERASRHAVHDVHRRLTRLVETLHDIACGKDIKMFILTVLSLYMASVIADCFSSLTLLYLVVLGTMTVPALYERYESEVDHLVARGVHDLRTHFADMDSGVLRKIPRGTGAAAPK

SEQ ID NO: 32142 - protein, 169 aa, Sorghum bicolor
  Clone ID: SORBI-28MAY03-C117961_1.pep
HEDHVLHQVLRLYNLINAKGRMAKLALALAVSVFTSAGLYLLPFAVPCSPCDPAFGDACPTVGKSGNFKQFNCPDGYYNDLASLLHATNTDATRNIFSTGTAGEFRLDSLLIFFAIYCVLGLFTFGIAVPSGLFLPIILMGSAYGRMVALVLARFVRIDHGLYAVLGAA

SEQ ID NO: 32143 - protein, 241 aa, Sorghum bicolor
  unsure (1)..(241): unsure at all Xaa locations
  Clone ID: SORBI-28MAY03-C11803_1.pep
MDKKKAFDDTEPGPAPSRAVDRFGFIKPEQSNSPDGIPKGKSIHEREREERRIRKWRKMIGVGGSDWKHYVRRNPHVVKRRIRKGIPDCLRGLVWQLISGSRDLLLMNPXVYETLVIYETSASELEIIRDISRTFPSHIFFQQRHGPGQRSLYNILKAYSVYDRDVGYVQGMGFIAGLLLLYMSEEDAFWLLVAXLKGAVHAPMEGLYXAGLPVVQQYLSQFEKLSIELMPKLGPTTCEEM

SEQ ID NO: 32144 - protein, 195 aa, Sorghum bicolor
  Clone ID: SORBI-28MAY03-C118055_1.pep
ADRLVFCHFMIGIVGDRGSSADYDDDMQRAKAAGIDAFALNIGVDGYTDQQLGYAYDSADRNGMKVFISFDFNWWSPGNAVGVGQKIAQYANRPAQLYVDNRPFASSFAGDGLDVNALRSAAGSNVYFVPNFHPGQSSPSNIDGALNWMAWDNDGNNKAPKPGQTVTVADGDNAYKNWLGGKPYLAPVSPWFFTH

SEQ ID NO: 32145 - protein, 154 aa, Sorghum bicolor
  Clone ID: SORBI-28MAY03-C118110_1.pep
MASVLAFSRCSSLLLLLLATASQALNVGDLLGTAPSGSKDCSRTCESSFCIVPPLLRYGKYCGILYSGCPGEKPCDALDACCMVHDHCVATHNNDYLNTRCNENLLSCLDRVSPAGPTFPGNECGVGQTASVIRGVIESAVLAGKILHKRDDGP

SEQ ID NO: 32146 - protein, 162 aa, Sorghum bicolor
  unsure (1)..(162): unsure at all Xaa locations
  Clone ID: SORBI-28MAY03-C118126_1.pep
MSSSSNGGKKPAASGGRGGPTIRTLSDLNRGPAGFPGAGGHGSGSDDDEPQEYYTGGEKSGMLVQDPTRRNDVDAIFEQARQAGALHGMPPFLGDESSGSRSFSGTGRLLTGETVPSAAPQEPAPVRIRHNIXXWNNGFSVDDGPLRYYDDPENAEFLESLK

SEQ ID NO: 32147 - protein, 312 aa, Sorghum bicolor
  Clone ID: SORBI-28MAY03-C118129_1.pep
DWKKGHYFNDNEICDEFHEVDLRDLDTCMKMCQGIDEVYDFAADMGGMGFIQSNHSVILYNNIMISFNMVEAARRSGSVKRFFYSSSACIYPEYRQLETANPGLKESDAWPAQPQDAYGLEKIVTEELCKYYNKDFGIEFRLGRFHNIYGPHGTWKGGREKAPAAFCRKALVCGDVFEMWGDGKQTRSFCFIDDCVEGVLRLMRSDVREPINIGSEEMVDMNEMAHLVLEFAGKKNSTKLHHIPGPEGVRGRNSDNTLIREKLGWAPSISLKDGLKRTFDWIKLQIEAEKAQGVDVSQYSQSHVVNQKPTDK

SEQ ID NO: 32148 - protein, 192 aa, Sorghum bicolor
  Clone ID: SORBI-28MAY03-C118135_1.pep
MLERSSSTPSSRTPASSWLPPPRSPLGVDEEYDSAFKSKSFLDLWSHAHRHLMHTFSSASFKLASSSSSKSGGVKDGEPDDAAAAAATLEQSCSYTVLDDFVLEPSPEVLGRGRRRRRRRVERLLIEYFDVTQEACEACSSLLAAIGAARRHQEDGGARDDARLAAVAGGGDAAAAAAVPRLASHQSSLIAS

SEQ ID NO: 32149 - protein, 128 aa, Sorghum bicolor
  Clone ID: SORBI-28MAY03-C118212_1.pep
GKHETMSRELAGTLAYGAAKAECDESVQNQPEDVNQQQSREKQTTNSTVKDEPVTLEPQVFEKPWSIKHEDTMTLADATMKKQGDLGFKRTIKDIEVEADMKPCQPTKKEKAVKAACQASLLSYFARK

SEQ ID NO: 32150 - protein, 97 aa, Sorghum bicolor
  Clone ID: SORBI-28MAY03-C118286_1.pep
DRMVEISPALAAYDVVEPVALPALSKVQLVDQNKGAQVTGTPLKKVIDNFYFTDVISRSSPTMARCSAAKATGDPRTNFMAPGMEEDKPMGQVEYGV

SEQ ID NO: 32151 - protein, 85 aa, Sorghum bicolor
  Clone ID: SORBI-28MAY03-C11829_1.pep
ATARATAAALRPAAMSSSGPLPAAGTHHTRNRANNRRKSGDRADRANYSYNNDGEKSHVPSLKNLPPIVHHETFFSNVQNDYNQT

SEQ ID NO: 32152 - protein, 76 aa, Sorghum bicolor
  Clone ID: SORBI-28MAY03-C118303_1.pep
HFQASAITKHGCWWSYMAKQLAFRTHQNSNPQAHKTQPAAHKHRPKRMNDKSLDKRLINLRIRQSVIGALDDIGHP

SEQ ID NO: 32153 - protein, 45 aa, Sorghum bicolor
  Clone ID: SORBI-28MAY03-C118326_1.pep
TPTQYNCYCTCSKSIHSCMPGRANSTIMVFLLSCLHPISSKYAMD

SEQ ID NO: 32154 - protein, 97 aa, Sorghum bicolor
  Clone ID: SORBI-28MAY03-C11838_1.pep
SSRKLSKGKISKKMQRQQDDDDTVHAAAIVLAAAARSTSTGLLRHQQQLDDHDHASCAAAVHVIYFLTATCFLFRISVEFHKSYQEHVNMSQEYTTR

SEQ ID NO: 32155 - protein, 111 aa, Sorghum bicolor
  unsure (1)..(111): unsure at all Xaa locations
  Clone ID: SORBI-28MAY03-C117825_1.pep
DLSTVNTIQELDDRYFSIRGFVAALKRESFDGSNYKSWHARMVLWLATMRCYHIAERKPEQFTPKKEQKFIEANNLFXGTMISALDKKYVDSYIICTTTKELWNALEAKFG

SEQ ID NO: 32156 - protein, 198 aa, Sorghum bicolor
  Clone ID: SORBI-28MAY03-C11843_1.pep
MEAAAAAATGLSQRPVVLYPSPGMGHLVSMIELGKILGARGLPVTIVVVEPPYNTGATGPFLAGVSAANPSISFHRLPKVERLLPIKSKHHEALTFELVRISNPHFREFLAAASPAVLVLDFFCSIALDVAEELRVPAYFFFTSGPGVLAFFLYLPVLHERTTASFQDMGEEPVHVPGIPPFPATHSILPIMERDDAA

SEQ ID NO: 32157 - protein, 151 aa, Sorghum bicolor
  Clone ID: SORBI-28MAY03-C118477_1.pep
ARGSFKHLGRSHGVIVNTLRLLEQRAVETVAAGHCTPPGLPTPPVYCIGPLIKSVEVVGKRGEECLAWLDAQPSGSVVFLCFGSLGRFSAEQIREVAAGLEASGQRFLWVVRAPPSDDPAKKFAKPPEPDLDALLPEGFLARTKGRGLVVR

SEQ ID NO: 32158 - protein, 108 aa, Sorghum bicolor
  Clone ID: SORBI-28MAY03-C118492_1.pep
EQGLEPLDRYDDDDANVMDDDGSMASHESHNCQAQDASPLLVPDPDHYDHVMVVASGGFGRQPNRELFGLARPNTPNSALRFAGSRQIRVGKSVLDVTLLPRAAQNSP

SEQ ID NO: 32159 - protein, 166 aa, Sorghum bicolor
  Clone ID: SORBI-28MAY03-C118574_1.pep
KLSEKACTHAAQNELLPLRVVVQVLFFEHARAAALASGGGHAAVAATADLPSNIRALLSNKSGSSEDEEADRVDEQRLRALAAGGSPGDDWSVEGLRRAASKIATLRMKLAEDEDYEDRDADEFARKARLARSASLRFRAFCAIPAGKPKRMLSKLWPLGRSGVSH

SEQ ID NO: 32160 - protein, 229 aa, Sorghum bicolor
  unsure (1)..(229): unsure at all Xaa locations
  Clone ID: SORBI-28MAY03-C118614_1.pep
MNSTILRSNAARSALRAATKSSARAGVATTFVRGKATLPDLSYDYGALEPSISGKIMELHHKNHHNTYVTSYNNFSEQIAEAKAKNDIKAQIALQPLINFHGGGHINHSLFWENLAPTSQGGGEPPSGALAAAINDSYGGLEKFQEKFNTALAGIQGSGWAWLVQDIQTGSIQIKTYANQDPVVGQFRPILGVDAWEHAYYLDYQNRKAEYFKAXWNVINWKAAEKRFQ

SEQ ID NO: 32161 - protein, 145 aa, Sorghum bicolor
  Clone ID: SORBI-28MAY03-C118630_1.pep
HEARLQLNLRSILHLLVPTRILLAAWIRKQAVGKLIARFCSCPMSRAKKSITIPRNYRLDIDLVYSGLHTATQSLRHSSQSDRSAINQLTWSITRMQARRTSSPRRYYKLKKGYSPSEPVERQGKDLSSFTIADAEYAPQKNLDC

SEQ ID NO: 32162 - protein, 159 aa, Sorghum bicolor
  Clone ID: SORBI-28MAY03-C118644_1.pep
DDAPSAHGGVQEPLELDERDVVWSSSSSSSAASSPSPTPSPSSSSLRQQPPEADLHVVARPERQHAPQPYHQSAPMAVPAWPKAMTAADRRRREAELQTAAYFDDDDDDSEPVVPPHEMAARRAAAAASVMEGAGRTLKGRDLRRVRNAVWRTTGFLDL

SEQ ID NO: 32163 - protein, 179 aa, Sorghum bicolor
  Clone ID: SORBI-28MAY03-C118765_1.pep
MSRLDAASLLAPWPPLAKPHPRGRFLCLLSSMLAVLGASLAVLLFFALQPVPNVVPNYEALFLSLGSNDTAASHLRALTLHPHVAGTKANAITARYVLDALSALSFPAHITPYSVLLSYPVHRSLSLSAPGRGVVTSFSLKQETYPNDPYAAAAAETIPTFYAYAASGSVSAEAVYANY

SEQ ID NO: 32164 - protein, 272 aa, Sorghum bicolor
  Clone ID: SORBI-28MAY03-C11880_1.pep
HSLTDPVAMWHVRAEIAPAILLVVDFGGWYKVDSKSANRNSSRMIQHTQVSLLKDVIVPYTHLLPTLLLSENKDRPTLLYFKGAKHRHRGGLVREKLWDLLGNEPDVIMEEGFPNATGREQSIKGMQTSEFCLHPAGDTPTSCRLFDAIASLCIPVIVSDEVELPYEGMIDYTEFSIFVSVRNAMRPKWLTSYLRNIPKQQKDEFRKNLARVQPIFEYNTSYSISRGSTSIDGAVSHIWKKIHQKLPMIQEAIIREKRKPDGASIPLRCHCT

SEQ ID NO: 32165 - protein, 139 aa, Sorghum bicolor
  Clone ID: SORBI-28MAY03-C118115_1.pep
ILCRKTTRRNMTTSAIKPLTVLFFFLAVSPRGTNGEPCGTSSIQVQTINTGATAAGGDTVFEVQVKNLCPCSVRNVRVDGGGFATTVEVDTNLFRSVDGSVYLVNAGEPIASMGTVSFRYAWDHFFQMTPRSLEVEGQC

SEQ ID NO: 32166 - protein, 159 aa, Sorghum bicolor
  Clone ID: SORBI-28MAY03-C118815_1.pep
MTPLDCDMPPAASCKKRLSPSRPLPNRCLLILIVALAAAAAVASAQLSSEDYYDASCPAALFTIRTAVSTAVLLDRRMGASLLRLHFHDCFVQGCDASVLLDDTASFTGEKGAGPNAGSLRGFDVIDNIKMLLELLCPQTVSCADILAVAARDSVAQLG

SEQ ID NO: 32167 - protein, 208 aa, Sorghum bicolor
  Clone ID: SORBI-28MAY03-C11886_1.pep
SFYVHAEGNSSTSKTILDALQSASKSLGSDNVKVKQAASSNPGVPPSSLMSFIRKNTSTSGVVLEDFDSHFSNRFYHSYLDNPVNINSSSIAAAAALVARSLYILANDGSVVDLITLNTIKVNVSLVEELIGCLLTCNPGLSCGLAKRFISPSNSCPSHLCFSAHDDPTGTGFPLSAGDSSRSEWNFLADRTSNLAGNKSSCTGKCAD

SEQ ID NO: 32168 - protein, 107 aa, Sorghum bicolor
  unsure (1)..(107): unsure at all Xaa locations
  Clone ID: SORBI-28MAY03-C11898_1.pep
ALLDGVRHRASWCTPVQPQRTKHVEIDLHFIXERVAIGNVRVLHVLTTSQFADIFSXGLPTSVFQEFGLVFPVFMTAWSAIRLHGRRGVSMLNVRRLPGITPDRHAA

SEQ ID NO: 32169 - protein, 165 aa, Sorghum bicolor
  Clone ID: SORBI-28MAY03-C119059_1.pep
PENAEFLESLKMSKCPRELVPTDGEHVDVSVIKRMEDYREPVRPRSAFQGVGRTLGGGPSPDESATPAPAPAPAAPAASRSVGIVVDDSQPFTSIQLRLADGTRMVARFNLHHTVGDIRSFIDASRPGATRPYQLQTGFPPKQLADPMQTVEQAGLANSVIMQKM

SEQ ID NO: 32170 - protein, 169 aa, Sorghum bicolor
  Clone ID: SORBI-28MAY03-C118936_1.pep
SSSVTSRKQAAEIADAMAQVKRPFLWVLRKDNWKDDDDDDAAIKKAAAAAVDPDSGGGMVVSWCDQARVLSHPSVACFVTHCGWNSTLESLACGVPTVAVPQYSDQGTAAWLVAERMGAGVRVRVRADDDGGVVVEADELARCVEAAAASDAVAARAAALMGKARAAVA

SEQ ID NO: 32171 - protein, 67 aa, Sorghum bicolor
  Clone ID: SORBI-28MAY03-C119083_1.pep
MRQAREETTKLDDGQRLLVIVGWETQNKKQNSLSNERSLTRLPLGYPPFLKPGWMHPGLACVSLLCI

SEQ ID NO: 32172 - protein, 124 aa, Sorghum bicolor
  unsure (1)..(124): unsure at all Xaa locations
  Clone ID: SORBI-28MAY03-C119182_1.pep
INLLCLTVSTVMVELDGVFTISANVVPITDSDDWIHKYGETGSVDXLVHLDLGFQFHNLTKDVDGVLGXTYRPGYVSKLDIGAKMGGAPKYLSAGLFSTNCAVSRFHHRSFDGAGAGVITTFAS

SEQ ID NO: 32173 - protein, 212 aa, Sorghum bicolor
  Clone ID: SORBI-28MAY03-C119235_1.pep
RLAPEHRLPAAFEDAADAVLWARPHAAAGRPVFVMGSHNGASIAFRAALAAADAGVELRGVILNQPHLGGAERSPAEAASVDDRVLPLAANHLLWELALPVGADRDHEYCNPEAMLARVGAARLRRLPPCLVLGRRKDPPRDRTRTLVNALRKAGVAVEARLDGAGYHAMELFKANCAAEFTAQVADFVRRHSSADTGASASAGDVVGMSKL

SEQ ID NO: 32174 - protein, 172 aa, Sorghum bicolor
  Clone ID: SORBI-28MAY03-C119273_1.pep
MPSAAAAAAAPLHRIACARQRLPQTSLFFLPPRALPNSGRLTVPAPLPVHALRLPPTATRAASHDAATGARSPTSGGQMLVFVPPHPLIKHWVSVLRNEQTPCAIFKSAMAELGRLLIYEASRDWLPTITGEIETPVAVASGEFIDPREPVLVVPILRAGLALAELASSVLP

SEQ ID NO: 32175 - protein, 111 aa, Sorghum bicolor
  Clone ID: SORBI-28MAY03-C118420_1.pep
GDHSTPVEYGDHSFEPVPFAICRLRDYAAAIGEDNVINTQLDDFPLPSVKSGEDLLDDIESPERKPDQLKAFSGDAVCEFNEVATARGCLGRFPGSEMMGIIKKFIKAKND

SEQ ID NO: 32176 - protein, 171 aa, Sorghum bicolor
  Clone ID: SORBI-28MAY03-C11928_1.pep
EYKAAIKDYDDVLDLELDSMDKFVLQCLSFYQKEMALYIASKANLEFSQFNIDDDVDPLFKEYWCKRLHPKNVAEKVYRQPPLRISLRNGRLNKQDFKFTKHQTTLLLAADSIGKKIQYNCRGFLPNQRQYRMAGLAAIEIAQKVSKAWRFLRNPKNIAKLVRKRDKLNMS

SEQ ID NO: 32177 - protein, 165 aa, Sorghum bicolor
  Clone ID: SORBI-28MAY03-C119295_1.pep
QLLKLHSVFPRSLTMEAPIMMKQYDTAPKAALPHDLPPTELSVPGPDSVTLAKKRSQWSCIDDNRLRNNLFAAVGFLELANAGDFAANVWNDVPVPIYAIVFMAIGGTSAFVLSICAFFDSRQAWRNIKFLRQQKQYLETEKENLHAGADSRGLDVFIEITTREL

SEQ ID NO: 32178 - protein, 117 aa, Sorghum bicolor
  Clone ID: SORBI-28MAY03-C119303_1.pep
MAQQRQQRRRGSGAVLRLVAVLLALLSLCLARADAMAAPSASTSLAGAAPASFSEHGVAAALENALAQEVARGHSTAAAAAAEEDGGDGDVVLERVAMESTEDYSFPGANSRHVPHP

SEQ ID NO: 32179 - protein, 103 aa, Sorghum bicolor
  Clone ID: SORBI-28MAY03-C119412_1.pep
MCTPAAVRGRVRLNVGGRVFQTTAATLASAGRDTMLGAMLDASWNACRDDAIDGGGAAAEYFIDRDPASFAVLLDLLRTGGLHVPPGVPEATLYREALYYGLL

SEQ ID NO: 32180 - protein, 272 aa, Sorghum bicolor
  Clone ID: SORBI-28MAY03-C119450_1.pep
HEAKTEKKKRLFFKKAENPSPAYALGEIEEGAPGADVEKAGIVNQQKLEKKFGQSSVFVASTLLENGGTLRSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNVASIWFMALFICIAVTGILEMRWSGVAIDDWWRNEQFWVIGGVSAHLFAVFQG

SEQ ID NO: 32181 - protein, 221 aa, Sorghum bicolor
  Clone ID: SORBI-28MAY03-C11947_1.pep
KDYDEDTTFLCRVSLIDIDCTSGWCYLGCDTCQKSMGRAPRKYRCSRCGPIKRPINWYKLKTTVKDATGTMTLMIFCEVAEELVGVSAEELVDEIEDDEEWYTLPEEIEDLLGSTRTFQVFDKHLSGSFSVYAIMDDDIVPVPAATTSQCKEESVPEGSVNAAFPSPATTLCKVEPVLEDSVGMAAPAPTMTPCKEEPFSMVVPAPTTKHECKEEPFVEQC

SEQ ID NO: 32182 - protein, 123 aa, Sorghum bicolor
  Clone ID: SORBI-28MAY03-C119492_1.pep
PRTPASGAAAPRRHSSTPKTKSVPILMIAKKCSSCPRGWAPVCVLRDGGKGSPLRRARTGSDTQPSPCQPKKFVKKLFQMTSYKSRTPPETKATPPQDPSKDAFCKQRTAHNRPWQEIGHVFH

SEQ ID NO: 32183 - protein, 242 aa, Sorghum bicolor
  Clone ID: SORBI-28MAY03-C119494_1.pep
HEGEKADKLDEDLSHVEKTVARVARREADLETDYTDLATQFRKLVPLEPAVEMPLQVFAASVEETARGMHNLKDHTDQNYLGSLRDMEAYILSVKALLKTREQKQLDFEALVDYRNKAVAERDSLAANPAAYYASNPLTSSPASFIRSKMEDMRGVDHEQSRRERVRKLELRIDELTREVESAKTTSEMFDEEVVREVADFERIKAVEFRDSLGALAEAHIDFYQGVLSTWERFIAEMEGEC

SEQ ID NO: 32184 - protein, 180 aa, Sorghum bicolor
  unsure (1)..(180): unsure at all Xaa locations
  Clone ID: SORBI-28MAY03-C119512_1.pep
RPFDEAASFLSSIQAQLSNLCSAGSSPAATATHSDDMMGSSEDEQCSGDTDVPDIGQEHSXRLADHELKEMLLKKYSGCLSRLRSEFLKKRKKGKLPKDARTVLLEWCNTHYRWPYPTEEDKVRLAAMTGLDPKQINNWFINQRKRHWKPSEDMRFALMEGVAGGSSGTTLYFDTGTIGP

SEQ ID NO: 32185 - protein, 141 aa, Sorghum bicolor
  Clone ID: SORBI-28MAY03-C118811_1.pep
RHEGRVSHRAREQANLIDRSMVLRACAVMEAGTFSVPFYEWLKPRSSSSSPPPSPSSSSSTTSSTTLSTPSIDQLAAVDERHAMTCLPLLGRLEGRAATPDHGHNNPIKEELLSNNIATTGGATRREEAAAAGVDLNIGLP

SEQ ID NO: 32186 - protein, 186 aa, Sorghum bicolor
  Clone ID: SORBI-28MAY03-C119624_1.pep
HEAASDRAVPGADATEASSLRLRRAPSADAGDLADDSSGDRRENGEPQPPQEQQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLIRRKLIGEHVVILLHIIITTSVIVYPVVVTLNR

SEQ ID NO: 32187 - protein, 172 aa, Sorghum bicolor
  Clone ID: SORBI-28MAY03-C11965_1.pep
PHLTEVGSMCGPSFPNTAPNAVGAFPTTADAARGVVRGATSARVSCSTVAEVDRQEEAARGGRNTGGDQQGTLTRHSSRNEHRRRPTGGAAPQVHDTVNPRQRGVWLQHRDAREEEEEEEEEEEEEEDGRTGCGLAARAAVLGRCGAASEGRRCRLVRSGERGIGIGRGRET

SEQ ID NO: 32188 - protein, 111 aa, Sorghum bicolor
  Clone ID: SORBI-28MAY03-C119688_1.pep
MPVRVPKLPAAKPSEIFCMGAAGVGVLTPLYLVMPGAEERLSNQTNKWAPRWERNVSYFIPPMEKGVQRIEPPVSRMVQRVEDRLPLEKMAKSVDKGIRSGIARFNGENKP

SEQ ID NO: 32189 - protein, 96 aa, Sorghum bicolor
  Clone ID: SORBI-28MAY03-C11971_1.pep
ALTHLLEGRHVVEANEDYSNDMDLDIKPKFWSQLQSLLKRMLVGSLPSSTGRVVSSVSQVSTNNRTEAAKLKEMYRLSLKSSTLGQLHELYKLWVS

SEQ ID NO: 32190 - protein, 249 aa, Sorghum bicolor
  Clone ID: SORBI-28MAY03-C119716_1.pep
MAALALAFLALTAVPAVLCQAPGPAAPKGPPNVTAILEKGGQYTTFIRLMKSTQQDTQLNSQLNNSFGSGYTVFAPTDNAFASLKPGTLNKLSQQEQVSLVQFHVLPQFYSLDSFETASNPVRTQASGSDGPYTLNITADSNSQVNVSTGVVATRLGTALRATQPLAVYSVDTVLLPNDLFGVKPPSAAPPAPAKKKPAKGGSVAEAPSAGDSADAPPSGAAAARAGWSSLAALLLGAAACSTLLDCEK

SEQ ID NO: 32191 - protein, 135 aa, Sorghum bicolor
  Clone ID: SORBI-28MAY03-C119770_1.pep
SWQSIKQKVVALSSCEAEYVAATTAATQAMWLSRLLAELLGRPVDIVELKVDSKSALALAKNPVFHERSKHIRIKYHFIRSCLADGSIRAEHISTGDQLADILTKALGKAKFEELRGRIGLEAISAKEIKTKGEN

SEQ ID NO: 32192 - protein, 175 aa, Sorghum bicolor
  Clone ID: SORBI-28MAY03-C119791_1.pep
RGRSTTVVICYLVQYKNMTPAEAYEHVRLRRPRVLLAPAQWQAVQEFYQLIRVKKTGRSSRLDNPLIKPPLFLATHNLVAFDDSAFVMVSESDLEGYNSDALALNMGSGLWEISLIYRVQFASKAAFAGFSYLWLRCRACKEALPENVGRESCSLEVEQLTTGHPCLLQGVVVNP

SEQ ID NO: 32193 - protein, 210 aa, Sorghum bicolor
  Clone ID: SORBI-28MAY03-C119939_1.pep
TREQSFSALKQALTSPPVLAMPNFSKPFVIETDASGTGVGAVLMQQGHPLAFLSKSLSPRLQGLSTYEKEYLAILMAVEQWHSYLQLAEFQILTDHKSLVQLEEQRLHTPWQQKVFTRLLGLQYRIVYKKGVDNGAADALSRAPAVQCAAISISQPQWLVDVLQSYENDPMAQELLTKLTDTSVPTPNYTLQSGLIRYKGRLWIGNDAAL

SEQ ID NO: 32194 - protein, 262 aa, Sorghum bicolor
  Clone ID: SORBI-28MAY03-C119952_1.pep
HEADFLKETGYQNRPQTSAVQKGLNTELGLFPWLKQQPDLLKDFQSLMGIPKEGNCLDVIPLESAVISGHKGPVFVDIGGNTGHQAKHLLSKYPELADRVVVQDREETIKNASDSKGFQLMAHDFFNPQPVKGAKYYYLRAILHNWDDDKAAQILSNIVPSMSADSLVLIDEVVIADQGPHIWPAGLDLQMYTLFGSAERTASQWDSILDRAGLRPVAVKKYAPVMGSSVIFAAPKIADASLSEQHSLVDTYVSQSTTVTCN

SEQ ID NO: 32195 - protein, 155 aa, Sorghum bicolor
  Clone ID: SORBI-28MAY03-C119277_1.pep
MGKGVLEVHLVDAKGLSGSDFLGKLDPYVIVQYRSQERKSSVARDQGRNPCWNEVFKFQINSAAANAQHKLILRIMDHDNFSSDDFLGEATIDVTDIVGLGTERGTYHLNAAKHNVVLPDKTYHGEIKVGITFTATQVQEDGGAIGGWRHSSFNQ

SEQ ID NO: 32196 - protein, 131 aa, Sorghum bicolor
  Clone ID: SORBI-28MAY03-C119968_1.pep
MGKTAIHFGGGNIGRGFVAEFLYAAGYEVVFIDVMDNIINELQKTKSYQVTEVSEGGETTKTITNYRAINSKTHEQDVIQEISTADIVTCAVGPNILKFIAPVIAKGIDIRSTPKPLAVIACENAINATDT

SEQ ID NO: 32197 - protein, 152 aa, Sorghum bicolor
  Clone ID: SORBI-28MAY03-C119986_1.pep
YRLELPPSSTVHPVFHVSQLKKAVGARHTITATLPPASAQWSIPERIIQRRHVARGKKFIQQGLIQWSNMPVSLATWEDLEHLRHQFPRASLCKQHGAEGRENVSATPAHNDQASSSTSATPNQNPTADARASDGLHKARPKRSRTGNPRYS

SEQ ID NO: 32198 - protein, 162 aa, Sorghum bicolor
  Clone ID: SORBI-28MAY03-C120002_1.pep
KTIAEAMHDSYIRGVVRDVLKETASLIIDKHEIEAQEQQDYVETIIARISNPYLEDSVERVGRAPLRKLSRKERFIGPAAQLAERGMKYDALLGSVEMALRFQNVQDDEESVGLAKILKENSPADATVQLTGLERTHPLFSAVVKVVDQVQSEAKETGQPRI

SEQ ID NO: 32199 - protein, 181 aa, Sorghum bicolor
  Clone ID: SORBI-28MAY03-C120036_1.pep
CYCTLLSHQLHRFTRRTHTCTLYLSAADATASATEFIQKLELDKRLDEAWSSIGTHTPAALKHAAATDLWLLASHLLPVDRRDLLEHGQPLAALPVRHRHVQESQHLVLDPVIVVVALAPALVPAASAVGAAARPRLRHDPGQQLLHFPDDLAVLLLVARQVPPGEHVGEDELGVGEPGLL

SEQ ID NO: 32200 - protein, 167 aa, Sorghum bicolor
  Clone ID: SORBI-28MAY03-C120063_1.pep
RATRGGTYRGGGTRGGAARRGRARRPAARRGLATLGGAVRRSRPDARGDRPGLATLGGTVPPRTREEDAPDSRRPSADGRKDDAAMLGGTFRRQTRDARRHLPPTLGGRPGLATLGGTFRRRTRARRTQRKPSAGACEGALRPGRRTGRGRRRCWEAAKPSGVRSDR

SEQ ID NO: 32201 - protein, 202 aa, Sorghum bicolor
  Clone ID: SORBI-28MAY03-C120067_1.pep
SCGEKAAALAEKEEAVEEEETKKMIGEDNGAAAVETDGAAEKESPEVVELKAKLAEKDKEIAALAAENAELKKQAGEAAEAAKKAGEDAASKAAQAEHDLKEGAAREARVGEQLRASEASREALDGELRRLRVQTEQWRKAAEAAAAVLGGDNHLTGLAGNGNGWGSPATMPDDGDDEGFGGKRKGAGIRVLGDLWKKKGSK

SEQ ID NO: 32202 - protein, 183 aa, Sorghum bicolor
  Clone ID: SORBI-28MAY03-C120119_1.pep
MGEAGEEESAAAPAEVSRQAELDEQRRLVEALEAISSLVSASLSATLFPLKWQLIRDRLNRLHAGLADITVPVGDENGEDRCDAFANLLRDVAAAAREARELVPRSQGRHYGGGKLRLRSDLDVLAAALDAHVARLDEVYASGALTRARALVVPRPGAGATRDDVRFYVRDLFARLRVGGAEM

SEQ ID NO: 32203 - protein, 69 aa, Sorghum bicolor
  Clone ID: SORBI-28MAY03-C120121_1.pep
TRHVTVAFRPSMPEALRMLEGDMDVPDLPDRPQPFGQRIAFDEGETNFSASSILSGGGGPLVDFGDMLR

SEQ ID NO: 32204 - protein, 155 aa, Sorghum bicolor
  Clone ID: SORBI-28MAY03-C12024_1.pep
MQDRMRRQGQYGEADINSMVAAQLHHYQAQQRVQQHPENSYSGRDPAQASGEHQYTPPKVRQSQWDRGGPNVPSQVPSYAYNEAQGAGGAQSFYDGKRSDSKVGLEKQPSKESRDQPRTDRTETRYENYNLPRTFEGLEQSFHEDIILLSKELQD

SEQ ID NO: 32205 - protein, 308 aa, Sorghum bicolor
  Clone ID: SORBI-28MAY03-C120247_1.pep
MSATVTETTTNPVPVVVAADNNNTTSKTHIEDAANDKDFQSVARGNRAGTLKLRGIPTFSDPAAKRQWMKEHMAAAFRFFGKKGYGEGVSGHISMRDPILKDHFWMNPFAKHFSTIKASDLVLVDAEGYVTEGGAQLPINEAGFMIHSEIHKARPDVIAAAHTHSIYGKTWSAFGKPIEMLTQDACNLYGKVGVYEDHGGIALAQEEGEQIARALGKDNIACILQNHGLLTVGRTVDEAAFLYFSLDNACHTQLLAEAAAANGVPKRIISNEVAKYTADVAQNHHNFYTEFQPEYELIVEETNGRVLQ

SEQ ID NO: 32206 - protein, 165 aa, Sorghum bicolor
  Clone ID: SORBI-28MAY03-C119636_1.pep
EHLKDRFLAGGLELRIRAVYHRFLDLNDTTLAWMMAIDACFLLDFIENYRRREATDVVSSSANWINAVVRDAMMLENQIPLFVFARALELRHSTRHEAAKALHAVVFRFIMDVSPFKNSASDAANNKRGAAAIGDLAKHAHLLEVLYHFLVPDATLLDDVDDQVV

SEQ ID NO: 32207 - protein, 158 aa, Sorghum bicolor
  unsure (1)..(158): unsure at all Xaa locations
  Clone ID: SORBI-28MAY03-C120271_1.pep
TRPTSGSRPERAFCSAQHGERGSALLLLSHPLPPRPPPGTANGTGPRPRRPPGPLPRRARPAGAAGDAQEHGPPLPRHPPPHPQGRRSPRRXPPAVAWARQPPPSPPLAQKPSPATPPLRLRIGPTPAGAPSSRPCPCCARTTPRVVSSSSSAGRQYY

SEQ ID NO: 32208 - protein, 124 aa, Sorghum bicolor
  Clone ID: SORBI-28MAY03-C120380_1.pep
MDGKLPPPNPNLPYREDCWSEGETAALVDAWGSRYLDLNRGSLRQPQWREVADAVNSRPGASARRRPPRTDIQCKNRVDTLKKKYKAERARGGPSPWAFYGQLDLLVGPTLTGSKKPSPPRAAL

SEQ ID NO: 32209 - protein, 54 aa, Sorghum bicolor
  Clone ID: SORBI-28MAY03-C120402_1.pep
AGPVVGQRDVVERRHSRRRRIGRGRGGETGEPPHQTPSRPQVHHRLATRDWVNN

SEQ ID NO: 32210 - protein, 178 aa, Sorghum bicolor
  Clone ID: SORBI-28MAY03-C120514_1.pep
AHLAVNGDFFMTPGIRVLRSDGSKRWTVSKEPNLFYTTWSPTEPGVVFTSMGPIFETTKATVRIARVEFDPADLTDDDSRVEVGVATVRPLTRPEAGNDAFPAVSPCGRWLVFRSGRTGHKNLYVVDTARGEDGGVLRLTEGEWIDTMPSWSPDGSLIAFSSNRHDPANPAVFSIYLV

SEQ ID NO: 32211 - protein, 163 aa, Sorghum bicolor
  Clone ID: SORBI-28MAY03-C12054_1.pep
TRVSIRHHVRFLTFEICTIGALSWRTWRTIHESAELLKATKAVIVNDGMYWLLLNEASSHLCREILTLNLTDERFSKIPIPDAVKNHNLELFEGEGKLRLLSTHSDGSNNIVSDIWVADLTRQDWIHLQTIIPRMPVGISPIFQLKTKIFFGNQKRLLCVDLQ

SEQ ID NO: 32212 - protein, 116 aa, Sorghum bicolor
  Clone ID: SORBI-28MAY03-C120627_1.pep
RSLERNGTLSFLAWITFYIPDTPNTPMVRTRQCTISMLMAIYGQDAQTRSSSTLDGFNVQLPHMRPASLLHRHVLMLILHLLFCLVVSRLRGCLGPAAGVKKNRHCYFHRLLFGYY

SEQ ID NO: 32213 - protein, 135 aa, Sorghum bicolor
  unsure (1)..(135): unsure at all Xaa locations
  Clone ID: SORBI-28MAY03-C1208_1.pep
DHASRLNPPLCLHNDDYERFQPIPVKKGANFRDLKGVKVGANNIDEWDPEIERVKLSSGKPLVPDYAMSFIKGXSLKPFGRLWWDETVSTVVTRAEPHNQIILHATQARVLTIRENARLQGFPDYYRLFGPSRRS

SEQ ID NO: 32214 - protein, 146 aa, Sorghum bicolor
  Clone ID: SORBI-28MAY03-C120822_1.pep
MRRSWSCLSCLPMGTAALPIEDRFVPPAGLPAVPASGSEDGGFGKGSIDLGGLEVRQITTFAKVWSTTQGGQDGLGATFFKPSPVPAGFSVLGHYAQPNNRPLFGHVLVGRDTSGTGAVLAAPLDYALVWSSPDGAGHFWLPTAPE

SEQ ID NO: 32215 - protein, 62 aa, Sorghum bicolor
  Clone ID: SORBI-28MAY03-C120890_1.pep
SRTKVGGSKTIRYRPSLNHIVVGTPGRILALARDKDLPLKNVRHFILDECDKMLESLDMRRD

SEQ ID NO: 32216 - protein, 240 aa, Sorghum bicolor
  Clone ID: SORBI-28MAY03-C120911_1.pep
MATTKNKYSVILPTYNERKNLPIITWLLNRTFTENNLDWELIIVDDGSPDGTQEVAQQLVKVYSPHVVLKPRAGKLGLGTAYVHGLKFVTGNFVIIMDADFSHHPKFIPEMVALQAKGNYDIVTGTRYAGNGGVFGWDLKRKFVSRGANLFADTVLRPGVSDLTGSFRLYKRAALEKAIASTESKGYSFQMELMVRAKAMGCTVAEVPISFVDRLYGESKLGGDEIVQYAQGVFNLWLKV

SEQ ID NO: 32217 - protein, 206 aa, Sorghum bicolor
  Clone ID: SORBI-28MAY03-C121099_1.pep
AVTRVVLQTVQCNRTTRHSPHARDAGAARGVRAAGRGGSAAAAAAAGAVPAELPVLGGAAAGGPGGVAGRAPRAEAARGRRGRGEGGRARALVGGRRARLGVARLEAPRRPAARLLRLFPQVLPARLRVTHSIFTSTKDVCVCVCVCNWYYVTRLLGFLECQRVHMCRGVYRMYSVYIIDLLLRTAYCVLVQCLAHCLCATKKKKK

SEQ ID NO: 32218 - protein, 261 aa, Sorghum bicolor
  Clone ID: SORBI-28MAY03-C121111_1.pep
IGRAPADPDRGGRRRDDDDGGSTGGRRRRRPGRRRHGLRHADGEELPAAAHGPGPRRRPGHRRRRRRRRSRGLRHADGVAVPATAGHGVPSGAAEAGEAGAAAFRQQEEALLCPTGPAARLLPRAARPLHRVRAARPRGQVAAAASSGRQEDPPARRGLMNEATPPVRRTESSDTTGCMPCHHAPCFRSFDLLLLLLPPVLIHAAPRHWPFAASLQVRSIEDKFKLPDRTEDTKAGRPAGQYNRHAPTFQQRLPSVCLCVQ

SEQ ID NO: 32219 - protein, 232 aa, Sorghum bicolor
  Clone ID: SORBI-28MAY03-C121118_1.pep
MKLFMCFGGAAAAVIDDEAAEVAARHMQEGQRRRGRRSLSFRGKFLPGNNKKQGGNEKKPSAASSKKRGMDAADDVVYGVSRASSVASSALLSSASSLDSTTSSASSASSCSSTASSSPSVSGVLYPPAVKRQASNNKRPASSSPVAGAAAVVLCLLMVVFCGRVLATLLTSTALYLFPRRWRPATTTRKEKKGAVDSLECDAASSASEAEEEETAKRKVVMEGSSVRNRNK

SEQ ID NO: 32220 - protein, 130 aa, Sorghum bicolor
  Clone ID: SORBI-28MAY03-C121232_1.pep
MAAQQQQGRGSGAAVVVAAAVLLCVLLQAHVAESAVFTVGDRGGWSFNTNTWTNGKRFKAGDVLVFKYDSTAHNVVAVNAAGYKGCSAPRGAKVYKSGNDRVTLARGTNYFICSIPGHCQSGMKIAVTAA

SEQ ID NO: 32221 - protein, 97 aa, Sorghum bicolor
  Clone ID: SORBI-28MAY03-C121235_1.pep
MASAYASWSKRWIRPEVYPLFVPMAAALGICSYQLVRNITGNPEVRVTKEKRAAGVLDNHDEGEKYAMHGLRKFVRGKKPEIMASINSFFADPPKDG

SEQ ID NO: 32222 - protein, 305 aa, Sorghum bicolor
  Clone ID: SORBI-28MAY03-C121268_1.pep
ARGNNYVGFRAQPTLVLLAAREAEERLEENGTDIARCLAARLPAATFELQAYGFTNDGVFFTGYPVVGFQHRIQASGTCINGDDDDGGGLLLSACTWDSRIRGPFFYQSGFSVAMSKVPAFVADMQRLRDLNPRAFCGVDAKMGVLMRYVRSSSAYLGKAEDSLDFDVTYYRSYDEGVPRAHADVYDELEQMALRKYGALPHWGKNRNFAFDGAIARYPGAARFMEVKDRYDPDGIFSSEWSDQVLGIRGSPNVVGPRCAIEGLCVCSDDEHCAPEQGYFCRPGKVYADARVCVFERRTRLVDEL

SEQ ID NO: 32223 - protein, 175 aa, Sorghum bicolor
  unsure (1)..(175): unsure at all Xaa locations
  Clone ID: SORBI-28MAY03-C121379_1.pep
MALFALSSLKPTSRLVIICALLCIFLLSSEVSLVRQATALGINYGQVGNNLPAPPQVVQLLSSLRIGKVRIYDVNPQVLTAFAGTGIELIVTVPDDLVPGMAGSASQALQWLSASVRPYFPAARVTGIAVGNEVFTGDDEQLKASLVPAMRNLHAALAQLGMDAYVRVSTXNSLA

SEQ ID NO: 32224 - protein, 138 aa, Sorghum bicolor
  Clone ID: SORBI-28MAY03-C121341_1.pep
LPLPLPPPPPAHYPMWTSASPAGPYGGGGPGSMSQPINGSPVPAGLWRVPPPAATTTTAMENFGMSGRHGAGGTAIIQPTLVGPAGGEAAACKEEKAAMSLLSPSPSLSSCSSTSPEKKLGRCELGHQKESVSLDLHL

SEQ ID NO: 32225 - protein, 146 aa, Sorghum bicolor
  Clone ID: SORBI-28MAY03-C121431_1.pep
MQFSLAFLAAVLSATSVSAAPTEQAVNMMAAAPQWTIESMQRSCAKDDSSCTWNFKIDTHKGAATACKFVVKGSKASQRNGGPVKCGDYTVTSGWSGQFGPGNGFTTFSVVSSKRQIVWPAYTDKQVQGGKVVKPDQSYAPANLPN

SEQ ID NO: 32226 - protein, 237 aa, Sorghum bicolor
  Clone ID: SORBI-28MAY03-C120259_1.pep
MRKSSSCSGHVIGVPVTSKAYGIEEVSSRDPSSFRKGDAAGDHLAVSLTHPSPYASFGYKHSSKGQVIHWVSKLGRRAQGFREHVTLGPKLSETVKGKLSLGARILQAGGVERVFRQAFSAEKGERLVKALQCYIYTTGGPIAGMLFVSTKKVAFRSDRPITVTSPKGGTTARVTYKVVVPLRRIDKVRPSDNVDRPEEKYIHVATVDGFEFWFMGFVSYQRSCKYMQQAVSELQLQ

SEQ ID NO: 32227 - protein, 143 aa, Sorghum bicolor
  Clone ID: SORBI-28MAY03-C12146_1.pep
RKVHTLVSSSSQEKIMAADHHRDRALVLSKQAMAPSKEPAAGSDHGGGKKAGLSLFEIAVFDEEDDRHGYHDYWTRSSLFDDDNCQYNDDEEDVHQEDGGDVDDVLGALDDEPSVIEVIRSNREAEGLAFNMDDEIDEACDLF

SEQ ID NO: 32228 - protein, 213 aa, Sorghum bicolor
  unsure (1)..(213): unsure at all Xaa locations
  Clone ID: SORBI-28MAY03-C121539_1.pep
VPPSSSPKPTFVIPFSPTVAILSSLFHTIFLHTNTSPSCLPQPSAPPAPSPRPAQTSMTPPTRTTPAPCLSRPTTPRSCRSAAATPRSXATTTAAASTASPSTRPSATSQSASSPTAPPTPMSSAAAARRPQRQRTPTSPLPPRLASSPATMMIRTMMTRALLVLLLVPPRPPVPALLAPRLLLRVETPLLASLPSLASTPLVSPLVLCSSPT

SEQ ID NO: 32229 - protein, 151 aa, Sorghum bicolor
  unsure (1)..(151): unsure at all Xaa locations
  Clone ID: SORBI-28MAY03-C12156_1.pep
RRRARQAASWASASGAAAGAAAAPSRARGXTPTAAXTPPPPSPAADACRRRRRSCCSSRRAAAPAEEASRVPRPRPRAPAGCRASRAIDRSAGDGRTDGGRVTFGGGSGKARGGRTARRSMRSRACCAERLRLLLLRSPCRRRLPIEFSSR

SEQ ID NO: 32230 - protein, 124 aa, Sorghum bicolor
  Clone ID: SORBI-28MAY03-C121580_1.pep
ARGSNDLAARVPQFMVPTIFFPISNMPLTLTGKTDRHTLRTLGGEISAEDVRTFNPHWGSKQPPGTAMEESLKALWASIIQIRPESIGRNDSFLRLGGDSMSAMRLVAAAREAKLYLTVATVFS

SEQ ID NO: 32231 - protein, 34 aa, Sorghum bicolor
  Clone ID: SORBI-28MAY03-C1216_1.pep
HCPLCCIAHSYKPKKKIGVNIICMFQLGLLLGEV

SEQ ID NO: 32232 - protein, 150 aa, Sorghum bicolor
  unsure (1)..(150): unsure at all Xaa locations
  Clone ID: SORBI-28MAY03-C121611_1.pep
QTELYTAALIFPSPATLSPPPSAARPHRRPPRLRPPPAXSPPAPGRSSPPPFSARWRLAAAAVASPTASRSTAPPGSRSPTSSSPTLPPPRRTRTRTRMLPPPPPPLPRPLWLSSGAAAGRAGAGCRTSSWWRPSPPGKRPPRRPPFPPR

SEQ ID NO: 32233 - protein, 93 aa, Sorghum bicolor
  Clone ID: SORBI-28MAY03-C121639_1.pep
HEGWQWHDVSIDATATFGDLKVMLSLVTGLWPREQRLLYRGKERDDCEHLHMVGVQDKDKVLLLEDPAIKERKLRSTTLAQLMGVPCHSFIQV

SEQ ID NO: 32234 - protein, 253 aa, Sorghum bicolor
  Clone ID: SORBI-28MAY03-C121672_1.pep
FTRRDFQADVSRTPPEVRAYENLVQFERGIRLHLPRFQKLLTALQDPRRPPSSAQIADASKVRKRLIDSFAKYDVAARRIRDLPTESPSQERLQKAIYQKASNFLHLHMLPLKTLPKVLKSAHADNGGTSRTCSPTIPNNGPPTGSRPPETALASIKYNERAAASRSDSSLGSDASSAVSALEAEEKALRERLIVLEEQKFFVSEMIVDANRRRKFDEVSSLAVNVEDLSREIDSVNGMLAALDFEGVYTGTV

SEQ ID NO: 32235 - protein, 154 aa, Sorghum bicolor
  Clone ID: SORBI-28MAY03-C121671_1.pep
KPAASSSPSMSIYDIVPGCVPPSSNKFAHVGTLELKARIVKRLGPSPFGSDCSGASVLSSPPPSSAKYYSDDWPAPAVFHAPASASLWGGGPPWSMEYLWLREVLGETLAQIFSADDGDASGAVYLFLNEGCRIPSSRHHSTSDFRHKHRLRSL

SEQ ID NO: 32236 - protein, 282 aa, Sorghum bicolor
  Clone ID: SORBI-28MAY03-C120893_1.pep
YVLTATTAGLISLYTFNRPDDKSSDDAANSVNDKPLSKATATATEKPPSATLPPPYLLTSLKSHTTHLPLALSIRRMSSSVSASIAYTFSAREGWCIGIQDLLIAPSADGSGVDTISSRLASTLPITASGGADSTQTNESRSGLTTLCYSHPYLLATLPDNTLVLYLCTSTATFLSLSLGIRLWGHTSGISDAEITPRGKAVSISTRGDEIRVWELEGRGGGSSIEVRPTSRQVADDAGIPTSAPRAEWEDRRNWVGFDDEMVIVLKEARDGRESLMVYDFT

SEQ ID NO: 32237 - protein, 256 aa, Sorghum bicolor
  Clone ID: SORBI-28MAY03-C121812_1.pep
PFVDKDSNLVSMISRSDLTKNQHFPNASKLPDSKQLLCAAAIGTRPEDKQRLKLLVEAGLDIVILDSSQGNSMYQIEMIKWVKSEFPGVDVIGGNVVTREQAASLIAAGVDGLRIGMGSGSACITQEVMAVGRPQAAAVYSVSRFAARFGVPCIADGGIQNVGHIVKGLALGASTIMMGGLLAGTTESPSTSFVSREGKLVKAYRGMGSIDAMQDKKAGKGGKDSQASNAGTARYFSEGDSVLVAQGVSGAVAHRG

SEQ ID NO: 32238 - protein, 107 aa, Sorghum bicolor
  Clone ID: SORBI-28MAY03-C121813_1.pep
SKVMCIKARSEATQAGDDGGCPADECRVCLSKIRLAEATRRLPCRHVFHRDCVDRWLLSCKRTCPLCRVYVTDGNKQPVAAKHTSREAQALADDLVIWFSTVLVPGF

SEQ ID NO: 32239 - protein, 172 aa, Sorghum bicolor
  Clone ID: SORBI-28MAY03-C12190_1.pep
PLAPPIKYTKPSELRPARAQANTQEQQDLRWRSSPIEPKAIFRWRASAQSSKVLTIYWSVGTMPEGCLDRSTGWLPSNAGSAIRGSNPPPPPPDEIPQSPLQQRDETAQSEADSRGKVEAVRDPAERISKSAVFYRDRGEKESDPRGGWLGWLDGVGARVCVSVASRRRRPG

SEQ ID NO: 32240 - protein, 122 aa, Sorghum bicolor
  Clone ID: SORBI-28MAY03-C121823_1.pep
RARAAAKRRRSRARVILASLFCGGDELDVAVLDGLQPRRGDGDRDQLVLAPALEWGRERDDDAYAYNNDDGDEEEEEEEAEVVVDYGEEGDEEVDGRAERFIQRFYEEMRLQRQRSLVQRRL

SEQ ID NO: 32241 - protein, 189 aa, Sorghum bicolor
  Clone ID: SORBI-28MAY03-C121916_1.pep
HEGFANEALRTLCLAYMEVEDGFSANDQIPTDGYTCIGIVGIKDPVRPGVKESVAICRSAGITVRMVTGDNINTAKAIARECGILTEGGIAIEGPDFRTKSEEELTQLIPKIQVMARSSPLDKHTLVKHLRTKLDEVVAVTGDGTNDAPALHEADIGLAMGIAGTEVAKESADVIILDDNFCTIVTVAK

SEQ ID NO: 32242 - protein, 303 aa, Sorghum bicolor
  Clone ID: SORBI-28MAY03-C121926_1.pep
SGHPMPFDSPRMMRSAIRLIADRWPYWNRSEGADHFFVTPHDFGACFHFQEEKAMARGILPVLRRATLVQTFGQRNHVCLKDGGGSITIPPYAPPWKMEAQLLPPATPRSIFVYFRGLFYDAGNDPEGGYYARGARASVWENFKSNPLFDISTAHPTTYYQDMQRAVFCLCPLGWAPWSPRLVEAVVFGCIPVVIADDIVLPFADAIPWADIGVFVAEDDVPRLDTILTSIPVEVVLRKQRLLASPAMKRAVLFPQPAQPGDAFHQILNGLARKLPHGDDAFLRNGQTVLNWTAGPPRDLKPW

SEQ ID NO: 32243 - protein, 157 aa, Sorghum bicolor
  Clone ID: SORBI-28MAY03-C122008_1.pep
FPYSESRAIARHVLRKYKPELLGASSLEQSAMVDMWVEVEAHQLQPPAGAIAVECIVAPVLQGRERNQAAIDENVEKLKKVLEVYEARLSQSKYLAGDVLSLADLSHFTIMHYFMATEYATLVKALPHVDAWWEGLAARPAAKKVAEFMPLGSGVPE

SEQ ID NO: 32244 - protein, 199 aa, Sorghum bicolor
  unsure (1)..(199): unsure at all Xaa locations
  Clone ID: SORBI-28MAY03-C12202_1.pep
DLPFTNNYGVWEDEFKDLGLASCIEHVWKDTIVYLDNNKPILIGRSYGRVHRDLLHEELLRRCYEAGVTYLNSKVDKIIESPDGHRVVCCDKGREIICRLAIVASGAASGRLLEYEVGGPRVCVQTAYGVEVEVENNPYDPSLMGFMDYRDCFKEEFSHTEQENPTFLYAMPMSSTRVXFEETCLASKDAMSFDLLKKR

SEQ ID NO: 32245 - protein, 183 aa, Sorghum bicolor
  Clone ID: SORBI-28MAY03-C122071_1.pep
FPAPPPPPLPALMAPPLFPPPPILVPPPSPPALVAPPPPVPAPPPSPPPPLPVPSLLPPVQNSSRKRKIKEEKASSSAAKRKVSDVKQANASVMSMHSPASLLPLPPSGAGADLSSHEAIRLYSPDPPTRFSLFVVPQLPSSSVVSPTAAAATPANQDQRHGDSSTAAATTLAGRVQRHIEAK

SEQ ID NO: 32246 - protein, 173 aa, Sorghum bicolor
  Clone ID: SORBI-28MAY03-C12209_1.pep
MATTEMEMGMGVVVGGGSNSNNGGGSSSSSGLVVTELSHIKELVRQLEVHLGGSPDLCKHLASQIFSLTERSIGLITSSNLDAGAARRKRSASDAAGLASPLSATPTSDVTDGPFKNNTKKRKVMGQRRERVSSAGGENPVDDGHSWRKYGQKEILGAKHPRGYYRCTHRHSQ

SEQ ID NO: 32247 - protein, 134 aa, Sorghum bicolor
  Clone ID: SORBI-28MAY03-C122097_1.pep
SHPFKQSIQTKHLKTAIEEHELRMIQRHTTQSSRDSEEARLQTDNTCGFLIDGGCMIDRRWWLSLTGLYACLILRAGGSADRSTAVSVVPRPPPLVDSPNLRAGGGGSFRQLGEMGVSGTVVTAGGGGAAKRRG

SEQ ID NO: 32248 - protein, 151 aa, Sorghum bicolor
  Clone ID: SORBI-28MAY03-C122123_1.pep
MCPTGKYLGLDLSAAAVSGAGGDLRPAFDVLDADRDGRISREDLKSFYAAAEGPAAGERFDDDDLAAMIAAADADRDGFVQYDEFERLLASRAAAAAGGAGRRAAMEDAFRLMDRDGDGKVGFEDLKAYLGWAGMPAADEEVRANDPRRRR

SEQ ID NO: 32249 - protein, 112 aa, Sorghum bicolor
  Clone ID: SORBI-28MAY03-C122137_1.pep
SEKKKVNELDQYLEEETVPVTVDLDILQYWKIHSTRYPVLGCMARDILARPASTVASESAFSTGERIVSDYRSRLKSETIEALICLQDWLRSEDSTHDNIAGIIAADDEDCI

SEQ ID NO: 32250 - protein, 208 aa, Sorghum bicolor
  Clone ID: SORBI-28MAY03-C122157_1.pep
LVCILHLYMVSHYAKKKNLYMNNNRAEKYCKITAMILHPWFAGGAMPWWCHEYAPSPLASRCSGLSRAHPATLSAAAAAFLLPCCFHSLPMSSPFALALIIIAGCALAFLTGTLNCCTGFMSGCSCLLTRPPSDELRNRRRSLSRHFLHPALLDLAAVRVAGFLGGDPARATLPLSSLPPSGDGDGALVASSSAAANGSKSTPEPTLL

SEQ ID NO: 32251 - protein, 117 aa, Sorghum bicolor
  Clone ID: SORBI-28MAY03-C122226_1.pep
MNMTSPRLKLFGFHVSEEERHHELPGLETEAAEAEPDQEAPACGNNGGGGGSDSSSSSTTTTTTATGAATAGAGAGDGRRDECQYCCREFANSQALGGHQNAHKKERQQLKRAQLQA

SEQ ID NO: 32252 - protein, 184 aa, Sorghum bicolor
  Clone ID: SORBI-28MAY03-C122228_1.pep
SSYPPVYCYQEASHPDLFVEAIAGVMVEQIDSAYVHGGVIAAARQDARPVHVHDAIHFEEEVDGVGPGGDVRARGRGGGRGARGGAGRRDGSSRCGGRGGGRRAGTVRLGGARRCYLLLVLVLVGAAGRRPLRRRLLLAGLVAAFSFFSHLRSWIALLRQRRGQGLRERPVGDGVDAHLLELLL

SEQ ID NO: 32253 - protein, 152 aa, Sorghum bicolor
  Clone ID: SORBI-28MAY03-C122296_1.pep
GDEMCQMCTQLLLREAGLPNGLLPLKDLIECGYVQETGYVWLKQSKRVDHNFQSLGRLVSYGTEITGYAEKGRIKKIKGIKTRELMLWVPVEEIALDDPATGKLICKSIAGITKTFPASAFHVPEKENVKMNCAAPKPVVLMERTPRVVKNN

SEQ ID NO: 32254 - protein, 150 aa, Sorghum bicolor
  unsure (1)..(150): unsure at all Xaa locations
  Clone ID: SORBI-28MAY03-C12240_1.pep
MATPTQQMQSDGDPMEDRFLVRTPGLLQGVKCYIDASTSPDQQPSLPLRPVGTGLFIINTQVQPAQTIYIKATMTTTTXVLMAEAAAIALAAXLLTLSVCSRVTFLTDNXQLVHLLNGQDQANPPEWRIKYFTQTFSIFTGQRDMRILRI

SEQ ID NO: 32255 - protein, 166 aa, Sorghum bicolor
  Clone ID: SORBI-28MAY03-C121805_1.pep
MSSNGPTGAAADAMEAAAAVGSYRVCDTVVLVCLASASVLIVFTVAFCFRRAFANGYAAAAVAANSAEATAANGRSRCGLAPSALSAIPKLAYRRGAGATAGAGWAQCAICLALVRDGETVRLLPACGHLFHVECIDLWLRSHATCPLCRRDVVEAPAEKIGVERG

SEQ ID NO: 32256 - protein, 170 aa, Sorghum bicolor
  Clone ID: SORBI-28MAY03-C122435_1.pep
MPDGEDQWRQPCTSQCAGGSSVAFLVPGGSEDMASTGAPLSACSPPQVIASKADSVQGAAHSTVFTASSAEYEPYTCNGSVDIKGNPASKKHTGKWRACYSILGGEFCGSLAYYGVGTNLVSYLTPLLGAFLADSYWGRHRTIVVSLTIFTIVTLDRHSTLFFVKSASAC

SEQ ID NO: 32257 - protein, 290 aa, Sorghum bicolor
  Clone ID: SORBI-28MAY03-C122444_1.pep
RIKYKKVQYGEHSQPEPEYPGEHWDLDSPEWDSFDEDAWGELYDAWAATRPILLPEPGEFKPHEGWERGRVDLRRHFPGQRLQVIVKMANIELTPDSPEYEGGSWHIEGQLNERIAASAIYYYDNENITPSNLSFRQRGGSDFYEPSYEQSRHEFLEVVYGFDEPSKWGERNITQELGGVKCEEGRLITFPNTLQHKVSPFSLADRSKPGHRKILALFLVDPHRRVISSANVPPQREDWLPEGRREELKGKLMTLEEAKDSRLELMAERSLRSVERNRNYEVGDFNLCEH

SEQ ID NO: 32258 - protein, 211 aa, Sorghum bicolor
  Clone ID: SORBI-28MAY03-C122455_1.pep
MYSDQISTGRKRSIHDRLDGDLPAGTGAGGRVRHTVSKRQRQIDEKWKHDLYREDDEPASKSIDPKDLRLKLQRRSSQQGFTSTRSSGVRDLREKLSGTMHPQPSNADPPKRKPVSEVVNISRRETADEMPARQSKKAPKQTSSKKTSQPKAASPLDSFLSSLGLEKYSITFQAEEVDMAALRHMTDSDLKALGIPMGPRKKIILALESRA

SEQ ID NO: 32259 - protein, 218 aa, Sorghum bicolor
  Clone ID: SORBI-28MAY03-C122469_1.pep
MARRCLRVTLALVVAVITATATTLSSAQQTAAVALPTLPSCPPAPLSLSPCIGYVFGVGSATLASCCSQLRGFLHAQAPCLCAASKLAPSPIGLFLGQAQAMIPNVCDLPNPCDEAAAGEGSTPPVAGTSPPSATTTPAATTPATEPSSGTPAAADPGTSGAPPAPIEDASATAMAPAGTGSKLPELLHAAGATRSTDMAAGTVFVAVLLASVAAMYV

SEQ ID NO: 32260 - protein, 178 aa, Sorghum bicolor
  Clone ID: SORBI-28MAY03-C122518_1.pep
NKVIMPMLSMITGMKRGLTELQRIGVGLVFAMLSLVSAALVEMARLKIVDERGLVHRSTAVPMNILWQAPQYFFVGVAKVFTVVGFIEFAYEQSPDAMRSLCQACSLIMITLGSYLVSVMLKFMDSATVGRGRQGWIPDNLNEGRLDRLFWLMAGLQLLNLLTFAYCATRYKRKLANT

SEQ ID NO: 32261 - protein, 225 aa, Sorghum bicolor
  unsure (1)..(225): unsure at all Xaa locations
  Clone ID: SORBI-28MAY03-C122550_1.pep
MSSSSGSSSAAAHHQQHYRHQTGGSGLVPLAALIKEEARTGRHSXPAGESRISARDEDAAGVGNSGVGGEVAAETRLERPLLRYGCAAQCKKGEDFFLLRTDCPRPAISVSFPDSPHPTFAVFAVLDGHNGNAAAIYTRDNLLNHVLSAMPRGLSRDEWLHMLPIALVAGFVKTDKEFQSKGQTSGTTATFVIIDGWTITGASVGDSRCILNAQGGAVSLLTVDH

SEQ ID NO: 32262 - protein, 135 aa, Sorghum bicolor
  Clone ID: SORBI-28MAY03-C122567_1.pep
MAAPAAALARELLDAARAPGFAEWQRGVRRRIHQHPELAFQEHRTSALVRAELDALGVPYAWPVARTGVVATVAGPAAARGAVFALRADMDALPLQEMVEWEFKSKEDGKMHACGHDAHVAMLLGAAKLLQSRRR

SEQ ID NO: 32263 - protein, 126 aa, Sorghum bicolor
  Clone ID: SORBI-28MAY03-C122574_1.pep
ARGERTSSTPRRLRFRPAIAAADATARSRGSSRVASRRIGSGGAAARDAGAEVVVLRRRQDDGKETKKQEPGLFNNVIEETASRLVAEARKSKVKALVGAFETVISLQETSKAAAAPAMAAGVVVP

SEQ ID NO: 32264 - protein, 193 aa, Sorghum bicolor
  Clone ID: SORBI-28MAY03-C122599_1.pep
TRHMNDENILNAVSIEKDVDGFHPLNIGRLAMQGRDPFFVPCTPKGCMELLHRYGVEIKGKRAVVIGRSNIVGMPAALLLQKANATVSIVHSQTKNPEEITRQADIVIAAVGVANLVRGNWIKPGAAIIDVGINPVDDPESPRGYRLVGDVCYEEASKVAGAITPVPGGVGPMTIAMLLSNTLESAKRIHKFK

SEQ ID NO: 32265 - protein, 224 aa, Sorghum bicolor
  unsure (1)..(224): unsure at all Xaa locations
  Clone ID: SORBI-28MAY03-C122087_1.pep
TRLALTATFFXGVFQASLGLLRLGFIVDFLSHATIVGFMAGAATVVCLQQLKGMLGLDHFTTSTDVVSVMDSVFTQTHQWRWESVLLGCGFLFFLLLTRFISKRRPKLFWISAAAPLTSVILGSVLVYLTHAENHGIQVIGYLKKGLNPPSVTSLQFSPPYMMLALKTGIITGVIALAEGIAVGRSFAMFKNYNIDGNKEMIAIGTMNILGSFTCCYLTTGPFS

SEQ ID NO: 32266 - protein, 174 aa, Sorghum bicolor
  unsure (1)..(174): unsure at all Xaa locations
  Clone ID: SORBI-28MAY03-C12260_1.pep
GDTADDHYHRYMEDIELIHSLGVNSYRFSIAWARILPKGRFGHVNPDGVAFYNALIDALLQRGIEPFVTISHYDIPYELEKRYGGWLSPKIRRDFGYLADVCFRMFGDRVKFWITFNEPNIFAKLSYIYGRYPPGHCSRPFGNCTFXNSSTEPYIVGHNMVLSHANVVSIYKEK

SEQ ID NO: 32267 - protein, 76 aa, Sorghum bicolor
  Clone ID: SORBI-28MAY03-C122604_1.pep
AAAGAGPYEEMLQVVETCAARIRWRLRPASKRRLLNDILFLCTGLRPVVLVDYGGTMPQLQENLCSLLRHARQVTS

SEQ ID NO: 32268 - protein, 202 aa, Sorghum bicolor
  Clone ID: SORBI-28MAY03-C122601_1.pep
MPRITAPVSKLTRSLAESQRHAGIALMPKYAELLGASSEQSQHSESRGLKTTHRPTPQPSLSGRRRPLMQSFHSSTPSRAPVNHVDSTVLPKIHATPNFNEPLPRMPLLPDNYGAYHSSMSDAADLYSKRPVIFAVDPDVVVPGAPMATMDAVNMDSVDVKFVHEQPAQETKPDDSDRSTFLKDVFGGMIQDILPGRTLSKN

SEQ ID NO: 32269 - protein, 165 aa, Sorghum bicolor
  Clone ID: SORBI-28MAY03-C122613_1.pep
MASSAGSSLFFATALVMMALIVLDGSSTCHAARHLADTTTAAPAAAPAAVPGIPAVPKPPVIVPTVTVPAATLPPMPTVPTAGAVPPIPALPKIPAVGAVPPIPAVTVPTVPNAAALPPMPAIPAMPKVTLPPISAVVPKGGALPPMPSIPAGVPMPFVASPPSA

SEQ ID NO: 32270 - protein, 206 aa, Sorghum bicolor
  Clone ID: SORBI-28MAY03-C1227_1.pep
MAIAISQEAFDAMVRENMEDLGMDPDEALADAVEALTLQGADLSGIIKRVPGEAAAAEVSPVVRVLDELKASHSASSGSEQDLDGLVSLLDELRGLCSSGEGSENAAIAVRNGVVEALVALCASARVQQERLLATALKTLSSVLRDVASTEKFRQSEGPKIVMDLLKGGSENSDLLDAGFSVVAAGSAGNEVVKESFMDLKVDELI

SEQ ID NO: 32271 - protein, 202 aa, Sorghum bicolor
  unsure (1)..(202): unsure at all Xaa locations
  Clone ID: SORBI-28MAY03-C122652_1.pep
RYDNSGGGACSESIMADQMAGQWYARACGMEPVVEEGKARSALATVLDYNVMXVDASSGQSKEVWPGVTYAVAAAMVHEGMHEAAFRTAKGAHDAGWGKDGFGYAFQTPEAWTEDGGYRSLHYMRPLGIWAMQWALSPPELHKDLRAPGARSVEEESSPADAALGQAQFEKVANMLRLPEEKQPKGYLWAIYKVIRQMVLPE

SEQ ID NO: 32272 - protein, 187 aa, Sorghum bicolor
  Clone ID: SORBI-28MAY03-C12270_1.pep
SSDPIHVPSPGSKSAGTFGAIKREVGVVGARQRPSNSAATTTSASNGLVKVVSAPKVSPHLEWKPKSVSPSSISHAVTAAPPAAPSPVDDGSKTEVSALSKKLSHANVSHEHVIIPEHIRIPDSERTHFIFGSFESEIDPKASLTASCDIVAKEELNDHSPSSLAAQDSSSTSGPNGRMSYVVSCPL

SEQ ID NO: 32273 - protein, 119 aa, Sorghum bicolor
  Clone ID: SORBI-28MAY03-C122706_1.pep
LKAHSTAIKGLAHITGGGLVENIPRMLPSTLTAAVDVSSWPQPSVFQWLQREGNVSPAEMARAFNCGVGMVIAVDPASEAAVRQNFEAAGETVYRVGELRARAEGEEGCVLSGLESWSA

SEQ ID NO: 32274 - protein, 114 aa, Sorghum bicolor
  Clone ID: SORBI-28MAY03-C123043_1.pep
VVGLVRAVAGELARSGVRVNAVSPKYIATPLVMRILQEWYPERTADEHRLIVEKSINEMEGVVLHPEDVARAALYLASDESKYVNGHNLVVDGGFTVGKVPNMPPFAQGAVANN

SEQ ID NO: 32275 - protein, 130 aa, Sorghum bicolor
  Clone ID: SORBI-28MAY03-C123212_1.pep
ASAPLCATTSPSTSASCPAPRPTASPRATRAARASSSATYGPARTTRSRLTSASSSPAPTCKCSTSASPPSAAITTSTSPTSWPRGPKPRSRSRPRTRERGARGEEEPSVDRRDMIYRNTIYAHIIRTHD

SEQ ID NO: 32276 - protein, 194 aa, Sorghum bicolor
  Clone ID: SORBI-28MAY03-C123155_1.pep
ARGSSSSPSSASSLTTSTRGTCPQQPRRASKSTTTSPTRRHHPPTTPTRRSSPPRRTRLRRRTRRRLANRRPRNTPPSCASSTSSSCASPPSSPTNPSTSPGAPSTGPCPPTRAGSSAWARASASSTSTTAPSTSRASSLGPSPCPGPTRPRVTASRWVSSTTGSTPRSMGTNTTTSTSASTPTAAPHGRNRPS

SEQ ID NO: 32277 - protein, 223 aa, Sorghum bicolor
  Clone ID: SORBI-28MAY03-C122430_1.pep
TRRWIRFHGKDEALRLMNWNNSDPHFSLRVNTSKGYTRADLVKRLESLQVHYEESVMDGFVRIQEGMQAVLQAGLLKDGICAVQDESAGLVVSVVDPQPGETIVDCCAAPGGKTLFMASRLSGEGKIQALDINKGRLRILMDAAKLHGLDDIITDIHADLRLYAKETTAKYDKVLLDAPCSGLGVLSKRADLRWNRQFEDLEELICLQDELLDSASMLVRPGG

SEQ ID NO: 32278 - protein, 71 aa, Sorghum bicolor
  Clone ID: SORBI-28MAY03-C123241_1.pep
TTHKTESLIRYYHYHNSINVMGEPCREFVPMPANGSKTMFEGVPYVCADNMKRLADEIKRFEKVTLGSVQT

SEQ ID NO: 32279 - protein, 62 aa, Sorghum bicolor
  Clone ID: SORBI-28MAY03-C123248_1.pep
PAAARRPWLVGPGSSPPTCRARCGRCTPCRPTRVAIQPGVGPQWEYYPEVWRCKCGNKLFMP

SEQ ID NO: 32280 - protein, 168 aa, Sorghum bicolor
  Clone ID: SORBI-28MAY03-C123311_1.pep
ARGRHVSMITITLSKIELDTSSIGYQSPLPADELKPLVEYDNDEDAHSPGGRRRGRGGRARGRGTGRARGGRGNGYNDYADVGWEDDHAPAYMGNGYPRGRGRGFRGRGRRGGYNGQPDYQQDAGYYEEAPVHAPARGRGRGRGRGPSRGRGRGGNANGVMHAAAPGA

SEQ ID NO: 32281 - protein, 205 aa, Sorghum bicolor
  unsure (1)..(205): unsure at all Xaa locations
  Clone ID: SORBI-28MAY03-C123319_1.pep
ARGRTACERAKRTLSSGAQATIEIDSLFEGEDFTMTITRARFEELNAKAFAGTLEPVAQVLKDAAIDKSAVEEKXATSAETADLLLLDVVPLSLGVAMEGNIFAPVVPRGQTVPTLKKRTFTTVADNQQTVQFPVFQGERVNCEDNTSLGEFTLAPIPPMRAGEAVLEVVFEVDANGILKVTATEKSSGRSANITISNSVGKLST

SEQ ID NO: 32282 - protein, 142 aa, Sorghum bicolor
  Clone ID: SORBI-28MAY03-C123323_1.pep
MRRLSTGVAFDHGDFEAAYEGIRLICLRNPQSTRAWNLLNTTTIRMGRFNSRSHHKFIVRQLLRSPNSVPLMILAGHDCNISGTHKFALGEFFRAYHFSPKHPMISLCIGLTYLAQVRTLALAFSRSCAHPLSASCTCTLHR

SEQ ID NO: 32283 - protein, 117 aa, Sorghum bicolor
  Clone ID: SORBI-28MAY03-C123330_1.pep
MSTESPPRFIYKIVPSPPRDPFPKEHPLSKLDQNDGFVHLSTSTQVPKTADLFFTRSSSLWVIKLEFKQFADSIRWEGGFPHLYGNFGADNVDSIVKFVRQESQTWDEVMAKSEWLD

SEQ ID NO: 32284 - protein, 119 aa, Sorghum bicolor
  Clone ID: SORBI-28MAY03-C123349_1.pep
ARGWILVIDLRSSRRSSRADCPSSESEGAVQIGAETREDSLLAVHLTIPDAISPAICACTCVRSQTLKNFMTRSVTGFCIQFPVYAKQQLLCVAMEIRTFTLCRLQVVRILAGFSHGVI

SEQ ID NO: 32285 - protein, 173 aa, Sorghum bicolor
  Clone ID: SORBI-28MAY03-C12335_1.pep
TRALYFEAIGLSGTKKPMRLDLTNQNSKVEKTKVGPFGSKLFDSAVSVSSGSASDEWTLEFVDFSGETRRDVWLAFISEIISVYRFIREYGPGGDDPAIHNVYGAYKGKKRAVSSAANSIARLQSLQFIRRLYEDPAKLVQFSYLSNAPFGDVVLQTLAVNFWGGPLTTKARS

SEQ ID NO: 32286 - protein, 83 aa, Sorghum bicolor
  Clone ID: SORBI-28MAY03-C123412_1.pep
SNDEAFSKRFEAKQQLESYIGRVEEIVSDPTLSLKLKRGQKEKIESTISDAMAALELGDSTVEDLKKQELALKRLVTKAMSSR

SEQ ID NO: 32287 - protein, 139 aa, Sorghum bicolor
  Clone ID: SORBI-28MAY03-C123371_1.pep
TPSELQNLEHLALIHRKAKPWLPLALEITNQICPKSIRRNHLWNNSYLQRLQRRGVRSRQPEAAAPSHGDGGAPRRIKKLPGPPPRAPTKSGEEWRGRRAAAREHPTPNGRRGGETDCLGIEDGGGACGGVVWCGVVWG

SEQ ID NO: 32288 - protein, 202 aa, Sorghum bicolor
  Clone ID: SORBI-28MAY03-C27660_1.pep
IIHRDVKAANILLDDYCEAIVGDFGLAKLLDHRDSHVTTAVRGTVGHIAPEYLSTGQSSEKTDVFGFGILLLELITGQTALEFGKAANQKGAMLDWVKKMHQEKKLDVLVDKGLRGGYDRIELEEMVQVALLCTQYLPGHRPKMSEVVRMLEGDGLAERWEASQRADSHKFKVPDFTFSRCYSDLTDDSSLLVQAVELSGPR

SEQ ID NO: 32289 - protein, 276 aa, Sorghum bicolor
  Clone ID: SORBI-28MAY03-C123455_1.pep
TRLLSSWFTARRGRRPSMIIGGAAFLAGAAVSGGAVNVYMAILGRALLGVGLGFANQAVLLYLSEMAPARYRGAFSNGFQLSLCLGSLAANIINYGAEKITGGWGWRLSLGLAGVPAALFTLGAVFLPETPNSLVQQGEDRGRVRALFVLIGVYVAGYSWSWGPMTWLVPSEVFPLEIRSAGQSITVASGFVFTIFIAQGFLAMLCRMRAWLFFFFAGWIVVMTAFVYMFLPETKGMPIEQIGKVWREHWFWGRVVGSSEELQATHKVSDNLKELR

SEQ ID NO: 32290 - protein, 186 aa, Sorghum bicolor
  Clone ID: SORBI-28MAY03-C12349_1.pep
MAGVTATGVAGVPSTFSSATSQIGGFLSKKPYAPPSWATHLSPMPSHTFSLGQFPTPIHKWNLPNLPEGTEVWIKRDDLSGMQLSGNKVRKLEFLLADAVAQGADCVITVGGIQSNHCRATAVAAKYLNLDCYLILRTSKLLVDKDPGLVGNLLVERLVGAHIDLVSKEEYGKIGSVALADLLKKG

SEQ ID NO: 32291 - protein, 208 aa, Sorghum bicolor
  Clone ID: SORBI-28MAY03-C123509_1.pep
TRVNAADTYRPWPHPYDEPRGAPSSSASLPGTPDRGGAHAAAQSSSPLWAGPSAKDKEYASETEARWPPDADGRGGRRHRQHRRARVAREVWLERAWRMRKQRRQLQEEVPVVVLGGGESPASRGGVAMDMEEVRACRDLGLALPCDWTVEIPCYALSGVDTASSGGNSPASGSWRISSPGDDPKDVKARLKVWAQAVALASASRLGS

SEQ ID NO: 32292 - protein, 368 aa, Sorghum bicolor
  Clone ID: SORBI-28MAY03-C123520_1.pep
HEEVIDKGPRNIDLDILLYGDEKVDHERLKVPHIGILEREFVLRPLAELIPAKSLDPTKPWKLIQDNLNELPLGEPLSSMTPLSSTAGSLTPLAAKRKTHVMGILNLTPDSFSDGGFHDRDNLAQTIMDMVNNGTSIIDVGGQSTAPGRPEVSAEEEASRFVPAVQLIRSIPEARDVAISIDTYRASVAEEAIANGADIINDVSAGLLDPDMLSTVGRLEKTICLMHMRGTPQTMTKLTSYPDGLIPTIASELLGRVAAAEAAGIRRWRMILDPGIGFAKTGEQNLEILRRLEELRYWPGLQGLPWLVGSSRKTFVGKITGVTEPKQRTWGTAATVAAAVQGGADIVRVHDTQEMGMVAKMADAIWRV

SEQ ID NO: 32293 - protein, 178 aa, Sorghum bicolor
  Clone ID: SORBI-28MAY03-C123608_1.pep
TRLHASLLLPDLPLHPHSHAPIRVYLHPSGALLAAAHGAVPAHRARAAAKALVSRLQPEEVLVLDAVRSGSYRGRLAADEPVEGKLETRAARARGGVGAARAVAALAPPGSVVDGLGAAVLAECEIRGKAASMVVTWPAGARPAEFVVTRRVAEEIGVDTGKAAARVSGRPELDALYT

SEQ ID NO: 32294 - protein, 186 aa, Sorghum bicolor
  Clone ID: SORBI-28MAY03-C123649_1.pep
DARIAPLSLQLDERLLLRATDAARLTGFNGFRGLLYALHNASSLLLLILASGAVSCAAAAAGGPCAADDTAGGGVDAGAGFMASIAMLQQRMAEEAESDGAAGIRMCEFRCARAAVEAAREEVERVAATGRKCEGATGGVVKDKVEELKAWVDVLRTGTDSLVCQLDDFLDDIVEGRKELSDLCSH

SEQ ID NO: 32295 - protein, 130 aa, Sorghum bicolor
  Clone ID: SORBI-28MAY03-C123666_1.pep
MEVPMNSTQSGAHFPVQHRSFSLDIKGNKTDIVISKYEDTFLVIVTQIDFYPTDDRAKKDESVFSDPTYNVSVLFGKRDEPLLVACARQLIEHISGSGSARSLVISLGLKDHSQGTLKDIIVAVIENRLW

SEQ ID NO: 32296 - protein, 112 aa, Sorghum bicolor
  Clone ID: SORBI-28MAY03-C123681_1.pep
LLVATDVAARGLDIPAVKVVINVTFPLAAEGYVHRIGRTGRAAKEGLAITLFSEHDKALSGSLINVLKAANQPVPEELMKFGTTVKKKEHGAYGAFYKDTSDVKAATKITFD

SEQ ID NO: 32297 - protein, 235 aa, Sorghum bicolor
  Clone ID: SORBI-28MAY03-C123887_1.pep
KTVRFAPRSAELASRPLTPQEAWSLYHFENHARGCRSCDSRRLCDVGYNLSQDVRILVCQHGGELCSTRPDEEGKWVRVEVPHAYDRVKVLLGAERSRERKKHAPVVSYDAPEPKPSRKREPTHVVVEPSRTHRDKERRSRQKPQRYDVVEVIPTSDHDRKHERGEPVKLPDRAKRGSLYESDMRRPRREYRLEDRAPEQRERRDRSREREWRERDRAERHERRRRERDHPDGGH

SEQ ID NO: 32298 - protein, 102 aa, Sorghum bicolor
  Clone ID: SORBI-28MAY03-C12375_1.pep
TPGTHRAYPPTQPTATSQRPKTLNPSSCGGGRGAAVPEVIEAGGDKQAYLEGAHGAVEGVDQRRIVPEFAALAHPRIAPTSLALAEPAGFSSFLSSSAAPPF

SEQ ID NO: 32299 - protein, 138 aa, Sorghum bicolor
  Clone ID: SORBI-28MAY03-C123986_1.pep
EALFEKYYTSKNLPYIPTAFDGRSDYDGFISRGIPAGGLFTGAEGVMTEAEAKMFGGQANVAYDINYHAAGDNCTNLNHEAFLINSKATAFAVATYANSLASIPPHNASVTRPDVKNRAPKSRAHNKKTGCFHSLVEI

SEQ ID NO: 32300 - protein, 189 aa, Sorghum bicolor
  Clone ID: SORBI-28MAY03-C12402_1.pep
QSLHVAIDVSEPGKVRPLMEIQIRTKEMHRGAVGGEASHSLYKGGLTDPEEAKRLKTIMLAAAELAALRLRDLPGSDRGAGNCKNPAFCQLDKNGDGRISIEELTEVMEDLGAGGEDATELMHLLDANSDGSLSSDEFESFQRQIEMMRNLEDDDDHYREILKEKLHTIDSAGLIHVYRKELSDKLLVG

SEQ ID NO: 32301 - protein, 215 aa, Sorghum bicolor
  Clone ID: SORBI-28MAY03-C124162_1.pep
TRREAPGGFALGQRCHRAAVPRASRVGGARPFPAGCYRGCAPSAEAGAWVLGRTSPTWPLEVGANGGLLGLALRRGSGLCSRSAPKQAALVPSRVSTGPGAGAWPCRGGPNHGGVIHVAAIGVGISGAVALLAVCASDGSLPQFRCRGRLLRVRGLWCYSRISSMICYFFYKNITFGVTLFLYDAYTSFSGQPFYNDWAMACFNVFFTSLPVIAM

SEQ ID NO: 32302 - protein, 192 aa, Sorghum bicolor
  Clone ID: SORBI-28MAY03-C124198_1.pep
MASLTVSTATAAAAGGNKSKEQQREGAEIITGAEACFAHSKEMLKSLGFPGGVMPLRGLEECGWVRETGFVWMRQKAPYEHYFRGTGTRVRYDAEVTAYVEEGRMKRMTGVRSKQVMLWVPIVEMSLDGDKRDKIYFKSNVGIGRSFPASAFPDEDEEAAEPKKKKEEEKKEEEENAGDDDKSAADDAAANK

SEQ ID NO: 32303 - protein, 316 aa, Sorghum bicolor
  unsure (1)..(316): unsure at all Xaa locations
  Clone ID: SORBI-28MAY03-C124217_1.pep
ARGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSATGTYSSVTVTSWPSIVATGGTTTTATPTGSGSVTSTSKTTATASKTSTSTSSASCTTPTAVAVTFDLTATTTYGENIYLVGSISQLGDWETSDGIALSADKYTSSDPLWYVTVTLPAGESFEYKFIRIESDDSVEWESDPNREYTVPQACGTSTXATVTDTWR

SEQ ID NO: 32304 - protein, 126 aa, Sorghum bicolor
  Clone ID: SORBI-28MAY03-C124225_1.pep
LVSTKRSNNGSNYLIGSYRRKKLEGKQGIVVDQVVQPSPFFAHETRDLSGYNVLLAMHAWNGKRIETSICNNDNYEVRKHILLHLLTYTGNKNIANIPKGVRDLNAILVSQAKNNELFLIFSLSKC

SEQ ID NO: 32305 - protein, 160 aa, Sorghum bicolor
  Clone ID: SORBI-28MAY03-C12428_1.pep
ARGELLVSVRKAFSMLSDMDYCHGKDSNIILSPKLPSASISSCDIKEQGGDKPSSLVKDSSLINVCDTALCHPKDILSRLTLPHRQDLDSLLAPGSESTAGVKPYMPSMTVHGASLPPFPWSHSQAGGCRQSVDCGKHGSSRSNSQWQWGTGWIQPHSRF

SEQ ID NO: 32306 - protein, 86 aa, Sorghum bicolor
  Clone ID: SORBI-28MAY03-C12430_1.pep
PLFFLRPRKRHSDQIVYIEVYFRCIVQHHIFSTTSKFCELWSTIHSTFALCCYLLYTACTYAPVVHLKLYVNTMPPMYGLRSSTSV

SEQ ID NO: 32307 - protein, 147 aa, Sorghum bicolor
  Clone ID: SORBI-28MAY03-C124386_1.pep
GDQRLQIRRVLGLDAKEPVAGLRGGLQGRLRGPHPEDGQGQEGQEGRRRRRQREEGVHHAVIGTDDIVRYQEEEEEEGRKEERRRGSTWKDGGTRERSNRPTARKEECRWKKKKMTEMWRKTRANERRRKLRSFRWWEAPIVQIGAP

SEQ ID NO: 32308 - protein, 98 aa, Sorghum bicolor
  Clone ID: SORBI-28MAY03-C124346_1.pep
MLLLRASTPFGYAKVDKVDAEEARHLRAQYLIHKVLEEKSPRPSALVTRTRPRIGVRLKKLRVAVRGLRARACRALQRHLRNLRRLVGNGPQGSPSPY

SEQ ID NO: 32309 - protein, 164 aa, Sorghum bicolor
  unsure (1)..(164): unsure at all Xaa locations
  Clone ID: SORBI-28MAY03-C12441_1.pep
ARGSKEVAGHGAIAPHYYKFHGIRNGIDPDIWDPYTDKYIPVHYTSENVIEGKSAAKKALQQMLGLQQTDTPVVGIITRLTVQKGXIHLIKHAIYRALERNGQVVLLGSAPDPRIQGDFTNLASRLHNEYHGRVKLCLTYDEPLSHLIYAGADFILVPSIFEPC

SEQ ID NO: 32310 - protein, 168 aa, Sorghum bicolor
  Clone ID: SORBI-28MAY03-C124492_1.pep
MEPEKAEEAAKQPVEAEAGDSVDPRELVSSDDEIDYSVEPEFYDPDLDDVDERWVDRQRKGRTSDAVLSCPACFTTLCLDCQRHEKYVNQYRAMFVRNCKVKTDQILREGKSKRKNRKGRAANPTTASEGESKGQAYHPVCCDVCSTEVGVFDEDEVYHFFNVIPSNS

SEQ ID NO: 32311 - protein, 191 aa, Sorghum bicolor
  Clone ID: SORBI-28MAY03-C124526_1.pep
STRVKLTGKMSGWTAPKDIILKVAGILTAKGGTGAIVEYHGPGTESLSCTGMATICNMGAEIGATTSVFPFNDRMYDYLAATKRSQIGDFAREYAQELREHEGAEYDELIEINLDELEPHINGPFTPDLATPISKFKEAVKANKWPEELKVGLIGSCTNSSYEDMTRAASIAEDAMAHGLKAKSLFTVTPG

SEQ ID NO: 32312 - protein, 69 aa, Sorghum bicolor
  Clone ID: SORBI-28MAY03-C124594_1.pep
ADYEKIGPNDKVDLACPELAPGKPLTMTVHPADGSKPFDIKLSHTFNEGQIEWFKIGSALNAMAKAVKQ

SEQ ID NO: 32313 - protein, 117 aa, Sorghum bicolor
  Clone ID: SORBI-28MAY03-C12459_1.pep
AIYSDSDLSLHMYSINGKHIASSESNSRLRCMELSCCGQFMVCAGDHGQIVLRSMHSLDVVWRYEGAGKTITSLVVTPEECFLAGTKDGSLIVFSIENPLLRKNAMQRHKAKPSIGG

SEQ ID NO: 32314 - protein, 256 aa, Sorghum bicolor
  Clone ID: SORBI-28MAY03-C124621_1.pep
MAAGSEALLDATALSLSLALPTTTPAPGLVAGLKINKEDYLAICLAALAGTRGTGLSNKAVVAGFGLPQHQGQGHGNNNNKQQQWCPPPAALAHEEQLRFRCAVCGKAFASYQALGGHKSSHRKPPTPEQYAAAAAAQQQEAFSAPDSEETTTTTTSSSGGTTSTGGPHRCTICRKGFATGQALGGHKRCHYWDGTSSVSVSMSASASATGSSSAVTVRNFDLNLMPVPENAGMKRWVEEEEVQSPLPIKKRRILD

SEQ ID NO: 32315 - protein, 200 aa, Sorghum bicolor
  Clone ID: SORBI-28MAY03-C124632_1.pep
HEAALSFAPGELGQVYTGATSTASNPLPSNTPSTNTTPLPTPTTISSPIKATHTSAISGGFATANNGQVPPASPARSNSAGSVGTHSSTQQAAAVINNPTPTLGSVPSVTATHSSQPSGLPLTTPPQTPLPNTASSTTSTVLGKRDAPATSESEKEDCKGSESMTVTQQPKKRRVAPTLISAGTDSTSSKDQSQNPNVGS

SEQ ID NO: 32316 - protein, 130 aa, Sorghum bicolor
  Clone ID: SORBI-28MAY03-C124633_1.pep
IQNPLQIFTMASQALVLATNTALQPYQPTAYQEHSSTFHQQPSSSQPQPTTSQENPLASSKCKKRYSSPGGGLKKGLDTLTKCIERKIDQQILQAQSRAYDTSSQPVATANGINKKVHWEEHSHEAQGKA

SEQ ID NO: 32317 - protein, 97 aa, Sorghum bicolor
  Clone ID: SORBI-28MAY03-C12469_1.pep
MGRREMNGRLSAEYQGLEVKVPNLFRCPISLDVMRSPVSLCTGVTYERASIQRWLDSGNTTCPATMLPLPSTDLVPNLTLRRLIALWAATAAPSSPC

SEQ ID NO: 32318 - protein, 149 aa, Sorghum bicolor
  Clone ID: SORBI-28MAY03-C124645_1.pep
MSVELVLWLFSFASVMVLIGLTAYQLICLSDLEYDYINPYDSSSRINAVVLIEYSLQGALCASFLLTLHWFPFLVMAPVTYYHVKLYLARKHLVDVTEIFRQLSDEKKYRMIKLAFYFCLFIITIYRLVMTAVMLFIDEDINLVETRTI

SEQ ID NO: 32319 - protein, 159 aa, Sorghum bicolor
  Clone ID: SORBI-28MAY03-C124726_1.pep
GSSISHTPASPEATTLARWICQSYRFHFGAELIKSGDGSGCEGVLKTLWHHASAILCCSLKALPVFTFANQSGLDMLETTLVALQDITLEKVFDDQGRKNLCAELPGIMEQGFTCIPSGLCVSGLGRPVSYEKALAWKVLDDDSGAHCICFMFVNWSFV

SEQ ID NO: 32320 - protein, 54 aa, Sorghum bicolor
  Clone ID: SORBI-28MAY03-C124768_1.pep
RNWGANWQALAGLVGQGLSFAVTTTGGQYIQFWNVVPGWWQFGQTYSTTQNFYY

SEQ ID NO: 32321 - protein, 138 aa, Sorghum bicolor
  Clone ID: SORBI-28MAY03-C124777_1.pep
YLLQTRRKSLYRRMAIYVSIIVLFVVLLAATYNLSTPKDVKGAVTLISNGTSLFAPTTILISLDGFRADFLFRNLTPTLNQFVQEGISPKYMMPSFPSVTFPNHYTMATGMYPEAHGVVGNTFWDPELQQEFYYTASC

SEQ ID NO: 32322 - protein, 117 aa, Sorghum bicolor
  Clone ID: SORBI-28MAY03-C124802_1.pep
PGPPPLPPARRPAPRLLRGCCKRHVYRRRALHLTTLPREPEQSRRGVRAGRGGSTSPEGESANSSHGADLCWGCGPGGKRAPGADLAGGAFILRGIVSRPQEQVLSYLVLVRTGERT

SEQ ID NO: 32323 - protein, 268 aa, Sorghum bicolor
  Clone ID: SORBI-28MAY03-C124822_1.pep
LKHALTGADIVVIPAGIPRKPGMTRDDLFKINAGIVRDLVKGIAEFCPKAFTLVISNPVNSTVPIAAEVLKAAGVFNPQRLFGVTTLDVVRAETFTQEFSGLSDPSKATIPVIGGHSGETIVPLFSKVSPDFKIPDDRYDALVNRVQFGGDEVVKAKDGAGSATLSMAYAGFRFAEAVLKAAKGEKGIVEPTYVYLPGVPGGEEIVKATGVEFFSTPVELGPNGAEKATNILGGVTEKEKTLLEACIKGLKGNIEKGVEFVKNPPPKL

SEQ ID NO: 32324 - protein, 233 aa, Sorghum bicolor
  Clone ID: SORBI-28MAY03-C124827_1.pep
QSLFNLAFTKVALLSLLSLVAARDALQSPTESPVLGQVTPQGCFSALPSEADGRSDTFNSVGSCAEYCEEQKKTVAILKGVECICADIYPAKSAKVDDDKCDTPCPGYAKDACGGKDAYSVFNLGVNLLPGNEGDKRSSGSTAELRGSAKTTVATTATEVSTTNAETTSAPTTEAEETASVTKPEKASAAETTTSDSTAVSTPSASASSVPDNASRRLNNPIGNLVGLLRRLL

SEQ ID NO: 32325 - protein, 246 aa, Sorghum bicolor
  Clone ID: SORBI-28MAY03-C125_1.pep
ANQDLSMGTAVNLPSPSKHTSNNSMQKQQNVRGGDSKCHPAQNPETPLWLVNPDKSEGVPHEREKAKNNSAQEIAPLVQTPLPSPAGYLIKPSSSKLAARGNTISESTNFTTPGNQNKPLVKNVGAPKAWKRSITHVYVSHVIQMHVNKEKAAASSSQIQAKLEERPLARSSRPPSGGFTTSHKAAAAAVRDEKFYKVHFDVRVPAHQQPSAGGICDVGAGRQKIVSATDTTPLERGSYRGGTAAA

SEQ ID NO: 32326 - protein, 131 aa, Sorghum bicolor
  Clone ID: SORBI-28MAY03-C125086_1.pep
MSGMQIFVKTLTGKTITLDVESSDTIETVKQKIQDKEGIPPDQQRLIFAGKQLEDGRTLADYNIQKESTLHLVLRLRGGVIEPMLQELARKYNCDKKVCRKCYARLHPRAVNCRKKKCGRSSQLRIKKKLK

SEQ ID NO: 32327 - protein, 223 aa, Sorghum bicolor
  Clone ID: SORBI-28MAY03-C125072_1.pep
HIMLTDFDLSLESTASPSLEDARNVGDNREEDVPEPAAPTCLPIPELQLLRLRRWKRRAAPRPRFVAEPVDARSSSFVGTHEYVAPEVARGGGHGAAVDWWAYGVFLYELIYGRTPFVGENNEATLRNIVRRPLEFPAAATTTHAHGVGDSAAARDLIARLLDKDPRTRLGSKRGAADVKAHGFFKGLNFALLRSAPPPVVPPPAALHRCDKAADVQQLFDHF

SEQ ID NO: 32328 - protein, 191 aa, Sorghum bicolor
  Clone ID: 9299739.pep
HEGYLRPAFIEEESYLRSLFHGECSSDRYSSDWKVNETDEYSRETRPVSGTNRLIDGDKSKFDFNDAETKTDSMIYKLEIMTIELFSMYGKQFMIDPQDFQDSEPDILANSASAIIERIKENSDQCAMALRSLCRRKKGLTVEEASLIGVDSLGIDVRAFSGLEARTVRISFNAQALSERSAEKKIRRMLF

SEQ ID NO: 32329 - protein, 108 aa, Sorghum bicolor
  unsure (1)..(108): unsure at all Xaa locations
  Clone ID: LIB3478-043-P1-K1-G11.pep
ITDILIEWGMPATMRAIHPIYFAKCLKKAIHNNXGKKMDSPSNGLSIVGYLRPAFIEEESYLRSLFHGECSSDRYSSDWKGTPVEKLDKNKLLSFSQILFDNPVPFWM

SEQ ID NO: 32330 - protein, 282 aa, Sorghum bicolor
  Clone ID: SORBI-28MAY03-C125229_1.pep
MAVDPFDSALDLLRRLNPKQTTDHLNAIISIAPDLTEDLLSSVDQPLTVRRCKQTGRDYLLCDYNRDGDSYRSPWSNQFDPPLDEAGSGGVGAGGNEGAGEGAIPSERVRKMEVKANEAFDVYRDLYYEGGVSSVYFWNLDDGFAGVVLLKKASPQGGNSEGVWDSIHVFEAIERGRSTHYKLTSTVILTLSTDGGNLGEMDLSGNMTRQVEQDLPVENDDSHIANVGRLVEDMELKMRNLLQEVYFGKAKDVVGDLRSIGSLSEGARDREAQRELIGSMRR

SEQ ID NO: 32331 - protein, 179 aa, Sorghum bicolor
  unsure (1)..(179): unsure at all Xaa locations
  Clone ID: SORBI-28MAY03-C125260_1.pep
RRRRSAPPPSAATPLLPGSAAAAEPHPRPRRRARAPSPPRTRHHRADHGEPPAVPSPIPNLAPRPAPERAXAPSHRRRAPTPPAPRAPRLRHRAAHDDTRGQQQAAPASWTSPWPRRGQQNEFSVEPRRCVLTVCCSEPSTTTSLSATQVVVTATPAPSATTSRTDPIVAAPSPVTKHH

SEQ ID NO: 32332 - protein, 165 aa, Sorghum bicolor
  Clone ID: SORBI-28MAY03-C125344_1.pep
MDGQAASAVSEADAVASATAALVQAGGRCVADTWKIQAAALPAVARGGGGGHEQQQQHQDLLSSEAFSLLHDILSVDAAGTGSGSANAHMSNSSSLAPSVSNSREQSPDRGSGGLAMFFAKPAAAVPRLACPLPLGSWVSPSAVSSARPGVSIAHLPMFAAWTDA

SEQ ID NO: 32333 - protein, 286 aa, Sorghum bicolor
  Clone ID: SORBI-28MAY03-C125361_1.pep
ARGPDAVQRMYSEVQLLSSLRHDGIIGFHASWVDVAGRSFNFITELFSSGTLRSYRLRYPRVSLRAVRSWARQLLAGLAYLHARHPPVIHRDLKCDNIFVNGHQGQVKIGDLGLAAVLGRRGGAAHSVIGTPEFMAPEMYDEEYDERVDVYAFGMCMLEMLTVEYPYSECSNPAQIYKKVTAGRLPDAFYRIDDDDARRFIGRCLVPAANRPSAAELLLDPFLLDRHHVVAAAAGTVPSSVPPPPSLPAAVAAAGAPPPSTCSSSADDVVSASSSSLDDDEGEHHH

SEQ ID NO: 32334 - protein, 281 aa, Sorghum bicolor
  Clone ID: SORBI-28MAY03-C125362_1.pep
MAHGLAGGVGPLRCCPSVSSSSTTVHHTLDAPPRRSLAMCASTFSPPAASAIEGRDVGLSVTTRRGRVLPVLKGCSLLVPPGQLWMLLGPNGCGKSTLLKVLAGFLNPSAGTVYVNRPCSYVFQNPDHQVVMPTVESDVAFGLGKLKLPLDEVRLRVSKSLDAVGMLSYSQRPIQTLSGGQKQRVAIAGALAEASKVLLLDELTTFLDEHDQIGVIKAVRNSVAADGEVAALWVTHRLEELKYADGAIYMEDGQIIIQGDVSTISRFIKRKQARYFGHFEL

SEQ ID NO: 32335 - protein, 158 aa, Sorghum bicolor
  unsure (1)..(158): unsure at all Xaa locations
  Clone ID: SORBI-28MAY03-C125376_1.pep
FSGHAVFPMIYTGMRNRKTFPTVLLICFIICTLSYGLTGVVGYLMFGESLSSQXAIEDKLHVGKNRTVSIVIRTALVVSTTIVALAVPFFAYVVALTGSFLSSTVTMLIPCVCYLKISSRTSRNLRLELVVCLVIIMIGAGVIVVGTYSSLKQIVNSF

SEQ ID NO: 32336 - protein, 158 aa, Sorghum bicolor
  Clone ID: SORBI-28MAY03-C12540_1.pep
VSHGGLPLTTQPAGTLGYLAPEYVHSGVATERSDVYSFGVLALEVATGRRPTERGISVVDWVWVLWGRRRRVDAADQRLQGRFFAEEMRRILLVGLSCVHPDCRKRPGMRRVVKMLDGTAPLTMVPDKKPPVILQTQVNQGSSMNSVDTVNTAFYSCR

SEQ ID NO: 32337 - protein, 184 aa, Sorghum bicolor
  Clone ID: SORBI-28MAY03-C125406_1.pep
TSFVSLSLSQISLLPEGSTLVSAYSNRISYLFRTAWHLVSYSPPSAAQTSCAIRAHVLLLATQGPSMVAFEEDPMSFKLGMHSVEETMSTISSPEGPATTSQLPENGVGPQSGDFRCGICNKTYSRRDLRDRHRRRCIKTAGQERLSKRKSCEICAQKKLRCSMTRPACARCVQMGTACHYPPT

SEQ ID NO: 32338 - protein, 80 aa, Sorghum bicolor
  Clone ID: SORBI-28MAY03-C125479_1.pep
MEAAAAAAAPSVSVAGGRGRDEKTQPRPAAAAAAACDVEALRRCLEENKGDRVKCQAHIDAFRSSCSAGPSTSSKLQSSS

SEQ ID NO: 32339 - protein, 123 aa, Sorghum bicolor
  Clone ID: SORBI-28MAY03-C1255_1.pep
SAAHCPGPGLPQPLRPWRQPKAGPAPPRARASTTVTAASGPSAGTARRRRLPLPFAAAARRETGSTRPRRRPASSWRNPVWRMARRQRAWPSWLPLTRGAGALRRREMGMASPRVRGRVVDRD

SEQ ID NO: 32340 - protein, 210 aa, Sorghum bicolor
  Clone ID: SORBI-28MAY03-C125515_1.pep
MDPSMAVTKIYVVYYSTYGHVARLAEEIKKGADSVAGVEATIWQVAETLPEEALAKMHAPAKREEHPVMVSGRQLADADGVLFGFPARFGMMAAQMKALFDSTGGLWQAQALAGKPAGFFFALGTQGGGQEETALTAVSQLAHHGMVFVPVGYTFGEGMFDMDEVRCCSPYGSGTFAGKDGKSRLPSDAELQMAAHQGSYFAAFAKKLKA

SEQ ID NO: 32341 - protein, 212 aa, Sorghum bicolor
  Clone ID: SORBI-28MAY03-C125523_1.pep
ARGVEEAACQNPAIKALVSYGGRKFTSLSATNQPPQLVHTSGPPTAHRRQSSTESVGISPPSVKTYRYEDAEKESGWILPSDPNYHKRNAGIAHTRSLTFLKPLLGGPYFDLEAVWEEHTKYEFGERDVEKTMATMVDQPYVNHIPTMTGGVGKDRLTAFYTHHFIFSNPPDTSLSLVSRTIGVDRVIDEFVFSLTHTSHVPWLLPGVPPTG

SEQ ID NO: 32342 - protein, 73 aa, Sorghum bicolor
  unsure (1)..(73): unsure at all Xaa locations
  Clone ID: SORBI-28MAY03-C12553_1.pep
SWSYLVYGLVFLFVVQIILLFCEQIIEDKHXSTYIWLSVMNRMVFSRIILLYCPQRAASWACEGASILLNTSR

SEQ ID NO: 32343 - protein, 214 aa, Sorghum bicolor
  Clone ID: SORBI-28MAY03-C12559_1.pep
GRLSELLGLSDHLILLNVIVGKIATNLKCYAESEDVIDHTLSLFLDLATGYMTGKLLLKLESVKFIIANHSPENFPFLAEYKCSRSRTTFYYILGSLVFMEDSPVKFRTFMEPLQQVAFNLEATPDAAFQTDVAKHAFIGLMRDLRGIAIATNSRKTYGLLFDWLYPSRMPLLLRAISLCTDEPAVTTPLLKFMYEFVLNQAQRLTFDSSSPNG

SEQ ID NO: 32344 - protein, 139 aa, Sorghum bicolor
  Clone ID: SORBI-28MAY03-C12561_1.pep
HAFGFILLLLAIFRFELQYLEVRENEYDEKVYLDLYTDSSPKVPAVENVMVYFATANKESNENYLGPAPLDEMARQICLAQGPSGPNREYVFKLEDALNKLGKTNMSKNWRMLCVSILTPSYLSEKSHLPLVWRVKIYE

SEQ ID NO: 32345 - protein, 216 aa, Sorghum bicolor
  Clone ID: SORBI-28MAY03-C125629_1.pep
RGFNVAASMLQASGVASEFEADEHGAGITVFVPTDDAFAGLPATDRLQSLPAERKAVVLRFHVLHSYYPLGSLESIVNPVQPTLATEHTEAGHFTLNITRVNGSIAIDTGIVQASITRTVFDQNPVAVFAVSKVLLPKEMFSRGDSGSTAIVPPSVAMAPGDTSSEQTPQTRLSSPPDLHGEDSESSAALATAKGASWWRIGLMYLQLHLLFLSLV

SEQ ID NO: 32346 - protein, 111 aa, Sorghum bicolor
  Clone ID: SORBI-28MAY03-C125652_1.pep
QWPVEHLSCWSSSIISLYLSMPLVAVFPGWLPVPEGPVRRGQRPASQRSAMVSSCRSLLLIYQFKVSLYLLLLVFLRSFLSVPSVPVRAEDFSRSLAFWRQFQCWFWNMLL

SEQ ID NO: 32347 - protein, 132 aa, Sorghum bicolor
  Clone ID: SORBI-28MAY03-C12586_1.pep
AISGPLTRRQDGSWRITLRRWRRRWSRTPPPTQTIRNGVCSWKIWLVLRYLRLSCTCQICFTLVALKGAVARPRHSVGSPRWTLSSTGDEGGRRYRVGTLLWSSARVKEVCSSIMLAWRRHDEERSWRRRRR

SEQ ID NO: 32348 - protein, 224 aa, Sorghum bicolor
  Clone ID: SORBI-28MAY03-C125866_1.pep
SQLALRRLLSPPSATAAARRAAPVAAEPVSGGGGVLLPRGGVAGVAGNGWSGSASGLRLARRLCTYDERDDRALEEEAEKKFGWILKIFFLGTAGLVGYQFFPYMGDNLLEQSISLLRVKDPLFKRMGASRLARFAVDDQRRMKVVDMGGAQELLNVLEGAKDDKTRKETLKALAALSKSEEAAGFLDKAGAYAIVSSTPNSGEYAEIQTYKTSLLTAFDQLKS

SEQ ID NO: 32349 - protein, 194 aa, Sorghum bicolor
  Clone ID: SORBI-28MAY03-C125872_1.pep
WTSFLSLTVFHMYANYKAVQSLSLTTLNYERASILLQYFKECGDVLAPQKVSQQEHILPFWSTWRKLNKIKLPHERVHLGAKASMLTHSDMLVIAKTRSHYENTNYLLLNKQGSVYIFIHKLATPADVLRSFVHGLVLASSTSQHLEARRWMDEMYTNFISKLQSEGYSTERLLSHSILWRAHWLHGQHDEKLK

SEQ ID NO: 32350 - protein, 218 aa, Sorghum bicolor
  Clone ID: SORBI-28MAY03-C125867_1.pep
GFAITASHTGSEGAMCLVKVKQEEDHVVPYRVVQRNRSPPRRRASRQSRDIERRYSRTEIVHDSSPRPSASYVAVPSPKPLQIPAPQPVPMFVQPPPPPAPMPAPPAPPSHISSHHTQAHSHHGGAHYVEVSPRSSMSSRSSSPGRSEYVYTEREVRRERERNYSPENPRYEHYRYVEPASSESDHYERYQRRDRSRQRSRSRGGYEETNTRVAYSRR

SEQ ID NO: 32351 - protein, 129 aa, Sorghum bicolor
  Clone ID: SORBI-28MAY03-C125932_1.pep
NVLTRLLDNFPDVGTEKIIEAMMYSSTSRSSSSDHEMMDARKEILTRVFLKSLQTDDTIFKKVSQSVYCAFRAITLGGSGEKGRKLADASLRRIGATKLTARLVKAAEVLLKAAMVSEQVHGPWYTQLL

SEQ ID NO: 32352 - protein, 210 aa, Sorghum bicolor
  Clone ID: SORBI-28MAY03-C12598_1.pep
DIKRYLCLELVKQVPLFHGMDDLILDNICDRLRPLVFSSGEKVIREGDPVQRMVFILQGKLRSTQPLTKGVVATCMLGAGNFLGDELLSWCLRRPFVDRLPASSATFECVEAAQAFCLDAPDLRFITEHFRYKFANEKLKRTARYYSSNWRTWAAVNIQLAWRRYRARTSATDLAAMAAPPLAGGPDDGDRRLRHYAAMFMSLRPHDHLE

SEQ ID NO: 32353 - protein, 174 aa, Sorghum bicolor
  unsure (1)..(174): unsure at all Xaa locations
  Clone ID: SORBI-28MAY03-C126034_1.pep
TRLQSLLQQPDLERQVTELRHQFNRKTVLLGVDDMDIFKGIDLKILAFEQMLKTHPKWQGRAVLVQIANPKGGSGKDLEGLQTEIEDSCRRINEQFGRXGYSPVVLVNRTLSSVERMAYYTIAECVVVTAVRDGMNLTPYEYIVCRQGIPGLAGSVDDKPRGKSMLVVSKKKKK

SEQ ID NO: 32354 - protein, 136 aa, Sorghum bicolor
  Clone ID: SORBI-28MAY03-C126144_1.pep
DFDEEEMYEKIPADLIISSEKAKSIVQAFAKVRLENSLVQAIALLRQKKRDDVVSSLNDMLACDAAVPASKPLSWPTPGELDDLYAIYLKSIPRPEKLSRLQYLLGISNEKANKIRDAASEGSLPIAAEEKEELAF

SEQ ID NO: 32355 - protein, 220 aa, Sorghum bicolor
  Clone ID: SORBI-28MAY03-C126039_1.pep
MADGQPAPPRPVVVVAMKGHPGSGKSTAARAIAAALGWPLLDKDDVRDCTLPLEGLAAAGILNDLSYAVLWRMAERQVRLGLSVVIDSPLSRRAHLDALTRLAGALVVVVECRPGDNEEWRRRLESRGAAVPNGGGSDGWHKPKTWAELERLLEGYQGCTDYEIGDVPRIVVDTTDPAVDAQAIAEKVVGFIRSLLSCSQSSCERQDSPVCYWKPKCTLT

SEQ ID NO: 32356 - protein, 116 aa, Sorghum bicolor
  Clone ID: SORBI-28MAY03-C126158_1.pep
SMPGRRSSSAADATSAAPCRALPPRPRARRAAGTGAGARRASTATEDGGWTGGMGTTAALTAAEAGAEGADAMGGWWVRVRAQSAEGDRTSGPAAVWRLARRLLRARLLRWTLPSC

SEQ ID NO: 32357 - protein, 127 aa, Sorghum bicolor
  Clone ID: SORBI-28MAY03-C126200_1.pep
AKLGDVMSRPVQVATPGQRLAEVDAIFAAEQFSGLPVVDEDGRCVGVISKKDKAKAPNGMQMESTVVEVMSSPAITLTPEKTVLEAAALMLKEKVHRIPVVNEQQQVIGIVTRSDVFQALEANNNKA

SEQ ID NO: 32358 - protein, 161 aa, Sorghum bicolor
  Clone ID: SORBI-28MAY03-C12624_1.pep
MKEKARKDSKGVEKKEKGSKDMETKEKAGKDSKDVETKEKAGKDSKDVEMKEKVGKESKDVKMKEKAGKESKDTEVQEKPVKDSKDVKMKEKAGKESKYMEVKEKAGKDSKDVETKGKAGKESKDVEMKDVEKLDDHTLSNKVESDNETLSVWKKRTAKAT

SEQ ID NO: 32359 - protein, 158 aa, Sorghum bicolor
  Clone ID: SORBI-28MAY03-C126244_1.pep
ARGALARRATQHSPGYKGNPEANEAAFRFGWFHTGDIGVVDEEGYVRLVGRIKELINRGGEKISPIEVDAVLLGAPGVAQAVSFGVPDDKYGEEINCAVIPRDGSALREEEVLAHCRRNLASFKVPKKVFITDDLPKTATGKIQRRIVAQHFVQPASA

SEQ ID NO: 32360 - protein, 71 aa, Sorghum bicolor
  Clone ID: SORBI-28MAY03-C126539_1.pep
TRAASTSTSATPCSASPTDAALIDDGRRDDDRVDDGQARPSFASLISLGDMISSSPCNTHCSLVWFLLARS

SEQ ID NO: 32361 - protein, 147 aa, Sorghum bicolor
  Clone ID: SORBI-28MAY03-C126540_1.pep
MVSAKRLAQMAKKWQRMAAMARRRIASAPTKGTTEGSSPCSTSPVAGKGHCVVYSADGRRFEVPLAYLDTAIFGVLLSMSQEEFGFASDDGRIMVPCDAAVMEYVMCLLRRDASEEVVRAFLSSMVRPCHCGNGLVQSMGVSQQAVF

SEQ ID NO: 32362 - protein, 62 aa, Sorghum bicolor
  Clone ID: SORBI-28MAY03-C126558_1.pep
MAKIKPKALLAQSKMKKAPSQISVITIVTYTILGVLVVSSVYVAYKYLTCIGPVEAVGVQGN

SEQ ID NO: 32363 - protein, 175 aa, Sorghum bicolor
  Clone ID: SORBI-28MAY03-C126559_1.pep
HEAGRCGGGRLSKTDRLLLGWWVFTALAHIVFEPPFLFTPDFLSKENPNFFDEMFKEYSKGDSRYASRNTVVLALEVITVGFKGPASLLAVYAIASRKSYSHILQFAVSLSQLYGCLVYFIPAYLDGFNFWVSPFYFWAYFIGSNSSWVIIPTLVATRSWKKISAAFQAEKVKTR

SEQ ID NO: 32364 - protein, 65 aa, Sorghum bicolor
  Clone ID: SORBI-28MAY03-C126600_1.pep
TVHFVTCKKKKFTEISLLLHGVLGCCIAPPCMVPWTGCAACVYYCVCVCVCVYIYITLLSGKPEL

SEQ ID NO: 32365 - protein, 101 aa, Sorghum bicolor
  Clone ID: SORBI-28MAY03-C126680_1.pep
TRETCVTVCGVSELDACADACARTVCVNQHQVPNWNDVCLKRCQSECLKLSSTLMHGPSRYRAALLRYHQSGSYLLLSISWLTNFSLQTLLTVIISRNWSE

SEQ ID NO: 32366 - protein, 65 aa, Sorghum bicolor
  Clone ID: SORBI-28MAY03-C126687_1.pep
VEKEKHAWNTITGLVSYLLHIYIPVSAKNEKRSHTADENCNLQSFCYSSCIPTAIAMVVHMRALF

SEQ ID NO: 32367 - protein, 112 aa, Sorghum bicolor
  Clone ID: SORBI-28MAY03-C126694_1.pep
SLCLLQFYVHLPTRKRFLSKAEVLHFVNKGMVSTCDMDVLCDTSTDDNILAQVEFSPDGLPDGWVKETIFRKCNDGIRKDPYYTDPVSRRVFRTLKSVLSYLGTGEISKHSY

SEQ ID NO: 32368 - protein, 146 aa, Sorghum bicolor
  Clone ID: SORBI-28MAY03-C123901_1.pep
KERRFRIPHRFRRLLLVSGGRSGAGGGEESRNRWLVRGLPPNSLCLGRLGLVDSASVTSSMGISTSFPSCAAATSVSARSLMTSGAVSRTDKMRYVAWCWSGYLSIASQFLYPSRSFPASFPSSRNRVGFLPLGLLCRWVFWGRQR

SEQ ID NO: 32369 - protein, 58 aa, Sorghum bicolor
  Clone ID: SORBI-28MAY03-C126719_1.pep
HEGHLSHHSSVIFCPYIWCINFSKNLVGPNHSTGRLVFFNSYTINILQTRIKKKKKKK

SEQ ID NO: 32370 - protein, 45 aa, Sorghum bicolor
  Clone ID: SORBI-28MAY03-C126739_1.pep
ARGANLNEEPEPARDLDLNQRPPPELDLNQSPPPELDEAGDDGAE

SEQ ID NO: 32371 - protein, 61 aa, Sorghum bicolor
  Clone ID: SORBI-28MAY03-C126822_1.pep
LKLCMDATAFGASEKRCLNVENYIKVTQKCLQRYYRAVTRKHLPIYPTPFPRAEFGTRPRA

SEQ ID NO: 32372 - protein, 215 aa, Sorghum bicolor
  Clone ID: SORBI-28MAY03-C12681_1.pep
IYYPSQSSDVPSNSRVTFALDHNYRSHIEYRWGGEGLRKYLVKWASSVVERRGRTEKQIIFEDSEHSSTYCLAFRVVNPNHLPPLKELQKLMRIQSLRCHALYNHGATRLSVIPIHASRSQALRYLSIRWGIELPDAVVIVGETGDSDYEELFGGLHKTVILKGGFNTPANRIHTVRRYPLQDVVALDSSNIIGIEGFSTGDIRSAMQQLGIPTQ

SEQ ID NO: 32373 - protein, 143 aa, Sorghum bicolor
  Clone ID: SORBI-28MAY03-C126972_1.pep
HFLYTNRHSYKIDLQPHCISHYSFQTFHTFLLTNQIKLILLYIAQKKQNIQRTEKADGNERRNAPSNTCPEAPNYVIPKILGGCASALPLLIGKSTPLQIEQISSLDFFRIRFILQILIRISTQNWRQAAVFLVYQLLLSSST

SEQ ID NO: 32374 - protein, 152 aa, Sorghum bicolor
  Clone ID: SORBI-28MAY03-C126973_1.pep
MTPKWSACPSDSYRELSSHENGECKSTLTPVPSPTSCFGLHTANTMCSLSSQKKDGNVYKRRKMDKDSNSTIAYEEAKEMTTQSCTISDDHSSSLLPIVSSEALHLNSTAGMAGPILDCEEPADVSLEPNSGTNDRCFVSSMSPSFMILGKK

SEQ ID NO: 32375 - protein, 171 aa, Sorghum bicolor
  unsure (1)..(171): unsure at all Xaa locations
  Clone ID: SORBI-28MAY03-C126993_1.pep
RLRILSDSLSLKNLHKFFNKLDIPLVHLIWERHYSKGLLPIQERRGSFXWRDILKLLXGSSCFLRLDLWHGHLLQQSFPELFSFSKNPNISDQSARLTTQLQLLFHLPLSVEAFAQFQVFSSIRPRSFHRERAPERILGRIGILFYINFHCRIDSWPLNTVTEQALIQTLV

SEQ ID NO: 32376 - protein, 215 aa, Sorghum bicolor
  Clone ID: SORBI-28MAY03-C127042_1.pep
MAGNEMTPSSKAAAPPATIRLVNFISEDQLDEVKRTRGERVEDGTAQRDKPLFQILQENKEKKDAEFNERFKHRPPKALDEDETEFLDKLASSRKEYEQQVANEEAEQLRSFHEAVAARSSIVHELETPTVSRPEESRPKPPTKRSQHALLKNVIISVKPQAKKPKVEAEAKPAPAPEERPSNGHDADQKQPDDTKATLGSLVAYDDDESGEDDD

SEQ ID NO: 32377 - protein, 121 aa, Sorghum bicolor
  Clone ID: SORBI-28MAY03-C12702_1.pep
DPQKGRKDKGKGGLKIQFPPHIPRRSRAVLSISRCMDVMRAREKGQGERELRRSLDATTVTLYSGGFEGAWVAARREGGATHHWRGRKCDRMVGAAGGSETREKSRVEKNEWIRRHRGGAK

SEQ ID NO: 32378 - protein, 121 aa, Sorghum bicolor
  Clone ID: SORBI-28MAY03-C12707_1.pep
EKRPIECVCRAGEVVFVPNGWWHLVINLEESIAITQNYVSRRNLLNVLDFLKKPNASELVSGTTDRVNLHDKFRGAIEAAHPGMIKQLELEAQQKAAARKKKASFWDSAADAKSGGFKFSF

SEQ ID NO: 32379 - protein, 46 aa, Sorghum bicolor
  Clone ID: SORBI-28MAY03-C127092_1.pep
LYWCIRTRAGVEAIGVCYGMSANNLPPASTVVSMYKSNGITAMQLY

SEQ ID NO: 32380 - protein, 125 aa, Sorghum bicolor
  Clone ID: SORBI-28MAY03-C127144_1.pep
RRTRSAGGAVTVAGHIPLPVPAPHRDGRRGAPRPQLAEPTDDTWRRQAAAPQWRAVGIYLPIPEKNDSTLATRGYESIARRDWGPPGLRAGAGRGSIMDAAESRKGRRGECARHEEDETRHNPRA

SEQ ID NO: 32381 - protein, 150 aa, Sorghum bicolor
  Clone ID: SORBI-28MAY03-C127213_1.pep
TQSIRTARAERTRNRSKQTHVSMASSSDLPVPAGPGATRLRDLDDRRGRGQPRREAVVEQAVAAAGAGSQILVLVLFVVAVDVEVALVEVERVAERVVAELPDARAAAPPHPLAQAAAAGALLAEAAAHGGPQPVPQRAQRRRRRRLHLL

SEQ ID NO: 32382 - protein, 118 aa, Sorghum bicolor
  unsure (1)..(118): unsure at all Xaa locations
  Clone ID: SORBI-28MAY03-C127217_1.pep
MAREPSPEIDDELFNEVYGKAYSGPVASAANSATPKVNAEKRPLTRDKSDDEDEAPDPNAVPTDFTSREAKVWEAKAKATERNWKKRKEEEMICEICGDSSHFTXGCPSTLGANRRNA

SEQ ID NO: 32383 - protein, 149 aa, Sorghum bicolor
  Clone ID: SORBI-28MAY03-C127232_1.pep
MDATSGSSMHFVMMPWLAVGHILPFTELARRIALQGHRVTLLSTPRNTRRLIDIPPDLDGLVHVVDVPLPRVERLPEDAEATMDLRSDDLRPCLRRAYDAAFSAKLSKILQGPEPSSRPDWVLIDHAAYWAPAAAARHGVPCAFLSVMG

SEQ ID NO: 32384 - protein, 99 aa, Sorghum bicolor
  Clone ID: SORBI-28MAY03-C127329_1.pep
SEEAIQSRVSTHSGRITFQANQQTTTAEEEKQLIDREVERGVVYLMGEANVSAGPRSSILKKIVVNYIYTFLRKNLTEGHKALAIPKDQLLKVGITYEI

SEQ ID NO: 32385 - protein, 161 aa, Sorghum bicolor
  unsure (1)..(161): unsure at all Xaa locations
  Clone ID: SORBI-28MAY03-C12733_1.pep
PRVRENRSWIRQITGGGGVTVPAIMEYLRLWDILSTITLGEGEDKLIWRWTADGAYSSKSAYRALFMAATPVYGCHLVWETWAPLRVKIFLWLAIRKRHWTADRRRXHGLEAADRCYLCDQEPETIDHIIASCSLSRQIWWNVLTILGANVSQIGDDSLLD

SEQ ID NO: 32386 - protein, 197 aa, Sorghum bicolor
  Clone ID: SORBI-28MAY03-C12740_1.pep
RISSDTSALPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARMQDGCLRRYPALYGSDDRIQACMAELGVPLTKHPGFHQYDVYGDLLSLLASHPVAPIVTLHHPDVMKPMVPDARSSPAAVQQLFNRTVKLD

SEQ ID NO: 32387 - protein, 92 aa, Sorghum bicolor
  Clone ID: SORBI-28MAY03-C126697_1.pep
ITIIIIMSFTDAETLCELTLITTDQIDAVTEHLISWTDVNQGGNTANSPVLMCSEELWCLLLTPQVGIFNPEGCYWGSSPAKGQKMGTWALA

SEQ ID NO: 32388 - protein, 63 aa, Sorghum bicolor
  Clone ID: SORBI-28MAY03-C127553_1.pep
MNRGGDRSGGPSSGGDRSGARFQRGPSRWSGSGGGGLWGSPPYRYSSRGAADGGGGGGGGGGG

SEQ ID NO: 32389 - protein, 90 aa, Sorghum bicolor
  Clone ID: SORBI-28MAY03-C127561_1.pep
WCRNAHTLGGCFHHHHRRDRGRCHQGCNPCFHLRTWSCHRLPPSKPPGTDAIVGRRGVLFAQCERRRCPRRRVGSAGRVRVLREQSPASC

SEQ ID NO: 32390 - protein, 157 aa, Sorghum bicolor
  unsure (1)..(157): unsure at all Xaa locations
  Clone ID: SORBI-28MAY03-C12757_1.pep
MAASVPNGSPTVSSLATTVPVQAVLFDIDGTLCDSDPLHHLAFQELLLEIGYNNGVPIDDEFFIKNIAGRSDVEAAQNLFPDWPLEKGLKFLDDKEAKYRSLAKERLVPVKGLEKVVQWVKDHGYKRAAVTNAPGINAELMISLLXLSDFFQAXIIG

SEQ ID NO: 32391 - protein, 150 aa, Sorghum bicolor
  unsure (1)..(150): unsure at all Xaa locations
  Clone ID: SORBI-28MAY03-C12762_1.pep
AHAGVGTPPHGNSVSNVVCDSPVKFVSSVVCSRAQTSPSHDDINLEQAQLTTSPYGSEDTSASGTSFAAVGAVVLADESSKLGNLTSDLELNTIQRMPLHTSSECVAQKDETKFEEIRSLASSNCAEFVESSVLAIAEKVHLDIGXDEVN

SEQ ID NO: 32392 - protein, 176 aa, Sorghum bicolor
  Clone ID: SORBI-28MAY03-C127688_1.pep
TRQVPIHPHPRPGHHHVGPPPVASPRRRRHARRLHPHRRRVLPGGGGGGAGEEGAGKEGWGGSNLGRDLPTPKEICKGLDKYVIGQDRAKKVLSVAVYNHYKRIYHQSLQKGSGADLGGFDGEADDDDNVELEKSNVLLMGPTGSGKTLLAKTLARFVNVPFVIADATTLTQAGYV

SEQ ID NO: 32393 - protein, 157 aa, Sorghum bicolor
  Clone ID: SORBI-28MAY03-C127781_1.pep
FSRDQTQAVTNRVVGTYGYMAPEYMMRGNYSVKSDAFSFGVMVLEIVTGRKNNSNNDGTQQSGDLLTTVWEHWETGTVVELVDPNMGGGSIPEHDVLRCIHIGLLCVQGDPAARPVMSSVVVMLGSNTVTLQAPSKPAFCARNNSNTAVSSTAPLQG

SEQ ID NO: 32394 - protein, 113 aa, Sorghum bicolor
  Clone ID: SORBI-28MAY03-C127794_1.pep
YTIRTWSMTVLENVHSLVGQSASPEYLQKLTYLCWNHHKAVRHIDTVRAYTFGSHYFVEVDIVLPSNMPLREARDIGEALQEKLERLPEIERAFVHLDYEFTLRPEHALSHEK

SEQ ID NO: 32395 - protein, 100 aa, Sorghum bicolor
  Clone ID: SORBI-28MAY03-C127828_1.pep
TNLTCVTSIKCIHPKHTIDYTITFLFQYTNTMHTLNGTRFLLNQPYSQSTNTRANSIASPMHYTKADKIYISTSFNPFMGDEFMQIYQRNEQELLRSCRT

SEQ ID NO: 32396 - protein, 89 aa, Sorghum bicolor
  Clone ID: SORBI-28MAY03-C127905_1.pep
LIRAENNQISSSIMFGTRTQISPSWFRGRCFIVFASTNFASTPETSAPASSSTKLMGMALLQVLQRYYPARGAPLYICAGTVISTLIQT

SEQ ID NO: 32397 - protein, 269 aa, Sorghum bicolor
  unsure (1)..(269): unsure at all Xaa locations
  Clone ID: SORBI-28MAY03-C127043_1.pep
MAVEEIVQHPLPGYGAPSVLSFSPDDRRVAYLYSPDGTLHRKVFTFDTAQRCQELLFGPPDGGGLEEGNLSAEERLRRERARERGLGVTRYEWRARHSGEPAARAGIVVPLPSGVYFQDLSGSEPVLKLQSSPTSPIIDPYLSPNGSMIAYVRDDELHTLGVSSGETRQLTFGARESRKVHGLAEYIAQXMERKMGFWWSPDSKHLAFTEVDSTEIPLYRIMHQGKSSVGPDAQEDHAYPFAGAANVKVRLGVVPSHGGEVTWMDLLCG

SEQ ID NO: 32398 - protein, 184 aa, Sorghum bicolor
  Clone ID: SORBI-28MAY03-C128127_1.pep
TRAKPTTKGCSKQRGRDSSNARGNRNKRTEEENVPGLITVAPESEDETPFVDGNQAEGGALWDIFRREDVSKLHDYLMKHADEFRHCNFETVKQVTHPIHDQCFYLTNEHKRKLKEEYGIEPWTFEQKLGEAVFIPAGCPHQVRNLKSCIKVALDFVSPENVRECIRLTEQFRLLPKWHRVNED

SEQ ID NO: 32399 - protein, 84 aa, Sorghum bicolor
  Clone ID: SORBI-28MAY03-C128150_1.pep
MSLIFIYSGKGFNWQKFQMPSVKSKNGWLLAGGLHADNVCEAFSALNPNGVDVSSGICAPDGIQKDADRINSFISNVKSMNFLS

SEQ ID NO: 32400 - protein, 99 aa, Sorghum bicolor
  Clone ID: SORBI-28MAY03-C128176_1.pep
DGWAGRKAARGGSPGTPGGAESASTGSSDASEVSYGGGAAVTLAAAGGPVFEFETKPTVPPAQQMPLSAIESWLFDDDSHFHHVQSAGVLDAAPMDYPF

SEQ ID NO: 32401 - protein, 279 aa, Sorghum bicolor
  Clone ID: SORBI-28MAY03-C12818_1.pep
EAIRISCAGYPTRRTFYEFIDRFGILAPDVLSGSSDEVSAVRRLLDKVDLQGYQIGKTKVFLRAGQMAELDARRNEVLGRSASMIQRKVRSFLAQKSFIALRRAALQIQTVCRGELARRVYHNLRREAASLKIQTLYRMYTARKAYNELSASAVTIQSGLRGMCARKELHFRRQTRAAIIIQSRCRQFLARLHYSRTKKAAITTQCAWRGKVARKELRKLKLAARETGALQAAKNKLEKQVEELTWRLQLEKRMRADLEEAKSQENAKLQAALQEVQQQ

SEQ ID NO: 32402 - protein, 74 aa, Sorghum bicolor
  Clone ID: SORBI-28MAY03-C128247_1.pep
KLHRYPCACGFFCLRLKYPITFLAPLPGNGSCASFEPSRPCILFFSFFLPHSPYHFHHTTWISLHTLMSMEFIS

SEQ ID NO: 32403 - protein, 141 aa, Sorghum bicolor
  Clone ID: SORBI-28MAY03-C128293_1.pep
TKSDVYSFGVVLVELISSKPAVDMSRARGGDVNLATMAVHMIQCYEIDRLVDPRIGYRTDGGTKRAVDLVAEMAFRCLQPEQDVRPPISEVLDALREAQRMQQDGCAAVKAKDDMGLLKKSRDGSPDSVMHQWTSPCTNHP

SEQ ID NO: 32404 - protein, 147 aa, Sorghum bicolor
  Clone ID: SORBI-28MAY03-C128465_1.pep
ARGFVGVGARRVRSLFQAAKKKAPCIVFIDEIDAVGSTRKQWEGHTKKTLHQLLVEMDGFEQNEGIIVMAATNLPDILDPALTRPGRFDRHIVVPSPDVRGRQEILELYLQDKPVANDVDINAIARSTPGFNGADLANLVNIAAIKA

SEQ ID NO: 32405 - protein, 172 aa, Sorghum bicolor
  Clone ID: SORBI-28MAY03-C128679_1.pep
HKLILQCIRQRLTRIILFHRCILLGPKQLNRTTIIISRFMLLGCKQGHTKAITRSMLQDSKQDHTRVVIIRFIEQGCNLEEHIRSTINIPRCIMQGSKPTVHTKISSGGRDTHRPIRLTGILPWQRGMSLFVDSSTMDQQGTQNPKQQTLQLHKDSRQHPLITQEDSNRQIF

SEQ ID NO: 32406 - protein, 123 aa, Sorghum bicolor
  Clone ID: SORBI-28MAY03-C128663_1.pep
QTPSLLLPDYEDEGSRQYLEEKGQIEYRDMNSNGEHTPTQPNEYSDVEHHQQKGQTETSQEVEMEEDYPMQQENPSFLQLCASLFPSNGSSTFRVRHSLFRPRRRAPLKASPLHVAMAAIMKR

SEQ ID NO: 32407 - protein, 140 aa, Sorghum bicolor
  Clone ID: SORBI-28MAY03-C12742_1.pep
HACCLPCFHPSFCFHLAITNIGSLASQTTDVALLQKPYAMAALPFSRSCVAVVVLLAAVYEYPGAHQIKILSSQSSIQYLLIPLSLLLPLSDLVDGNSKDQDTAPKLTYRSTCKQGMSAVAIKKELKNTYVASIIEKEGF

SEQ ID NO: 32408 - protein, 54 aa, Sorghum bicolor
  Clone ID: SORBI-28MAY03-C12871_1.pep
MDATARPVIVIDNGTGYSKLGFSGNSEPSFTLPTVVAANESFLDQTELLSSANW

SEQ ID NO: 32409 - protein, 164 aa, Sorghum bicolor
  Clone ID: SORBI-28MAY03-C128757_1.pep
ARGLGPLLNPARVPHAVIGVYHENIVTKMAKAAQKFGMKRALVVHSKGLDEISPLGPGYILDVTPGKIEKMLFDPLDFGIPRCTLEDLKGGDPAFNAKVLQDVLAGQRGSIADALVLNAAASLLVSGKVKNLHDGVALAQETQRSGKAINTLESWIKVSNSSRD

SEQ ID NO: 32410 - protein, 110 aa, Sorghum bicolor
  Clone ID: SORBI-28MAY03-C128820_1.pep
HEASCRIRHEDVYSFAVVVLELLTGRKAFVPVEDEDGEEEGGLAFCFITAAQAGRHREIMDQQVMEEVGAEVLDEATELLVRCLSMVADERPTMKEVADKLHRISSGTQN

SEQ ID NO: 32411 - protein, 244 aa, Sorghum bicolor
  Clone ID: SORBI-28MAY03-C12885_1.pep
RHRVETLNAAFGYAVRSTGYGSRYQGVYPVKCNQDRYVVEDIVEFGAPFGFGLEAGSKPELLLAMSCLAARGNPDALLICNGYKDDGYVSLALMARSMGLNTVIVLEQEEELDIVVEASRRLGVRPVVGMRAKLRTKHAGHFGSTSGEKGKFGLNAAQILSVVTKLKAIAMLDCLQLLHFHIGSQIPTTALLSDGVGEAAQIYCELARLGADMRVIDVGGGLGIDYDGTHSAQTDMSVAYSLEE

SEQ ID NO: 32412 - protein, 146 aa, Sorghum bicolor
  Clone ID: SORBI-28MAY03-C12903_1.pep
MAELQQLQQVASDDAAEWKQVAELRAVTQAQDPSCKEEDDYTLRRFLRARDHNIGKASAMLLKYLKWKPTAKPHGGEIPASEVAREVAQAKLCLQGFDREGRPLIYGFCARHHPVRRDMEEFKRYVVHVLDATVARLPPPGPGRQE

SEQ ID NO: 32413 - protein, 206 aa, Sorghum bicolor
  Clone ID: SORBI-28MAY03-C12908_1.pep
VFDPESMLVKYQNMLSNLRSGTGSVIVRLGQLKIGLARHRALLFKVLADDLDVPCRLLKGRQYTGSDDGALNIVKFKDGREFIVDLVADPGTLIPSDVTVLSTELDRNFVSDNHHFGQDDSTNLLGSSLSGITSSGYGCFELELRDRRSTSSNVGPSDTDGPTTNQTSNQQSVLSNSFEKLSVNTFTSENRPVSNESTNTDYIIVG

SEQ ID NO: 32414 - protein, 192 aa, Sorghum bicolor
  Clone ID: SORBI-28MAY03-C129107_1.pep
LLEWRRSDVPVVVHGAPPSTTAAAFAPAAATAFVGAGGGAAAAAAELDVVVGRGVDGAGLADGRRRHLHGLEALGEDADRLLLRLGAHHVQRRLPCELDLVEGQRLGLPLYGRHPPRRRLLHLPAARRRRRRYRQRRHGCRRSSLSSSSMSVVYIQIRKILQAFFLKKKIRRRRRPLLCRFSKFLLASSASC

SEQ ID NO: 32415 - protein, 248 aa, Sorghum bicolor
  Clone ID: SORBI-28MAY03-C12921_1.pep
VSSIRTVASFSAEEKVMDLYKKKCEGPLRAGIRTGITNGIGFGVSFFLLFGVYAASFYAGARLVENDKTTFPKVFRVFLALSMAAIGVSHTSTLTSDSSKAKSAVSSIFAIMDRKSRIDPSDDAGVTLEPLSGNIEFRHVRFRYPTRPDVQIFQDLCLTIQSGKTVALVGESGSGKSTAIALLQRFYDPNAGHILLDGVDIQKFQLRWLRQQMGLVSQEPSLFNDTIRANIAYGKDGQATELDIVAAA

SEQ ID NO: 32416 - protein, 87 aa, Sorghum bicolor
  Clone ID: SORBI-28MAY03-C129253_1.pep
APGSRHFSGPRLRRFPTAMAAAGEASSKLLRFMYFVGAGVICTKAINTYRDYEHKKEASAAVAAAESALAAAAAAEPAPATAAAAKP

SEQ ID NO: 32417 - protein, 251 aa, Sorghum bicolor
  Clone ID: SORBI-28MAY03-C129260_1.pep
RQESSELLEHAAGGHTQHKRNSAAPAPRRQTERRRKVPSHRLARAETEQLMAYAKKATAVLSVAVIASFLVAAAESESRHIARKDLGVGLGGGGGGSLGVGTGGGVGVGSGTGGGLGVGTGGGLGAGTGGGLGVGSGIIGVGGGGSGSGSESGSGAGSGSGSGSWSGSSSGSDARSGAAGSSAGSYAESGSGTNAGPGGAGSYAGSRAGSDAGGAGSYAGSDAGSYAGSGGGAGSGAGSHAGSYAGSGHGK

SEQ ID NO: 32418 - protein, 216 aa, Sorghum bicolor
  unsure (1)..(216): unsure at all Xaa locations
  Clone ID: SORBI-28MAY03-C129300_1.pep
GSRKVMIVKEGAGWVLPLLGVIRLLAALSGPTSSGRGEHARFVVVSASGSAAVRLALGATXSRVSAVMPAASPLGDSPREGSLVSDLERVFPPFCHGFVELAPPLALVHWAVRPSPCRFGKVLEGEIAMCRQVAQQTGILLDPMYTLAAWEQAVDLCCGDSAAKVLMIHTGGTLGLFEIGNKEYSTTVHHRRTIISRTKPNVDVQMLRFVGMECDF

SEQ ID NO: 32419 - protein, 97 aa, Sorghum bicolor
  Clone ID: SORBI-28MAY03-C127998_1.pep
LEESTLHKLSLTIDQGFHSRHTCPTNQTMKTAASVPSSQSIVLFTRTPIIHQLCMLGQPIVLYPCTRSDTTTRALLGPVLVTIIIVVVIIICAIILR

SEQ ID NO: 32420 - protein, 94 aa, Sorghum bicolor
  Clone ID: SORBI-28MAY03-C129314_1.pep
HEEQMLRTVVLSLGGFRRLHEMYIRPVQQRAAGAPPPGQQQRRQLPVRMGRDQVQVSLSLLSTSFFLNMPNAPPPPPPKDKDKDRDKNGGGQCG

SEQ ID NO: 32421 - protein, 189 aa, Sorghum bicolor
  Clone ID: SORBI-28MAY03-C1294_1.pep
SFIGDSRTVMISCISPSSGSCEHTLNTLRYADRVKSLSKGSNAKKDVSLAVPMRESSPSPLTSVVPSFSASSVMNDITERSNFGWPKQQYVKEQPAPTFAERMPKVKDSVEFTSSYGAYSKQQRSKGFVAPNMAEVPDIMYQQGRQPTRKARDTTFGKDMRNSVTYPTRRVEPDEDEHLNNLLQVVLSL

SEQ ID NO: 32422 - protein, 156 aa, Sorghum bicolor
  Clone ID: SORBI-28MAY03-C12941_1.pep
INDIFKKLWVEHGDELSLEYAGSYALKGDLVRYGRQTLPGLIKDGMSALSRYYLNNFHGGVRQDALDLISGYYTVSQGSSSPFHNGGFESSSYLPVARASIVGGITATTFTLSQVGRNAQHLISSIICAGLTVGVVALVKANGKQFCSRPRLCGLI

SEQ ID NO: 32423 - protein, 118 aa, Sorghum bicolor
  unsure (1)..(118): unsure at all Xaa locations
  Clone ID: SORBI-28MAY03-C129423_1.pep
IPKHGNQIMKLYRXQTQVVVLDLREVPQNRSAKAPTHRHPPRHHQNPIGANILHLNNPTHIFPETAPRPARLYSSKQPRDLLDLGRDYDRRIRPPTDQSRDGGAHHQVLQILSSETRN

SEQ ID NO: 32424 - protein, 66 aa, Sorghum bicolor
  Clone ID: SORBI-28MAY03-C129434_1.pep
FFFFFLTGNKDTAALPSMIHGRELLLIIRHKTVITSTLHTALNMHKCHRNPHPSIIYRGCCSNSAS

SEQ ID NO: 32425 - protein, 162 aa, Sorghum bicolor
  Clone ID: SORBI-28MAY03-C12944_1.pep
LDLLGAKEIAVRAWDQSLNTQPEKLIWNLMGMMNNCWFKVKVNVCRPHRGEIGLVFEHPTQPGNQSGGWMARQKHLETAEAAAPGLKRSTSTPFMSTISDGKQFTMSEVRRHASQESAWIVVHGHVYDCTKFLKDHPGGADSILINAGTDCTEEFDAIHSDK

SEQ ID NO: 32426 - protein, 75 aa, Sorghum bicolor
  Clone ID: SORBI-28MAY03-C129559_1.pep
NSLSFGFGLCSLSLVSYTIFFTFSYGNRSRCQYHHARQHLEERDQGAPFLLRQSQRHANIQLLLSFMSLLFLPCT

SEQ ID NO: 32427 - protein, 170 aa, Sorghum bicolor
  Clone ID: SORBI-28MAY03-C12971_1.pep
IPCSISEAIDGIPSSSRKAAWIPFTLEGLAVLDKTTALSTTGIPSVPRNSGEAKFETIDNKPATDELDSLIRLKQAEAYMYQERANDARNEVDNLRHIVVVKNARIEEDYATQIVDLDINELQERRKQKIEELQVIERPPHEFRSMKTRMVASIGELLSKMEALKQNQST

SEQ ID NO: 32428 - protein, 194 aa, Sorghum bicolor
  Clone ID: SORBI-28MAY03-C129972_1.pep
VHESARTANKHGSARNPHLKHSTPIIHSNPTFQKRTIKINGQNNRQAVEIAHKVQTFVAPGATNRSQDDEGTHKSADSCTSSAAWKNPSFCHCSSPPEAAMSAAAAAAGNCRSHQGPDTRPTPRHEHQLRWLRAPGAPPQCRAARPRPASGDPAGGAADQELRTPRKEGSGCLRASAAQRGRKRKRGDEGDVAR

SEQ ID NO: 32429 - protein, 68 aa, Sorghum bicolor
  Clone ID: SORBI-28MAY03-C129992_1.pep
TRVLLSWFPNIPWDRQPFSALRDLCDPFLALCREVMPPVFGRKLDLSPLVAFMAIDIIIMILRPQPRM

SEQ ID NO: 32430 - protein, 88 aa, Sorghum bicolor
  Clone ID: SORBI-28MAY03-C130008_1.pep
ARRHEQDMHGDTMKQIGTRTSTKAPPPFYIKIKQRPLQPASAKGCMWWLPSMSSGWAAAAGKLAYGSAQRGRRRVDDDLTRPELGGAR

SEQ ID NO: 32431 - protein, 213 aa, Sorghum bicolor
  Clone ID: SORBI-28MAY03-C130029_1.pep
MAGSDTAAASAQADSAAAICAQIASVFSAPSSPHPPARSVLVSELEAASSRGGRVFVHGVGREGLMMRALCMRLAHLGLPAHCVGDVTAPPAGAGDLLVASAGPGAFSTVDAICGVARGAGARVLLLTARPDGDFPRRQADVVAHLPAQTMADDEVGPGETETERSPPARAKLPMGSLYEGAMFVLFEMVVLELARVLGQSSAQMRARHTNLE

SEQ ID NO: 32432 - protein, 198 aa, Sorghum bicolor
  Clone ID: SORBI-28MAY03-C130033_1.pep
YYGPTNSSNFNQPSKSNNSYSYSKHHKNTTQRNTRVKGEEQLLPIRSDPLPFWLRPFLFQSQITVVYIRATRQSSPVGPMIRSVRRRRGGVCRRRDHAAVGVGVGRGGPVVHGRVRHLLRQQAAAEGRRAPLVVVPQRTQHLHLPRFHQPLRKGEREEGRDQEESEKKPPLGHCGWGQERRGGGKAKNRGRRRGVGLV

SEQ ID NO: 32433 - protein, 126 aa, Sorghum bicolor
  Clone ID: SORBI-28MAY03-C130051_1.pep
MEGGGLPGPSQSIQVSGDAYCNSSAAPLDAAGSSSSPAVAKLRKLLFRRMLIGVNDGRYFHGLFHCIDKQGNIILQDAVEYRSAARHCSPPTEQRCLGLILIPAACRSSCQVDCSVEEKMSLLGLE

SEQ ID NO: 32434 - protein, 104 aa, Sorghum bicolor
  Clone ID: SORBI-28MAY03-C130053_1.pep
TRIQSAGRLTGGHRGPRLLRCPLPPAGDRSVCSNAHGRGIKTDTRITEHEQHLDRFSDPQVAREHQQFVQFLDRMLDAIRNPQSLAQMQRRRLASGLKALDDDI

SEQ ID NO: 32435 - protein, 185 aa, Sorghum bicolor
  Clone ID: SORBI-28MAY03-C130082_1.pep
MQADKAEPAAAAAAPAAAAAGGKSPSICDRLQRAFQTRPPAFRPLRRLTVRHQDGGGGGADKPAGAGDGATSAAPGGPAPKAKHSGPPLPAAPRPLTPSPAPVGVGGATSAPAIAPQAEQQRPVPVRLPAVTSKVAAGSALTGPPVPVPPPDVMAGMATPADAKAGDIGQQTKGKSRVRQLLSSK

SEQ ID NO: 32436 - protein, 123 aa, Sorghum bicolor
  Clone ID: SORBI-28MAY03-C130122_1.pep
LSQSLLSIHTAGWLARLYSEWKLIHARRATKTPEKYSSRITAGSSHQEATHSRSAGNDGDVDGVGRRRRREGEAPEDEEADPARQDAPRRRGREQALHGARHRRRVGLQQLRHDRHEYHVFSG

SEQ ID NO: 32437 - protein, 175 aa, Sorghum bicolor
  Clone ID: SORBI-28MAY03-C13027_1.pep
MAAAGAEVGEDKYRSFIHGESERNTVWRYGGPPNYDTVNKLFEEERTHVWAEGSLEEKVQRLLKSWEMELVHKARPEDQKTVSSERYTTSTNGMSALTRAEVMAIGGYNNFLRTKLPPEHRIYDPDSESPESAMDTFKTAFPRGFAIEVLDVYSGPPKIAFKFRHWGYMEGPFKG

SEQ ID NO: 32438 - protein, 135 aa, Sorghum bicolor
  Clone ID: SORBI-28MAY03-C130287_1.pep
MEGKDGKHDVPATTAAPPPAGAPQPAAPAPPAESARWGTRQMGPPAAPGAHPENQEAARWTAARGDQELPPYVVMGEPVAVQRGKGDSPMEHILDFFNTWSRKAEELASNIWFNLKTAPSMSDAAMGKLSLGAKA

SEQ ID NO: 32439 - protein, 160 aa, Sorghum bicolor
  Clone ID: SORBI-28MAY03-C130348_1.pep
VRASETHKLPAGFAEAEDDGAACGRQRGLVVSWCPQLEVLAHRAVGCFLTHCGWNSTAEALVTGVPMVAVPQWTDQPMNAEYVEAVWRVGVRARAAAPDGLVRRGEVARGIEEVMDGDRSAEYRSNADVWMEKARAASREGGSSDRNIAEFVAKYASDAM

SEQ ID NO: 32440 - protein, 81 aa, Sorghum bicolor
  Clone ID: SORBI-28MAY03-C130473_1.pep
PPRSTRATSPAPLAARSSSPPIVRPAASSKSSGPPPCPGPGPCPRPRPPPCSRGAPHARAARSTRRRRRRAAPRPPWSRPT

SEQ ID NO: 32441 - protein, 114 aa, Sorghum bicolor
  Clone ID: SORBI-28MAY03-C130531_1.pep
ARGSLSLPSARAAPPAASRPPSSARAPAPAPAPSPRPALLHRTSTLNKLIEERNAGREHLELNFRWTRRSLAVVGFFGLAVPILVYKGIVREFEYPSAIVGSGGGCMGGMHRSC

SEQ ID NO: 32442 - protein, 155 aa, Sorghum bicolor
  Clone ID: SORBI-28MAY03-C1306_1.pep
MREPSVLVREAAAEHLEERQADWAYSRPVVALDLLWNLAFITVAAVVLVLSRDEDSPMPLRTWVAGYALQCVVHMVCVAIEYRMRHGQGGGAGAAPTDEERGSDGSSSSSDDDDREFDRHGRRTDYASIAKHLESANTMFSFIWWIIGFYWISAG

SEQ ID NO: 32443 - protein, 108 aa, Sorghum bicolor
  unsure (1)..(108): unsure at all Xaa locations
  Clone ID: SORBI-28MAY03-C13071_1.pep
RPGSALSISDIPXAGHREAGGFSGPGQPSMMPNLTAEVLVPRLIIPALCSEDGGCLDRIREFSEAKITVAEPIADAMDIPVLISGTPDQMHAARSLVQAFVMSESFAP

SEQ ID NO: 32444 - protein, 166 aa, Sorghum bicolor
  Clone ID: SORBI-28MAY03-C130904_1.pep
MPSSAPEPHVVEDCRGVLQLMSDGTVRRSAVPALPVDVPDDEDCGVEWKDVTWDRQHDLNARLYRPGHLGAANDARIPVVAYFHGGGFCIGSGRWPNYHAWCLRLCSELPAVVLSFDYRLAPEHRLPAAQEDGARAMAWLTRSAATDPWLADAADFARAFVAGDSA

SEQ ID NO: 32445 - protein, 200 aa, Sorghum bicolor
  unsure (1)..(200): unsure at all Xaa locations
  Clone ID: SORBI-28MAY03-C1310_1.pep
GRSTRRPVAGYENGCARDAPPPRPPXPTPTAAASPVRSPPPPPRTPPAAPTPAPRRSRTPSGNSAASAIRTAWSPSSTPSTRRPSPLPPPGTRSPWRRAAFPSPAASLKRRPSSPPISPRQTPRPTSPPSCAATPPPTSPRRPSTPFAPLRRPSRPPSPRSPSTPSSPPLSVAAATAASLSSSLSSPRSSRSPQTPHPMP

SEQ ID NO: 32446 - protein, 90 aa, Sorghum bicolor
  Clone ID: SORBI-28MAY03-C131108_1.pep
VVGCVCGCWVSWTCVPVFYLNEMTRSSPALFEKKKPAKFGIQPNLPNCLLFHISLWVLQHYVTKLWASTNLKSLPSLLFISLSGCINNTF

SEQ ID NO: 32447 - protein, 207 aa, Sorghum bicolor
  Clone ID: SORBI-28MAY03-C131133_1.pep
ARGFGREELIHLWIGLGLLGPDDQNKRLEDIGLDYLSDLVNHGFFHEAKKEDGSTYYVIHDLLHDLARNVSAHECISIQGSNVWSIQIPASIHHMSIIINNSDVQDKATFENCKKGLDILGKRLKARNLRTLMLFGDHHGSFCKIFSGMFRDAKTLRVIFLSGASYDVEVLLHSFSQLVHLRYLRIKGYVLNLRSLFGSISRFYNLL

SEQ ID NO: 32448 - protein, 184 aa, Sorghum bicolor
  Clone ID: SORBI-28MAY03-C131217_1.pep
HEATARPPRPTALLPALHHAHRAMDGGGRPSARWPSTATPGTATLARTDPGAATPAWWRFGSCGTAAQTSEADGTVGRWVRLRRASWGGWRGCVEATGCVDRHGYEEAAWRRDCWVREPADEEVLHCISTISTSTVPPINHHHLPSHKLLSLHLICRYISFPVASLNFRDTSYGFSYRLNPQII

SEQ ID NO: 32449 - protein, 215 aa, Sorghum bicolor
  unsure (1)..(215): unsure at all Xaa locations
  Clone ID: SORBI-28MAY03-C131389_1.pep
TRRQGLASRGHDESQSSLNKGNFLELIDMLAENFEEVAKVVLKNAPKNCQLTAPQIQKEIANCCAKETTKLLMEDLGSDFFXILADESSDVYQNEPRALCLRYVDKKGSIVERFLGVVHVENTTSLTLKTAIEKLLMEHSLILSMVRGQGYDGASNMNGHANGLKKLIMDDCSSAYYVNCFAHQLQLTLVEVARENPDCVWFFDQVRFLLNLIXN

SEQ ID NO: 32450 - protein, 218 aa, Sorghum bicolor
  Clone ID: SORBI-28MAY03-C13126_1.pep
MVSRGGGARGLLGAYELGRTLGEGNFGKVKQARHRGSGAQFAVKILDRARVVSQRVDDQIRREIATLKLLAHPNVVRLHEIAASKTKIYMVLELVNGGELFDRIASKGKLPEQEARRLFQQLIDGVSYCHEKGVYHRDLKPENILVDRKGNIKISDFGLSALPEHLGNDGLLHTTCGSPNYIRPSVRPSPPALPPTPLPAPILSSSIRSGFLLPSLDA

SEQ ID NO: 32451 - protein, 121 aa, Sorghum bicolor
  Clone ID: SORBI-28MAY03-C131419_1.pep
MSARLRVEELRAALLSRGLDVSGTKNALVRRLDAAICKDEKIAVAAAATEVADGYGVAVDGVLVDGKGNGRNNKRKRSGDGDEEGNGDTSIDLAKLEGMSYRELQGLAKARGLAANGGKKD

SEQ ID NO: 32452 - protein, 125 aa, Sorghum bicolor
  Clone ID: SORBI-28MAY03-C131458_1.pep
SGDAKSVHSCELFFSKDVTTAVPWPGVHQDGHTKPSCLTEKPSSAPILRHHEECQSPGPWSFMDCSKGTATWPEENLPSTAKSESSPKVGDCLSLVSAAWSTVIVTASRDGVIRSFPNYGLPVRL

SEQ ID NO: 32453 - protein, 109 aa, Sorghum bicolor
  Clone ID: SORBI-28MAY03-C131489_1.pep
HEAPLHIALVLLALSSPLHVSSTEPGHGILFQLYFLHNVLSLLLKLFYLAIGRRMLQGMKVTSTSYATTQAIHVDEAEFMHAGSMGFVLNDYPASGANNRHSPYPGGTR

SEQ ID NO: 32454 - protein, 95 aa, Sorghum bicolor
  Clone ID: SORBI-28MAY03-C1315_1.pep
GISARRHQRRSSVPEEMARGPNVAGLIEDDAVSVITEGLVVCEICGSGSAPHLIANCARCSAREHWYCMQVLTFLIPRIWFCNSCQRKANRAPRS

SEQ ID NO: 32455 - protein, 61 aa, Sorghum bicolor
  Clone ID: SORBI-28MAY03-C13149_1.pep
MFLSFLIFWFGLLFLTMKRQIVHMIKYKYVPFSFGKQKYGGRRMSRAPVPQKTDSEPTYPQ

SEQ ID NO: 32456 - protein, 162 aa, Sorghum bicolor
  Clone ID: SORBI-28MAY03-C131551_1.pep
PSTTLGHSGSNGSVTVAGPGAFVSPRLPHWGLPAPWARAQSFGLVLLALQMLIGKRPTDSMFEGEMNIVSFVEKNFPNQMSHIIDAHLQEECMSKRFLLARVERGNEVHQCLMSLVGIALSCTRLLPSQRMNMRQVAANLNTASYAIQQLPSATVQGQIILR

SEQ ID NO: 32457 - protein, 121 aa, Sorghum bicolor
  Clone ID: SORBI-28MAY03-C131575_1.pep
QLLAIWGNLIALYVLNFFISSIPTSGMYTVMFRLCRQPSYWITLVLISGVGMGPVLALKYFRYTYRPSAINILQKAERSRGPMYTLMNLESQLRPDKDNMMIASSTAPAKNKSSVYEPLLS

SEQ ID NO: 32458 - protein, 311 aa, Sorghum bicolor
  Clone ID: SORBI-28MAY03-C13167_1.pep
PRVRAGGGEAGGADVALQRQLQQLFHLHDSGLDQAFIDALPVFAYREIVVGGGGDGDKEPFDCAVCLCEFDAEDRLRLLPLCGHAFHLNCIDTWLLSNSTCPLCRGVLFVPGLMGEDTPMFDFEERLEEGRLSEDCDDGFGLPGLKASGLAQTPVAEKKVFPVRLGKFKNVGTQGAVEGGNANADANARVLSRDQGESSSSSSDGRRCFSMGTYQYVLGASELRVALQPGRIRNGAGGAMRGRPPGLSSINADIMEGKKICARNKGESFSVSKIWQWSNLKGKLPAGSDECSDAGSLPWMKRGGAADTSNL

SEQ ID NO: 32459 - protein, 107 aa, Sorghum bicolor
  Clone ID: SORBI-28MAY03-C13183_1.pep
LKLEKADVYRLPYLSSGAPGFALLETARKIDFQDVQSRISAGFSSNGWEKPILLAWGISDKYLPLSIAEEFKKANPSVVKLEAIEGAGHMPQEDWPEKVVKALIYFL

SEQ ID NO: 32460 - protein, 316 aa, Sorghum bicolor
  unsure (1)..(316): unsure at all Xaa locations
  Clone ID: SORBI-28MAY03-C131842_1.pep
TRLPSNMGDRFSNLQKLLLGENWLKGRIPDSLGNATTLKQLVLQTNNFTGQIPSSFGKLSSLSELDLGSNMLEAKDSESWEFLHALENCSALRVLALSNNQLQGVIPNSVGNLTANLQYLFLGGNKLSGTVPSSIGKLAGLIYLPVDGNSLIGSIDGWIRNLKNLQYLYLSENNLSGPIPPIIGNLTQLARLLLDNNGFEGPIPSSFGXPSNAFKLNLNHNNXIEGSIPLEISNLKQLINLELASNKLITGEIPDDLTLCQYLVTIDMEHNFIVGNIPKSVGSLESLNKLSLAHNNLSGTIPAALGSLKLLNMLDL

SEQ ID NO: 32461 - protein, 171 aa, Sorghum bicolor
  unsure (1)..(171): unsure at all Xaa locations
  Clone ID: SORBI-28MAY03-C131872_1.pep
TRLIPWFIVISIKVSLDFVKSLYAKFIDWDEDMYEPAKTXIPAHAANTAISEDLGQVEYILTDKTGTLTENKMIFRRCCIGGTFYGNESGDALRDIELLNAVANNSPHVIKFLKVMTLCNTVIPIKSPSGSILYKAQSQDEDALVNAAANLHMVLVSKNGNNAEIHFNRRV

SEQ ID NO: 32462 - protein, 171 aa, Sorghum bicolor
  Clone ID: SORBI-28MAY03-C131876_1.pep
ARGSCKKHDLEDNNTADVSTNSNDEELNPKQLPCHEVAQDCQDVGGVICDSNENQDRLLTGEATHQVSSNDCYETGIGIASETSNIIHNDLPVESTAADFSEVIPEEVAVSAGLDMEGSNQVNHYNPFIAYGSLDGTWESNYSLPTIVDAASIAPICPVEKTDSCSDLVNR

SEQ ID NO: 32463 - protein, 112 aa, Sorghum bicolor
  Clone ID: SORBI-28MAY03-C131883_1.pep
SLLFFFWTSVVSLGQKDVLGQQEDAMRRDVQVWTPFRLLKLNLLVCYRIPWTGAAVSWLSCARRLWGFRGVARAESGEGVEHRWRTLGLGIGERRPAAGPCIAWPAQQLQQR

SEQ ID NO: 32464 - protein, 181 aa, Sorghum bicolor
  Clone ID: SORBI-28MAY03-C131893_1.pep
HEGLTEDIAGKAPARRKNGNLEGVVANGVQNGVKDMVTPIIRTSLEKQGYKIIGSHSGVKICRWTKSQLRGRGGCYKHSFYGIESHRCMEATPSLACANKCVFCWRHHTNPVGKSWKWKMDDPLDIVNAAIDQHTKMVKQMKGVPGVKPEKLEEGLSPRHCALSLVGEPIMYPEINALVDE

SEQ ID NO: 32465 - protein, 243 aa, Sorghum bicolor
  unsure (1)..(243): unsure at all Xaa locations
  Clone ID: SORBI-28MAY03-C131938_1.pep
HEGKILYSLRRFYHVETLFNGTFVLAGRDQETTGFAWWAGNARLINLSGKLLGAHVAHAGLIVFWAGAMNLFEVAHFVPEKPMYEQGLILLPHLATLGWGVGPGGEVLEPVPYFVSGVLHLISSAVLGFGGIYHALLGPETLEESFPFFGYVWKDRNKMTTILGIHLILLGLGAFLLVLKALYFGGVYDTWAXPGGGDVRKITNLTLSPGVIFGYLLKSPFGGEGWIVSVDDLXDIIGGHVWL

SEQ ID NO: 32466 - protein, 56 aa, Sorghum bicolor
  Clone ID: SORBI-28MAY03-C132144_1.pep
SGAPASHPPALGETLLPRSCLWWRSMAAANWTRPARQCAGIIRLCQPRPGDGGASC

SEQ ID NO: 32467 - protein, 155 aa, Sorghum bicolor
  Clone ID: SORBI-28MAY03-C131342_1.pep
ARGLGSGEELMELVGAHKESLTALDVIDGMNEDNASSSSPTGREKQNLSTSLSLADKKHEANDDEGNDAHSGQLVQEEEREKGMVGFWVYWKYLTLAYKGALVPLVLLAQMLFQVIHIASNYWMAWAAPVSKDVEPPVSMPTLLSVYVMLALGSS

SEQ ID NO: 32468 - protein, 93 aa, Sorghum bicolor
  Clone ID: SORBI-28MAY03-C132158_1.pep
MQGGGGGGDQAGGSLGMDMGVGYAAGSGGAECSSSTSAAAAAAAAAAAAAAAAAAEAEERQLLKGEIAVHPLCEQLVAAHVGCLRVATPIDHL

SEQ ID NO: 32469 - protein, 182 aa, Sorghum bicolor
  Clone ID: SORBI-28MAY03-C132178_1.pep
ARGKGELILVYDYMANGSLDKYLYDQQVPVLSWHERYRIVKGVAASLLYLHEDWEQVVIHRDVKASNVLLDHEMNGRLGDFGLARLYDHGTDPQTTRVVGTMGYLAPELVRTGKATPSTDVFSFGVFLLEVACGRRPIDRDVDRDGRVVLVDWVIEHHRNGSVLDVVDPRLVGKYEAEEATL

SEQ ID NO: 32470 - protein, 166 aa, Sorghum bicolor
  Clone ID: SORBI-28MAY03-C13222_1.pep
TINHCVVRRRPRFQVQQPCSRRGESSHVWRRSRFRSLRSLCLFILRLRFFFTLSAHTSAAPPPTSSHAGALPAGSRHGCIWRPGWNEKRASRRVPGGVWAGVEAGSGGAGAGVGPCCRCGVMLERSVLKGSGGGSRTRRSSRRSGAAAAAMGDVRRARSGGFPWEW

SEQ ID NO: 32471 - protein, 258 aa, Sorghum bicolor
  unsure (1)..(258): unsure at all Xaa locations
  Clone ID: SORBI-28MAY03-C13223_1.pep
IDSDYSAKDSCYLNNWLQTAVTPGIEELTLILIPHGPKYTFPCSILSNGSGDTIQHLHLGNCSFRPTVTFGGLRSLTRLHLCHVCITGDELGFLPSHSPALERLELKCCNKIVRLKVPHLLQRLSYLEVTGCTKLKFIDNEAPNVSSFAFGGENTVHLSLGETSQIKSLSMNRPGSVFYARAELPSSMPNLEALTIYSQEEMAHAPMLRSKFIHLRHLSMVLTGALLYPIYDYLSLASFLXAAPSLETFDLDLWQRDM

SEQ ID NO: 32472 - protein, 131 aa, Sorghum bicolor
  Clone ID: SORBI-28MAY03-C1323_1.pep
DAWENYDDLCECHGLQITELKLLVDSLEKERDFYFTKLRDIEMLSQNPEVEHVSVQTIQNILYASEEDAQQLPPALSPIMEASEERPKQEMANKRKSISDLDEFGMSSSSRQRLSDISDVQLCGSPLTSFS

SEQ ID NO: 32473 - protein, 223 aa, Sorghum bicolor
  unsure (1)..(223): unsure at all Xaa locations
  Clone ID: SORBI-28MAY03-C13241_1.pep
TRMIIQDKYRQKRHFSKCGIPLPDFMEVDTLHSIEEAGEKFGYPLMVKSKRLAYDGRGNAVAKTKEELSSVVASLGGFEHGLYVERWTPFVKELSVIVARSRDSSTVCYPVVETIHKENICHVVEAPAEVSDKIKKLATSVAEKAIKSLEGAGVFAVELFLTEEDQILVNEVAPRPHNSGHHTIESCYTSQYEQHLRAILGLPLGDPSMKAPAAIMYNILXED

SEQ ID NO: 32474 - protein, 188 aa, Sorghum bicolor
  Clone ID: SORBI-28MAY03-C13231_1.pep
HEALLLPARTGGQGGARIPTRPLQALNGRLLRSSFSTLSCSCSPSPSPGDGGEDSARSLFDELSVLSPVVPWEVDDIWRIYAGYFFILHIPLSFGGLGVVAKVLQCSSLDSMTTVISTVILQLAELVLTLVLLQYTAKPGQTIQPFFSGKIFTERNWVKETVLGFVVLMALVLTTSILADKLVGSEDA

SEQ ID NO: 32475 - protein, 59 aa, Sorghum bicolor
  Clone ID: SORBI-28MAY03-C132414_1.pep
WFTRTANVEPLVKTHLYERGSYLCFDPEIWDSVRKDNFVLHYELVEKRPALPSIAQNVR

SEQ ID NO: 32476 - protein, 129 aa, Sorghum bicolor
  Clone ID: SORBI-28MAY03-C132446_1.pep
TTAPRAIARTALASCAPGAAAVAPRAATSPASAAASPSALSSTTRAVVRRLGRRLIRPCRTSDSTPPHIAARAHENYCPRREAKTSLLGAAKLAQFSATRPIGSSSSSSTDNCSNGRNNYVLFSCHLVM

SEQ ID NO: 32477 - protein, 201 aa, Sorghum bicolor
  Clone ID: SORBI-28MAY03-C133344_1.pep
TRLMIAPVYTAEVAPTSARGLLTSFPEVFLDAGVLLGYVSNYAFHGLPVHLSWRVMFLVGAVPPLFLALGVLAMPESPRWLVMQGRIGDARRVLAKTSDSPAEAEERLADIKKAIGIPDGVGDSDDDDEVVVVDRRNKKGSHGEGVWRDLLIRPTPPVRRILIACLGLQFFQQASGIDSVVLYKPRVFEKAGLTSNSNSLG

SEQ ID NO: 32478 - protein, 266 aa, Sorghum bicolor
  unsure (1)..(266): unsure at all Xaa locations
  Clone ID: SORBI-28MAY03-C131619_1.pep
ARGEEEAARLRFACEDWGFFQLVNHGIADEIITNIRSDIQSFFQLPLEVKCAYAQVPGSLQGYGQSFVVSEGQKLDWCDRFSIIAQPPQARDMKYWPTQPRTFSXNIDLKLMDDKYVSQVLRMNYYPPCMTMAEKVLGLSPHSDASFLTILLEINSVEGLQIKRHNAWITVKPNPKALLVNVGDFLEIMSNGKYKSVEHRVTINANQERLTISAFHFPSLDGVVAPMTTITEERILYKTMGVEEYLKIFMSNKLEGKSALDHAKLS

SEQ ID NO: 32479 - protein, 148 aa, Sorghum bicolor
  Clone ID: SORBI-28MAY03-C13254_1.pep
MAPPLLSPPVLADALATPPRSFPCSLPTRRLPTVGFAGAVRSDLQQSWSARRRDLRVCATATEADHEREEDVADDYYSVLGVMPDATPEEIKKAYYGCMKECHPDLSGNDPDVTNFCMFINEVYSVLSDPAQRAVYDEIHGYTATAIN

SEQ ID NO: 32480 - protein, 72 aa, Sorghum bicolor
  Clone ID: SORBI-28MAY03-C132526_1.pep
NGFHTYIHQSSPLRLIIMYPGQPTKNSYLGHVSASHDSHHEKAKQHIACQNLDRARLYILGLLIIAIVCYIS

SEQ ID NO: 32481 - protein, 126 aa, Sorghum bicolor
  Clone ID: LIB3478-055-Q6-K1-F4.pep
VLLVRVDEEPDGCCIRLLSCKLEGSPLVEAQNDKFSASMANRVFCSSRSQDSTIQQLTSDTTIEVAIDIPFPFRAIPVEAIESSGRQVLEQLLRVMLPRFLKQLVKDYQAWASGDASRKPLGTGEI

SEQ ID NO: 32482 - protein, 106 aa, Sorghum bicolor
  Clone ID: LIB3480-025-P1-K1-C9.pep
MCPARRTEELLRALRRTTEALQASMANRVFCSSRSQDSTIQQLTSDTTIEVAIDIPFPFRAIPVEAIESSGRQVLEQLLRVMLPRFLKQLVKDYQAWASGDASRKP

SEQ ID NO: 32483 - protein, 77 aa, Sorghum bicolor
  Clone ID: SORBI-28MAY03-C132580_1.pep
GSARLRATSSRGSWNAALFGSCRHSSSDIGPSRDDNILKRSETIKSSGGSNGDHSSSRRRQSKEIFPEPSGSRDTED

SEQ ID NO: 32484 - protein, 148 aa, Sorghum bicolor
  Clone ID: SORBI-28MAY03-C1326_1.pep
IEMLQQCSHPNVVRYFGSYQGEDYLWIVMEYCGGGSVADLIGITEEPLDESQIAYICREALKGLAYLHSIFKVHRDIKGGNILLTEQGEVKLGDFGVAAQLTRTMSKRNTFIGTPHWMAPEVIQESRYDGKVDVWALRVSAIEMAEGM

SEQ ID NO: 32485 - protein, 163 aa, Sorghum bicolor
  Clone ID: SORBI-28MAY03-C132608_1.pep
MGLLSIIRKIKRKEKEMRILMVGLDNSGKTTIVLKINGEDTSVISPTLGFNIKTIKYHKYSLNIWDVGGQKTIRSYWRNYFEQTDGLVWVVDSSDIRRLDDCRAELHNLLKEERLAGASLLVFANKQDIQGALKPAEIAKVSKFQSFICIRDMFPIFLWLFTV

SEQ ID NO: 32486 - protein, 105 aa, Sorghum bicolor
  Clone ID: SORBI-28MAY03-C132724_1.pep
MADENQAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPN

SEQ ID NO: 32487 - protein, 135 aa, Sorghum bicolor
  Clone ID: SORBI-28MAY03-C132748_1.pep
HEAKTRTCVVNSRVRRSSSHRSVDGKNGGHRAQHHQVASAGRRPRRPAPRDVPVALARGDGRECQQAVEGVVRRRCAAYGGVAAGGGLHPDGGGRDHRGGGARRRCCSRPQVDERRHARRDQGLRPEPRRRPLAS

SEQ ID NO: 32488 - protein, 145 aa, Sorghum bicolor
  Clone ID: SORBI-28MAY03-C132794_1.pep
ARGREREAEGAGEGQAKIMIPSMRGMRMAGAERVSRRRVGQKKRPTHIGEILMPMAEISAKEKYNNPDMQADKHSRRKDDSEDTDKWPADNRHSDDTKTLSRYEHGKSRSSKEQRFDDDKYKEKYKDDYVRDKRQHDDKFSDERV

SEQ ID NO: 32489 - protein, 116 aa, Sorghum bicolor
  Clone ID: SORBI-28MAY03-C132205_1.pep
FAANAARAPLTVASPMLGLVGGESVERYCRLASCDRSSPTPAVPSRTTGERSGDSAGDAFAVVIPLQLYLHGGQGSTSQSPRTRSGYKMSIGETDSLLPLNPPLDSYAQEPHGAVP

SEQ ID NO: 32490 - protein, 198 aa, Sorghum bicolor
  Clone ID: SORBI-28MAY03-C13297_1.pep
LRRAAASGSPLDLQDALERFAFDNICRVAFDHDPCQLPDDGDAGADSSFADAFRDAENLSAGRFRYALPGFWKIKKALNVGSEKRLRESIAMVHDFADRIIQSRREEMLTAGFDKHDLLSRFMASQDETYSESEVPLRDVVISFLLAGRETTSSALTWFFWLLSSRPDLQRRIRDEVAAVRARRRAQGDVDSIVGFDL

SEQ ID NO: 32491 - protein, 176 aa, Sorghum bicolor
  Clone ID: SORBI-28MAY03-C132972_1.pep
MYVTRPLSRYLSDPKAMAEPPPEAPGSGFLVVLDEATEQESTLCCGLCKDPRVRSLPFPQNRQLSVEKGNASDPLEGIGKCVEVVSELLSMASGQDSGGGAPGSGRYVAPNSYAMFVPVIGQPLSSGRYYVVKVDGKHTGKVSACSKEEDRTECCFCSFPADVKPRPFDRSDVYQQ

SEQ ID NO: 32492 - protein, 157 aa, Sorghum bicolor
  unsure (1)..(157): unsure at all Xaa locations
  Clone ID: SORBI-28MAY03-C132994_1.pep
NSIGTHCDDDEEEEGADNAEGNNKLENPKEADTSVESREANGKSEDLKDVTDNLDEVKEETTSSSTEAIKALEGLMEANGDVEELKDFNESSXELEEENNENLDKLVELFLDKGLLDELKPIKVESRRRVRAALSIIDKMMSSRVVKGGNGANDTHG

SEQ ID NO: 32493 - protein, 200 aa, Sorghum bicolor
  Clone ID: SORBI-28MAY03-C13309_1.pep
RANLSMDALVYNEMMTLYISVGELDKVEIIAEELKRQNVSPDLFTYNLRVSAAAASMDLEGFKGILDEMSKDPNSKEGWTLYRNLASVYVDASQLVGSGNSLVEAEAKISQREWITYDFLVILHAGLGNQERIKDIWKSMVMTSQRMTSRNYICVISSYLMCGQLKDAGEIVDQWQRSKAPEFDISACNRLLDALMSAGL

SEQ ID NO: 32494 - protein, 87 aa, Sorghum bicolor
  Clone ID: SORBI-28MAY03-C133113_1.pep
LRYRPLSRVYQHHPLCCRPWLPTCKKQKRGGMAISHRRGLHLAPPILRLRLLSRRPTRPPPAAVLYRPLTSLSDKSRAARPWPLPLL

SEQ ID NO: 32495 - protein, 94 aa, Sorghum bicolor
  Clone ID: SORBI-28MAY03-C133219_1.pep
NTNATALQANKHENNLFDLVKTVICPVPSIIMLEFMRYMPLCTSTLSESEFSNQALTFDQFLLGSHIKTCCNLLCAKPQQLLHTWFAKHKLNQS

SEQ ID NO: 32496 - protein, 86 aa, Sorghum bicolor
  Clone ID: SORBI-28MAY03-C133231_1.pep
SKRATGLHTRGRGLHGGRRLVSRPVHSSLVFVIQRRVTLLSPSIHLPTYQQVTTDRCLLAKKDQCSYAMLTDRLPKKLTDRVLVAS

SEQ ID NO: 32497 - protein, 221 aa, Sorghum bicolor
  Clone ID: SORBI-28MAY03-C133268_1.pep
LNSTAVDRQSISPCTPGSLMCPKLTATVTWQIGNGKLQLQASALVSCDSFSKQTCIKANATHTPHSVVSVREGAAADVAARARGGGGVEQVCEVAELVHVLQPRRRRERLLLRRRHHRQVAGSSLLIHRPPGSLLLLLPGANEGRPARARPLRVRCRRRLMSRRLRRGGGGGLAGEALHDGLEAGGVGADELRLDELDLHAGVLRRPPGALDLHGHEAKLG

SEQ ID NO: 32498 - protein, 56 aa, Sorghum bicolor
  Clone ID: SORBI-28MAY03-C133291_1.pep
AFVVWHVNWLQKSLIHCPATIFYKLQDLILLRTVVNFYDRRGLGTEGLNLQHSFDL

SEQ ID NO: 32499 - protein, 87 aa, Sorghum bicolor
  Clone ID: SORBI-28MAY03-C132473_1.pep
MSGLLNSNLNSSASNLPDSAGRPFTASFSGQSGSIPGFHHSGLHNTHGSYNLPNMPGSLAQRNAAMSGFPSSGVQQPGGSIPGRFPS

SEQ ID NO: 32500 - protein, 196 aa, Sorghum bicolor
  Clone ID: SORBI-28MAY03-C133435_1.pep
ARGTSKLIRSVSGLDLPVQPVHTLICYWKVKPGHEQELTPEAGFPTFASYGDPYIYGTPSMEFPGLIKIAMHGGPPCDPDGRDWSTGGLVEPVARWIDAVMPDHVDTAGGPVIRQCCMYSVTPDDDYVVDFLGGEFGKDVVVGAGFSGHGFKMGPAVGRILAEMALDGVARTAADAGVDLRPLRIGRFAENPKGNL

SEQ ID NO: 32501 - protein, 171 aa, Sorghum bicolor
  Clone ID: SORBI-28MAY03-C133445_1.pep
MALPAEYSSEELFKAQLQLWHQALCFFKPVALSVVLDLRIPDAIHRLGGAATLPQIMAEAGINLCKLRDLRRIMRVLILSGIFSVKQVATTVASDGEGPIYKLTTASSLLVSDESLTSQQQLLRPFLYPQLMLTPCRECPVSRGLHAWFRQDQPQPAGLSPFALAYSGLTI

SEQ ID NO: 32502 - protein, 155 aa, Sorghum bicolor
  Clone ID: SORBI-28MAY03-C133534_1.pep
VNLAQLAVDRIGRGCVDDIVDPYLDPHRDAWTLSSIHKVAELAFRCLAFHSEMRPSMTEVADELEQIQLSGWAPSADDAAFMSTSSSISSSVASTRGTDRSSWGAGRSRTERAAVKASLVVQETAAKGAVESPVSVQDRWFSERSSPSSKQLAGQ

SEQ ID NO: 32503 - protein, 262 aa, Sorghum bicolor
  Clone ID: SORBI-28MAY03-C133562_1.pep
DDVWNRDVNKWGKLKSSVQHGGSGSAVLTTTRDRVVAKLMADTTHEPYDITGLHPDFIKEIIEARAFSSKKDRDAKLVEMVGDIAKRCAGSPLAATAVGSLLQTKTSVDEWNAVLSKSAICDDETEILPILKLSYNGLPPHIRQCFAFCAIFPKDYEIDVEKLIQLWMANGFIPEQHGVCPEITGKKIFMDLVSRSFFQDVNKVPFEVYDIEDPRVTCKIHDLMHDLAQSSMGTECATIVAEPSQALFSSPRNPKSFQDSLS

SEQ ID NO: 32504 - protein, 222 aa, Sorghum bicolor
  Clone ID: SORBI-28MAY03-C133552_1.pep
MAAAAQLHGSAAATAACRRTRAYSVRSSCRWPQSLLAGSPKLSISTSGVCTKPFGFAAKFSTKCANENARVEELDLQSDTMKELHVEEHVIPQKRSAKIHDFCLGIPFGGLLFSMGLLGYIFSRSTISLVLGIAPGLATLLLGILSLKFWRSGRSSFLLILAQAAISAFLAWKYSHAYFLTNRLLPWGFYASLSTAMGCFYAYVLLAGGNPPPKKLAAIPPQ

SEQ ID NO: 32505 - protein, 256 aa, Sorghum bicolor
  Clone ID: SORBI-28MAY03-C133672_1.pep
MAVGKNKRLSKGKKGLKKKTVDPFTRKDWYQIKAPAPFNVRDVGKTLVNRTTGLKNANDALKGRILEVSLADLQKDEDHAFRKVKLRVDEVQGKNCLTNFHGLDFTSDKLRSLVRKWQTLIEANVTVKTTDDYLLRLFAIAFTKRRPNQIKKTTYAASSQIRAIRRKMTEIIQREASTCTLTQLTSKLIPEVIGREIEKSTQGIYPLQNVHIRKVKLLKQPKFDLGALMGLHGESGTDDQGQKVEREFKERVLEEV

SEQ ID NO: 32506 - protein, 148 aa, Sorghum bicolor
  Clone ID: SORBI-28MAY03-C133725_1.pep
FIFDLAAISVDDEAVRDALGLAGVFLCVFGLLYGGFWRIQMRRRFGLPENRACCGKPDLTDCMQWLCCYSCSLAQEVRTADAYEVVLEDKQQPMPMPMHHPRHHPTLQEELSTMQEPLRFAGVFASPSPHLNDDGVTIPPSSLSATRT

SEQ ID NO: 32507 - protein, 158 aa, Sorghum bicolor
  Clone ID: SORBI-28MAY03-C133798_1.pep
ARGLYELGMRKLFFVGTGPLGCYPLLRQGSVTKECNAEANSLSMQYNTGVQKLLREMSTRQPDFRYSFLDQYAVLKKYINEPQANGFAEVEAACCALGDKDAMLICTPESQLCYSRTNHIFWDGAHLTEVTTQKLVAVAFNGSAPLVAPVNLRQLSAP

SEQ ID NO: 32508 - protein, 129 aa, Sorghum bicolor
  Clone ID: SORBI-28MAY03-C133877_1.pep
MAELMATMVVGPLVSMVKEKASSYLLDQYNVMEGMEEQHETLKRKLPAIMDVIADAEEQAAAHREGAKAWLQALRKVAYQANDVFDEFKYEALRRGAKKKGHYKKLGFDVIKLFPTHNRVVFRYRMGNK

SEQ ID NO: 32509 - protein, 180 aa, Sorghum bicolor
  Clone ID: SORBI-28MAY03-C132931_1.pep
HEVTNSVLPSGLSARRRDTPCFLGSPQSASIAVDCGSSRPISGSDNSMYQPDNASLGAASYYVTGAPTWGVSNVGKFMDTSNGSGSYIIFSSHQFQNTLDSELFQTARMSPSSLRYYGIGLQNGNYTVTLQFAEFDFEDSQTWKSVGRRVFDIYLQGERKEKNFDIRKAAGGKSYTAVEK

SEQ ID NO: 32510 - protein, 152 aa, Sorghum bicolor
  Clone ID: SORBI-28MAY03-C133953_1.pep
MAPADAGDFLLDADDDDFFGDYNPHPYQGGYDLAATFGTPLPPSSNICYPVSSSSAATAAVPAIPSPPPSSTPKPEEPHGDEKAQRDPAHEIPDAFPDGAAKEEKARRDRRRGRGFWRKCVRVLDYLFCYKDPYKEQRIVVDSYVVPVCVIR

SEQ ID NO: 32511 - protein, 40 aa, Sorghum bicolor
  Clone ID: SORBI-28MAY03-C133988_1.pep
NGRGLNYLIVSLTRLCPLSFFLPFLVIMIQVETILCLIAY

SEQ ID NO: 32512 - protein, 103 aa, Sorghum bicolor
  Clone ID: SORBI-28MAY03-C13405_1.pep
MVRFSSFVQSIFYRTMNPQFSVLWMIDLLLKDLPGVGYPLFVARMIILMLLLLALHFCWCYIIVWIVLFTILLVYIAFLVSFASTVIDWVHCAIVSLPFLNFT

SEQ ID NO: 32513 - protein, 186 aa, Sorghum bicolor
  Clone ID: SORBI-28MAY03-C134011_1.pep
HDSRFHLWDEPYLFRVCADGLLRRCVPMVEATQITERCHASPFGGHYGAFRTHAKIWQSGFFWPTMYEDTKDFVRRCHRCQKHGNIYSRNEMPLTNNLQVELFDVWGIDFMGPFPMSGNCEYILVAVDYVSKWVEALPCRSADSKHAKRMFHEVIFPCFGIPRIVISDGGSHFIDKIFRKYLANHG

SEQ ID NO: 32514 - protein, 207 aa, Sorghum bicolor
  Clone ID: SORBI-28MAY03-C134187_1.pep
MSFSNADTGNKAADPYKAANLDNDVSVKEKVEAFVKFAEKTKFGMMTTRDAKSGALVSRAMALAATENGGVDLLFHTNTESHKTDEIDSDPHINIAFINSSGDWASVSGVSSVITDRSLVKKHYNPTLKAWLGDLGDGTHDGSENDPRIGVIRVKTTSITYAISNATIVGKVAQLAEGVITGSPAQVNKLREVSSQEVEQYRSAASS

SEQ ID NO: 32515 - protein, 102 aa, Sorghum bicolor
  Clone ID: SORBI-28MAY03-C13423_1.pep
DRKGIHASWQKLHIHIRPQTNLTFQKPTVHGCTLTQSSAEGMKLARSTKVQAPSSLIGATPGHTILRSVELKIICRETWLHYSPLIMKGVLMARAELLELPS

SEQ ID NO: 32516 - protein, 179 aa, Sorghum bicolor
  Clone ID: SORBI-28MAY03-C134283_1.pep
SCLCSITSRVPRLTSRLPPPRSYYAAMHSLRFPSIQVMRQTEEELEPEAEAEAEAGPSSGPSGKHADTPSDADADLTPTWRPSCSRTGRCSAAEPPGNGGPRCRASPKAEERHQLERSVCVAVGEQPSSVSVQSQLQLARLTAYCKISKFIVSASPGVDGYDQLQMCSTSSSWLAAVDQ

SEQ ID NO: 32517 - protein, 212 aa, Sorghum bicolor
  Clone ID: SORBI-28MAY03-C134266_1.pep
MATTAMAKRSSWLLVLALAALLLAAAAVRVDGGATAAAPAPAPAADCGDALLGLAGCLSYVSEGSTVATPDPTCCSGLKDVVHKEVACLCQVFQSGQKLGISLNMTKALQLPAACKVKTPPFSKCHVSVPGVPTASPVPAPSTGAPFFGQSPSPSSSIPSGSPAAAATGSQSQTSTPAPSPARSGAAGLSAPPRTFLAAATAAATLFVCRLL

SEQ ID NO: 32518 - protein, 99 aa, Sorghum bicolor
  Clone ID: SORBI-28MAY03-C134290_1.pep
NSDAAGTWVPWKTIELDKLLSLDRLTRIWTATILGFDEDSNAFFICTSVGIYMIHLESTRFTKLFQGDSFTAYYPYTSLYTAGLGIDDGDDRAEMLNNT

SEQ ID NO: 32519 - protein, 143 aa, Sorghum bicolor
  Clone ID: SORBI-28MAY03-C134425_1.pep
SSTHCGLERRTQYAEQIRSAAGLAAGRRPSPIRPPSAVGRRPSRHAPLRASSTMSSEQIDKTTSAAAARGGVTVLLSGSFASHMGTAFLLHAWLPGQGTASPWSLSSPLTPSRVMLLQNPYRCLQPLVSYNCCMIKFNIAKGY

SEQ ID NO: 32520 - protein, 107 aa, Sorghum bicolor
  Clone ID: SORBI-28MAY03-C13444_1.pep
SDCSCFFKFQAEKDELRDEKQKLKLEKESLEHQMKLMTSTPAYMPHPTLMPAPFPQAPLAPFHAQGQAAGQKLMMPFVSYPGYPMWQFMPPSEVDTSKDSEACPPVA

SEQ ID NO: 32521 - protein, 157 aa, Sorghum bicolor
  Clone ID: SORBI-28MAY03-C134518_1.pep
TRRQPEASRRDITRSPRSALCSLLSPLPPSLFLHCRRSSPSRAPPPPPRKSAQRSSVRKEGRRRRIPGRWRWRRCWRTTCSSPSSASGYRCSSPTTTRAARTSPPPRRSSPPPPPRRPSRGSQRRAAPMCHRSSSSSRIGARRCWRHRPTRWTTTAP

SEQ ID NO: 32522 - protein, 149 aa, Sorghum bicolor
  Clone ID: SORBI-28MAY03-C134572_1.pep
MSEGATSPALEPEAAPLPDNDDIHREIFLRLPPLPSSLPRASLVCKRWRRVLSDPAFLRRFRAHHRAPPLLGFFADEDGDIDFVPTLRRPDRIPGARFSLPRRRRGDDYLSFLGCRHGLALFVDRARSEAVVWNPVTGSQCRVPFPPDF

SEQ ID NO: 32523 - protein, 123 aa, Sorghum bicolor
  Clone ID: SORBI-28MAY03-C134574_1.pep
VKKDEKIMASPTRETLSSYSELIDKQVREEKLPLDDEHNNKKIKFQPQITKEAKFQPNFLSGLDREGGLGERSQMGAEDVRMRCGCVASPLTGVSVRAWFCTVPDMVPFLKIFFHPQANKFSF

SEQ ID NO: 32524 - protein, 181 aa, Sorghum bicolor
  Clone ID: SORBI-28MAY03-C134610_1.pep
HEEKFEELCEDLWEQALTPVKEVLTHSGMKIDDIYAVELIGGATRVPKLQAKLQEFLGRRELHKHLDADEATVLGASLHAANLSDGIKLNRKLGMIDGSTYALVLEIDGPGYVKDESIDQTLVPRMKKMPIKMFRSIRHTKDFDISLNYDKAYELPPGIPSHKFAEYSISGLSDANEKYAH

SEQ ID NO: 32525 - protein, 200 aa, Sorghum bicolor
  Clone ID: SORBI-28MAY03-C13463_1.pep
SILPCSGSRRHQSPRPRDRAWLVARGRELQLRRRNAVLRRPLVLLRLLVMVVERLPLHRTASWGRRGLALHAVLDLHGCAVAVLISVHHFRACRCGAGGGMVLLSPWIQSGLTRRDAPGRSGPCRRLRAASAGWYTTIARSSFTAGAATPMAAAGGATSLLIGKCPTTKGCGVTGSTSGTPTADSTDGTSASSRRILVAG

SEQ ID NO: 32526 - protein, 126 aa, Sorghum bicolor
  Clone ID: SORBI-28MAY03-C134777_1.pep
ARGPGAGEKDEVLRKRHAGGQPELTPEEAAEQAAVMRQQIHLFWGNMLFERSQVEFKLSVGDWKTNLDASVERFKLAGASESDISTVLKNHFSNAASECEEKKVMTSGTEISQTNDNVEDKCVVET

SEQ ID NO: 32527 - protein, 98 aa, Sorghum bicolor
  Clone ID: SORBI-28MAY03-C134839_1.pep
HEGRAMLQAYRQAIVNANKTGAAQEAINGIRRASKAMTEQEARQILGISEKSTWEEIVQKYDTMFERNAKNGSFYLQSKVHRAKECLEPLYQKPDVLN

SEQ ID NO: 32528 - protein, 102 aa, Sorghum bicolor
  Clone ID: SORBI-28MAY03-C134928_1.pep
RRLRCIMDQRLAGHYSVKGARAVAQLPVQCTPTQPRDRPRMVAVVEALEKLQGLKDMAVTVGLWPAAAPVAGRNAISAKIRAEVKGAGGAGSRRRSASSKLP

SEQ ID NO: 32529 - protein, 189 aa, Sorghum bicolor
  Clone ID: SORBI-28MAY03-C133918_1.pep
HEAFTTMGRVIAAALLKWSVPVPADAKELHELDLEEYTRKRRFRMDSTNAMRFLNKAAVPVNDDKDGGGLAAPTWSLCTVTQVEETKQILKLMPLLVAMFVPCTLIAQTNTLFVKQGTTMDRHMGPHFEIPPASLGVFVTLTMLVSVVVYDRVFVKAVRRYTGNPRGITLLKRMGTGLALQVVTMAVAS

SEQ ID NO: 32530 - protein, 206 aa, Sorghum bicolor
  Clone ID: SORBI-28MAY03-C135_1.pep
YIYLVILQISLIDVPEYRRRKAMALSPNIMRDTSDKVLTHGQPGEEVSLELILRVVADVGLVGPPKPGKSTLLSAITLARPDIADYPFTTLMPNLGRLGGDPALGALQFSSEATLADLPGLIEGAHLGKGLGRNFLRHLRRTRVIVHVVDAAADDPVNDYKIVREELRMYNPQYLERPYVVVLNKIDLPKANDRLSSLALEISSIG

SEQ ID NO: 32531 - protein, 170 aa, Sorghum bicolor
  Clone ID: SORBI-28MAY03-C135114_1.pep
HEGQVAWPSVIAVLPLLLLNIWYRNRYIATSRELSRLQGVTRAPIIDHFTETFLGAPTVRCFRKEDEFYQTNLDRINSNLRMSFHNCAANEWLGFRLELIGTLILSITAFLMISLPSNFIKKEFVGMSLSYGLSLNSLVYYAISISCMIENDMVALERVHQYSTLPSEAA

SEQ ID NO: 32532 - protein, 149 aa, Sorghum bicolor
  Clone ID: SORBI-28MAY03-C135127_1.pep
ARGSRQLSSGAARLWRQLSLDPHTPRRGGPGPGAGAGARQTRFAIARQSSLDPTPRGGPDGSSAHQQLAVPENLDATMRLLFAACQGDAAGVEELLRSGVDVDSIDLDGRTALHIAACEGQGEVVRLLLDWKANINARDRWGSTPAADA

SEQ ID NO: 32533 - protein, 117 aa, Sorghum bicolor
  Clone ID: SORBI-28MAY03-C135128_1.pep
MRDRALFRRAERSIACLLPGVMAFDGVTRASTCRRFEGVTAPLANEVADLGGRPRRLYGVGFSGSGSGCLSSSSSSSLSAGYFVWVNRCSLTPPFRGGAVHGLVGFVLQLLAGAFLA

SEQ ID NO: 32534 - protein, 204 aa, Sorghum bicolor
  Clone ID: SORBI-28MAY03-C135269_1.pep
TRIAYSILIHGYSKLGEIGRALQVWNLMCSSQRVTPTSVNHVSILLGLCKKGFLDEARSYLETIASKYQPSDVVLYNVVIDGYAKVGDIGNAVQLYDAIIMAGMCPTIVTCNSLLYGYCKFGDLHMAESYFTAIQLSDLLPTTVTYTTLMDALSEAGKVHSMLSLFKEMTGKGIKPNAVTYSVVIKGLCKQVMFHDAKNVLDDM

SEQ ID NO: 32535 - protein, 198 aa, Sorghum bicolor
  Clone ID: SORBI-28MAY03-C135414_1.pep
HEVDVKDPATMASVPADGRTMGEVMFRGNTVMSGYYKDAAATAEAMAGGWLRSGDLAVRHAGDGYVKILDRSKDIIISGGENISTIEVEAALFAHPAVAEAAVVGRPDEYWGETPCAFVTLKEGKDVGAEEVMAFCRARLPRYMAPRTVVFVAELPKTATGKVQKFALREQAKAMGSISGSSSKKPGGSGVAGTRSKL

SEQ ID NO: 32536 - protein, 64 aa, Sorghum bicolor
  Clone ID: SORBI-28MAY03-C135531_1.pep
KASKAFRKRPDCCAPWRSREQVLLLISGSVRRPPALAKSCVRYSPSALGIQGVSRKSIPLNMID

SEQ ID NO: 32537 - protein, 171 aa, Sorghum bicolor
  Clone ID: SORBI-28MAY03-C135557_1.pep
MAHALIFLLVDHLLIFLLCNPIAFLAADSTNNSEIELQALLNFKQGITNDPSGALSTWNISGSFCTWSGVVCGKALPPSRVVSLDLNSLQLSGQLSPYLANLTSITRLDLGSNSLEGPIPKELGTLPKLQDLILANNSLSGIIPASLFKDSSQLVVIDLQRNFLNGPIPDF

SEQ ID NO: 32538 - protein, 296 aa, Sorghum bicolor
  Clone ID: SORBI-28MAY03-C135622_1.pep
TRSISRILKDIKLTSNISTNQKESSSGPCTVIYVVCPFPEPCAILQTLVECSVALGYVISSPERERKSLYSQVAKALNSSASADEASASNVVMLSGFSIPKPRGQIVTIETVLRIDKPNKELAVLKDIAFTVYNKARRIPRAVSTSDMFQSPTYLGRSQSTMMHVTSPAPTLWKECLVPRMSGPTLSRETDFDASMRSATWDNSWQPARSGGLLDPSKMPDLCAQDDRKYAFEPLFILADPGSADLNALMEPSKSGADARGSRVYGSMSGSNSDSGVSPLLDVSESDSAASLHCCY

SEQ ID NO: 32539 - protein, 106 aa, Sorghum bicolor
  Clone ID: LIB5047-010-R1-XP1-D8.pep
PAGPGEEPRTSSGLPRVLIKNNNRAIVRSKDLHRSEVQGRKAGPPMEPLAIVTVAGGVLTPVFVLLSRLQPVVDFFRRLCDCLRHPQRRPARPVRAAWNKPAATEE

SEQ ID NO: 32540 - protein, 130 aa, Sorghum bicolor
  Clone ID: LIB3480-043-P1-K1-F7.pep
PRCSCCYRASSPSSTSSAGFVTASGTLSAAPLGRSGRHGISLQPQRSRASGCLHRICLQPLAFVQYVCNGEAYRCCIHWRSHRSATPGSRSGSSPKCKRNLLYIYIELCDFIAKYFCLMRIAWALCRRSY

SEQ ID NO: 32541 - protein, 151 aa, Sorghum bicolor
  Clone ID: SORBI-28MAY03-C15695_1.pep
GGKLLKLADFGLARLFTRDGTLTNHVITLWYRPPELLLGATSYAEPVDIWSVGCIFAEFLLKKPLFPGRSELLKIFELCGSPNEENWPGVSKLPLYKTMTIRPATPTKRSLRDMLQNFDCHAVELIERMLILNPSQRISAQDALAAAYFNN

SEQ ID NO: 32542 - protein, 110 aa, Sorghum bicolor
  Clone ID: SORBI-28MAY03-C15662_1.pep
FVVTAIAKLATCHSELLPRARVSPTSPVARSQTLDRRVWQRACDYLGLMNEPAICLSVLGPSTAQGNGPGIVNWSEGGTKMVAHVPFYLLAEQKGPPFHDFSFTDLLPTE

SEQ ID NO: 32543 - protein, 140 aa, Sorghum bicolor
  unsure (1)..(140): unsure at all Xaa locations
  Clone ID: SORBI-28MAY03-C13589_1.pep
MFHTMDKDNDGNLSLDELKEGFRINGHPVPEEEIKMLLQAGDIHGNGTLDCEEFVTVLLHIKKMSNNDYLPKAFKFFDKDGNGFIEMAELMEALGDGELKSNEQVVNDIIREVDKDKDGRISYPEFELMMXGGSDWTNAS

SEQ ID NO: 32544 - protein, 63 aa, Sorghum bicolor
  Clone ID: SORBI-28MAY03-C13594_1.pep
TSLNKSTQSVLMHGLIYMCSQRVALPMFQCISMVVSDHFRTARIGVIHDIKGGQHHCDYPNGR

SEQ ID NO: 32545 - protein, 97 aa, Sorghum bicolor
  Clone ID: SORBI-28MAY03-C13596_1.pep
PIRYFPRATLAKIFQACVILHNMAAEDEKDMASACFDSGEVMGTSAVLPSNIKTGPANCLANIQQRNATLCSLPTHGQLRRDLIEHIWQQFGPFGDK

SEQ ID NO: 32546 - protein, 146 aa, Sorghum bicolor
  Clone ID: SORBI-28MAY03-C135948_1.pep
MSKTFSTSDVAAHNKPEDLYIIVDEDVYDLTKFQDDHPGGKKILQRVAGKDASKQFWKYHNEGILKKYKAKLQVGSLDSKPQPVEAAPAAATPVPKKAASKKAVASSTEESEPMDPFGDLVPYADPNWYQAYHTPYYNETHAALRA

SEQ ID NO: 32547 - protein, 123 aa, Sorghum bicolor
  Clone ID: SORBI-28MAY03-C135998_1.pep
LLHLHSPTPRADRPPSPPPPPAPNRNRVDPACRVQEIPRPGGRRCDCEAEDRRGGGFIKGVAGSGPLSARSLLAWAALSRYILVVAASWFLEIHIDVVCSGNFYSSWMLLRAMQRRLILVVRL

SEQ ID NO: 32548 - protein, 201 aa, Sorghum bicolor
  Clone ID: SORBI-28MAY03-C13602_1.pep
PAGFRNILISRFLLGVIHRPRPHHPRRTSRRPAAASTFSPPASASLPLVPRPPPNSSGAARFSTLDGPPLADLATSGSPPEDAARRRCSCTTRPRRGRPSTSPSGSTSRLDPCVTYGVGAPSHHGGSSIGRYDGLWATTRPSAAKGRSGGADPLPRSMAGFLLCRLLHGGPVSLGNGRYGSDLSQVILSWPAISLDLPRSF

SEQ ID NO: 32549 - protein, 139 aa, Sorghum bicolor
  Clone ID: SORBI-28MAY03-C13611_1.pep
HASEKDGSVVAMVGDGINDSPALAAADVGMAIGAGTDIAIEAADYVLVRNNLEDVITAIDLSRKTFSRIRWNYFFAMAYNVIAIPVAAGALFPFTGVQMPPWLAGACMAFSSVSVVCSSLLLRRYKKPRLTTVLQITVE

SEQ ID NO: 32550 - protein, 273 aa, Sorghum bicolor
  Clone ID: SORBI-28MAY03-C136344_1.pep
ARGHLDVSRNAIGTVPEGLRSLTLVRVLNLSGNNMTGVFPDDLPPLAGIQVLDISHNNFSGAVDAATVLKFGNSSFFQAGNALRVIDDVAPASSPALAPSSNGGDMNRRAVTIALISVGATVTLACLAACALTRRRRNKKKKKKDKDGKTAVWEDEEVVVGAVKVAAAAPVVVLERPLMELTLADLAAATSGFGRESQLADTGGRSGAAYRAVLPGDLHVVVRVVEGAVAGVAEDADAAAIEAGFRELARLRHPNILPLLGYCIAGQLNYTFY

SEQ ID NO: 32551 - protein, 77 aa, Sorghum bicolor
  Clone ID: SORBI-28MAY03-C134947_1.pep
ARGPMSRVVKMLTGDVEVTEVVAKPSYITEWQRRGGNTSYVTSDYSGDTTGEFSTQRETIAPLTPSPAMTGIIDDGR

SEQ ID NO: 32552 - protein, 196 aa, Sorghum bicolor
  Clone ID: SORBI-28MAY03-C134993_1.pep
HEARVVLVRARSSSVPLRMQDMAGSDGMQTMQLPPLRDLSRRAVSFLRMARLALTGAATPAQLLAGEEVVDGISCNPYYKRVSTEDDWESELWPEEDESEELLVDDDEDGSTTRGASDLVGGGVVGGPLNKKAQFRHQSTATPGAHVTAAEPEEPSEPLMTRRATKRVNDAAVAVDHPFGCDRQGRESSSLLLVSS

SEQ ID NO: 32553 - protein, 83 aa, Sorghum bicolor
  Clone ID: SORBI-28MAY03-C13638_1.pep
VCTHTSYSKYVHILYIVCTHTSYSEYVAILHSKVLDRDIPMLIIHFVGCHQFRKRRFRNLHELTLLNCICCLFGNLQNLALLV

SEQ ID NO: 32554 - protein, 131 aa, Sorghum bicolor
  Clone ID: SORBI-28MAY03-C13641_1.pep
MAIAEGKKRRPALICCGVLVAVLVLLAVIFVTLYFTLFRPRSPKVVATAVGAEIFPKNNGGGAQDLNLTVHVDVTVNNPNYAAFRYGDVATVVRYHGEDVGLSVVPAGEIGPRETHTIAVAVEVDTGKVAT

SEQ ID NO: 32555 - protein, 249 aa, Sorghum bicolor
  Clone ID: SORBI-28MAY03-C13644_1.pep
ARGFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETEDDKKVLSEN

SEQ ID NO: 32556 - protein, 124 aa, Sorghum bicolor
  unsure (1)..(124): unsure at all Xaa locations
  Clone ID: SORBI-28MAY03-C13659_1.pep
MSGRKRTQELMEVTMILGPAVREGEXVFGVAHILAXFNDTFLATAACCGSIRWETLGRITGKSRPRXAMLAAQEDALRCKELGITAVHIELTGGIKTNTPGPGAXSVLRALAFGMKIGRIVYSI

SEQ ID NO: 32557 - protein, 220 aa, Sorghum bicolor
  Clone ID: SORBI-28MAY03-C136663_1.pep
ARGVNTCKMHDIVRDLALSIARDEKFGSASDQAAVINMDREVRRLSLCGWHGGDAPRLKFPHLRTLFSLDGVTSTRMLASIFSESSYLTVLELQDSEITEVPQSIGNLFNLRYIGLRRTEVKSLPECIEKLSNLETLDIKQTKIEKLPRGIVKVKKLRHLLADRVVDEKQKDFRYFTGVQPPKDLSNLVELQTLETVEATNDLAGQLDNLKKLKSVWVCK

SEQ ID NO: 32558 - protein, 159 aa, Sorghum bicolor
  Clone ID: SORBI-28MAY03-C136636_1.pep
SARGPPVSTTARLVARRTGPSDGVDRISSLSDTLLRDIVSRLPFKDAARTAVLATRWRGLWLAAPLVVADAHLLNHWPPTPADAAPVTAAVSHALATHPGPFRCVHLVSTRMDAYQPQLKRWLRLLAAKGVQELVLVNRPCPREVPLPDTLLRIATLTR

SEQ ID NO: 32559 - protein, 228 aa, Sorghum bicolor
  Clone ID: SORBI-28MAY03-C136719_1.pep
MAMSISVGCVRGDSGTVLAPSASSLRPPLRRAAGPKGHFCTFPHGASSNHNRLCIEHQRCSRSSTQTYALSRKDFSPITQDVEGFLHNVVNMGFLDRLKLAWKIMFSAPTIKDTSNANIAKQRLKMILFSDRCEVSDEAKKKIVEHVIEALSEFVEIESRDNVQVDISTDAGLGTVYSVTVPVRRVKPEYQESEEQYRGKIVGVDFKDTGESSGNVDVTFDFFVPNEN

SEQ ID NO: 32560 - protein, 71 aa, Sorghum bicolor
  Clone ID: SORBI-28MAY03-C136808_1.pep
MSSFEPVVVIDGKGHLLGRLASIVAKQLLNGQKIVVVRTEALNISGEFFRAKLKGHAYLRKMTRCNPTRGG

SEQ ID NO: 32561 - protein, 186 aa, Sorghum bicolor
  Clone ID: SORBI-28MAY03-C135683_1.pep
ARGRERTTGISLKFESPSPSGGAAGTMSSARSFMSSLSMDGSMASLDGKRPFHLVGTPVASDPADAHRAPKRRCTGRGEDGRGKCATTGRCHCSKRRKLRIKRSIKVPAISNKIADIPPDEYSWRKYGQKPIKGSPHPRGYYKCSSVRGCPARKHVERCVDDPAMLIVTYEGEHNHNQLPAQAAQT

SEQ ID NO: 32562 - protein, 132 aa, Sorghum bicolor
  Clone ID: SORBI-28MAY03-C13706_1.pep
KGMEERGATIIYATHIFDGLDDWPTHIVYIAHGKLQLALPLEKVKEMSQLSLMRTVESWLRKERDEDRRRRKERKEKGLPEFDMVAEGSRVIGDPAKSAARVVNNGWAAGRLTSTIAGEENFVFSSNSVLRQ

SEQ ID NO: 32563 - protein, 193 aa, Sorghum bicolor
  Clone ID: SORBI-28MAY03-C136856_1.pep
ARGEHWIAVKRILRYLKGTMGYGCKYEKGAELKPMLLGYSDSDFAGDSEDRKSTTGVGYFLNGSLVTWASQKQKIVALSSCEAEYVAAAAAACQGIWLSRLIADFQGTKETTVKLLMDNMSAIALSKNPVHHDRSKHIDTKFHFLRECVEEAKVEVEHVGTGEQVADIFTKALGRVKFIELRSALGVVDVHLV

SEQ ID NO: 32564 - protein, 123 aa, Sorghum bicolor
  Clone ID: SORBI-28MAY03-C13712_1.pep
MMPQLRSLVALLLVATAVAAVVAVAAAGGGFVVTGRIYCDNCRAGFETNISHAIQGATVEMECRHFESQQIHDKAQATTDAGGWYKMEIAGDHQDEICDVRLLKTPGGLRQTSHRTGRSLRTR

SEQ ID NO: 32565 - protein, 84 aa, Sorghum bicolor
  Clone ID: SORBI-28MAY03-C137129_1.pep
RSQMQRVPPQAVLFYLGAEAGPCSRNLTGAKGSSSEKFDPRSNIQGLPPSGPLLPMIASPNLLAHLASFIFCKMENICLADIPA

SEQ ID NO: 32566 - protein, 186 aa, Sorghum bicolor
  Clone ID: SORBI-28MAY03-C13750_1.pep
PRVRSGIAVGDILIMADADEIPTPETVQLLKWCDGIPPVMHLEMKNYMYSFEFPVDDNSWRATAHVYNERTSYRHSRQSNLILADAGWHCSFCFREIKEFVFKMKAYSHADRVKQKSFLNPDRIQKIICNGDDLFDMLPEEYTFTDLFKKMGPIPKSASAVHLPSHLIKNADKFKFLLPGGCLRSE

SEQ ID NO: 32567 - protein, 118 aa, Sorghum bicolor
  Clone ID: SORBI-28MAY03-C13791_1.pep
MCKNYLKDPTIAVFNDIMTPGKFDNMYFVNLERGLGLLSTDEELWTDPRTKPLVQLYASNPAAFFTDFGRAMEKLSLYGVKTGADGEVRRRCDAYNSGPAIPGALGGGGAMPMPMPKM

SEQ ID NO: 32568 - protein, 60 aa, Sorghum bicolor
  Clone ID: SORBI-28MAY03-C13794_1.pep
RVPFEGEAAKACYCEGLYWLWQTKRKLIGGEQRCRFVNLIKRPSGTERQGTSPFEQLFCS

SEQ ID NO: 32569 - protein, 156 aa, Sorghum bicolor
  Clone ID: SORBI-28MAY03-C13821_1.pep
LNPRLTDCGLAYFYEDTSQSLGPGYDPPECTSSSGYVMKSDVYCFGVVMLQLLTGQKPYDSSKPRAEQSLVKFVTPQLHDINALEALADPALRGLYPPKALSRFADVLARCVQSDPEFRPSMSEVAQSLLQCVQRSTSNRRLGGHRSVSQLIDDTD

SEQ ID NO: 32570 - protein, 115 aa, Sorghum bicolor
  Clone ID: SORBI-28MAY03-C13833_1.pep
IVFLCLVYLLNDPAVSEARKRMGLGNLEPTFETLVESFVFLDKNKDGYVSKSEMIQAINETIGGERSSGRIGVKRFEEMDWDKNGTVTFKEFLFAFTRWVGIDNEDDDEDDEEAA

SEQ ID NO: 32571 - protein, 57 aa, Sorghum bicolor
  Clone ID: SORBI-28MAY03-C136194_1.pep
LARPQGSLLSAGQGRCVLSTALWQMDTQDASFAVVAFTPHLAPTTYQNRTVHPKLAC

SEQ ID NO: 32572 - protein, 61 aa, Sorghum bicolor
  Clone ID: SORBI-28MAY03-C136355_1.pep
TREATISSLQVEISESKAKCVALISQASSTEDQNHAEDIRQLSEKLESMQSLVTRLRTLIN

SEQ ID NO: 32573 - protein, 126 aa, Sorghum bicolor
  Clone ID: SORBI-28MAY03-C13849_1.pep
MLRPWDPSFESTVSPTRPPFNPSEYHGHSSWPSLEGSSIAGTNGFNSMAVHPESVQRGNYTFPSNHIGHSWMPHATNGIADGVPQWEYVNATTNIQGRFFHSGAKVFAGTSLQSYHYYPSAQSILT

SEQ ID NO: 32574 - protein, 75 aa, Sorghum bicolor
  Clone ID: SORBI-28MAY03-C13884_1.pep
PRVRHKWNKAGVDDLVPQKIVWHRRPHDPPVLVDGGRDYYGHAPAVIELCMQVGAIVPPKYHCMMKTHGLAPPVR

SEQ ID NO: 32575 - protein, 163 aa, Sorghum bicolor
  unsure (1)..(163): unsure at all Xaa locations
  Clone ID: SORBI-28MAY03-C13901_1.pep
RDRISRSVRQELDQPLNYARVYLADTLPPDVRRVTYLDSDVIVVDDVRTLASVDLAGHVVAAPEYCHANFSNYFTDAFWSHPALNGTFHGRRPCYFNTGVMVMDVDKWRAGGYTRRVEEWMAVQKRRRIYHLGSLPPFLLVFAGHIRAGDHXWNQHGLGGDNV

SEQ ID NO: 32576 - protein, 78 aa, Sorghum bicolor
  Clone ID: SORBI-28MAY03-C13914_1.pep
MSAERPVPRRESPWGLPEGDTRQPKAHRCNDRAEDVVQACFEGNPFKTVTCPFKLFWQCMRSKPEEVPAEPYTYLQLD

SEQ ID NO: 32577 - protein, 167 aa, Sorghum bicolor
  unsure (1)..(167): unsure at all Xaa locations
  Clone ID: 9303565.pep
TQQQPDAAAAKQXAAAAGNCSGESAEATAAAPPPPLPSILELLPSCRGDPAPDAAVETAAAVGTEHEVVEKAGARLFGVSIGRKRMRDESNGGVFEDYPASRAAEVKAEPVEAAHPDQRQQENNATEPVPQSWPIYRPRPVYHPLRACNGSGSAGSDHDGSTNSRLN

SEQ ID NO: 32578 - protein, 123 aa, Sorghum bicolor
  Clone ID: LIB3480-008-P1-K1-C6.pep
HASGRGDPAPDAAVETAAAVGTEHEVVEKAGARLFGVSIGRKRMRDESNGGVFEDYPASRAAEVKAEPVEAAHPDQRQQENNATEPVPQSWPIYRPRPVYHPLRACNGSGSAGSDHDGSTNSR

SEQ ID NO: 32579 - protein, 106 aa, Sorghum bicolor
  Clone ID: SORBI-28MAY03-C13935_1.pep
RAVDRLAANYSRLPGVFDSEIDEDIPRLKTVAASVLSEMGLNGASLSEDLITEMCRFGGAEIHPVAAFVGGVASQEVIKLVTKQFVPLRGTFIFNGIDLKSQVLVL

SEQ ID NO: 32580 - protein, 182 aa, Sorghum bicolor
  Clone ID: SORBI-28MAY03-C1394_1.pep
MAALLRTAAALAPPPSSPLPAREPRGRSLRLACSRRAPARPLLAWLLPTPHVFCRDGARFRRLAATEADEAAQTATQEDSETEVTGDSAADDGAGSTEETPSIIVTTLQSYREALINDDEAKAAEIESFLLSIEDEKNSLLNKITALNAELATQRERILRISADFDNFRKRTENEKLNMMEN

SEQ ID NO: 32581 - protein, 229 aa, Sorghum bicolor
  Clone ID: SORBI-28MAY03-C13973_1.pep
QTEIDMLSKLRHKHLASLIGCCEDDGEMILVYDYMAHGTLREHLYKSGKPALSWRQRLEITIGAARGLHYLHTGAKYTIIHRDVKTTNILVDENWVAKVSDFGLSKTGPTAMNQTHVSTMVKGSFGYLDPEYFRRQQLTEKSDVYSYGVVLFEVLCARPALNPSLPREQVSLADHALSCQRKGTLQDIIDPVLKGKIAPDCLKKYAETAEKCLADHGVDRPSMGDVLWN

SEQ ID NO: 32582 - protein, 196 aa, Sorghum bicolor
  Clone ID: SORBI-28MAY03-C13685_1.pep
MATMEKNQDSQLIMGRYRLGRLLGCGTFAKVYKAHKVATGEAVAVKVLDKDAVHRSGMAEKVKTEVDVMRRVRHPNVVRLHEVMATRSRIYFVMEYASGGELFARLSQSARFPEPVARRYFQQLITAVEFCHSRGVYHRDLKPENLLLDARGDLKVSDFGLSALQQDSGARFRGDGLLHTACGTPAYVAPEVLLKS

SEQ ID NO: 32583 - protein, 126 aa, Sorghum bicolor
  Clone ID: SORBI-28MAY03-C136853_1.pep
TRLNVHEGPIGIGTRVQFAEVALAPGNILSIEPGFYEDGSYGIRIENVAMVTEVKTKHSFGDKPYLGFEHVTMVPYCQNLIEPSLLTAEEKAWLNAHNADIFQKTKEYFQDDPLTLTWLARETQPL

SEQ ID NO: 32584 - protein, 78 aa, Sorghum bicolor
  Clone ID: SORBI-28MAY03-C14014_1.pep
DDCVSANSSGVTCCRTIALILMFLLLVRHVIVIVRDVSMLQDATVLFSATLQFAGFFLPCYVIARSCYALQHRRRRQV

SEQ ID NO: 32585 - protein, 138 aa, Sorghum bicolor
  Clone ID: SORBI-28MAY03-C14017_1.pep
RCEICPDFDVCNACFQKGAGTHPHNLTNHPSAADRDAQNAEARQMRVQQLRKMLDLLVHASTCRSGSCQYPNCRKVKGLFRHGMQCKTRASGGCVLCKKMWYMLQLHARACKDSDCNVPRSRDLKEHLTRLQQQSDSR

SEQ ID NO: 32586 - protein, 164 aa, Sorghum bicolor
  Clone ID: SORBI-28MAY03-C14021_1.pep
MDAPFFHELRRQASSYLTGKIRSARLALTDVTPTQLMTEEATSGDASPPNVKTMGLIARQAFEVDEYVRITDILHRRFASFDRRQWREAYKALLLLEHLLTHGPRSVAVEFQKDREAIEQMATFQHIDEKGFNWGQTVKGKSERVLKLLERGPFLEEERKRALL

SEQ ID NO: 32587 - protein, 95 aa, Sorghum bicolor
  Clone ID: SORBI-28MAY03-C14040_1.pep
LIWGNVDYNLLKTGYNFCERPSKNNFCELALYLQNIVYFFLMLYRNKILITALVCYAQDSSLHGLVGKDQGHSQNCPPPHQPSFSRSESLDPAAS

SEQ ID NO: 32588 - protein, 117 aa, Sorghum bicolor
  Clone ID: SORBI-28MAY03-C14060_1.pep
ARQARRWSNTRRKDCQLKRGGDKGQSVFRSHDDWNATATDAIQEWSKEEAVYDKQREKCLGGRTYMECGHFALMVTKRTAKVGCARAECYQGGVFITCNYAAAADTGTKDKKKSSSK

SEQ ID NO: 32589 - protein, 66 aa, Sorghum bicolor
  Clone ID: SORBI-28MAY03-C14064_1.pep
PTRPQVDRPVSSQKKEQQEDHGRKHKRIHYSGPLMPPGGNIEDMLKEHERHIQEAVRKARLSKGSR

SEQ ID NO: 32590 - protein, 142 aa, Sorghum bicolor
  Clone ID: SORBI-28MAY03-C14074_1.pep
ARGDDVMLPEVPYDQFRAGSQFFVLTRRHAIMVVRDMRLWKKFKLPCLIERRDSCYPEEHYFPTLLDMQDPEGCTKYTLTRVNWTDSVAGHPHMYGPGEVSASLIRELRKSNMTHSYMFARKFSPECLEPLMEIADKVILRD

SEQ ID NO: 32591 - protein, 96 aa, Sorghum bicolor
  Clone ID: SORBI-28MAY03-C14088_1.pep
LRSEQSLVRWATPQLHDIDALDRMVDPALKGLYPAKSLSRFADVLALCVQPEPEFRPPMSEVVQALVRLVQRANMTKRMLDGDTSRRPDDQDQDFI

SEQ ID NO: 32592 - protein, 101 aa, Sorghum bicolor
  Clone ID: SORBI-28MAY03-C14094_1.pep
KLHLLDRRHESPSRYIPWNHKNLRSSRRLTPPDTHGPRQSDPPPTPHVDYWSRKRPPGTKWLANDDATGILAGGEGGSGVHDGGVVAACGCSVRQGRAARG

SEQ ID NO: 32593 - protein, 84 aa, Sorghum bicolor
  Clone ID: SORBI-28MAY03-C13834_1.pep
NKTHGFRTDDRYNQPKKHMLLPFNFCYSEPHYSSEPFKHLSYAFFSIRVPSEDFIKQELIKMPMLLNRTQLPARSDLADQMGQT

SEQ ID NO: 32594 - protein, 169 aa, Sorghum bicolor
  Clone ID: LIB3480-057-P1-K1-F11.pep
RVVPDHGGGVRRVRLERHERLADVDEQLLPEHRAGLQVQDHPLSVALRDRVQRRRDVGVVAVAAGVDHVRHLLRLRLLQALVHGLLAPVAGGLLRVQRVALLVLHDPVAESPARRVGGGRRRRKERGHEEEEEEQRLRRRRRRRRSPRHGGPPMHAAGRPIDDRHLSSS

SEQ ID NO: 32595 - protein, 104 aa, Sorghum bicolor
  Clone ID: LIB3480-012-P1-K1-G3.pep
GPPRLLNPSRTISPRTRAATTYPASPSFATTTCVAGNGDYPNITAALDAIPESNTRRVILDLKPGAVFREKLFVNISKPFVTFKSDPANPATVVWNDTEEARSR

SEQ ID NO: 32596 - protein, 111 aa, Sorghum bicolor
  Clone ID: SORBI-28MAY03-C14167_1.pep
QKGKHGSDSVGYDANGRFVPEKFEEIFKKHAHTRPDALTGKELKELLKANREPNDFKGWLGGFTEWKVLYFLCKDEKGFLHKDTVRAVYDGSLFEKLEHERKSKKESTKKK

SEQ ID NO: 32597 - protein, 234 aa, Sorghum bicolor
  Clone ID: SORBI-28MAY03-C14186_1.pep
ERFRVEIDRVLGENLNFWLRFSTSYHQIRNFQISFDMLKTEMHRLTDEQEDGDTYRFAGSYQVAKLESAVLEKKLRDLNTDLQVWIEKNVLLKGEVENRFSSLCSIQEDISKITTLDKCDEVHFNPFQAAKFQGEVLNMKQENNKVAKELEAGLDHVRGLQVEVGRVLLKLRENLEVSIARSHRAQQNFRSLSTKAGVPLKTFLFGSKGKRPSLFSCMSPGVPKQHNGSRAGRK

SEQ ID NO: 32598 - protein, 142 aa, Sorghum bicolor
  Clone ID: SORBI-28MAY03-C14218_1.pep
PAGSGCGLLQHQNPSRVCSLCTYIEGDLHRLWIQPSPAPCRRVRNGDDEQSNGFRSPRFDASHEHRLCATCPGGLLERDQRRLHEDAQLPEQLPGAWPGGREVQVGVPRPGALLLLPAPQLQSLVGVLRIGSSAMGKRVTAR

SEQ ID NO: 32599 - protein, 115 aa, Sorghum bicolor
  Clone ID: SORBI-28MAY03-C14237_1.pep
QDDLNYPSITAILDQPPFTATANRSVTNVGAASSTYTVEVNVPESVTVEVNPTKLTFKALEEVLNYSVTIKSANGRALTGPVEGEIKWVSGKYVVRSPILVTTGALPSAAATRKP

SEQ ID NO: 32600 - protein, 124 aa, Sorghum bicolor
  unsure (1)..(124): unsure at all Xaa locations
  Clone ID: 14328404.pep
QELFEGIGQVGRIKQKRGYKDQWPXNIKIYTDDSGKAKGDACLAYEDPSAAHSAGGFYNNYDMRGYKISVVMAEKSAPRAAPSYGHGGGRGGGYGGGGRRDSYRDGGGHGPNRNQGGGSRSRPY

SEQ ID NO: 32601 - protein, 50 aa, Sorghum bicolor
  Clone ID: LIB3480-014-P1-K1-A5.pep
KSAPRAAPSYGHGGGRGGGYGGGGRRDSYRDGGGHGPNRNQGGGSRSRPY

SEQ ID NO: 32602 - protein, 209 aa, Sorghum bicolor
  Clone ID: SORBI-28MAY03-C14241_1.pep
VGKIVEEPVQVTETLNFDYTRPSPMALVPVPRLVPPNQRMQLEVSLTLPESDYNRRLGVFQVKAEFLSADGKVMSTSSQPCMLKFKSVHMHFIETFLQSVSLLSGYSSESQVIRLKMRGITQGLEPTTAVRIILEQRAEFGRGAGIPEIYAASLKLEAELPLFKRLLWNWRWTLFVWSSMGFFVFELLFALVCCRPCIFPRSGHNVAAP

SEQ ID NO: 32603 - protein, 86 aa, Sorghum bicolor
  Clone ID: SORBI-28MAY03-C14271_1.pep
FHEELLEHISGMSVEDTRECTLTQVKSIYKAINNSSSRLLHLNSNALASKMVQICLSTYCKHLLMHLVCLKFCFCILYQQWFKSLT

SEQ ID NO: 32604 - protein, 156 aa, Sorghum bicolor
  Clone ID: SORBI-28MAY03-C15806_1.pep
REKKKKTTPPPCHNPGQTPQAHAFILARALSFTRDQPPTHRCPHPPLPHLRPHPVTCQGLAPSSTSWAVPLSRVPWTPSSASAASPMLPHPPGSCAILVVAGAAASPTDRWGDNAHGHGKFVEIHDHDLNFSDLGNRRSEEIYDGISGKGELMESV

SEQ ID NO: 32605 - protein, 104 aa, Sorghum bicolor
  Clone ID: SORBI-28MAY03-C13961_1.pep
GCQRAALPTVAESRPHTSILPEALPPLRLHPTYPQSHGNGGGRKGKRGSRVGRGLTPACAALRLAPPGDFGHQIRPSSTSRRRSLKPKSSPSSGPKRRRRKFAS

SEQ ID NO: 32606 - protein, 236 aa, Sorghum bicolor
  Clone ID: SORBI-28MAY03-C13979_1.pep
ARDLIGMLQRIDGDNYPETLCRMFIINAGQGFRLLWGTVKSFLDPKTTAKIHVLGNKYQSKLLEVIDASELPEIFGGTCQCEGGCMKADKGPWKDPEIMKMVQSGAGRCGSHSMSSFEVEEKMICEDDMYPKKQALFDAETQLAGDGQRSQSQKISRSRIEHPQLSPLHEELMPTSHPIPGSPYSCDVPMVEKAIDAICKSQGTPADEKLAITKAIINASNESKPPIYAGIIALVM

SEQ ID NO: 32607 - protein, 145 aa, Sorghum bicolor
  Clone ID: SORBI-28MAY03-C14300_1.pep
HEAMFYYEGDQDKSVGKRLRTALIWVFASAVVCGLVLGILYGLVGKVDFTVRHLSSTVQTFPNSFSGFSSGQPCFSQLPRVCAASTAPANSQTTWTMRATFPEYVVALTTIVGSVLFTIFGGVGIACLPLGLIFSFIRRPKAVIT

SEQ ID NO: 32608 - protein, 140 aa, Sorghum bicolor
  Clone ID: SORBI-28MAY03-C14317_1.pep
MQIRVQCGCGESSCPEWAVVELQGVVQPQASFAGDIRGLHIGRLCSAPSPSSSSKAGYTFTVGYHELAGTKVTLKKPLLVLRKKKVYAGCGEQEPPAAAEEVELEVIGIIRHKILFKDRPKALISKPPTKEKKTVQPAAK

SEQ ID NO: 32609 - protein, 114 aa, Sorghum bicolor
  Clone ID: SORBI-28MAY03-C14343_1.pep
FPKAMATQCYKDEAEEELVEGRRRRRRRRRRRREGELHRSDDGFLTRSNDRCTTRVDRRDQPRHHHAPCTSLSLSLSLAFCHLPISLSLSPPIAAPAGPGPVRCRPSAEFLHGL

SEQ ID NO: 32610 - protein, 122 aa, Sorghum bicolor
  Clone ID: SORBI-28MAY03-C14358_1.pep
QYGGMYPPVQGNQPAGIYPQQMAGDVYQQQMFSGQMTGYGYGQQPGGYYVPNAAYAYASANDLSQRMNGLSMQDNSLYGTPAPSSLQQRNRPSRPEDSLFSDLVSIAKTKPSKSASNKAGNL

SEQ ID NO: 32611 - protein, 167 aa, Sorghum bicolor
  Clone ID: SORBI-28MAY03-C14370_1.pep
ARGRLVSHNRPALENATTTASAVLGDHDTAAGGCGHLLLLPGVVQRQAAAVAGHTAFSDPRSELTCNNNNKYDATWSVVVPRKRARIGGAVDAAGLVMEGHRHRALLPVPQAFAPGGGGEGALGGGSSSSSRVLCSGAASTSGRPSTVVPVSQSQHGILAHLYSHSF

SEQ ID NO: 32612 - protein, 187 aa, Sorghum bicolor
  unsure (1)..(187): unsure at all Xaa locations
  Clone ID: SORBI-28MAY03-C14378_1.pep
QTPAILFLYVISKLNGLGYLSLHILRETVASLQLRQWHIAHDYDGQARELNCKSICHSPMCPPYSAMTECQPIALSADKTHLVFETRPQVHDVSFGSFFEVHCRWSVKTISSSSCSLNISAGAHFKKWCIMQXSKIKSGAVDELKKEVKEMLDFAQGYMLKVRSPDQENSNLAQQDNMAPDAPPDLE

SEQ ID NO: 32613 - protein, 155 aa, Sorghum bicolor
  Clone ID: SORBI-28MAY03-C14391_1.pep
AFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGDGEVGMVKIDKDRSAGVSGAFSLDDEAEEDKRE

SEQ ID NO: 32614 - protein, 217 aa, Sorghum bicolor
  Clone ID: SORBI-28MAY03-C14430_1.pep
MDDKEKEKEKEKEKEKHADGTDVEEEEEDEEGNKRIVVLGPQVPLKEQLELDKDDESLRRWKEQLLGQVDTEQLGETAEPEVKVLNLTILSPDRPDLVLPIPFHADEKGYAFALKDGSPYSFRFSFIVSNNIVSGLKYTNTVWKTGVKVETQKMMLGTFSPQLEPYVYEGEEETTPAGIFARGSYSAKLKFVDDDGKCYLEMSYYFEIRKEWPAGTQ

SEQ ID NO: 32615 - protein, 181 aa, Sorghum bicolor
  Clone ID: SORBI-28MAY03-C1412_1.pep
EPTPMTHAMHELPKNSTSPTSDMDYVPCFFTSSYPYIHMYLVHVHVNLQDKLRFFYGSVPCRSDQDTATQAAMLLQTQISVCVLCVTPGSQEHDSPYGVLGGRAAAVSATTARFAGRPGRRCAGGAVGAPEFLTEGLLDLVSPGALPGLQLRGFHGWLWLACLCQKTKISYNTGCTRLSLV

SEQ ID NO: 32616 - protein, 80 aa, Sorghum bicolor
  Clone ID: SORBI-28MAY03-C14163_1.pep
MAETADMERIFKRFDTNGDGKISLSELTDALRQLGSTSADEVQRMMAEIDTDGDGCIDFNEFITFCNANPGLMKDVAKVF

SEQ ID NO: 32617 - protein, 145 aa, Sorghum bicolor
  Clone ID: SORBI-28MAY03-C14471_1.pep
FLAAPMAERFHDDWEVVPFNPNMELAEDPDARALVPANTERQLEAMPLRQRSSAQSYHAQPVLTAPLLLNGSSSKMKTTIKVPTGTRILPPRPNERVVGVKTNRSGEISSIRYTTEEERPYFEGIRADKVRFTPPTFADAWADAW

SEQ ID NO: 32618 - protein, 257 aa, Sorghum bicolor
  Clone ID: SORBI-28MAY03-C14492_1.pep
SFRHELTVLEKVRHPNVVQFVGAVTESIPMMIVSELHEEKDLSVCIQKKGKLHAHKVLRYGLDIARGMTYLHQCKPDPIIHCDLKPKHIFLDSGGNLKIAGFGVIRVSKIGPDKVRLINHGALVDSFSYHTAPELYRNDAFDSSVDAYSFGFILYEMVEGSVRTPEDSGHTIRFEGMRPPLKGKLKGYPPDFKALVEECWHPQAMARPTFSEIIIRLDKIYSHCQQQREAGRSRSSFGNDRHRWLAFVYVYISLQTR

SEQ ID NO: 32619 - protein, 145 aa, Sorghum bicolor
  Clone ID: SORBI-28MAY03-C14516_1.pep
MSHGANGRRLLSTLWSQITSTQGEDVLAHQQKLGVSPDDETDHAARRNLLSTELDSIASTSAEANRQLLAAEELPDELAGKRQLLSRTLMGIDEAATEAKRQLDEATTENTMSETFNRVLEGDHDTLFVHAQAVLQTAKWLGTVD

SEQ ID NO: 32620 - protein, 100 aa, Sorghum bicolor
  Clone ID: SORBI-28MAY03-C14541_1.pep
PNTQAIIYVVDSSDTDRLVTAKEEFHAILEEDELKGAVVLVYANKQDLPGALDDAAITESLELHKIKSRQWAIFKTSAIKGEGLFEGLDWLSNTLKSGSS

SEQ ID NO: 32621 - protein, 109 aa, Sorghum bicolor
  Clone ID: SORBI-28MAY03-C14552_1.pep
MKSSPWAGARRPAVVQLLLFLAHLVGRGGAAGGGSKGSSVYPAAVVYPHHSRQISWKPRVFLYQHLLSDDEANHLISLARAELKRSAVADNMSGKSTLSDVRTSSGTFL

SEQ ID NO: 32622 - protein, 173 aa, Sorghum bicolor
  Clone ID: SORBI-28MAY03-C14545_1.pep
QQVLYHWLCSPNPDFNEIMNWYKGWKGLFPPELLANERIRMLLTAGLDMMNQAAEGLEVVQPWARENVGYLRATEKRQFDAAQQAYHAAPGAAMADLSFKESIQAYAMEQGLLFMPRVGKFYNGMPVYEFGSVSICIDSVKRLLYAQLQDGVERWSAVTLTQLMDMNRMGRPH

SEQ ID NO: 32623 - protein, 111 aa, Sorghum bicolor
  Clone ID: SORBI-28MAY03-C14561_1.pep
RTRGNEFMTLLRNPLYLAVIFVIFLVGKAIWVQLDIASEFQNGFLPAILSLSTKFVPTIMNILKRLADEGQRPAASDRQREMELQPTNRSSYSSVTSAGSSSITATENGSE

SEQ ID NO: 32624 - protein, 141 aa, Sorghum bicolor
  Clone ID: SORBI-28MAY03-C14574_1.pep
LPSSLPSRKWVVDHMLSLGFSKSLSEWIGSNLKKDNDHVTWAFDLQAAIDMFSSYRERDYWALLEHPPKDLEIAIVQAEHSDRWVPDDVQRLKALARRESKTDIGKVSLHVLPNSGHWVHVDNPKGLLEIMVPNFLSAVQN

SEQ ID NO: 32625 - protein, 106 aa, Sorghum bicolor
  Clone ID: SORBI-28MAY03-C17407_1.pep
IFNEEKRLVTQGRSVQCTTAKCPEHQQALIHYVRKSSRESHDQAATSLGGHCAGWASEDRSVMDISFDLNLSAPSPSFPFSALEIGVFTVWGEGVSGMDWEIAIRD

SEQ ID NO: 32626 - protein, 133 aa, Sorghum bicolor
  Clone ID: SORBI-28MAY03-C14637_1.pep
MLSKYHEEGISVPVPAEEQNLVNRHRKAFLDNMSDDLKTTDVLDGEDGLTDLLKAINSNMNDLKKLQQKLEQQQKKQQQKKQQQKQQQTQKQPEDYIQGLIALETEIKDKLSVLGLMPPSSLSEVLNPLKDKA

SEQ ID NO: 32627 - protein, 189 aa, Sorghum bicolor
  Clone ID: SORBI-28MAY03-C14656_1.pep
LDNVVLNRLKQFRAMNQFKKAALRIIAGCLSEEEITGLKEMFKNIDKDNSGTITLEELKNGLAKHGPKLSDGELQQLMEAADADGNGLIDYDEFVTATVHMNKLDREEHLYTAFQYFDKDNSGYITREELEQALKEQGLYDAEKIKEVISDADSDNDGRIDYSEFVAMMRKGTAGAEAMNKKRRDIVLE

SEQ ID NO: 32628 - protein, 104 aa, Sorghum bicolor
  Clone ID: SORBI-28MAY03-C14658_1.pep
WSDANREGLINDVARKNYLQGYVTCLSKAVRNGANVRGYFVWTLLDNFEWTFGYTVRFGLYHVDYDTQERTPRMSATWYQGFLTAGNTSLVTHEDEAQARRADA

SEQ ID NO: 32629 - protein, 138 aa, Sorghum bicolor
  Clone ID: SORBI-28MAY03-C14676_1.pep
QAYGGDKNIIKFDGDHNSPRPQSYYDSVSIFFYKTLRPPMLPTTRSKLHVGAFKVGSITNESFFFEIINGLRSANTAACSSSRDAPNIPHDSTSVVELLSSMNQLSIKNENDLDFLLNENCSLSEIDGDSVGSRLQDK

SEQ ID NO: 32630 - protein, 99 aa, Sorghum bicolor
  unsure (1)..(99): unsure at all Xaa locations
  Clone ID: SORBI-28MAY03-C14682_1.pep
EKSDNKSSVSFYFSEHKYEIVKCLGAQKHICYIHIFRVYLCTILLTIFCLCAQFFLCLCMCTRWRASSLVSVYMGCGGLVAVASQMNTRFAVCXMNFSC

SEQ ID NO: 32631 - protein, 82 aa, Sorghum bicolor
  Clone ID: SORBI-28MAY03-C14699_1.pep
MSPQQQQRVAIVGEEYCEGEDRELTVRKTTLFTPGDGLEAYDHRNGALAFRVETYGRGGACGGGAARGDLALLGARGEPVLT

SEQ ID NO: 32632 - protein, 65 aa, Sorghum bicolor
  Clone ID: 30977557.pep
SQVPVPVVYKQYKAWLNLCLKPPKLHHRSQTTLFLYHHDLNFWPAEFKPYLVVVKQQTIMSVLPH

SEQ ID NO: 32633 - protein, 45 aa, Sorghum bicolor
  Clone ID: LIB3480-023-P1-K1-G9.pep
GRVGSKATSMAKNRGMYHTTLTSAIVSTRNITEVTEHPIIGANKY

SEQ ID NO: 32634 - protein, 193 aa, Sorghum bicolor
  Clone ID: SORBI-28MAY03-C14715_1.pep
KPSLDDIKKFADTVRINRNSVAQITGYFMTHFTDTVGSLQAANLTVFVGVLKNEFMNLGFDFFADPTIEVATYAYSVVADGIVTDYPATAASYFRSPCSDMKLNLSYSILPAQPGALVNLAAPGMLAPAGAPAPLLQPTDVVDPPLPPVKAVITADAPAPKAADNTSSAFSSNTANGLLWAGVVALLSLTFLH

SEQ ID NO: 32635 - protein, 142 aa, Sorghum bicolor
  Clone ID: SORBI-28MAY03-C14443_1.pep
AQQLSAVNWFFLGGAVAPLLVWLAHKAFPTQSWILLINMPVMIGATGMMPPATAVNYTTWILVGFLSGYVVYRYRRDWWERHNYLLSGALDAGLAFMAVLIYLCLGLENISLSWWGNDLDGCPLASCPTANGIVVEGCPVYT

SEQ ID NO: 32636 - protein, 108 aa, Sorghum bicolor
  unsure (1)..(108): unsure at all Xaa locations
  Clone ID: SORBI-28MAY03-C14428_1.pep
MSPIWVFGYGSLIWNPGFAYDARVVGFVRDYRRVFYQGSTDHRGTPQFPGRTVTLEHQPGATCWGVAYSIKEEDKEIAMEYVXLKVREKQYDEYLCILIHTSCRLCDV

SEQ ID NO: 32637 - protein, 152 aa, Sorghum bicolor
  Clone ID: SORBI-28MAY03-C14784_1.pep
EDDIFSEDDIPSEQSSFDSVDDGADSEYLSEENSEDSNDEVPCKESFAEPTEMEAMKVLSSKECFGAMEAVKASKECFGELRVPYTNGRTLPQPTSNCHVKTSAVTGTGLQELLALIDRKLTEQQTVVQRSDGPFDRKWRPSSMDGENAAEQ

SEQ ID NO: 32638 - protein, 149 aa, Sorghum bicolor
  Clone ID: SORBI-28MAY03-C14738_1.pep
VMLLQIITAKPPMGLSHHVGRAIERGALLDMLDPAVPDWPLEEAQCLAEMALRCCELRRKDRPDLGAVVLPELNRLRALGEDNMQYCGGAMIRGGGGGCGGGGGMYSSPFHSNIARSHAAEMMVDSQYPRSVFNSRASDSPKPPRRSNA

SEQ ID NO: 32639 - protein, 251 aa, Sorghum bicolor
  Clone ID: SORBI-28MAY03-C14790_1.pep
MADEKLAKLREATAGLTQISDNEKSGFLSLVGRYLSGDEELIEWAKIHTPTDEVVVPYDTLESPPEDIEATKKLLDKLAVLKLNGGLGTTMGCTGPKSVIEVRNGFTFLDLIVIQIESLNKKYGSNVPLLLMNSFNTHEDTLKIVEKYANSSIEIHTFNQSQYPRVVADEFLPWPSKGKTDKDGWYPPGHGDIFPSLMNSGKLDLLLSQGKEYVFIANSDNLGAIVDMKILNHLIHKQNEYWHEVPLKLWL

SEQ ID NO: 32640 - protein, 104 aa, Sorghum bicolor
  Clone ID: SORBI-28MAY03-C14796_1.pep
TTHIFGDLVLEFQAEQLMPVESKGDQSMSLHVKEGAMSFCCFCSEKLKEGKDIYIYQGDKSFCSMECRENFMVDEMEEGEPIIYHPASPRSPPSDGGRIFQLIR

SEQ ID NO: 32641 - protein, 131 aa, Sorghum bicolor
  Clone ID: SORBI-28MAY03-C14815_1.pep
AHAFAIAHRPPRRRPLLARRHRRARPGCGDKANPATMANSASGMAVSDECKLKFQELKSKRSFRFITFKINEQTQQVVVDRLGQPGDSYDDFTGSMPDSECRYAVFDFDFTTDENCQKSKIFFIFWSPDTL

SEQ ID NO: 32642 - protein, 152 aa, Sorghum bicolor
  Clone ID: SORBI-28MAY03-C14825_1.pep
DAWSEALLIGIVCMALILIFRDSFSIIFTSDATLQRAVAKIAGLLGLTMVLNSVQPVVSGVAVGGGWQGLVAYINLGCYYIFGLPLGYLLGYKFNFGVGGIWSGMLCGVTLQTIILLVVIWRTDWKSEAAQASTRVQKWGGKGTDEVNPLLQ

SEQ ID NO: 32643 - protein, 118 aa, Sorghum bicolor
  Clone ID: SORBI-28MAY03-C14858_1.pep
MMREMYMDVLPPVDHIAARSNWFPAAARLWTAEENKRFESALAGLDLCHPDWEKVAQAIPGRTVREVVSHFKNLQLDVQQIESGQVPLPVYGSGASSFTLQWDGNGGYGPGDFKHGYR

SEQ ID NO: 32644 - protein, 139 aa, Sorghum bicolor
  unsure (1)..(139): unsure at all Xaa locations
  Clone ID: SORBI-28MAY03-C14884_1.pep
PRVREIFHSVAKVALESVKTAVEQSKNIGEAKASDKMTDSAREDCKKLLEDAVDDLRGMLDMVGGDIKVLFSRSDNLXTWLTGVMTFMDTCMDSFVDEKLMADMHSVLHNATELSSNALAITNSLCGILKKLDLDMFKK

SEQ ID NO: 32645 - protein, 106 aa, Sorghum bicolor
  unsure (1)..(106): unsure at all Xaa locations
  Clone ID: SORBI-28MAY03-C14875_1.pep
GDTDGVKIKLIAEDHSVRGTLMCPPEEIMEEVXFARFXNXDGMCGNFTGGTWHTPNAKQIVEKECLGKPSCMLPVDHTVYGADINCQSTTGTLGVQVRCIGGKKGA

SEQ ID NO: 32646 - protein, 183 aa, Sorghum bicolor
  unsure (1)..(183): unsure at all Xaa locations
  Clone ID: SORBI-28MAY03-C14587_1.pep
KSSPFISALEVIDLADSMYNTTDFGRFVMSTVARNRFGSKRHIVXDDPYNRYWAPFADANPMVESHSDISPDDFWNQPPAKALKAGVTTSRGKKLTVQWPTTELPAATYYVALYFQDSRSASPFSWRVFDVAVNGKEFFRGLNASAAGVMVYSSMMQLSGKTEILLTPNETSPVGPLINAGEI

SEQ ID NO: 32647 - protein, 238 aa, Sorghum bicolor
  Clone ID: SORBI-28MAY03-C1459_1.pep
MSSTAARAVPPAAAAPPPLPRRLRPARCTAGAAAAETTATAGPTRVTTVSNRGDSLAICRVLNGMWQTSGGWGRIDRDAAVDAMLAYADAALSPRVRADHYGPAEDLYGMFINRVRRERPPEFLEEIKGLTKWVPPPVKMTRSYVEDNINRSRKRMDVAALDMLQFHWWEYSNPGYLDALKHITDLKEEGKIKTVALTNFDTDRLQIILENGIPVVSNQVQHSIVDMRPQQRMAELCQ

SEQ ID NO: 32648 - protein, 134 aa, Sorghum bicolor
  Clone ID: SORBI-28MAY03-C14620_1.pep
MGGSRRKLKRSRAKVRVGLPRRKPNEFKPAFELPEALAAAARGGAGWDAEGSVVKNYAAFGVVANPNLLGAHARGTPRLVQSASLQAPDVAAERAPVPEFEPIDTGSDLENDDLKSALGKRRGDGKSAPLQPLT

SEQ ID NO: 32649 - protein, 178 aa, Sorghum bicolor
  Clone ID: SORBI-28MAY03-C14945_1.pep
FARGFCHQTYINSGTVGQLEWSANYPKHAVSGNHQPIIEEPLSPEPEPENVEAKEGAIEDFFCEDPDEIPTINLNIEEFTQNLKNYMQANNVDIEYADMSKALVAITPDAASIPTPKLKNISRLRTEHQVYELPDSHPLLDGFEQREPDDPCPYLLSIWTPGETAQSTDAPKTFCDSG

SEQ ID NO: 32650 - protein, 203 aa, Sorghum bicolor
  Clone ID: SORBI-28MAY03-C14982_1.pep
QLSLLETSRIKKYFRSCPGAAFYARTELPSSMPNLESLSLSSATETINTPLMPSKFLHLKFLTIALRGQTYDCFSLLSFFDASPFLETFILNVLSSVHVKPASVFEDPSDLRKMPENHNDKLKCVRIINFSSAKSLIELTCHILESAMSLECLTLDTTHGAPRCSVTKHGRCWRMTRDEIMEAHRALLAVQTYVKSKVPSTVE

SEQ ID NO: 32651 - protein, 201 aa, Sorghum bicolor
  Clone ID: SORBI-28MAY03-C1497_1.pep
RRSARAPEPGSSSSRALAHGAAFNPFDVDTDPPPRPELSPDPRGLCSDALARFEDKGKRPDGLSDEYRKLSGIRHMKTISVAHYPVNRGKNRYIDVLPFDDTRVRLSARPPNNDYINASFIKATENNRVAPFISTQGPLVKTFGDFWEMVHEYQCPAIVMLTQFDSIKCDKYLPPESGRQKYGNYDIKITKTRTDSPHLQV

SEQ ID NO: 32652 - protein, 212 aa, Sorghum bicolor
  unsure (1)..(212): unsure at all Xaa locations
  Clone ID: SORBI-28MAY03-C15066_1.pep
NPLSHTTQTPAIPDSPSLSFPSRQAALPNLAQRRNEPSKPTPSPSTHVKLAAAARARTRTPRQQRNWIEATKTRAKKRGSRARNPRPAPRRARARRRRPRYIAARDLGHRGGKVSALRHRPTVPACCVDSXRIEPTRGAGSRPWRSCRPRSPPWRRRGRSSGAGTTTTTTTSSSAAPPWARSSPRPCRRRRSTTRRRSSSSRRGSTSSSTSP

SEQ ID NO: 32653 - protein, 205 aa, Sorghum bicolor
  unsure (1)..(205): unsure at all Xaa locations
  Clone ID: SORBI-28MAY03-C15068_1.pep
MSSSSLPPPPASPPTAAEDEARDWAEMPSDALAAVFAKLDVAEILLGAGLVCRAWRRLAASDPTLWRRVDMTYQGDQLQTEEVEAMARAAVDRAAGTMEAFGAETFVNDELLRYISQRAPSLKSLHLCLCHHVTNQGFAEAINGFPQLEELDVTFCSLNGSMCETAGRACPQLXCFRLNERWCILQSEVASYEGMDDDTGSIRDR

SEQ ID NO: 32654 - protein, 231 aa, Sorghum bicolor
  unsure (1)..(231): unsure at all Xaa locations
  Clone ID: SORBI-28MAY03-C15084_1.pep
ARGSDSALVAAAVLSDRYISGRFLPDKAIDLVDESAAKLKMEITSKPTALDEIDRAVLKLEMERLSLTNDTDKASKDRLSRLEAELSLLKDKQRQLTERWEHEKSVMTKIQSIKEEIDRVNVEIQQAEREYDLNRAAELKYGSLNALQRQLQMTEKELDEYQSSGKSMLREEVTQDDIAEIVSRWTGIPVSKLKQSDREKLLFLEXEELHKRVVGQDPAVKAVAEAIQRSR

SEQ ID NO: 32655 - protein, 197 aa, Sorghum bicolor
  Clone ID: SORBI-28MAY03-C15087_1.pep
TRVPVAATIRATMPPVGWSIPIFKKRIDGYIEEVPNPIWDYHKYIPYSKPGKVHDQIELYGTPKDLEDFCEKAQLVNYVQYRALLEGWTSFMWTKFTGVLIWKTQNPWTGLRGQFYDHLQDQTAGFYGCRCASEPIHVQLNLVTFFVEVVNTTADELKDMAVEISVWDLDGACPYYKVTEKIVVPPKKVKQTIEMRY

SEQ ID NO: 32656 - protein, 267 aa, Sorghum bicolor
  Clone ID: SORBI-28MAY03-C14716_1.pep
TRKERLKQLNQEIDMLRQLSHPNIVQYHGSELSDEALSIYLEYVSGGSIHKLLREYGPFKEPVIRNYTGQILAGLAYLHGRNTVHRDIKGANILVGPNGEVKLADFGMAKHISSFAEIRSFKGSPYWMAPEVLDGSHGYSLSVDIWSLGCTIIEMATARPPWHQYEGVAAIFKIANSKDIPEIPDSFSEEGKSFLQLCLKRNPASRPSAAQLMDHPFVQDHPAVRAAKSSVLRNAMSSSADGRHTMSNRELPSRKIITPLKDIALSM

SEQ ID NO: 32657 - protein, 107 aa, Sorghum bicolor
  Clone ID: SORBI-28MAY03-C14729_1.pep
RKRRRRCRNGLFWAVHPGGRAILDSYEATLGLEPGKLAASRHVLSEYGNMMGATVIFVLDEIRRRRRRRCEDDAKEKNCQWGVMSGLGPGLTIETIVLHATDRQDEN

SEQ ID NO: 32658 - protein, 245 aa, Sorghum bicolor
  Clone ID: SORBI-28MAY03-C15153_1.pep
QVHSRTAFSPSRDGSMLSQRHNRYEEMPDTWYKPYADKFRTCHSKLRSGDKEIPKRTPEGMSDYLKICSLHKRKRAVFMDDPSISPPMSENGPSLLSKNAGEFSNSTDELIPEIRFPSDCVPESAIPKTSGISRTYKIEVHGVLDNLPAPVNRNTAMLERFGMVPEYYKTGNKYRGKDGSRVEGKSLSQEQALLMTKKLVARYLANLRFESGTAVSIDILSEIIIKHICKLGRNLKLLTDSYRKQ

SEQ ID NO: 32659 - protein, 152 aa, Sorghum bicolor
  Clone ID: SORBI-28MAY03-C15176_1.pep
NVGLVGAIPANMAKLTGLRFLALDHNRLTGAVPAELAQLPSIGALYLNGNNLTGPLEFLAGFYQRMGQRFASWDNPGLCYNIAAVDVAHAPSGVVVCKDLQEPQRGKKPEASSSLVASSSSRGSSAKGRWALVPGGGQGMVAAVLGLLSRLL

SEQ ID NO: 32660 - protein, 100 aa, Sorghum bicolor
  Clone ID: SORBI-28MAY03-C15182_1.pep
MRTHFIRTATNVGGGGKAVYRASVQAPEGCNVTVQPRQLAFRRDGQRLSFTVRVEAAVAAAPGKRMEPGSSQVRSGALTWSDGRHVVRSPIVVTVQAPLQ

SEQ ID NO: 32661 - protein, 93 aa, Sorghum bicolor
  Clone ID: SORBI-28MAY03-C15228_1.pep
MAIIRGLKESGVFTNAVTSAKAQSKTKSSNTGFGNEAIQLNGTAGQSTLEGGHEKLQATVRKILEMVDAQEEAMPPMSPPGFLELTESATALS

SEQ ID NO: 32662 - protein, 215 aa, Sorghum bicolor
  unsure (1)..(215): unsure at all Xaa locations
  Clone ID: 30932702.pep
LKERIAVPNXSPPXRPRTRPRPTSHXLPPSSWGXSSXXSPPTPVGRPALPGQEARPPPPTTDXPRPPSPPTPVGRPALPGQEARPPPPXPTPSPSPPTPDXSTPVLPRPRRPTLGRATPSTPSPSTSPSPSPQTLQPNAXRRPAPHPRPTPSHDLRRVASTLDARRATPSPPTPQPKALADLRLIIARRPRTTPEPNLRWQPQPCDVLEAVNPAF

SEQ ID NO: 32663 - protein, 105 aa, Sorghum bicolor
  Clone ID: LIB3480-034-P1-K1-F4.pep
NLSPVKETKLIACSSKGKNGTVPNPRPRRPRTRPHPTSHLFLHRPGSSSTPSPPKSDGRPGLPGQETRPPPPTTDALALHPRPPPTPSPSPKAPTPDLRCQVWRV

SEQ ID NO: 32664 - protein, 186 aa, Sorghum bicolor
  Clone ID: SORBI-28MAY03-C15233_1.pep
ARGYYLMLDLQLGIRYTVGKITPVPLREVRSNDFGPRARIRMYFPTEGSQYTPPHHSVNFFWKDYCPMVFRNLREMFHIDAADYMMSICGDDSLKELSSPGKSGSIFYLSQDERFVIKTLRKAELKILLKMLPKYYSHVRAYDNTLITKFFGVHRITLKGGRKVRFVVMGNMFCTELRIHRKYDLE

SEQ ID NO: 32665 - protein, 117 aa, Sorghum bicolor
  Clone ID: SORBI-28MAY03-C15239_1.pep
MMPCKVEVAYDQVPVSSAEPCLSSFAPLSEICPSISNGNSMEDNHQVNPGIGMPMQGLPKRTGFDVVPCPDRDSVISRYKAKRKTRRFDRQVRYESRKVRADGRLRIKGRFAKANQT

SEQ ID NO: 32666 - protein, 205 aa, Sorghum bicolor
  Clone ID: 30977122.pep
MARRSAPLLRRLVSASSSPPAPQPLGGVLARRTVTYMPRPGDGAPRAVTLIPGDGIGPLVTGAVRQVMEAMHAPVYFETYDVHGDMPTVPPAVIDSIRRNKVCIKGGLATPVGGGVSSLNMQLRKELDLYASLVHCSNLPGLPTRHQGVDIVVIRENTEGEYSGLEHEVVPGVVESLKVITKFCSERIAKYAFEYAYLNNRKKVT

SEQ ID NO: 32667 - protein, 156 aa, Sorghum bicolor
  Clone ID: LIB3480-034-P1-K1-G2.pep
MARRSTPLLRRLLAPSPSPSPSTPLAGAAPRRTVTYMPRPGDGAPRGVTLIPGDGIGPLVTGAVRQVMEAMHAPVYFETYEVHGDMPTVPAEVIESIRRNKVCLKGGLATPVGGGVSSLNVQLRKELDLYAALVNCFNLPGLPTRHDNVDIVVIRE

SEQ ID NO: 32668 - protein, 168 aa, Sorghum bicolor
  Clone ID: SORBI-28MAY03-C14911_1.pep
MADDLPTSIYDITVKDIRGDDIDLSEYAGKVLLIVNVASKCGLTSSNYKELNVLYEKYREKGLEILAFPCNQFAGQEPGTNEDIQETVCSRFKAEFPIFDKIDVNGKDAAPLYKYLKSQKGGFLGDGIKWNFTKFLVDKDGKVVERYAPTTSPLKIENDIQKLLGTAS

SEQ ID NO: 32669 - protein, 153 aa, Sorghum bicolor
  Clone ID: SORBI-28MAY03-C14923_1.pep
MAARRSTSSTRRGLLPALLLILCSSLPHFAAAYRPGDIVPMLRSGQYHGSRTVWFDVVGRHCPAFAVNREVLMPIPKPTGFTGADPYKITFQIGHEKFHVPWLYVINRKTSEVPLIDFHLKYSGNDILGVTAKVVDMPHHYVEVHPDIKKNFW

SEQ ID NO: 32670 - protein, 111 aa, Sorghum bicolor
  Clone ID: SORBI-28MAY03-C15259_1.pep
GMCVLEMVTREVPYAECGSVVQIFHNVTRGVPPAALKRLKDPELRGFIERCIGQPRNRPSAAELLQDPFFNGIRGGDDDDALADACSVVAGAPAVPRPRSYVDDLAGLRLD

SEQ ID NO: 32671 - protein, 80 aa, Sorghum bicolor
  Clone ID: SORBI-28MAY03-C15265_1.pep
ALYRSIFDQCVSGPSSGQSSGISSPAHTKAITARTRRQPSIISSAFCSSKKLPLTLPHIGAPHWSQILGNTHFRTVILSH

SEQ ID NO: 32672 - protein, 161 aa, Sorghum bicolor
  Clone ID: SORBI-28MAY03-C15268_1.pep
RPGLQNRGTLFSTPAVPFRLMQLPDVYQVLLERYVKMQCPDCGLVPDEPALCLLCGKLCSPSWKPCCRSGKCQNHALQCGAGIGIFLLVRKTTILLQRSARLAFWPSLYLDAFGEEDHEMQRGKPLYLSQERYTALTYLVASHSLDRTSEVLRQTTISFYD

SEQ ID NO: 32673 - protein, 203 aa, Sorghum bicolor
  Clone ID: SORBI-28MAY03-C15406_1.pep
GPFFFFFFEMHKVAAACKQFDQEFTPYLLCVFEALLEVIRTACQSRGTYSYIQSDQSVAAVAAAEKRRQRRRRQKRHGVNGRGWRRHGIEARSLARQRLQTPIRRVREPIEKTKAGRRGAWNEARSPARPAHRARRRHLAKPTLVLIFPSYWLVSVAAFFSFRRPSNLFFPFPPRARLGGRKGEEGRRSEEQQRQLSIASPAG

SEQ ID NO: 32674 - protein, 83 aa, Sorghum bicolor
  Clone ID: SORBI-28MAY03-C15423_1.pep
SQLSCMHHGDVHKQVVIDRSWRWLWRASSRWRRRCRWSGRRPCLLLFPLRRCRHSPQAYKHLCRVCKKGFMCGRALSSHMRAH

SEQ ID NO: 32675 - protein, 111 aa, Sorghum bicolor
  Clone ID: SORBI-28MAY03-C15454_1.pep
PAGPGGLYAKSIDCSWRSYTRLRSLGSRLRFGSYVVCHHHAWRITARDRPTNVYIIPDDKHQARLASSSLIFSDQGAAARWSLRIRSGSGEMLQRSVIMVLSVLYKLECAD

SEQ ID NO: 32676 - protein, 145 aa, Sorghum bicolor
  Clone ID: SORBI-28MAY03-C15473_1.pep
MADPTPSQSPAQTPPPPPAQQAAAAGGREDMLACVAALEAALLPCLPARELQAVDRSLQSSHQIDVERHARDFMEAAKKLQSYFISLQREDQPTAEEMLRKEITTMEEELKTKSELIAKHKKLIEGWRKELKEQLGKHITELERV

SEQ ID NO: 32677 - protein, 63 aa, Sorghum bicolor
  Clone ID: 6676155.pep
KRACIYAALPSLSIPVAQAVTISCLHHTIHLRLLASCLTDVESQAFVFCCSSVSHLNHKLQVA

SEQ ID NO: 32678 - protein, 50 aa, Sorghum bicolor
  Clone ID: LIB3480-039-P1-K1-F3.pep
WIQSKLLVFKIKLDLVDLTCVVYSSLELLHSLSLLPAMKMFHATCNLWFR

SEQ ID NO: 32679 - protein, 167 aa, Sorghum bicolor
  Clone ID: SORBI-28MAY03-C1551_1.pep
MGQSQGRGRTKPETRHATREGERPEEQHQQRGDIARPDATAEEKGQSRPPGVPATTMDTFFLSHGSPTLSIDDKIPARHFFKSWVPAKVAGDQAPRAILVVSGHWETATPAVNVIRGSNDTIYDFYGFPKPMYQLKYPAPGAPDLALRTKELLEQAGFGPVKEDHSR

SEQ ID NO: 32680 - protein, 167 aa, Sorghum bicolor
  Clone ID: SORBI-28MAY03-C15517_1.pep
MIEDDATQQGEPQVRRRRGGRNQRRPGDPAAMAPRSSSATCLWLALAAAILALAQAQGGSSAADLEKVTAKTFFDIEIDGKPAGRIVLGLFGDTVPKTTENFRALCTGEKGTAKSGKPLSYKGSTFHRIIPGFMIQGGDFTNGNGTGAESIYDSTIFPDENFKLNHT

SEQ ID NO: 32681 - protein, 71 aa, Sorghum bicolor
  Clone ID: SORBI-28MAY03-C15124_1.pep
LDFAGTYGVLVLFGVFPAAMSWSERYSHELEAPVPPIVPGGKFTLSDVTGGALLVIVSEIFMDIMQLQGLH

SEQ ID NO: 32682 - protein, 139 aa, Sorghum bicolor
  unsure (1)..(139): unsure at all Xaa locations
  Clone ID: SORBI-28MAY03-C15098_1.pep
ASCYFLSKLVGKPLVFSLWPDKLMFFQKQVAKRREKLLNYMLFLRVTPTLPNTFINFSSPIVGVPYHTFFLATAIGLIPAAYVTVRXGIALSDLRSLNDLYDPHSIAVLFLIGLVSVIPTLLGKIETPSGTPDIVSCTI

SEQ ID NO: 32683 - protein, 84 aa, Sorghum bicolor
  unsure (1)..(84): unsure at all Xaa locations
  Clone ID: SORBI-28MAY03-C15147_1.pep
MSSAEDGYCSSDSPRAESPDEPLLPAAVADADAESPRAAGSGMNKRERDLSDLPASPSSPLPPAKRSRRSVEKRVVXVPLAECG

SEQ ID NO: 32684 - protein, 74 aa, Sorghum bicolor
  Clone ID: SORBI-28MAY03-C15531_1.pep
MGIASLTILIGELLLPFFLVVMEFICNMSCAFVCLLLHCYFFFSVLCSMPFCCIHIQMCKLYFCRIVPGIQCLV

SEQ ID NO: 32685 - protein, 166 aa, Sorghum bicolor
  Clone ID: SORBI-28MAY03-C15563_1.pep
MLHVRAHHPRRRSENLNMILAVGGEGRPFRTLHWPQNDRGVLVFIGQSQGHLHCLSGCTGNGSQMTELSIWVLEDYNAEKWVLRDNVSFSKLFGRMSGSFHLDWDVVAIHPDRNLVIFAEYWNSKLISYDMDEKKVHALCSLHGYPRYIIPYVPYFAESAAFAKKH

SEQ ID NO: 32686 - protein, 207 aa, Sorghum bicolor
  Clone ID: SORBI-28MAY03-C1558_1.pep
STTRPSTSSDESLSAPPCVVTFNTGVKIVSVAAGGRHTLALSDLGQVWGWGYGGEGQLGLGSRIRTVSSPHPVPCIESALYSKDRPSAMKGNKAAEGHVSKVLGNCVRAIACGGRHSAVVTDSGALLTFGWGLYGQCGQGNTDDVLSPTCVSSILGIKMQDVAAGLWHTVCTSVDGDVYSFGGNQFGQLGTGSDQAETVPKLVDATS

SEQ ID NO: 32687 - protein, 136 aa, Sorghum bicolor
  Clone ID: SORBI-28MAY03-C15564_1.pep
MGNCQAAEAANVLLQHPGGRVERLYWSTSAAEVMRANPGHYVALVTLRVAEERQDAPGGERRTVRLTRVKLLKPKETLLLGHVYRLITTQEVTKAVQARKEEKQRKAQQQLLGVEAGHAEGRARGGRRRGSLGRQP

SEQ ID NO: 32688 - protein, 148 aa, Sorghum bicolor
  unsure (1)..(148): unsure at all Xaa locations
  Clone ID: SORBI-28MAY03-C15596_1.pep
MAAASASLLHLATPTNSTHLVVRLPASQLPRRRPXGHASPPQPPRAYKVTIEHDGASRVVEVEEDETILSRALDEGLEVPHDCKLGVCMTCPARLVSGVVDQSDGMLSDDVVAQGYALLCAAYPRSDCTIRVIPEDELLKVQLATADD

SEQ ID NO: 32689 - protein, 118 aa, Sorghum bicolor
  Clone ID: SORBI-28MAY03-C15597_1.pep
GRLMNLSGKLVLVGGIGKQDRPGIIKGIGIWELHNKEWCEVARMPHKFFQGFGEFDDVFASCGADDLIYIQSYGSPALLTFEINHKSWKWSVKSPVSKRFPLQLFTGFSFEPRMDIAL

SEQ ID NO: 32690 - protein, 215 aa, Sorghum bicolor
  Clone ID: SORBI-28MAY03-C15647_1.pep
LKKNPAERPSAKELLKHRFIKNARKTPKLLERIRERPRFAGKSMDDTQNGQTHDEEEDFGTGTIKVNRTKDTAPSLSQGTVRKATVRDFPDRSEGTGTVRVVSRPPQIASTKDGRSDMPQSPKAPIRTTDRENQRKSSWTGSEDSLSQRDTQSERGRVESSTDDNDQSVSGSGTVVLRSPRASQLYSTASNHSTKPPSRFSSYEDMSNSGTVVRT

SEQ ID NO: 32691 - protein, 154 aa, Sorghum bicolor
  Clone ID: SORBI-28MAY03-C15644_1.pep
GEALDWEDLAKMKYTWRVALETLRLVPPMFGDFRRALQDVEFDGYLIPKGWQVFWVASVTHMDPGIFPEPARFEPSRFENQSPPCSFVAFGGGPRICVGMEFARIETLVTMHYLVRRFRWKLCCKKDTYARDPMPLPLHGLPIQLEHKVSPCVM

SEQ ID NO: 32692 - protein, 109 aa, Sorghum bicolor
  unsure (1)..(109): unsure at all Xaa locations
  Clone ID: SORBI-28MAY03-C15245_1.pep
TAFESNIASRSEKQVHGRVGSVWKASSAISSDSSFMDSMHTAIMXLDNLLQNSNESFLYTGKLVKHGGVPDSILDGWDLVEREVLPPPPSQVEDVAQWERAMYAGTKKK

SEQ ID NO: 32693 - protein, 76 aa, Sorghum bicolor
  Clone ID: SORBI-28MAY03-C15250_1.pep
VYCIWMLHLSIPVPLCSVKLYNVELRTQQYVGTYSLDQTHQISEKALLPTRPPHKFTLSFVRCSLVSPPPATAGRR

SEQ ID NO: 32694 - protein, 88 aa, Sorghum bicolor
  Clone ID: SORBI-28MAY03-C15709_1.pep
RTHLSPSSLVSPLCFLSHALCSSYYSYSRSPNPLPWIENLTSNHPHTTPSTTMVLSHSIPPLFRPLRAIYFGILALGGAGDAAPRCRA

SEQ ID NO: 32695 - protein, 216 aa, Sorghum bicolor
  Clone ID: SORBI-28MAY03-C15711_1.pep
PRVRRHLQDGDIVLVNRQPTLHKPSMMAHFVRVLPGERTLRMHYANCSTYNADFDGDEMNVHFPQDEISRAEAMNIVDANKQYIGPRSGDAVRGLIQDHIIGAVLLTKRDTFLTREEYSQLVFGSCMPSSNRGSRHPGKKVSAIEDYGTLELVRPAIWKPKPLWTGKQVITTILNHLTKGRPPFTVEQKGKIPKEYLKEGDPFAQEEKDSPAQQQE

SEQ ID NO: 32696 - protein, 212 aa, Sorghum bicolor
  unsure (1)..(212): unsure at all Xaa locations
  Clone ID: SORBI-28MAY03-C15719_1.pep
AIPTVQVPNEAGQKIKAYLTKTRGATATFVFKGAALNTPKSPMVAPFSSRGPNRRSRGILKPDLIGPGVNILAGVPSIEDVDQLRDAPVPRFDIKSGTSMAAPHLSGIAALIKHAHPTWSPAVIKSALMTTAEPTDNLRKPILDVDGEPATMLALGAGHVNPKKAMDPGLVYNMTAKGYVPYLCGLNYTDDKVSTIIYPEPXVSCANLSKLE

SEQ ID NO: 32697 - protein, 115 aa, Sorghum bicolor
  unsure (1)..(115): unsure at all Xaa locations
  Clone ID: SORBI-28MAY03-C15737_1.pep
MAGNRGELKLLGVWDSPYVNRVQIVLNLNGLSYEYVEEDLLNKSELLLKSNPVHKKVPVLIHDGKPIAESQVIVQYLDEVFAGTGPSVLPADPYGRATXRFWAAFVDDKVGSSWH

SEQ ID NO: 32698 - protein, 216 aa, Sorghum bicolor
  unsure (1)..(216): unsure at all Xaa locations
  Clone ID: SORBI-28MAY03-C15762_1.pep
HFAGFGISIPQESHNEASRLRDSPGHFFLFPPPSVCILTPPRRTSCGGSKWPSPSRRTSCGGSRWPTPSRRTSCGGSKWPGSSRCTGAGSYRRVAGEHAGSEHARRQPAGQCPTSSLRQPPTGVAGEAPGQRAAGRAGQHPAGDAGQHRGVAGAAADERDPGHHPGGAGPAAGEPAARGAGQAPGGAEPSAGEHHARDGGQPRRGAAXRLAGSPWG

SEQ ID NO: 32699 - protein, 117 aa, Sorghum bicolor
  Clone ID: SORBI-28MAY03-C15792_1.pep
MGEAPPPCVIVVPRRATAHSFRLPRHGRRKKVHVVRLGGGGGGEGRRYGRGLRLRRWLRRAAWRLAELCVAALSGQGLPGAPPRPSAAHHPPWTGVEPYFAAPFVPVARMKRAGAHA

SEQ ID NO: 32700 - protein, 178 aa, Sorghum bicolor
  Clone ID: SORBI-28MAY03-C15803_1.pep
LGGPTWNVQLGRTDSRTASQSAANANLPGPGSSAASLVAAFAAKGLSARDMTALSGAHTVGRARCVFFRGRIYGEPNINATFAAVRQQTCPQTGGDGNLAPFDDQTPDAFDNAYYANLVARRGLLHSDQELFNGGTQDALVRKYSGNGRMFANDFAKAMVKMGGLAPAAGTPTEVRLN

SEQ ID NO: 32701 - protein, 179 aa, Sorghum bicolor
  Clone ID: SORBI-28MAY03-C15823_1.pep
MDDATVASRQRQQQQPASPATTTKDSRDMMAELDAPLHALGFEMEELSPSRLTGRLPVTRICCQPFKVLHGGVSALVAEALASMGAHMASGYSRVAGVQLSINHFRSAALGDTVLAQAVPVHVGRSTQVWEVKLWKMDASTGEKGPQIAESRVTLLSNLPLSEKHKTAGDALKKYASKL

SEQ ID NO: 32702 - protein, 104 aa, Sorghum bicolor
  unsure (1)..(104): unsure at all Xaa locations
  Clone ID: SORBI-28MAY03-C15837_1.pep
QFWFLITEVYADPTHSSYDALELHLGCSXTFTPAAGLKIIQLYREGYRQDWELSFEKNTRTKGGWYQGGLIVAGPGIDNILYIHKDKEAGDDPDMEDVLRACCS

SEQ ID NO: 32703 - protein, 155 aa, Sorghum bicolor
  Clone ID: SORBI-28MAY03-C15864_1.pep
YLIGVSSEPSSYTDASTLPFLSLSGPEPSHAAVPVPVFWTRTTHSEQSLPIYTRDSQPPIYSTTMNGYGLRLKYLSMYLSIYTYTFTYITYTAPHFLTHRGNYKQRARGLRHCSSCTSVSSYISSCRSSSMTSSMVMIPTASSSSFSVGKGSLWT

SEQ ID NO: 32704 - protein, 114 aa, Sorghum bicolor
  unsure (1)..(114): unsure at all Xaa locations
  Clone ID: 9848084.pep
LSSFFSCKCCPSFNLPAPGRRHTLYVXFVFAECCVFIKQSQPPFYCNPFVLLAQASQTTWAYLIPKLRYQFAEFLLPSSLKRLRILISPTCVGLRYGLVRLKLRGFSWNHFRLV

SEQ ID NO: 32705 - protein, 62 aa, Sorghum bicolor
  Clone ID: LIB3480-049-P1-K1-D10.pep
QKCSSVETSPRVGTVDGQHLHEKKDDNQESISHSNKRHGVELEEIENVRMQSLQKKKKKKKE

SEQ ID NO: 32706 - protein, 234 aa, Sorghum bicolor
  Clone ID: SORBI-28MAY03-C15889_1.pep
MAGIYGEINGKKIYIGDERIMARSSCHQHAAAHQETDGLMKGVSMGLVICDGDLVGKFSLSDTCRTGAAEAILQLKSMGIKSVMLTGDSAAAAKHAQEQLGGVLEELHAGLLPEDKVRLIRELQTRHGATMMVGDGMNDAPALAAADVGISMGLSGSAAAIETSHATLMSGDILRVPKAVRLGRRTRRTIALNVASSVATKAAVMALAVAWRPVLWVAVLADVGTCLLVVLHSM

SEQ ID NO: 32707 - protein, 158 aa, Sorghum bicolor
  Clone ID: SORBI-28MAY03-C15912_1.pep
QPRKPMPNQANIITAQGRRDKRSVGGTVLHNCTIEPHPDFKADAGGKIATYLARPWKEYSRTLYIQNDIGGFIDPKGWLEWNGDFGLETLFYAEVDNRGAGADMSKRAKWGGIKTVTYEEAQKEFTVETFIQGQQFIPKWGVPFIPGLLPQEQQGRTH

SEQ ID NO: 32708 - protein, 161 aa, Sorghum bicolor
  Clone ID: SORBI-28MAY03-C15906_1.pep
MSLCGKQPVSNDILPEVPLNSHHGQTSENSRDSSFTGVTSNPTSFRTSNTSWGMADLSSPVPSTIGQTHTSSTVRKEMCAEAQTFPEEVLQEKSILTIKEFYSAKDEKEVALCMKELNAPSFYPSLVSLWITDSFERKDLERELLAKLLVYLCTAQEHLLS

SEQ ID NO: 32709 - protein, 147 aa, Sorghum bicolor
  Clone ID: SORBI-28MAY03-C19967_1.pep
MISISKNGKIFSETPFAVHEDNDIGSAHNGEQGDKQDIYQIGLILLEVITGKPTESQSQLESLKAQLSEALTEDPDRLKDMADPAIHGTFAVDSLSTVAEISLNCTAANPSDRPSAGGVLWNLRYSMQVQDGWASSDSLGLSVRSQA

SEQ ID NO: 32710 - protein, 108 aa, Sorghum bicolor
  Clone ID: SORBI-28MAY03-C20033_1.pep
MAAAAAEGLAAYRAVLRAARRTFAGDQLMLKESAVEIRRRFEDHRGLAPGSDEAARALADAREAAHFITHMIVQATRAPSGSFVVKPESVHAGATLEVPSEEILSKLK

SEQ ID NO: 32711 - protein, 188 aa, Sorghum bicolor
  Clone ID: SORBI-28MAY03-C16080_1.pep
SRFPGVKVCNSAPTIIGPPACASLAPTNASKTHEILVPGSTPSPKGRESIVPILVLGNSESAGIKRLNSTPRMTPEGQEFLSRGIASQSPVLHPVKRPGASSSAARPPIYPPGRGKSPYVSTGVRDSLSLSITPKRRYPPVPTAEPKQQGSPAADSTPTSNRPPQAMDAATKVHNAPTPITGREKASC

SEQ ID NO: 32712 - protein, 218 aa, Sorghum bicolor
  unsure (1)..(218): unsure at all Xaa locations
  Clone ID: SORBI-28MAY03-C16082_1.pep
MGSMAASSSLGSAKALACSHASLLAPQFQRPVVAPAPSRRTSVRMRASATAAPAEPKKTVWVWTESRQVMTAAVERGWSTFLFGSKDLGKDXTARINPLFIDGPEIFNGENQKVAVISQVSSPSELDRVQPENAEAENIVIDFRGDWQVIPAENIVAAFTGCKGTVLAGSTNSTEAQVFLEAXEQGXDGVVLKADDMDDIIKLKDYFDRRNEAKSQLP

SEQ ID NO: 32713 - protein, 59 aa, Sorghum bicolor
  Clone ID: SORBI-28MAY03-C16121_1.pep
EENIPYLCIDLVYQYTLLVDGFGVDPYQDITLVKKVPYGDSYVEAAWPLGSAIEVASSS

SEQ ID NO: 32714 - protein, 104 aa, Sorghum bicolor
  Clone ID: SORBI-28MAY03-C16125_1.pep
WQTYCSLFISPGQRCLILGLLSLERGVPVWYGYGLCYGARGVIPNFPVFKSNTLPLVGGIHFFLFQLFIPIIAHLLIQTLVHVFFRMVSICSPFGGSIIVIQAT

SEQ ID NO: 32715 - protein, 209 aa, Sorghum bicolor
  Clone ID: SORBI-28MAY03-C16131_1.pep
VLHSFLEYIYTGSTQIVEWLLTSVLELSSQFKVEPLVKCCKEIIDCLEVDKKLSDSGKILIKFPKSGLQDHRFDSSPLKAPLNVQKVGEFLANGEHSDINIYVNGHGLVSKGHKLILSLWSAPLAKMFTNGMRESSATDIFFGDVPPEPFFLLLQFMYYGKLKLDTRDTTSVLVQLLLLADQFAITVLQFECCKRIMECLSEVKFFSLV

SEQ ID NO: 32716 - protein, 104 aa, Sorghum bicolor
  Clone ID: SORBI-28MAY03-C16188_1.pep
AGKAAARPPAPHHHGGDTTTGGSGRSPKVVAARGDFASSNLSKPIKKQPQQQHAQRLLLRRSASDLGTRVVRNDHDAPPPPSPGVARGRPRVRRYKLLEEVITS

SEQ ID NO: 32717 - protein, 190 aa, Sorghum bicolor
  Clone ID: SORBI-28MAY03-C16162_1.pep
APEWQARPRRPVGSSSRDQDMLNNPAKMQELMALHQAQAQAQMFKRQCEQKEQGQSSSSEQRSGDMRPPMPPQGVPGQQLPSMGMIRPMQPVQGQVGMGSAGGGPITPAQFQAIQAWAKEHNFDLSNPANMSAISQLLPIWQANRMAAMQKQNEANMAAQQQAMPSQVNSDTPGHGNAPSQGALLKPRQQ

SEQ ID NO: 32718 - protein, 171 aa, Sorghum bicolor
  Clone ID: SORBI-28MAY03-C16194_1.pep
WELLYRSCRRTLASVLSTRPRLPPSMNSPTRLIEQVLPFARETVDLVLDGLASMPMIIPPSDLDEFSNFLKVMCQQARHWISGEGPMPSNLYSRESEHGDTWIWRFHNMSMDMLKRLDECLKTLEMDLSLSSESTGVMDSQTTWAARSHILVILTELDFISAIYEDVGHNL

SEQ ID NO: 32719 - protein, 71 aa, Sorghum bicolor
  Clone ID: SORBI-28MAY03-C15812_1.pep
RARAAVVLVERRLRLLLLLVVAASDVVEHLHLVQERVVLVDLQRRVRGRRRRHGGRQRDERVAGVVEEPRA

SEQ ID NO: 32720 - protein, 224 aa, Sorghum bicolor
  unsure (1)..(224): unsure at all Xaa locations
  Clone ID: SORBI-28MAY03-C15813_1.pep
VEAARATLDQVKVEDIDTNVAVLKELLFPLIEIGKRLLALAGWEEPFKSFVFLLCFLYMAYSGWIWFMFPGFLLGSTLFMLWNKHYGNGRSVEAFEIITPPRRRTVEQLLALQQAISQLEAHVQAGNIFLLKLRSLMLAAFPXEHQQSCSCTCRCGHVIHIHAIENHCSTDSSRRIHKTDAIEEKEQRKVGEKVKGVVAPDSGCACTTSKASGHXEMEIEIEIR

SEQ ID NO: 32721 - protein, 164 aa, Sorghum bicolor
  Clone ID: SORBI-28MAY03-C15819_1.pep
PDSPVHLCFAMNARPMLHASLPRGGAGFYGNCYYIMRVSAPAGKVAGSSVTEVVKIIKDGKRRMPAEFARWAAGEVGAAGVDPYQITSDYRTLLVSDWTRLGFAEVDYGWGPPAHVVPLTNLDYIATCILVKPWAHKPGARLITQCVTPDRVAAFHEGMLDTSC

SEQ ID NO: 32722 - protein, 100 aa, Sorghum bicolor
  Clone ID: SORBI-28MAY03-C16287_1.pep
IPHGRISLPPLGFLLSLFLSLILVDLGEEDPRQFRIPGETTTARLVLSATTRPQLYVSAGRGTSAPCTALLGLSVGKGTKITRPLHSWSPCWRFKHGIQL

SEQ ID NO: 32723 - protein, 128 aa, Sorghum bicolor
  Clone ID: SORBI-28MAY03-C16294_1.pep
ELAVQFSVYIQNRAAAIFKRDMKLCPIFSNLKTLVLNGWAVACELDALICFLQHAPILEKITLQLNGLNYDVEMRESCSSNEKIALPEHLKLVEVRCQKIAENVHRFVDVLNAYGITSDIINIVEMDV

SEQ ID NO: 32724 - protein, 110 aa, Sorghum bicolor
  unsure (1)..(110): unsure at all Xaa locations
  Clone ID: SORBI-28MAY03-C163_1.pep
YGAGLGMSRDDAVAMVLRCPALFTFSIERNFRPKFEYLVDAMGGGVEEXGGGPHYFAFSLEKRIAPRHRAAEDAGVALPLPDMLKATDEEFKEMLDKERELLQEQTATTD

SEQ ID NO: 32725 - protein, 64 aa, Sorghum bicolor
  Clone ID: SORBI-28MAY03-C16330_1.pep
KRAFSFSIALSKQEIAEDFAAIRGTRPPRRPKKRPRTVQRQLDLLYPGLCLADVAPGSYKIEER

SEQ ID NO: 32726 - protein, 143 aa, Sorghum bicolor
  unsure (1)..(143): unsure at all Xaa locations
  Clone ID: SORBI-28MAY03-C16360_1.pep
YAGIIALVMSIAAMVRVTRNMPGKVLGXAIGGGKPATLSESKSKIQERQQPKLSEEAVKEAEDAVSAKRLVELEEKVIALLTKPASMPVDKEDILQAAVNRVSALEEELAATKKTLQETLERQMEIVAYIEKKKKKSKRLFRW

SEQ ID NO: 32727 - protein, 174 aa, Sorghum bicolor
  Clone ID: SORBI-28MAY03-C16363_1.pep
TRMNFNKLVYAHYVERCPKSEPFFDPLAVDPRACTRKRAPKIVEAVLSLEQKVVSTAALSDAERFSQIPYFMEGSSSANDGHHAVAGNKRKHEALEVDEEDSIIAESEFLWRINFERFIFCLKKKFCAERKKAKMRLGTLAIWEAFFEANVTDNDNKTVTSPIDGILERVGQKE

SEQ ID NO: 32728 - protein, 172 aa, Sorghum bicolor
  Clone ID: SORBI-28MAY03-C16375_1.pep
TPLHRPASSVVGEIGKHSTLVYSFVARGTVVLADHAEVSGNFASVAAQCLQKLPTNNNRFNYNCDGHTFNYHIHDGFTYCVVATESAGRQLPIGFIERVKEDFFKKYGGGKGKTANANGLKREYGPKLKEHMRYCDQHPEEIDKLAKVKAHVTEVKGVMMQNIEKVLDRGEK

SEQ ID NO: 32729 - protein, 249 aa, Sorghum bicolor
  Clone ID: SORBI-28MAY03-C16409_1.pep
PRVRRSLQATANRMILSQEELEEVVLKRCWLARYWTLCSKLGIHSDIAEDKKEYWSSFAPRALEAVLSIGQKARDGTLSDNADMESRSKMSDVNDISSDGNVETMLSVEKGLRELASLKVEDAIMLTLAENRHIKPLSGQASEGRSPSESLELSADEREDVRFKQAWLTYFWRRAKNHNIEEDIADERLQFWIEQINHPVTTSDVIEVERGLHELKKLGIESHLWDATRKAQALDDDLSNHGSPTGSEA

SEQ ID NO: 32730 - protein, 78 aa, Sorghum bicolor
  unsure (1)..(78): unsure at all Xaa locations
  Clone ID: SORBI-28MAY03-C15962_1.pep
NISFTRLIRLLNFLPSLHLLVRICRFLFLYLRSRGCGRVSFCIGLLVGVGGHRRRGLRVXDLLHGLVSSLLRWSPTRP

SEQ ID NO: 32731 - protein, 187 aa, Sorghum bicolor
  Clone ID: SORBI-28MAY03-C16020_1.pep
RGAHRRSVSDSVAFLEAGPDDGNAGVGAHDFDRLDDDQLLSMFSDDLQPPPPPTTTTAQAAPVASSSSPSDHNSINDEKTDRGEAEEAQSKCHGDATADAAPASAAPVDPKRVKRILANRQSAQRSRVRKLQYISELERSVTSQQVTAIALFPRVGFLDHQRSLLTLGNSHLKQRIAALAQDKIFKD

SEQ ID NO: 32732 - protein, 185 aa, Sorghum bicolor
  unsure (1)..(185): unsure at all Xaa locations
  Clone ID: SORBI-28MAY03-C16064_1.pep
LLLITLLLKVIRLSAATQDVPRSVICNVHGVNPKFIEIGKLKHQELCQREQAFFKGAYYIGKMVWSKGYTELLHLLHKHQMELSVLKMELYGSGEDADEVKASAERLSLDIRVYPGRDHGDSIFHEXVFNRCPIPFHTFLTAAREAYVLGKIMICAYALSNDFFKRFPNCHMYSTEKEFVTLTMK

SEQ ID NO: 32733 - protein, 216 aa, Sorghum bicolor
  unsure (1)..(216): unsure at all Xaa locations
  Clone ID: SORBI-28MAY03-C16539_1.pep
RFFRLYFLERHRSLVLDTYLPRVRQLGRDVMVKNRQRKLFTNISTSQWSDGGYMRSAWSHVVFEHPKTFDTLAMDPVQKKRIKADLDMFKSGKDYYKRVGKAWKRGYLLYGPPGTGKSAMIAAMANHLDYDIYDIELTSVHTNTDLRKLFIETTSKSIIVIEDIDCSLDLTGAREKKRXAEEDDKDKKGGGPVRPGEKXDTSSKVTLSGLLNFIDG

SEQ ID NO: 32734 - protein, 285 aa, Sorghum bicolor
  unsure (1)..(285): unsure at all Xaa locations
  Clone ID: SORBI-28MAY03-C16559_1.pep
MAGGLRIAVPALTIAMQLKVLQCYFSLANKLLLCLAHYIYLTPSTVEDLERCNAMVGTEEDINNSKHHTAAKHGEPTKFFPFKQGYLAIATLRVGSEGIHMTVDGKHVTSFAYRAVNFFHITKWIIKXSDMRPILTNWCFSYXGLEPWYVTEVGISGDFKLVSAIVSGLPTSEDLENSNIEALKSPPIPDDKDVDLLIGIFSTANNFKRRMAIRRTWMQYDAVRQGAVAVRFFVGLHTNLMVNEELWNEAQTYGDIQVLPFVDYYSLITWKTLAICIYGMRSNPQ

SEQ ID NO: 32735 - protein, 80 aa, Sorghum bicolor
  Clone ID: SORBI-28MAY03-C16565_1.pep
AARKRKCIKSFIKKVDELWIKIIFSHISTGALRMNHFLFPFQGKENKNSNTRNSDPDPPTFFLFFYSKRAKAQAIFMHGA

SEQ ID NO: 32736 - protein, 145 aa, Sorghum bicolor
  Clone ID: SORBI-28MAY03-C16587_1.pep
RCPLSPLPARDRYPQFRVNKATKASATRLVLHCIGCRRPKHKCSIIFTVHTTFTCHRTTDRCKVREQTDVAIGMHNFSNQKFGGTGRADEPWLSVCTEACRAVHLQIPSFHPVVPAIRGADECRTVIPCIASVIWAFGLPLVLPA

SEQ ID NO: 32737 - protein, 94 aa, Sorghum bicolor
  Clone ID: SORBI-28MAY03-C16597_1.pep
LLKTGHSTMLQERPCNDARRMTSIGRLIIKRLQLHMIKLRRSFKLHPFRCLPPSQLLRRLLGDTLSPTGSGKHWRRGCSAISPMLLGVFAGWQR

SEQ ID NO: 32738 - protein, 103 aa, Sorghum bicolor
  Clone ID: SORBI-28MAY03-C16613_1.pep
LTYLESEKEYNYSQRVQQDMFLMDPRNYQDSTKVHAPVSTRELDHLICTYLWRNIPQLYIVQCEMVQITSHIQGVELEEAGGSDPCTAVYHSHVYQELLPSLT

SEQ ID NO: 32739 - protein, 88 aa, Sorghum bicolor
  Clone ID: SORBI-28MAY03-C16626_1.pep
LEYCSPNRALAFYRVFACIVVSGMFPFGIMKCSVLNYNSIIFFPAGCLMLHVPGTSEVIDFIGPKIKSDVSICPSITYQPVRPACYIT

SEQ ID NO: 32740 - protein, 62 aa, Sorghum bicolor
  Clone ID: SORBI-28MAY03-C16213_1.pep
TGLRESGHGSFTESVHIYQSNVLVGVNTAEASSISIVPFQLIRIRPFNFALLQVKPRPELFL

SEQ ID NO: 32741 - protein, 201 aa, Sorghum bicolor
  Clone ID: SORBI-28MAY03-C16276_1.pep
KLARDFHNYPALGGLVQTLMGYVVGGDSSNWVGVLGLPHYNMDDMPGVSFHVALHLAQIKRAKKFQMYDYGSPAANIEAYGTPEPLDLGAHYGLIDIPVDLVAGQRDRVISPSMVKKHYKLMRKSGVEVSYNEFEYAHLDFTFSHREELLSYVMSRLLLVTDPGKGRIKQPTMRLSRQKKAQSEIEKDMECRAKEESDELA

SEQ ID NO: 32742 - protein, 167 aa, Sorghum bicolor
  Clone ID: SORBI-28MAY03-C16654_1.pep
DQQQQQPPRLTMVADLNKAFIYFSRMMHSLHLVDNGGELMLVHRTIGQGKCREYDVYRLDFEAGILIPVKRLNGRAVFMGMQRTISVSAEAFPYVSADTIYLGYGCDRNTEEYNIADGSRYSRSRIYDGSVSPDTIVQSLICYCIKDKDILGTENAGHLSLLSKLTG

SEQ ID NO: 32743 - protein, 157 aa, Sorghum bicolor
  Clone ID: SORBI-28MAY03-C16720_1.pep
TFSSRMVGHDIFLLISSSLFCTFVQILDRRGKIELLVGKTETLQSQVELHLYVTPPGVGHQTLFFSVSTSPSSSPEQVDYRDCGLFQWEIGALLHHWVTRLTLLMKEVMLYSVGEKEIRLDGMQCLKRKRMKKIKNVEKHIKEKRSNNCVLKQSMVV

SEQ ID NO: 32744 - protein, 176 aa, Sorghum bicolor
  Clone ID: SORBI-28MAY03-C1673_1.pep
ELQDRVVSAAEMGSAEELLWVRKEIVHFHGEMVLLENYSALNYTGLVKILKKYDKRTGALIRLPFIQNVMQEPFCATDVLYKLVKECEEMLDQLLPGNQPSVPSEDDGKEDSDSDDKPAKPSASLANGNGTGDMELEEIEDMESMYMKSTVAALRALREIRSGSSTVNAFSLPPLW

SEQ ID NO: 32745 - protein, 82 aa, Sorghum bicolor
  Clone ID: SORBI-28MAY03-C16736_1.pep
LRMTNAALSRLLMRCLCDISRCVLHYRRKSSGISSGIFLSARITYSPAYFFQLEDRDEIRLFRLVKMMMLAYVLPFNGHMCL

SEQ ID NO: 32746 - protein, 215 aa, Sorghum bicolor
  unsure (1)..(215): unsure at all Xaa locations
  Clone ID: SORBI-28MAY03-C16753_1.pep
SRFRPASAFTAKCTTGGEGGLSYCITQFVXEKDCKLADTVIRGLIKYWPITNSTKEVLFLGELEEILLXTEPAEFQKCMVPLSHQIARCLNSSHFQVAERVLFFWNNSHFENFVKQNSKVILPIIFPALEKNINGHWNQVVQSLSLNVRKIFSDRDPQLFTECLRKYEEDKDREKEFKLKQELAWKRLDEIASAKITSGEAVLVSPTLPRQPSVL

SEQ ID NO: 32747 - protein, 225 aa, Sorghum bicolor
  Clone ID: SORBI-28MAY03-C16779_1.pep
FFSEMDDQLLDAICERLVSFLCPENTYISREGDPVNEMLFIIRGKLESSTTNGGRSNFFNSIILRPGDFAGEELLTWALLPKTNVHFPLSTRTVRSLTEVEAFALRAEDLKFVANQFRRLHSKKLQHTFRFYSHHWRTWAACFIQAAWRQHQRRKLAESLSRWESYSWWSEDHPSGDKPRQEGTSSGGTRTIAEGAIAHMHKLASASRRFRTEDIAIRRLQKPDE

SEQ ID NO: 32748 - protein, 319 aa, Sorghum bicolor
  Clone ID: SORBI-28MAY03-C16842_1.pep
LPPTHWQDLCLQGFLNRSQSGPAILIPDAAIDMSGNLVQDLYSKSDMRLKQELVGQQKSKASLTDHQLEASASGTSYGLDGGENNRQQNFLAPTFGLDGDSRNSLLGGANVDNGFVPDTLLSRGYDSQKDLQNMLSNYGGVTNDIGTEMSTSAVRTQSFGVPNVPAISNDLAVNDAGVLGGGLWPAQTQRMRTYTKVQKRGSVGRSIDVNRYRGYDELRHDLARMFGIEGQLEDPQTSDWKLVYVDHENDILLVGDDPWEEFVNCVQSIKILSSAEVQQMSLDGNFAGVPVTNQACSGGDSGNAWRGHYDDNSATSFNR

SEQ ID NO: 32749 - protein, 172 aa, Sorghum bicolor
  Clone ID: SORBI-28MAY03-C16838_1.pep
SKSKIPKRIVDVGCGIGGSSRYLARKYGAECRGITLSPVQAERGNSLARSQGLSDKVSFQVADALAQPFPDGQFDLVWSMESGEHMPDKSKFVNELVRVAAPGGTIIIVTWCHRDLREDEDALQPREKEILDKICNPFYLPAWCSAADYVKLLQSLDVEDIKSADWTPYVGP

SEQ ID NO: 32750 - protein, 196 aa, Sorghum bicolor
  unsure (1)..(196): unsure at all Xaa locations
  Clone ID: SORBI-28MAY03-C16423_1.pep
SSILDCVSNIMRHARQANIPTVVDGDGLFLVTNNLSLVEGNPLAILTPNVYEYKRLVQKVLNCDVDEETASEQLITLCQKIGDVTIMQKGKADVISDGKTVTQVSTFGSPRRCGGQGDILSGSVAVFASWARHFVLTNEQPTEKRVNPMTLGCIAGSLLHGKAASHAFEKSLXSTYTSDIIEFLGKSLEDICPAEH

SEQ ID NO: 32751 - protein, 55 aa, Sorghum bicolor
  Clone ID: SORBI-28MAY03-C1650_1.pep
QKMLNQHSRMRIQHQNMVVYATQPDGTYCSNIMLANVTYTINLTGKNQHHAKLRC

SEQ ID NO: 32752 - protein, 112 aa, Sorghum bicolor
  Clone ID: SORBI-28MAY03-C16489_1.pep
MRSQVILVVVTLALLGVLAALPLGEGSSWPCCDNCGVCNKKFPPECQCNDISARGCHPECKKCVKNKFTVPPGGGPGPVVTYTCADVLTNFCQRRCTPAPAPPPKAFVGGVF

SEQ ID NO: 32753 - protein, 96 aa, Sorghum bicolor
  Clone ID: SORBI-28MAY03-C16925_1.pep
AGGLRNELGHRSDGETIEWLLRQAEPSIIAATGTGVTTEEAPSVLVPVSSVAATASMTPVSYSYYTALLMQPPTAKESPPASAYVSGTAAEENNNN

SEQ ID NO: 32754 - protein, 114 aa, Sorghum bicolor
  Clone ID: SORBI-28MAY03-C16931_1.pep
MANGGGYVWALAAGFNAGLAAISAKFFATLLLKYGMVIAFNVTMWGCYVNSLKALSSLQATVTNFAANFISSGLAGYFLFEEPLPSKWFAGASLIILGVFVLSKSSIEEKPNTD

SEQ ID NO: 32755 - protein, 64 aa, Sorghum bicolor
  Clone ID: 30974851.pep
MPWRCNVQGVLGSGVTFYLQSWSISVRGPLYSAMFNPLCTVITTVFAAAVLREELHVGRFVICM

SEQ ID NO: 32756 - protein, 122 aa, Sorghum bicolor
  Clone ID: LIB5047-008-R1-XP1-D7.pep
RPGRGTWCCGAKRATPRGGGCRTRSQSSTRTTTWRRRRRGRIRWSTSAMASPSPSWPAAIQRRSRGDFLLLSVLCVRRVSGSSLCYWRSACSPIFFGHVQYSSSFEMAGWWSLVKKKKKKAP

SEQ ID NO: 32757 - protein, 110 aa, Sorghum bicolor
  Clone ID: SORBI-28MAY03-C16975_1.pep
DPAFSAASQKASGYSDDGHEQVPSLEAGRVDVVAGGRPGKRGGVWSTGAGALGFDKATPASVVAVPTQGFVREMSWNSDSDSDVFAVPEFPHPPPAKKAQPAPASTFWCF

SEQ ID NO: 32758 - protein, 93 aa, Sorghum bicolor
  Clone ID: SORBI-28MAY03-C17017_1.pep
RPGRGPQARTPVRPVLAFLFHFFKNSPLHLGLEPRSLGSFSFSSPLSLTHHRAGFGKPQSSIALTDTTAKQDREKLRDISCWSRRTSHIGMCA

SEQ ID NO: 32759 - protein, 68 aa, Sorghum bicolor
  unsure (1)..(68): unsure at all Xaa locations
  Clone ID: SORBI-28MAY03-C171_1.pep
QPNVQAFLVPRSNQKLAFKFFNSFXVLDKIGVFAYKLDLLATSFIHPVFHVFKLKTSAPTLHTISMLP

SEQ ID NO: 32760 - protein, 133 aa, Sorghum bicolor
  Clone ID: SORBI-28MAY03-C17066_1.pep
MAEGTATIRTRKFMTNRLLARKQMVVDVLHPGQASVKKADIREKLAKMFKVTPDVVFCFGFRTNFGGGKSTGFALIYDTLDFAKKFEPKHRLARHGLFEKKQQTRKQRKERKNRMKKVRGTKKSKVGQASGKK

SEQ ID NO: 32761 - protein, 123 aa, Sorghum bicolor
  Clone ID: LIB5047-010-R1-XP1-B9.pep
MPKAASTPKSAAGKPLHKFYVDYSVPAGDNVFDPASFEKFLHDRIKVDGKPGQLGEAISLSREGNKLVLTSSIPFSKRYLKYLTKKHLKKNNFENFLRVVATAKDTYSLRYFKVDQDEAEEEE

SEQ ID NO: 32762 - protein, 121 aa, Sorghum bicolor
  Clone ID: LIB5051-006-A1-XP1-F3.pep
MPKAAASKTAPKAVRKFYVDYSVPANDNVFDPASFEKFLHDRIKVDGKPGQLGDAITLNKEGNRLVLTSNIPFSKRYLKYLTKKHLKKNNFENFLRVVATSKDTYSLRYFKVDQDAEEDEE

SEQ ID NO: 32763 - protein, 95 aa, Sorghum bicolor
  unsure (1)..(95): unsure at all Xaa locations
  Clone ID: SORBI-28MAY03-C17212_1.pep
MSCCGGXCGCGSGCKCGTGCGGCKMYPDMPEQQVTTTAKTPVMGVAPSXQGHAQGGFQAAAGAGAENDGCKCGPNCSCNPCTWQVSCIITPCTAL

SEQ ID NO: 32764 - protein, 124 aa, Sorghum bicolor
  unsure (1)..(124): unsure at all Xaa locations
  Clone ID: SORBI-28MAY03-C16638_1.pep
LGPSXYGPVVTSLRXPQAWLEFMMKFELGLEKPEPRRALVSAATIALSYVAGGLVPLLPYMIVPEAGRAMAVSVAVTLAALLFFGFVKGRFTGDRPFFSAVQTTVVGALASAAAYAMARAVQSI

SEQ ID NO: 32765 - protein, 241 aa, Sorghum bicolor
  unsure (1)..(241): unsure at all Xaa locations
  Clone ID: SORBI-28MAY03-C16640_1.pep
LVHQPSGDVFELFHGLCLLAAGRTVFFGTISDATEFFTLNGFPCPHLRSPSDHFLRTINKDFDEETVESSKTQRKTAAEAIEILATAYRSSDYIEKTTNQIVEMKNMDGASFRRREQASFATKLLVLTRRSFLNMHRDIGYYWMRLGIYMGIGVCLGTIFYQVGYSYSSIQSRCSVIMYTVALLTFMSIGGFPSFVEDVKVFRKERLSGHYGVSEFVISNTLSATPYLSGIAVLPGAMXYY

SEQ ID NO: 32766 - protein, 80 aa, Sorghum bicolor
  Clone ID: SORBI-28MAY03-C1665_1.pep
SRSRTSVARHRPTAAVPAGAAASAARGGWRGRWWPVHHQPQLLSEAATLLSAIVLTLVVQTSWAPPALAHFHPTANAAGT

SEQ ID NO: 32767 - protein, 190 aa, Sorghum bicolor
  Clone ID: SORBI-28MAY03-C17290_1.pep
MKLKQLEGLLGGLTQFPNPKVELEQYPTGPHIASRMLYTAENSFDDITGKVVADFGCGCGTLAVGSALLEAEHVLGIDIDPQSLELAQENAADLELDIDLVWSDIKNLNLKGVHVDTVVMNPPFGSRRNGADMEFLSMGLKVASQAVYSLLKTSIREHIKMLALRCCNARSAEVLCELRYGLPQTYKFHK

SEQ ID NO: 32768 - protein, 170 aa, Sorghum bicolor
  Clone ID: SORBI-28MAY03-C17285_1.pep
RAARRRGPRRSPPRRSYPAQGARSPAHRRRPHMAQPPVSSKDAPDLPAAREQRVVVANKHGENLMGILHHAGSNKVVVLCHGFAACKDDSIMIDLAAALTKKGMNAFRFDFSGNGESEGEFQYGNYRKEADDLHSVVSHLYQKYDVTAIVGHSKGGSVVVLYASIYGDGP

SEQ ID NO: 32769 - protein, 208 aa, Sorghum bicolor
  Clone ID: SORBI-28MAY03-C17327_1.pep
MASPLPAPSSATHRRRSRPPSSPPASSVGSSAAFPPPKKRRSEPPPPLLGLACYDGFYPAMEPHPSAKHAIALARKADFEYYFVPPVPKEEAWGWFPLDARDGRVLVQSKYFPDDFHRPRFMNYAVCDPLFKRYVLLPPIPDDLTVNEGSLLNFGLCLAPSQEDEVDTSFRVICVAGYETKLVVFVFYSVTRKWGIATSSNWSFLGTE

SEQ ID NO: 32770 - protein, 92 aa, Sorghum bicolor
  Clone ID: SORBI-28MAY03-C17332_1.pep
MDGATAAGGSREPAANGSKPEEQQFDPSRMIGIVKRKALIKDLAMAYQAECIASCKELLQLQRKWEEEQHIEAKMPEEPRSLMIKTSKHRKK

SEQ ID NO: 32771 - protein, 142 aa, Sorghum bicolor
  Clone ID: SORBI-28MAY03-C1737_1.pep
DRFRHDSQNVRAGYIVQLAGSFRLLACFVLPCFLADAGYKVFWYCANAPFPPWWSAAACALEMASWMYRTAMFFMACVLFRTICYLQILRMTGFARDFGQCADVAAVLRQHRRIRVQLQRISHRYRRFILYSLILVTARTRG

SEQ ID NO: 32772 - protein, 223 aa, Sorghum bicolor
  unsure (1)..(223): unsure at all Xaa locations
  Clone ID: SORBI-28MAY03-C17384_1.pep
MEYVNPLTGFRVDGRRPNEMRQLKGEVGIVARADGSALFEMGNTRVIAAVYGPREVQNKGQQVNSNEALVRCEYRMAEFSTGDRRRKPKGDRRSTEISLVIRQTMEASILTHLMPHSQIDIYVQVLQADGGTRSACINAATLALADAGIPMRDIVTSCSAGYLCSTPLLDLNYLEDSAGGSDVTVGILAKMDKVTLLQMDAXLPMDTFENEWDLXEGCKAIAS

SEQ ID NO: 32773 - protein, 161 aa, Sorghum bicolor
  unsure (1)..(161): unsure at all Xaa locations
  Clone ID: SORBI-28MAY03-C17388_1.pep
MWVEILCGLLAYKIIQRVFFAGGDDASYLADLDSSHSDLCFAVASRLEKLYAGRCFVGLRIPDPDAGERQHIDVVLVTKREVMVVAIKNFSGFVEADKDGNWSCPTDKKRKQEIFPNPVLEVNRLVASLQSYLEQRGAKLPDGHIXGRVVLPNPNCRPSYT

SEQ ID NO: 32774 - protein, 182 aa, Sorghum bicolor
  Clone ID: SORBI-28MAY03-C17396_1.pep
MAAQNDPAASPMVYPVYLTGAFPQQAGDDQAQGPGIYAIQQNQLAAAMGMGCFAPTTLIPLTYKIPTESVGGPAGEENVQDARQQNGPQRQVVVRSFHFAFQLDLALIIKLAAVVFLFSQEGSKQRLFLLILFASLIYLYQTGAITPFVRWLQRAGGAAARPPQAPARAENRAPLPAQNDGN

SEQ ID NO: 32775 - protein, 111 aa, Sorghum bicolor
  Clone ID: SORBI-28MAY03-C16852_1.pep
MDQQGMDDHEGVHVVGFEVPPSPDSSYNNPIPGNEDEGREPPLVPPHLQHTLLSFPPSQDESSPLPQPQTVVLNHLYIEKENTRSVVALGITHRFKAKFVTVVLYKPVLRR

SEQ ID NO: 32776 - protein, 62 aa, Sorghum bicolor
  unsure (1)..(62): unsure at all Xaa locations
  Clone ID: SORBI-28MAY03-C1686_1.pep
TMFSGKIFIKNLFLLFMNKFISLVILLSLLYKFYGSLCVIIECYDXYFMIFGVLQLYYVIYV

SEQ ID NO: 32777 - protein, 181 aa, Sorghum bicolor
  Clone ID: SORBI-28MAY03-C17418_1.pep
MPRLLVVLLLLALSLVACVSAVPAVIRMVPADPTAASSGAVDDADALFCDSWRLSVETANAGPWLAVPARCGDSVRDYMEGPRYASDSAVAAADALAFASDALAAAAEWGGSASARPAWVFDVDETLLSNAPYYAVNGWGLQEFNETSFDEWVDAAKAPALPSSLNLYNQLQGLGFHVILL

SEQ ID NO: 32778 - protein, 75 aa, Sorghum bicolor
  Clone ID: SORBI-28MAY03-C17442_1.pep
RPGRVTFATIMTTRQLVSILLSCIWFVHPLSWMQWVGAAIVFGALYTKSFLRSKPQKPAVASPPRGSSPNPVNNS

SEQ ID NO: 32779 - protein, 181 aa, Sorghum bicolor
  unsure (1)..(181): unsure at all Xaa locations
  Clone ID: LIB5048-005-R1-XP2-A7.pep
QYNQALPQXFRNRQIQPQCMQLGMSQSQSNQGTQLPRHLGXFTGAANSTMFTAAQEEIESDTYQNPAPPQVRCWRCWMRWSTARGHTTIILDMPAQLRCRSSAAPPNTSAGPVKAHRRSSTPEIRCPLQHLARPVGRKELAAAACEGQDTVRPSGGRACVMPREKVRRGAASGEEGGAASP

SEQ ID NO: 32780 - protein, 153 aa, Sorghum bicolor
  Clone ID: LIB5049-003-R1-XP1-C6.pep
ISYSLPYVCPSLVTSAASSTEVSVYLYFSQNPAPPQVRCWRCWMRWSTARGHTTIILDMPAQLRCRSSAAPPNTSAGPVKAHRRSSTPEIRCPLQHLARPVGRKELAAAACEGQDTVRPSGGRACVMPREKVRRGAASGEEGGAASRVSRPGR

SEQ ID NO: 32781 - protein, 87 aa, Sorghum bicolor
  Clone ID: SORBI-28MAY03-C17445_1.pep
PPGGAGGGDCRYPQQASGAPPPPPGSSAAVAPASGCCARATHRWPCRSTTRARARSREGEVRGKISWALVAAALLTVWWVPARPASS

SEQ ID NO: 32782 - protein, 163 aa, Sorghum bicolor
  Clone ID: SORBI-28MAY03-C17468_1.pep
MASDSLETARQLLEVTYTTEAEATAEAEQLPSLPSGFYDAFVLRGIRVVQALQPGTLLCHFTVPSRLLNSGGFLHGGATASLVDLVASAAFATAGLRTRGSPLEMNISYLDAAFADEEIDIEAKVLRAGKAVGVAVVELKKKSGKIIAQARYSKYLGVASSKL

SEQ ID NO: 32783 - protein, 94 aa, Sorghum bicolor
  Clone ID: SORBI-28MAY03-C17527_1.pep
MASEDSKDMLKNVDWKTVGGAVTTESSQPVVKKRLPKKIRQVPECYFLPRRSLPSALAIYGAVCAAGVGAGMLIEVWINKKIKEDSAIIWEMDK

SEQ ID NO: 32784 - protein, 150 aa, Sorghum bicolor
  Clone ID: SORBI-28MAY03-C17561_1.pep
AQKAGGWLGPEGGTLPRGSKSPTPSGGDATKGGGWLGPEGGTLPRGSKSPTPSGGDASKGGGWLGPEGGTLPRGSKSPTMPCGIAESSYGCASASIIKSVDSSVSATTTTIGDAVAPMILFLLLAMSSLRFFSSSVFVDQANGSTPGPAG

SEQ ID NO: 32785 - protein, 174 aa, Sorghum bicolor
  Clone ID: SORBI-28MAY03-C17588_1.pep
MASSPPPPPPPLQEEEQEQGREEEHRHGAGGGDDDQITTPLLLVEATTSTSRSSPAGDEHYSDDLSSSEGENSPIEQVALTVPVGDDPTTPVLTFRMWVLGTASCALLSFLNQFFWYRKEPLTITAISAQIAVVPLGRLMAAALPERAFLRGTRWEFSLNPGPFNVKAAVIIPI

SEQ ID NO: 32786 - protein, 136 aa, Sorghum bicolor
  Clone ID: SORBI-28MAY03-C17214_1.pep
ELGGVHSILHVSIRCGSFSTLLHTALQLAVTSAALALYSFLHPSSQDFMSGTLSNWVHLPKHVTLSKNTKSERWLRAHDSLQLLLIVGSFLSAQLVMQKSSAAFFASSLSSASAMSGMTTSVRDNMKNVVANVFIF

SEQ ID NO: 32787 - protein, 158 aa, Sorghum bicolor
  Clone ID: SORBI-28MAY03-C17241_1.pep
SPPSAEASCASAFVTRPAPAVSVAASSSSRLERRPYARASTLAWKRAALEMRSLIPALPWFLRRDSCVRLVKYSSTSPTVKCAVAVDAASSRSISRPRHNVVVAAAVDDLRIITGVVVIPYLLAQQLLDDRLLFRSDPARKSPLAACACYDELIEASS

SEQ ID NO: 32788 - protein, 166 aa, Sorghum bicolor
  unsure (1)..(166): unsure at all Xaa locations
  Clone ID: SORBI-28MAY03-C17632_1.pep
MATEEAAKPSPIPPYPEMILAAIGGLGDKNGSNKSAISKFIEDKYGDLPPAHASLLTAHLARMKESGELIFLKNNYFRADAPDAPPKRGRGRPPKARDPNAPPPPPKSPASAGTGRGRGRPPQAKSALDAAVKQATAXMPKARGRPPKKAKTSEDGASPDPRPCPP

SEQ ID NO: 32789 - protein, 172 aa, Sorghum bicolor
  Clone ID: SORBI-28MAY03-C17670_1.pep
MEKALTKLGSFTISRKAKQELSAIGGDISRLSSTVEEKAKWVFEKLKGHKKSLSDLLREHNLPPGLFPRNIICYEYDESTSKLVVHLSKPCEVSFKDSSTIRYAPRVKATLSRGKLSGVEGMKTKVVVWVKVASVSLESYKSDKICFIAGVKKLRQKDAYEVPREAVSGEEF

SEQ ID NO: 32790 - protein, 192 aa, Sorghum bicolor
  Clone ID: SORBI-28MAY03-C1771_1.pep
AYASVCNCWTRRVRLVAVKVESLSGFTNSLLTPHIFPQIILNDPVEKYMVPFQESRPLPADLILRKAVMRFLKDRAVPLVDDWGGCVGIVHRDDCTKLDAPLLSMSRGPPLCVPTSTTVEHVIDLLLREKSEMVIVVKSGNMFEGSYTSSSRPLGIFSLARIWSFTGDYDWSESDIPDDAGTSWATRPKQDT

SEQ ID NO: 32791 - protein, 260 aa, Sorghum bicolor
  unsure (1)..(260): unsure at all Xaa locations
  Clone ID: SORBI-28MAY03-C17787_1.pep
PAGPGDQFPKWFPIERXTYLDRLSLRFDKEGQPSQLAPIDFFVSTVDPLKEPPLVTANTVLSILAVDYPVDKVSCYVSDDGAAMLTFEALSETSEFAKKWVPFCKRYNIEPRAPEWYFQQKIDYLKDKVAASFVRERRAMKREYEEFKVRINALVAKAQKVPEEGWTMQDGTPWPGNNVRDHPGMIQVFLGQSGGLDCEGNELPRLVYVSREKRPGYDHHKKAGAMNALVRVSAVLXNAPYLXNLDCDHYINXSKAIKEA

SEQ ID NO: 32792 - protein, 186 aa, Sorghum bicolor
  unsure (1)..(186): unsure at all Xaa locations
  Clone ID: SORBI-28MAY03-C17801_1.pep
LGWLGFGQAAVLLPVHLRLSELKRFSFPRSKVVVDGRVVNKAGTQVSDKSVIEIKAEIPKYXGHKLEAAIKGFDIDCEGKIALDSGLSTGGFTDCLLQHGASHVYGVDVGYGQVAEKIRTHERVSVIERTNLRYLSQLPEPVDLVTLDLSFISILLVMPAVIKVMKPDSILITLIKPQFEARRSQV

SEQ ID NO: 32793 - protein, 232 aa, Sorghum bicolor
  Clone ID: SORBI-28MAY03-C1784_1.pep
ARGIVNLDPSITNDDLHQIFGVLGEIKEIHPISDNDHYRSIEFFDVRAAEAARYALNRSEIAGNKIKLEPGCLDGTKRLMQQMSRVLEHERFGGCKLGSPNSPSPCFGSINMASIRSTGTDSGTVQVLHSRVQTPTNQFQEGRSFLDLPSTTIRNRSSPVGIATAGSQSSHHVLDEHIHSLGKMNVQNKGRMDCGFQESIAFHPHSLPDFNDRLRNGIPYSCSIPPIGVKEQ

SEQ ID NO: 32794 - protein, 69 aa, Sorghum bicolor
  Clone ID: SORBI-28MAY03-C17824_1.pep
MADWGPVVIATVLFVLLTPGLLFQLPAHGRIVGFGTMHTSGIAILVHAVLYFALITIFLIAIGVHIYAG

SEQ ID NO: 32795 - protein, 131 aa, Sorghum bicolor
  Clone ID: SORBI-28MAY03-C22408_1.pep
MSRGNGGSGVRSTRLELQLNLSPPVGMEVDGGGVQDDSDSSSPSSCVSSDGRSSSGGGSPGGKSPMVIGACTRCLMYCMVAKKDYPTCINCKQPCLVDLLHGEAGGRGGGGGASEAAAGDKKQQQQRGKRK

SEQ ID NO: 32796 - protein, 161 aa, Sorghum bicolor
  unsure (1)..(161): unsure at all Xaa locations
  Clone ID: SORBI-28MAY03-C22590_1.pep
MATEATLNNSGGSESATPLLEQLAEVFGKLKSHTEASLQLQNGMQWEDIKGHFLSLDKSYRSKCDELVEKQKALEEKKAEARRLIAEKETNVSTKERASLNQLQELRDAAVSSLAEARQKXYKVELAEILXDAGGKQDQKGKSLHKLTINAFSVLQRRNPL

SEQ ID NO: 32797 - protein, 162 aa, Sorghum bicolor
  Clone ID: SORBI-28MAY03-C18017_1.pep
EQQAYATHIQQHVLRLLLVLEQQQQQEAPVSCCRQPRAAAAEDDDVSCLSCHQEKEAEAEEVEVESRSRGHGDAEPEALPGEPVHPRREREAPGEGHRAPPREPRAAAEPVQDGGRARGRSRSCVRLLPRLCLPAEDEVASLRPLSLVHVLVVWTLDRTVNS

SEQ ID NO: 32798 - protein, 136 aa, Sorghum bicolor
  Clone ID: SORBI-28MAY03-C17918_1.pep
MSSVGGRGKPKGTKSVTRSAKAGLQFPVGRIARYLKAGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 32799 - protein, 92 aa, Sorghum bicolor
  Clone ID: SORBI-28MAY03-C18094_1.pep
PAGLGTHSSCQERNMATKVTCLLFAILLLSINIHFSVVTSRKDPSFSGKAEEKIPGGHKTAHAAGSEEKVLLIGPNILLRPRPMPPCKRRCY

SEQ ID NO: 32800 - protein, 89 aa, Sorghum bicolor
  Clone ID: SORBI-28MAY03-C18038_1.pep
YCVYGGQHGCLSRSARANQRGHGRGGHCQQCGVLAARSPNWPVRCIWDVDAEIYRACVCCSLGFGIHLFLSICTQIILCVCVYHCWLIL

SEQ ID NO: 32801 - protein, 138 aa, Sorghum bicolor
  Clone ID: SORBI-28MAY03-C18099_1.pep
MAGKGGKGLLAAKTTAAKSADKDKDRKKAPVSRSSRAGLQFPVGRIHRQLKSRASAHGRVGATAAVYSAAILEYLTAEVLELAGNASKDLKVKRIAPRHLQLAIRGDEELDTLIKGTIAGGGVIPHIHKSLINKTAKE

SEQ ID NO: 32802 - protein, 75 aa, Sorghum bicolor
  Clone ID: SORBI-28MAY03-C18128_1.pep
LEHMQYEFIHVHGKSHHCEPSLKLGKFFFFFFGVIYAYSNYLDEKETRTHVLDRLRLPFKVKDEQGELVLKLPSD

SEQ ID NO: 32803 - protein, 108 aa, Sorghum bicolor
  Clone ID: SORBI-28MAY03-C18141_1.pep
MGVEIENISAGDGKNFPKKGDTVTIHYVGTLQDGSKFDSSRDRGSPFVTQIGVGRVIKGWDEGVPQLSVGQKANLICTPDYAYGSRGFPPVIPANSTLKFEVELLKIN

SEQ ID NO: 32804 - protein, 114 aa, Sorghum bicolor
  Clone ID: SORBI-28MAY03-C1815_1.pep
MASRGSSMACSLQLAVLMFAAVALGFGVRAGAAELCSEYYDQTCPDVHRVVRRVLKKAHEADVRIYASLTRLHFHDCFVQGCDGSILLDNSSSIVSEKFATPNNNSARGYPVVD

SEQ ID NO: 32805 - protein, 147 aa, Sorghum bicolor
  Clone ID: SORBI-28MAY03-C17592_1.pep
MASKMLLAALCVVALLAVRSESHGLGDFTNSEATPQMQNFFKPEAAALPESLDPSSMPAATMAAKPEATVIPTTTTTATTADTSAATAGTVPKSSATPRRSVSVAAGVACGVAAVAVVGIAAAVAYALRARRGGAPPATPPPLGSSP

SEQ ID NO: 32806 - protein, 111 aa, Sorghum bicolor
  Clone ID: SORBI-28MAY03-C17607_1.pep
MPPALRRIIMLAAAVLLLWSAACVAGDDDSTFLPPSPPGTASPFPFCPARPAGVSTGPFPWSPPQPPPQSPPSLSSPVAVFPQDPGFLPSGAGAVAWLPLLAVFPAFLVLF

SEQ ID NO: 32807 - protein, 126 aa, Sorghum bicolor
  Clone ID: LIB5051-010-A1-XP1-E5.pep
FHAAPAAATASPRCAVSATASPMACCCRQRPPRCDAQKPASLCPRADRTPRYQRRRHPHGLPDGRAVLGCDSGSRTTTTVRGLSGICITGTPLVPSHVQSAQGCCVFNDANSKHWASLFAYWTWLL

SEQ ID NO: 32808 - protein, 126 aa, Sorghum bicolor
  Clone ID: LIB5049-005-R1-XP1-D5.pep
LEAGRAGLASSHAAPAAATASPRCAVSATASPMACCCRQRPPRCDAQKPASLCPRADRTPRYQRRRHPHGLPDGRAVLGCDSGSRTTTTVRGLSGICITGTPLVPSHVQSAQGASLSPQICSLFRC

SEQ ID NO: 32809 - protein, 164 aa, Sorghum bicolor
  Clone ID: SORBI-28MAY03-C18235_1.pep
MAARTMGIASVTTSLAVVLPVLVALAFSRAAAQGNGCSSVMMTLSPCMDFISSKAPEPGISCCSVLAGVVQTDPRCLCMVLDGTATSFGISINQTRAMELPGVCKVKAPPISHCTGVQGAPAPAPSNEAATAEGEEVEATADSPKGYGASMTESSTNSKNAASL

SEQ ID NO: 32810 - protein, 265 aa, Sorghum bicolor
  Clone ID: SORBI-28MAY03-C18322_1.pep
AGRAWDFDINQGSQYITLIQSLRNNSNKPRLLRITGVDDPESVHRAVGGLKVVGQRLEKLAEDCEVPFESRAVAANTEDVTPGMLDCRPGEALIVNFAFLLHHLPDESVSIVNQRDQLLRMVKGLQPKLVTLVEQDANTNTTPFLARFREVYDYYSALFDSLDATLPRESPDRMNVERQCLAREIVNILACEGPDRVERYEVAGKWRARMAMAGFAPCPFSSNVINGIRSLLKSSYCDKYRFEKVHDGLHFGWGDKTLVFSSAWQ

SEQ ID NO: 32811 - protein, 173 aa, Sorghum bicolor
  unsure (1)..(173): unsure at all Xaa locations
  Clone ID: SORBI-28MAY03-C18305_1.pep
MAAPAADETWCRETVPRVMELVSPRLPQRDACALLAVSPWCYRALVANPRLWEVLDPREMKNAGDRLISALSLARYRHLKVLNLEFAQDIEDRHFVHLKEMSGISLENLEFLNLNACQKISDKGIEAVTSLCPNLQRLAIYWIVGLTDLSIXHITKNCKQIVDLNLSGCKNIR

SEQ ID NO: 32812 - protein, 122 aa, Sorghum bicolor
  Clone ID: SORBI-28MAY03-C18328_1.pep
WNIALMFITGMLVNGPYALITTAVSADLGTHSSLNGNSRALATVTAIIDGTGSIGAAVGPLLTGYISARSWSAVFTMLMASALVAGLLLSRLVVAEVAARPESRRTPAHAASDLPVSTMDEP

SEQ ID NO: 32813 - protein, 138 aa, Sorghum bicolor
  Clone ID: SORBI-28MAY03-C18338_1.pep
PGWEQNPATLCSARIENTEEKRPRYCRPSLHLNTPANGRRQGEEAMGVTKEDVEAAITSALSPSNLVVTDTSGGCGASYEIEVVSEKFEGKRLLERHRMVNTALAPHMAEIHAVSIKKALTPTQAQPQPEPAADKPQG

SEQ ID NO: 32814 - protein, 96 aa, Sorghum bicolor
  unsure (1)..(96): unsure at all Xaa locations
  Clone ID: SORBI-28MAY03-C1835_1.pep
RPWKEYARTVVMESTIGDLIRPEGWAEWMGDLGLKTLXYAEYANTGPGAGTSKRVNWPGYRVIGQAEATHFTAGVFIDGMTWLQSTGTPNVMGFTK

SEQ ID NO: 32815 - protein, 91 aa, Sorghum bicolor
  Clone ID: SORBI-28MAY03-C18371_1.pep
MGLQEEFEEHAEKAKTLPDTTTNENKLILYGLYKQATVSDVNTGRPGIFSLKERAKWDAWKAVEGKSKDEAMTDYITKVKQLLEEAAASTS

SEQ ID NO: 32816 - protein, 106 aa, Sorghum bicolor
  Clone ID: SORBI-28MAY03-C18398_1.pep
MAELVGPRVYSCCTCRNHVCLHDDIISKAFQGRNGRAFLFSHAMNVVVGAKEDRQLTTGLHTVADIYCNDCREVLGWKYERAYEETQKYKEGKFIFEKSKIVKENW

SEQ ID NO: 32817 - protein, 193 aa, Sorghum bicolor
  Clone ID: SORBI-28MAY03-C17848_1.pep
AGRAGTIAKYSNSMKNLAQKLLCIISESLSLPPSYIQEAVGEVYQNITISYYSPCPQPDLVLGLQSHSDMGAMTLLIQDDVGGLEVLKDGMWIAVPALRDGILVILADQTEIITNGRYKSSVHRAVVNAERARLSVATFYDPSKSRKICTAPQLVSKDEPQKYRDVIYGDYVSSWYSKGPEGKRNIDALLIQK

SEQ ID NO: 32818 - protein, 211 aa, Sorghum bicolor
  Clone ID: SORBI-28MAY03-C17854_1.pep
MEGCSKTSAGAASGLPDDPLVEILSRLPAKSICRFKCVSKAWRDLIADPDHRKKLRQAMQGLFVQTPEVSEADNTILDRTNFSFVDLTVGSMPLDIDPCFSFLPEMTGIEIYFLDSCKGLLLFAQHQEPSHGSGGYIVCNPTTRQWSPVLACDTRLALNHTYLAFDPAVSSHFHWLSPDALLGRGVVSLHVYSSKTGTWSQNQIDDQREQG

SEQ ID NO: 32819 - protein, 122 aa, Sorghum bicolor
  Clone ID: SORBI-28MAY03-C17904_1.pep
LPSTYTLLEQIQSTPLHLIMSFSKQVAVAAFALAFLLLTSNLAVAVAAAGAEEETIAPLNTCETPTCIPCWGQNAICIPACVAMHFTGGFCNGKNCVCTKPCLAQSETEAGGPTPQPPVCIN

SEQ ID NO: 32820 - protein, 200 aa, Sorghum bicolor
  unsure (1)..(200): unsure at all Xaa locations
  Clone ID: SORBI-28MAY03-C18459_1.pep
MAILGALKLAPCPPALAGAAPPATSSPARSSVHFHLANAGXAALVAASLPVADPAVAFIGGGPYGKQVTRGQDLTGKDFSGLTLIKQGFKTSILRQANLKGANLLGASFFDADLTSADLSDADLRGADFSLANLTKTNLSNANLEGALVTGNTSFKGANITGADFTDVPLRDDQREYLCKIADGVNSTTGNPTKETLFCS

SEQ ID NO: 32821 - protein, 164 aa, Sorghum bicolor
  Clone ID: SORBI-28MAY03-C1856_1.pep
MAAAEKPAAVRQAEELVEREMGGRDASHDASHALRVRDLALSLAAEEGLSAPSRLLTVELASLLHDVGDYKYTKNNVEDMSVVETFFQEVGLDEAQKDEIVAIIKGMGFKNEVSNKSIVDPTLEFAIVQDADRLDAIGAIGIARCFTYGGSKNSALHDPRILPR

SEQ ID NO: 32822 - protein, 195 aa, Sorghum bicolor
  Clone ID: SORBI-28MAY03-C18602_1.pep
PGPVATSSSCCVSPCRRERSQSGNQATKTSTAAARAPPGPGAAPYLIAPRSMAAKWAQKTVVIPAHRRGCHLITPKILREIEGDLAGFKCGLAHFFLQHTSASLTINENYDSDVQADTETFLNRIVPEGHNAPWRHTMEGPDDMPAHIKSSMFGCALTIPITDGRLNMGTWQGIWLCEHRDHASPRKIVITLNGV

SEQ ID NO: 32823 - protein, 128 aa, Sorghum bicolor
  unsure (1)..(128): unsure at all Xaa locations
  Clone ID: SORBI-28MAY03-C18647_1.pep
MGWAARFLTAVSFLAAGVLFAPDALPLGGSXSGAAAAARLVHVLAFATAWGAGLWVTFIGGIVMFKYLPRHQFGSLQGKMFPAYFMLISSCSAISVAAFAYLHPWKTASTIERYQLGFLISALGCNLS

SEQ ID NO: 32824 - protein, 90 aa, Sorghum bicolor
  Clone ID: SORBI-28MAY03-C18695_1.pep
MPIDTGSNKGGAEGAVKAGTSTVGNALGGITKTAGGLVGTAGRGVGETINNTTGTKAIGDGLQGITGGIEDGANSAGKGVENAGQGKKSW

SEQ ID NO: 32825 - protein, 163 aa, Sorghum bicolor
  Clone ID: SORBI-28MAY03-C1865_1.pep
YRPNSRVQKNGTGEHLPPPRPKRKAAHPYPHKASKKALQVVLPQQASHIMEQGCGTPMDTATVATDSSANDAFPVQHFSPRHTQGATYNNSSSIGSQSGTWPTSEGTEQDIRHPALSAMPDFARVYNFLGSIFDPETNGHLQQLKEMDPIDAETVLLLMKTCQ

SEQ ID NO: 32826 - protein, 67 aa, Sorghum bicolor
  Clone ID: LIB3480-033-P1-K1-F2.pep
CIIITSDSLSPLSLEKDMLSLLIYLAEVSMNVICLGRFYLSNSLPKIHLHGSFCSTQGQSSLPLITF

SEQ ID NO: 32827 - protein, 86 aa, Sorghum bicolor
  unsure (1)..(86): unsure at all Xaa locations
  Clone ID: LIB3480-033-P1-K1-F7.pep
STTRPGRVTMSAEWMPGQPRPAXHLDGSXPGDYGFDTLLCLAXTVPENFXRFKESDVYQWQESMLNEPHTIRLYTEQTCKGYQRQA

SEQ ID NO: 32828 - protein, 215 aa, Sorghum bicolor
  Clone ID: SORBI-28MAY03-C18766_1.pep
VHSPRTFFFIFGPLGDDGLLERGDGGRRREAPGPDVGAVRQPELDLELLLGAGHLQGRTRCYAAEVLNTADGEDGIEGSGGRANLSGASLAGVRFLGPGTDQETRGGGRIIGARPRASRTRTRSKVEGGRRRRGAATVGEEGKSRRGGAVVGQREGKGRRGGSRARGGGSVCLSAGLACDGQPHLRRGRATGWKAREGGSKGGQRHLVSAPGPAG

SEQ ID NO: 32829 - protein, 159 aa, Sorghum bicolor
  Clone ID: SORBI-28MAY03-C18165_1.pep
MEKEHIKMAMLKQEQTFRQQVHELHRVYHVQKQLMMQMQITKTNNYGNKVPETQTEPTVKLERQQLCGSSGKTEAKLAEDFNLELTLATGAGRMKQEKASNSDSEATMSSSTSAESESGQRFMPNSNVTNLRFQNESNRHDDQVMQSPWRYQCLSLKMA

SEQ ID NO: 32830 - protein, 146 aa, Sorghum bicolor
  unsure (1)..(146): unsure at all Xaa locations
  Clone ID: SORBI-28MAY03-C18194_1.pep
MALSSVFRRXNVKDLTSKVSVYTSATELSGGLNMIFRRWATKKTAGSTKNGRDSNPXYLXVKKFGGEKVLPGNIIVRQRGTRFQAGNYAGGTKXHSLFCLKEGHVRFERNKLSGRKWVHVDPVAGHDLHPIYADSFATTADTEPLQ

SEQ ID NO: 32831 - protein, 118 aa, Sorghum bicolor
  unsure (1)..(118): unsure at all Xaa locations
  Clone ID: SORBI-28MAY03-C18962_1.pep
MSVRIKAVVDKFVMELKEALDADIQDRIMKEREMQSYIAEREREVAEREAAWKAELSRREAEIARQEARLKVERENLEKEKSVLMGTASNQDNQDGALEITVSGXEKYRCLRFSKAKK

SEQ ID NO: 32832 - protein, 122 aa, Sorghum bicolor
  Clone ID: LIB5052-006-A1-XP1-E7.pep
RPGLHPAFRPTDTPLRCSSPVSPGVLRWIRPTEHGLAAAAALLQAAQVFVGPFAGNEHPPVTHQVLLQWGYSRAASLLVGMGCGIYVAQNYNVPNVKKLFNTYVFLAKHIEETYRKPKKDDD

SEQ ID NO: 32833 - protein, 55 aa, Sorghum bicolor
  Clone ID: LIB5049-011-R1-XP1-F3.pep
MGLFKGSFTLLVGMGCGIYVAQNYNVPNVKKLFNTYVFLAKHIEETYRKPKKDDD

SEQ ID NO: 32834 - protein, 156 aa, Sorghum bicolor
  unsure (1)..(156): unsure at all Xaa locations
  Clone ID: SORBI-28MAY03-C1899_1.pep
MASTSTTTMSSLALVLALLLSSGAIGSAARQLQELPPLPKPEIPPRPDLPPLPKPEEQPPLPKPELPVPPQPLPKPELPVPPQPLPVPPQPLPKPELPVPPEPLPKPELPVPPQPLPKPEVPVTPEPLPKPELPVPPQPXPCPNPPAPPPPPPTPQ

SEQ ID NO: 32835 - protein, 160 aa, Sorghum bicolor
  Clone ID: SORBI-28MAY03-C19039_1.pep
MGHAAGLRAGTRYAFSRDFKKKGMIPLSTYLKQYKVGDIVDVVANGAVQKGMPYKVYHGKTGIVYNVTKSAVGVILQKQVGNRYMEKRINVRIEHVRHSRSREDFLKRVKLNFAKQQKAKETGEPQQMKRQPAQPRTEHIVSLKEQKPENITPIPYETYI

SEQ ID NO: 32836 - protein, 154 aa, Sorghum bicolor
  Clone ID: SORBI-28MAY03-C19043_1.pep
PVLITMISNGIDDYSTNLVINHREPSTVRAHELLRDVHVHGEGEAHERDVLPVPLLLGAQALPRRHPRLHHVAAQPLGRGSPPWGLLLTTSSSSSTAAACWRRPGREATLAEEVGSRPRHGAATSSPAALRNMWSGPDGKHAQGSHAYGRPIRW

SEQ ID NO: 32837 - protein, 223 aa, Sorghum bicolor
  unsure (1)..(223): unsure at all Xaa locations
  Clone ID: SORBI-28MAY03-C1908_1.pep
PGIALRYFVYNLRCVIVTQVVASVEPQHKHRHHTSLRLSSTMAFPGSPARKLLPGGFTAVAGGSLSFDLDGAGDFFSGLWQLVKAKAAEVVAYLATLFAALAEKADEVFPPETRSETLRQWVHVAVTVVVPAVLGALVLRCVARCCWRCCCAGGGRAARGGRFMAAPGRGGARMPXGVFETTPGITSVTSAPGKPSCTSVRAFVDTPVCTYCTAVRVRTRSSV

SEQ ID NO: 32838 - protein, 151 aa, Sorghum bicolor
  Clone ID: SORBI-28MAY03-C19195_1.pep
MPGVSVRDVQADKFINAYAAFLKRQGKLPIPGWSDTVKTGHLKELPPQSIDWYYIRAAAVARHIYMRKTVGIGRLRKVHGGTKNRGSRPSHHVDASGSVDRKICQSLAKIGVLENDDDKGGRRITQSGQRDLDRIAQTTVEAEEEEDEDDE

SEQ ID NO: 32839 - protein, 143 aa, Sorghum bicolor
  Clone ID: SORBI-28MAY03-C19227_1.pep
MAMSIPSMVVVIAMLLMVASTTHYGCHAHAYAPAPRHHAATLSPHHAPAPAQPLGSHGHGHDGADHAPAPGHHGHHAPASAPYHHGHHSHHAPAATPSHHDYSAPAPVHTHHQSAHAPKLHHPHHHAPVPAPVHGSQAGQSSY

SEQ ID NO: 32840 - protein, 169 aa, Sorghum bicolor
  unsure (1)..(169): unsure at all Xaa locations
  Clone ID: SORBI-28MAY03-C18405_1.pep
MGDGGADDASSPPPPGGFSYLAVFHNYPLVAALLGFAIAQSIKLFVTWXWYKENRWDPKQLIGSGGMPSSHSATVTALAVAIGFQDGFNCSLFATATIFASVVMYDASGIRLHAGKQAAVLNQIVCELPSEHPLSETRPLREXLGHTPTQVIAGALLGCTIATAGQLFV

SEQ ID NO: 32841 - protein, 64 aa, Sorghum bicolor
  Clone ID: SORBI-28MAY03-C18454_1.pep
MAAMQALKSFVVKEPVVAASCLIAGFGLFLPAVVRPILDSWETAEKVPPPPLNDVVAGVTGKKK

SEQ ID NO: 32842 - protein, 68 aa, Sorghum bicolor
  Clone ID: LIB5052-005-A1-XP1-D7.pep
MTTSRRLADRKSAKFQKNITKRGSVPETTVKKGNDYPVGPIVLGFFIFVVIGSSLFQIIRTATSGGLA

SEQ ID NO: 32843 - protein, 68 aa, Sorghum bicolor; identical to SEQ ID NO: 32842
  Clone ID: LIB5047-005-R1-XP1-A11.pep

SEQ ID NO: 32844 - protein, 142 aa, Sorghum bicolor
  Clone ID: SORBI-28MAY03-C19356_1.pep
MAAGPVYSITRTEIDEFWRRKEVEAEERRLAAEKEAARIKAKTLKIEDYVLFEQMIREILKEGSKEDGATMAPATTGGTEARIIGIKHWWTRSAYAYLNSPTSSMDGNGRSKHVGPYVPQERCTMFFSSTPCQANVNARAVF

SEQ ID NO: 32845 - protein, 61 aa, Sorghum bicolor
  Clone ID: SORBI-28MAY03-C19417_1.pep
MVRVATYFAMTFGAFLFWQSMDRVHVWIALHQDEKKERMERELGIKRMQAELMAQAKENES

SEQ ID NO: 32846 - protein, 174 aa, Sorghum bicolor
  Clone ID: SORBI-28MAY03-C19476_1.pep
MARFQEYQIIGRHLPSEANPAPKIYRMRIFAPNEVVAKSRFWYFLGKLRKIKKANGEIVSVNQIHEKKPQKVKNFGIWLKYDSRSGTHNMYKEYREMSRVAAVDALYQDMAARHRSRFRQVQILKVVEVEKADDIRRPYIKQLLTKNLKFPLPHRINKKAGKKVFSATRPSTFF

SEQ ID NO: 32847 - protein, 135 aa, Sorghum bicolor
  Clone ID: SORBI-28MAY03-C19521_1.pep
MTKVQSMVASSRRKSRKAHFSAPSSVRRVIMSAPLSKELREKHGVRSIPIRKDDEITVVRGSNKGREGKVSSVYRLKYCLHVNGIVREKSNGQSVPIPIAPSKVVITKLKLDKDREQILERKSAGREEKKKQREA

SEQ ID NO: 32848 - protein, 210 aa, Sorghum bicolor
  Clone ID: SORBI-28MAY03-C19555_1.pep
MHRTYSMRQSRAPTASQIQSPPPPSSSTKSGRFFGKANIGHTFRHKSAGAFGPDLAKKLSQLVKMEKNVMRSMELVSRERMEVAQQLSIWGEACDDDVSDVTDKLGVLIYEIGELEDQYVDRYDQYRVTIKSIRNIEASVQPSRDRKQKITDQIAQLKYKEPNSPKIVVLEQELVRAEGESLVAEAQLSNITREKAQAAFTYQFDGMREH

SEQ ID NO: 32849 - protein, 153 aa, Sorghum bicolor
  unsure (1)..(153): unsure at all Xaa locations
  Clone ID: SORBI-28MAY03-C19564_1.pep
MATQSSKAADTAAPAPAPEAAAAGEAAPSAASSTPAQNPTAAATAAAGAIDLEKKMRRAERFGTPVVMSEEEKRSNRAERFGTGSSSVKEEEKKKSRAEKIGLASSSSSDEEAKKKXRLERFGQGTNGDKAKKKKKKLTCNTVGFYGSTKVLR

SEQ ID NO: 32850 - protein, 209 aa, Sorghum bicolor
  unsure (1)..(209): unsure at all Xaa locations
  Clone ID: SORBI-28MAY03-C19632_1.pep
YRLSSSVCASPPPPLDLLGRILLSYSEEHHFXSKGDAGASKTYPHKAGTARKXGFLAIWGRPXRVCRYLPPXTGKHGHASCLYXAIYIFLAEQLENIAPSSHNCDIPHENPTEYPLIDLLEDEFVSLLTLHVHTNDDPRLPTDDTLVDHMIECSESVKDLAATVQPDIEDEQICYLKDIDPEKLPCLGTRNYCISLLKCKNTVSPRDCY

SEQ ID NO: 32851 - protein, 260 aa, Sorghum bicolor
  unsure (1)..(260): unsure at all Xaa locations
  Clone ID: SORBI-28MAY03-C19621_1.pep
MPITVPQATELKDLFSLKGKVVIVTGASGPTGIGTEAARGCAEYGADLAITYNSRAEGAEKNAKEMSEKYGVKIKAYKCQVNEYAQCEKLVQDVIKDFGKVDVFIANAGKTADNGILDATVEQWNEVIQTDLTGTFNCARAVGLHFRERKTGSLVITSSMSGHIANFPQEQASYNVAKAGCIHLAKSLANEWRDFARVNSISPGYIDTGLSDFVPQDIQKLWHSMIPMGRDAKATELXGAYVYFASDASSYCTXSDLLID

SEQ ID NO: 32852 - protein, 217 aa, Sorghum bicolor
  unsure (1)..(217): unsure at all Xaa locations
  Clone ID: SORBI-28MAY03-C18848_1.pep
MVSCVVLLHETSPWSVLGGAAAMLALWWAMQALEWAWWTPRRIERTLRAQGLRGTRYRSLWGDLKEESRLTATALAKPVHTDRPHDIFPRVSPLLHRAVEEHGKLSFTWFGTTPRIAIADPQLAREVMSNKDGYFVKTKITTRVTKLLFAGVAILDAEKWAKHRKIXNPAXFHAEKLKGMLPAFSAACSDLICKWGNLXADSVGQXELDVWPEFQIY

SEQ ID NO: 32853 - protein, 126 aa, Sorghum bicolor
  Clone ID: LIB5049-010-R1-XP1-F11.pep
MRTLISMLVVAAAAVVGLCSVAPAASARGEPPVPQAVGGWRPINVNDPHIQELGRWAVSEHGKQASDRLVFGKVVSGEEQIVAGTKYKLVIQATRAGAGGNSATYGAVVYEKVDKTRQLLSFSPAN

SEQ ID NO: 32854 - protein, 125 aa, Sorghum bicolor
  Clone ID: LIB5052-006-A1-XP1-B8.pep
MMRALISMLIVAAAVVGLCSVAPAASAREAPLPENVGRWTPITDVNDPEIQEIGRWAVSEHDAAASDSLVFSKVVRGEEQVVAGTNYKLVIEATKGAGGKIATYGAVVYEKVDNTRQLLSFAPEN

SEQ ID NO: 32855 - protein, 132 aa, Sorghum bicolor
  Clone ID: SORBI-28MAY03-C19751_1.pep
MTKKRRGNGRNKKGRGHVKSVRCSNCSRCVPKDKAIKRYSVKNMVEAAAVRDLSEASVYAEYALPKLYIRVAYCISCAIHAKIVRVRSAKPGAINSRKNRLPPPRAIFRDGKRINPAVAAAMAAKTAEGQKA

SEQ ID NO: 32856 - protein, 91 aa, Sorghum bicolor
  Clone ID: SORBI-28MAY03-C1975_1.pep
SSPPPPSRSPPRRASRSPATSSSSSSSPSGCTSSATTSTSPRPSTSTTAASILSGRSSQASATVRCSWINSTGLQCRRRGSEILRATQSIQ

SEQ ID NO: 32857 - protein, 142 aa, Sorghum bicolor
  Clone ID: SORBI-28MAY03-C1976_1.pep
RPVVGKELICYQDSRFEVWGTKGYGVQPTGTSRKLPEYQMHESSSSPNVTIQTTDSRQDKVERLQRNLSTPNVAKFDDKRDYFGFIGHEEVDIGMSMASQWMVPCFAATACLMLYLSCRMQQKRRRRRKGSVASASRLTSMV

SEQ ID NO: 32858 - protein, 132 aa, Sorghum bicolor
  Clone ID: SORBI-28MAY03-C19801_1.pep
SFEASHSKRDLTSSIAEKLGVQAPPVRMDSQAKYGALARGDGDIFLRIPHKSYIETVWDHAAGSIVVTEAGGMVKDASGNDLDFSKGRYLDRDRGIIATNKHLMPLVLKAVQEAMKEEQAGGAGIEQSRNLL

SEQ ID NO: 32859 - protein, 104 aa, Sorghum bicolor
  Clone ID: SORBI-28MAY03-C19826_1.pep
PKWGHQGGVDVWCGIWAWALDVPWLACPFQVGCGQRRLGRKLLASLDLKWQERREAGFTEQRSLSASNGGRITGRCIMGPASGPDSYYNRPPSFYMKKKKKKGP

SEQ ID NO: 32860 - protein, 138 aa, Sorghum bicolor
  unsure (1)..(138): unsure at all Xaa locations
  Clone ID: SORBI-28MAY03-C1986_1.pep
LACTSLLLLAKTFITSVTSYYKQQEEKEIEAKIKEGFDFSASVILCSNPVRKKKSRSRELLCFFFLQERAVLVGRSTGRREWLPPAGAGARALCRRRRRRWPRRRARRRSCARSWSSGAPSGCXPTASPRRXRGCPSS

SEQ ID NO: 32861 - protein, 95 aa, Sorghum bicolor
  Clone ID: SORBI-28MAY03-C19840_1.pep
ATMADGGPLLLARSGRAGAGDVPRKEARAVGACCWPGTMTDGYCIQLLGPAKGGWKGPPWSAQQLCHSARAPTCSPLVRPKVCSGWSTNPRKICK

SEQ ID NO: 32862 - protein, 155 aa, Sorghum bicolor
  Clone ID: SORBI-28MAY03-C19894_1.pep
MANALLLLVALLVAGCAALASATSYTVGDGQGWTTNVDYSTWASGKSFAVGDKLVFNYMSKAHSVTEVSKSGYDTCSGANPLSDDESGSTVVPLQTPGTHYFICNVPGHCAEGMKLAVAVSATPSSAGGALLQVPAMASVVAAAAAGAAIKLALF

SEQ ID NO: 32863 - protein, 192 aa, Sorghum bicolor
  Clone ID: SORBI-28MAY03-C1926_1.pep
MSLAPSIPSIKVKVGAVSVAPPHRACRSFAVIRSSKAEGPIRRPAAPPLSPPPPKPPKTPALSTPPTLSQPPTPVKPAVPPTSSLPTPPSPELKPVEAQAPAAALQRPVAGAVTLEYQRKVAKDLQEYFKKKKLEEADQGPFFGFLPKNEISNGRWAMFGFAVGMLTEYATGSDFVQQMKILLSNFGIVDLD

SEQ ID NO: 32864 - protein, 136 aa, Sorghum bicolor
  Clone ID: LIB5051-004-A1-XP1-A11.pep
TQSEHAFIDPPECVPVTRSRIIAQLTRSYTARLTNPSITDQPLHIATTIPCTSYTALHADRKASGIPAGILAEIQDKEASSLKQRHQAGAIIRSARSVDVDAGRISTAPLVEKIGDDAPRHHHRRHSCRCPPRSTL

SEQ ID NO: 32865 - protein, 138 aa, Sorghum bicolor
  Clone ID: LIB5048-005-R1-XP2-C2.pep
HITTTIPCTSYTTLHTDRKASGKPAGSLAEIKTKEASSLKQRQQARTIMRSARSVGGGAGRISTAPLAVAVADVAAVTTITTRVLGAPSDQVFDDLFDDAAPPDVRVAVGLLSLAVHGAALSRKHSCLERWRQAPAAP

SEQ ID NO: 32866 - protein, 213 aa, Sorghum bicolor
  Clone ID: SORBI-28MAY03-C19327_1.pep
HEAASPAAALRSQAQPHPAVETPPPQPYGFHNLDRRTMLLADGTVRTYFALPPDYPFEPAPLPPLPRHLLPRAAPDLWPPHQAPAAPPQMPMPMPVQMPPHEARRKHPADQDEGFPRHHKQPRLDGPHQPPPHAAVDRHALRRAFLKYAKMLNESSAQRRSYLEGGRVPCLACGRFGDPTLFAAFFLASFLVSFVVKFLCWFLAIVELALTLA

SEQ ID NO: 32867 - protein, 231 aa, Sorghum bicolor
  Clone ID: SORBI-28MAY03-C20070_1.pep
MLRTHLPPEAWRRPLPQEAGGARDQSPRISFHRAATRSRIPGGKLRCGGLEPRWLSSSRSSSSDSKPWTRMCTKADYTTPVDSVATSEQTGGETEATSEQTGGKTEEPAIVAPANEYTVQEAAPQQKCAKIHDFCLGIPFGGFLFSMGLIGYLFWGSPASLTFGVAPGLAILALAVLSLNVWRSGKSSLPFILAQAGIAAAVAWKHSQAYTTTRKLLPWGFYVALNAAMIC

SEQ ID NO: 32868 - protein, 92 aa, Sorghum bicolor
  unsure (1)..(92): unsure at all Xaa locations
  Clone ID: SORBI-28MAY03-C201_1.pep
GGPWGGVGRVSTAKRXADDDXGRTWGXPPPVPLPPEPSCDLGLWLSPGSPPAPGERRGPATPSLTSEESVTTTTTSGGARGGREPELLNLFV

SEQ ID NO: 32869 - protein, 170 aa, Sorghum bicolor
  unsure (1)..(170): unsure at all Xaa locations
  Clone ID: SORBI-28MAY03-C20109_1.pep
MTGTTWIIDSQRFATKKKKKKAPTDPSDQELIWHLLAKHGKSDIKPHPFIDEFIPTVEEDEGICYTHPQKLPGVKQNGSVSHFFHRTFKAYNTGTRKRRKINTVDADVRWHKTGKTKPVLLDGKQLGSKKIMVLYMSPAKGGKAEKTNWVMHQYHLXIGEDERDGEYXXL

SEQ ID NO: 32870 - protein, 116 aa, Sorghum bicolor
  Clone ID: SORBI-28MAY03-C20069_1.pep
MPKSTGPLQEQLGLGTANQSTPNNMTDNTTAAADKLGANKDTNAIPSQNPSVISSAGAIGKQFNPDGAIGQIGEKVGGPFSKDGVIGSQFDASKNGIAGHVERAVDGPSNPAGSSK

SEQ ID NO: 32871 - protein, 224 aa, Sorghum bicolor
  unsure (1)..(224): unsure at all Xaa locations
  Clone ID: SORBI-28MAY03-C20143_1.pep
LAYGFCKKKNKNKKKKRFSAPDSFCADLLRPPVSQTPRLLAAGEPAGGGFQTPKSAATRCLFDEMAEGPAPKKPTSTAGAAASDAFAALPDEILQHVLSFLPAQPAVRTCVLARRWRRLWEGAAGLRITAANAPEPVCKPDDLVSSAELREFVDHLLLLRGGAPLDSCEFMFDVRDDADVPHVNLWIRHVIRCQVRRLELSITREEDPTGLHFYVDXLPLVSRH

SEQ ID NO: 32872 - protein, 98 aa, Sorghum bicolor
  Clone ID: SORBI-28MAY03-C20152_1.pep
MAGRKETALDLAKFVDKGVQVKLTGGRQVTGTLKGYDQLLNLVLDEAVESEREQDDPLKLSGKTRQLGLIVCRGTAVMLVSPTDGTDEIANPFLADGA

SEQ ID NO: 32873 - protein, 207 aa, Sorghum bicolor
  unsure (1)..(207): unsure at all Xaa locations
  Clone ID: SORBI-28MAY03-C2017_1.pep
HEGEVTCARHKTPKRDEFSMPTSRVLFKEVDTPSTSPALWNRPQVAILDEKAXRVSFIVAALEASELLSEENSQRWYTEDPLLDVSVLAEVGNSYCLTDDAVLLFDCVEEVLLKIRDKFFGTDPWVNFLKHNVRPAPVGRQLVEEVTKGIDSLVGKEFPNTLEQVMMKDLDSGSWLDLRGDTESVGVELWAGLFGDLLEEGVFDLWV

SEQ ID NO: 32874 - protein, 213 aa, Sorghum bicolor
  unsure (1)..(213): unsure at all Xaa locations
  Clone ID: SORBI-28MAY03-C20175_1.pep
RVTNRSPSSPSSSAAPPPPNSSATSAAIGDRRRRRRKKMPASKTVSTSAAETDLGTHVFNVVGYSHQKAICAHKDTXLLSGRFSVGGHEWALVLVADIYNDDHPDCVAISLLLDPFAAPGVLASFELRLVNQSTGLPFTVHKEAPMVFDDNNDMAATCWIKRSLLESPTYLQNDRLTVECIVTVIKERLVSKTKSLPRIEVPPPNMAENFGSL

SEQ ID NO: 32875 - protein, 94 aa, Sorghum bicolor
  Clone ID: SORBI-28MAY03-C19665_1.pep
MAKPPIQTAAILLLVVAAASWLQTADAASGFCSGKCSVRCGSVRARGACMRSCGLCCEECNCVPTATAPARGGNECPCYRDMLTAGPRKRPKCP

SEQ ID NO: 32876 - protein, 129 aa, Sorghum bicolor
  Clone ID: SORBI-28MAY03-C19692_1.pep
YALQCCTAENMVLRQSLLKDRHAGAPTAMQESAELSETLPLVSLLWLVSILCLFLVDDMPNRSLPAPRSLERDLVKLARTSINGVKMTRMTNNSDNPGALGLIRLGRRCRGTRARIKSPWVPWHAVAAC

SEQ ID NO: 32877 - protein, 181 aa, Sorghum bicolor
  unsure (1)..(181): unsure at all Xaa locations
  Clone ID: SORBI-28MAY03-C2262_1.pep
MFGIVFPDHTFPLDATAFAQVAPNSWLLDLSSLALATAPRSAVVFLLPAAVAALPPGKAVAVYFQAATNRPFAFLGALGPTRPSASFPLPEAGDEPEPAVGPAKLGVAVXEDAXALPPRPDEQRAERVALRVGENLFNFMQSFCGADGGKLVVPTDILDRWFRKFQERAKKDPAYLKSFEF

SEQ ID NO: 32878 - protein, 170 aa, Sorghum bicolor
  Clone ID: SORBI-28MAY03-C20208_1.pep
MGKAGRVEQASFPNSAPATRSCRCRCGAVVEKVVNGKCVSLVFLAVSGFLSAFFLLLHLRASGDIPDDPGILAEIEAGFILSVPHSQVASQVGMLENEIYTQIGVPNSTVSVSMQPYIYTDTTYVKFGVLPAPRNTSMSTQSINALRASLIKLTLHQLNLSLTPSVFGDT

SEQ ID NO: 32879 - protein, 140 aa, Sorghum bicolor
  Clone ID: SORBI-28MAY03-C20257_1.pep
RPVAGDPPPLAPQSPQAISTIYMSLPSPLHSSGGGFGLPSRFLSPLPPSRSSCDCCHHPASSQKMSRATHHRLHQHRPRPHPAVRGVDRRSSPSLLVVAPPEPCKGSDEGDSIQEGVEIATKAEQHECFIFKVVMKSWAC

SEQ ID NO: 32880 - protein, 160 aa, Sorghum bicolor
  Clone ID: SORBI-28MAY03-C2030_1.pep
RPKTVRDVALRCRWMNKKESAKRKKEDHSSSKKSKDKKEKVSDSSSKPPVHMAGRPSVPPYPLPVLPMDDDEISSKAIGGPTGEILETNAQVLSQISSNLSNMQIQDNISLLCQTRDNILRVLKEINDAPEIMKQMPPLPVKINEDLVNSLLPRPTVPMQ

SEQ ID NO: 32881 - protein, 284 aa, Sorghum bicolor
  unsure (1)..(284): unsure at all Xaa locations
  Clone ID: SORBI-28MAY03-C20375_1.pep
RPGRLKEALLLALSDGHQGSTRLTSPIDVVLKLGAYKSFSDLSPVLQFANFTATQALLDEIASTTSSCIRIIDFDLGVGGQWASFLQELAHRRGTGNVTLPMLKLTAFVSSASHHPLELHLTRENLSQFAADLGIPFEFTAINLDAFDPAELIPPTADEVVAVCLPVGCSARMPPLPMLLQLVKQLAPKIAVAIDHGSDRGDLPFSQHFMNCFQSCMFLLDSLDAAGTNADAASKIERFLIQSRVEDAVLGRRKAEKAMAWRAVVTSAXGXAPVPLSNLAEAPA

SEQ ID NO: 32882 - protein, 65 aa, Sorghum bicolor
  Clone ID: SORBI-28MAY03-C20446_1.pep
FLYLAISTLITRRSLDSSFAKEQQHSRCKYSATLCCFSSLLQVCVVLFLSRAVTTSVGAVQLCQS

SEQ ID NO: 32883 - protein, 223 aa, Sorghum bicolor
  Clone ID: SORBI-28MAY03-C20457_1.pep
PAGPAGSRRLPFFSDLRRSPAAAPPPLPLLVVDLVSGTMARLLSTALAKGLMRSSRAWTPAAVSRPAIQQFMNYSSGLGGAPNTNGDSMATRVAADHDTHQDFQPTSKSSDMSFSDIVAQDVKEHPVVIYMKGYPDAPRCGFSALAVKVLQQYGVPISARDILSDLKLKESVKAYSNWPTFPQIFIKGEFVGGSDIILTMHQKGELKELLGDIAQKGEQSGSS

SEQ ID NO: 32884 - protein, 109 aa, Sorghum bicolor
  unsure (1)..(109): unsure at all Xaa locations
  Clone ID: SORBI-28MAY03-C205_1.pep
ENLVEHRPAETVEILLRLCTDVGDRTTRRGSNSMHLLMIPSPMDFVNIFXHSPQYLMEFLENYIKTVTDSPAQTEIHNTLLELYISNDLSFPSISQENEHENHYIKETK

SEQ ID NO: 32885 - protein, 67 aa, Sorghum bicolor
  Clone ID: SORBI-28MAY03-C20518_1.pep
MAKRATVMVLAAALAVLLLAAVSSSHDQKQGSAAEGGCEGANDEDECMMRRTLNAHTDYIYTQQHHN

SEQ ID NO: 32886 - protein, 91 aa, Sorghum bicolor
  unsure (1)..(91): unsure at all Xaa locations
  Clone ID: SORBI-28MAY03-C25277_1.pep
SAVGVTGARSNVNLRVEHLLREIKKVTDKPVAVGFGVSTPEHVKQXQIAGWGADGVIIGSAIVRQLFEAAIPEEGLKRLEEYTRSIKAAMP

SEQ ID NO: 32887 - protein, 158 aa, Sorghum bicolor
  Clone ID: SORBI-28MAY03-C25282_1.pep
YGFCCHIDEECAKELADVPGVLSVQPDMNFGSDNKEYKVSGDDGLKSSEGTVAADIKTKRLFVTGLSFYTSEKTLRAAFEPFGELVEVKIIMDRISKRSKGYAFIEYTTEEAGGAALKAMNGQIINGWMIVVDVAKTRSRDRLSGGSNQAFRPHYQAR

SEQ ID NO: 32888 - protein, 253 aa, Sorghum bicolor
  Clone ID: SORBI-28MAY03-C20644_1.pep
MPSAGLSPPPWSSMEGQVVLVTGASSGIGRDFCLDLARAGCRVVAAARRADRLRSLCDEINASEAAAQGPRAVAVELDVAAGGSVLEAAVQRAWDAFGRIDALINNAGIRGGVHSPLDWPEDEWDRIIKTNLTGSWLVAKHVCRRMRDAKLYGSVVNITSIAGLNRGHLPGSTGYASSKAAVHYATKIMALELGAYGIRVNSIAPGLFKSEITAPLLQKRWLSTVTSKIVPLKEHGTTDPALTSLVRFLIHEA

SEQ ID NO: 32889 - protein, 129 aa, Sorghum bicolor
  Clone ID: LIB5052-008-A1-XP1-A9.pep
SIGLQPWLCFSLYCSCYSWPPVVKPTPMNRQHHIARAMKPRWGHRQQPAVTVTGRSRLVHASPAETAMLSPTKAMLPPASSDARAKATLVGAVTLSLAASPATASASRLMAVHRPPSGIAVSVLQGRWS

SEQ ID NO: 32890 - protein, 137 aa, Sorghum bicolor
  Clone ID: LIB5052-010-A1-XP1-B5.pep
SIGLQPWLCFSLSCSCYSWPPVVKPTPMNRQHHIARAMKPRWGHRQQLAVTVTGRSRLVHASQAETAMLSPTKAMLPPASSDARAKAMLVGAVTLCLAASPATASASRLMAVHRPPSGITVSVLQEVGASNHGRKNN

SEQ ID NO: 32891 - protein, 89 aa, Sorghum bicolor
  Clone ID: SORBI-28MAY03-C20664_1.pep
MATFVKRSSSQGLLLLALVLLALSVIPAPIRGQKTEESWRGRKDDIFNGCHYNHNVHDTDIFCCSKDNQCWSQLTECVKNCPCLVGCSR

SEQ ID NO: 32892 - protein, 140 aa, Sorghum bicolor
  Clone ID: SORBI-28MAY03-C20704_1.pep
MQIFVKTLTGKTATFEVESSDTVANIKAKIQDKEGIAPDKQRLIFAGKQLEDERTLADYNIRKECTLHLVLRLNGGGKGGCYPPKVDPNLLQLALKYCEYKMICRECYARNSIRANNCRKKKCGHCNEMRPKKKLAFKQA

SEQ ID NO: 32893 - protein, 178 aa, Sorghum bicolor
  Clone ID: SORBI-28MAY03-C20734_1.pep
APLDVADPPRPNGLPQARPGSAAPRLDAATPPRRTPPAVPRRPPDTHAPRPRRPHPSRPPPRGARVRGGRPPAPEAALRRPLPPLSTICDPYLNIFRGIIPPLGGTLDLSPILAFLVLNAFTSTAAALPAELPSSAAAQHHQRTAAPSSPAPLEATSNQRKWMRRMRSQKSQGEGGDH

SEQ ID NO: 32894 - protein, 156 aa, Sorghum bicolor
  Clone ID: SORBI-28MAY03-C20743_1.pep
VSPLVLFTTWENNEPPSPKQPPIACRLNPASQSAPLSTREFHQTRCAHQQPDRKKHTRTQSRAREQTKMGGRRYRPAWPLCLARSSGGVIRRTTASASASYTVPADAAIAWLVRTRRKLEHEGQDGGKPATEEGAGREGRRERSRTSCLRNRPAAA

SEQ ID NO: 32895 - protein, 247 aa, Sorghum bicolor
  Clone ID: SORBI-28MAY03-C20747_1.pep
MPRQFFVGGNFKMNGTIESIKDIVHKLNDAKVDPNTEVVISPPALYLLLTREHAREGIEVAAQNVFDKPNGAFTGEISVSQLKDSNITWSLLGHSERRVILQESDAFIASKTKTALDGGINVILCIGETLEQREANKTMEVVINQLEAVKKTVSDWSKIVIAYEPVWAIGTGKVATTEQAQEVHKGIREWLGKELGQKVADETRIIYGGSVSEKNCRELAKEADIDGFLVGGASLKPAFVDIINAKQ

SEQ ID NO: 32896 - protein, 141 aa, Sorghum bicolor
  Clone ID: SORBI-28MAY03-C20184_1.pep
MENLALLWGIIGPGVSGAIFGAGWWFWVDAVVCSAVQVSFLHYLPGIFASLAALMFNCVNKDEIGYDYYSPYGDDSEWRVKLWLFVAYVVSFVCLAGSVGLLVQDALTNKGPSVWTGVAGVLQCVLVLISGLVYWTCHSED

SEQ ID NO: 32897 - protein, 153 aa, Sorghum bicolor
  Clone ID: SORBI-28MAY03-C20187_1.pep
ALKKIASVACKCVRMRGKDRPSMDKVTTALEHALALLMGSPCIEQPILPTEVVLGSSRMHKVSQMSSNHSCSENELADGEDQRIEYRPASWITFPSVTSSQRRKSSASEADIVGRRTTDGRNVGSSIGDGLRSLEEEIAPASPQENLYLQHNF

SEQ ID NO: 32898 - protein, 152 aa, Sorghum bicolor
  Clone ID: SORBI-28MAY03-C20190_1.pep
STEHPYTYYEDAGRPRFCLCPLGWAPWSPRLVEAVVFGCIPVIIADDIVLPFADAIPWEDISVFVAERDVPRLDSILTSIPLADILRRQRLLARESVKQALLFHQPARPGDAFHQVLNGLARKLPHGDGVFLQPGEKVLDWDAGLDSDLKPW

SEQ ID NO: 32899 - protein, 73 aa, Sorghum bicolor
  Clone ID: SORBI-28MAY03-C20846_1.pep
PKLAFELQEAEASEGVEASSPAECSICLERCADSGDGLIQLRCRHIFHSACLDRWLRSHADCPYCRAAGRVCS

SEQ ID NO: 32900 - protein, 134 aa, Sorghum bicolor
  Clone ID: SORBI-28MAY03-C20878_1.pep
NKSIYCLRPKRERQDEYQIESNNRSRPKIDATRPKSDQIKKSSQLCRLLLVVRHAASPWKATDVFLHMDSIDGLEGCGEAVDGLFHHHRARCSAGLGLASKRLRGILCERSPAATLLWDPSRRKQPPALRQSWL

SEQ ID NO: 32901 - protein, 201 aa, Sorghum bicolor
  Clone ID: SORBI-28MAY03-C20931_1.pep
MSTEAQTKKFQKGERVIPSATDKALKYYPAEDEQVMKKARKTQHPYKPRASLRPGAVLILLAGRFRGKRVVLLKTLDQGVLLVTGPFKVNGVPLRRVNARYVIATRTTVPINGLDSKTLEKVSDANYFARDKKADKKGSEEAFFQQGEKPQKKEVAASRAEDQKAVDKAILESIKKEHYLQSYLASNFSLRKGDRPHEMVF

SEQ ID NO: 32902 - protein, 161 aa, Sorghum bicolor
  Clone ID: SORBI-28MAY03-C20970_1.pep
RRPAAGMSHSHQGCRARAGSWTTTIRFLSGLLLLILADGVVPLRRAGTRDHPGPWQVVEQPRRRRPLLHASRGPVVVVVDGASGRHQAGGGGHDEEDEERSGCGCAPPVEATHRRRRFWWPEMERTEWKEQCVMSGYLLGVQVQSGEMGMSRHGRPSIVRI

SEQ ID NO: 32903 - protein, 98 aa, Sorghum bicolor
  Clone ID: SORBI-28MAY03-C20972_1.pep
MGPQQDRSSSMANGTAAARSKEAKVVHYRECQRNHAASIGGHAVDGCREFMASGAEGTAAAMACAACGCHRSFHRREVEAGGDDDRDCSSTSTSTTSG

SEQ ID NO: 32904 - protein, 111 aa, Sorghum bicolor
  Clone ID: SORBI-28MAY03-C21105_1.pep
IAKFAESFEMVPRTLAENAGLSAMEIISSLYAEHASGNVKVGIDLEEGACKDISTLKIWDLYVTKFFALKYSADAACTVLRVDQIIMAKPAGGPRRDAQPGGGMGAELDWA

SEQ ID NO: 32905 - protein, 168 aa, Sorghum bicolor
  unsure (1)..(168): unsure at all Xaa locations
  Clone ID: SORBI-28MAY03-C21139_1.pep
MTRNATASTTAAAEPLRREREESPGRPFHLRXSRQRRGEPGRAGGGRGGQPPAPAAPGQVVVSRDELPQPPARARRRRXCRRLGGRGHGRRLRNRPRRCHRRRVRLDGHLPPPPPLCCRWDLGGCACVGLAGKRSGGLVGKTDAGGTETWRWCGEARRRAAGTPGTRP

SEQ ID NO: 32906 - protein, 48 aa, Sorghum bicolor
  Clone ID: SORBI-28MAY03-C20605_1.pep
RVWFSNCPCSMHTHSELDTCFMQPFCEVMCARTGDHCPVHKKKKKKGP

SEQ ID NO: 32907 - protein, 248 aa, Sorghum bicolor
  Clone ID: SORBI-28MAY03-C20637_1.pep
MSLSSVKIGEEVWLTCLSHALTTETEEVMGLLLGDIELSSKGATALIWGASPQMRCERKKDRVEVNPELLAAASAQAEKMTATIKRTTRVIGWYHSHPHITVLPSHVDVRTQAMFQLLDTGFVGLIFSCFSEDAQKVGKIQVTAFQSEGGQQHALPLAIAPVIDLDSSCSSSDNAFASHSASVEGMEQDTGDSRASKNNKAWRRSMDFYSHPDTSHSTSYQPRENALILYNPDNTQEASVDPYDSDMT

SEQ ID NO: 32908 - protein, 229 aa, Sorghum bicolor
  Clone ID: LIB5052-007-A1-XP1-D1.pep
MGFTDFVSETGLHVLNSWVSTRSYILGNAPSQADVKAFQQIKETPAVEKYPFAYRWYKHIASFESEFSKLPGDASKEFTAYGPGSEELTLNPAKAPEKEEEDDDEVDLFGSDDEEDEENEKLKAARVEEYKKKKEGKAKPAAKSIVTLDVKPWDDETPMKELEEAVRGIEQDGLVWGGSKLVAVGFGIKKLQINLVIEDDKVSLDELQEKIEGFEDYVQSSDVAAMQKL

SEQ ID NO: 32909 - protein, 230 aa, Sorghum bicolor
  Clone ID: LIB5050-005-R1-XP1-F1.pep
MGFTDFVSETGLHVLNSWVSTRSYIIGNGPSQADVKAFQQIKECPPVEKYPFAYRWYKHIASYESEFGKLPGDPSKEATAYGPGSEELAVNPAKAPEKAEEEDDDEVDLFGSDDEEDEENEKLKAARVEEYKKKKEGKVKPAAKSIVTLDVKPWDDETPMKELEEAVRGIEQDGLVWGGSKLVAVGFGIKKLQINLVIEDDKVSLDELQEKIEGFEDYVQSSDVAAMQKL

SEQ ID NO: 32910 - protein, 164 aa, Sorghum bicolor
  Clone ID: SORBI-28MAY03-C21373_1.pep
METNSKRVAIVGAGVSGLAACKHLLERGFNSPVPVVFESGAVVGGVWARVPDSTALQTPRPMYQYSDFPWPDTVTDVFPGHRQVMAYLDAYARRFGVMDCVRFRRRVLGMEYHGVDEDDVAKWEEWSGNGEAFGSGAGEWHLKVADAEGRVEVQHPGFVILCIG

SEQ ID NO: 32911 - protein, 228 aa, Sorghum bicolor
  Clone ID: SORBI-28MAY03-C21378_1.pep
MAAKIFALLALLALTVSATSAFIIPQCSPVTAAGYEHPVVQAYRLQQVLAASILQQPIVQLQQQPSAHLLVQTIVAQLQQQQFLPALSQLAIPNPAAYLQLQQLLPTNPLAAVNAIAYLQQQQQLQQSVVNPIAYFQQQQLLPFNQLAVSNAAAYLQQPQSLPFAQSAVATAATYHQQQQLLQVNPLALANPLAAAFLQQQQLLPFNQMSFMNPSLLWQQPIIGGAIF

SEQ ID NO: 32912 - protein, 135 aa, Sorghum bicolor
  Clone ID: SORBI-28MAY03-C2138_1.pep
SGEDDYIFETSPSEQNLRWNYAPELLGEPSLSDSNETPKRLPIVISAKRTGNIARFINHSCSPNVFWQPVLYDHGDEGYPHIAFFAIKHIPPMTELTYDYGQNHHPNIQMGTHSSFGKAKSCLLWAPKCRGSFGL

SEQ ID NO: 32913 - protein, 94 aa, Sorghum bicolor
  Clone ID: SORBI-28MAY03-C21389_1.pep
MSLRYMSRVGARAAQAVRESTGRSVKDKAQSSASASMARSGGGSRPAPAAGSSVESGRASAAAVARRKAEEEKRRRAEQALRTVMFLSIWGPNT

SEQ ID NO: 32914 - protein, 165 aa, Sorghum bicolor
  unsure (1)..(165): unsure at all Xaa locations
  Clone ID: SORBI-28MAY03-C21450_1.pep
XXXXXXXXXXIAALEAAGGVISTGRKHQRQPNQAAAAAAHHHQLRRLARPVGTGAYVRGKNPIEQASEERDGQLLLFFFFFGVGGRRRCRRLRRREEGEEGVAQRRRRRRVGRRQQGRHLHRQVPPPPVRRRLLRLRRRPAAADAGGRHCRSVTRRLGCLCMHGI

SEQ ID NO: 32915 - protein, 73 aa, Sorghum bicolor
  Clone ID: SORBI-28MAY03-C21484_1.pep
RKLRKDHVQKFIDCQVKDVAEFEAERDELIKVHEEKKMKLKKEYMEKELELEKELDAALTVLMEKHKPDSFEA

SEQ ID NO: 32916 - protein, 100 aa, Sorghum bicolor
  Clone ID: SORBI-28MAY03-C215_1.pep
DMIFYKIICTHFFFLSRYAITAGSKEHQTTGRRKNLNCSEELVEDDRGDELVMDTTLKIGFKNIKGDLNCSSSSNNHGWMSTMTMDRSRNWPAKSPSHIS

SEQ ID NO: 32917 - protein, 151 aa, Sorghum bicolor
  unsure (1)..(151): unsure at all Xaa locations
  Clone ID: SORBI-28MAY03-C20766_1.pep
MSGSIPTSTSVSESAVIDASFSDVWHLIKLQDFSKFWSKLDKSEFVKGTSDETDIVKWTFKDGAELEVKQEEHSSIDHFITYSVITSKPELSYSSVVNXRVYPVTSGTHENKTFITWSGNFSSDADASVIQDAKFKRREALADLAKVVSKK

SEQ ID NO: 32918 - protein, 130 aa, Sorghum bicolor
  Clone ID: SORBI-28MAY03-C20794_1.pep
MWWEWEGGGGEAPREETPVDFDFISLLSKPKDYYKILEVDYNASEETIRSSYIRLALKWHPDKKQGEESSTSKFQEINEAYQVLSNPAKRQEYDKKGILYVQDQNVVDYLNRHKGLILTCNGLGIRYSVW

SEQ ID NO: 32919 - protein, 140 aa, Sorghum bicolor
  Clone ID: SORBI-28MAY03-C2082_1.pep
MAGEAKKLFAASEVALHASRKDCWVIIGGKVYDVTKFLEDHPGGEDVLLHASASGDATEAFEEVGHSTSAVSMMDSYLIGSIKGYVRPAASKATDPWSTDVPPNSRTMQGNKGPPNPNTFLDFLLPLFVLGLAFAAWYYL

SEQ ID NO: 32920 - protein, 95 aa, Sorghum bicolor
  Clone ID: SORBI-28MAY03-C21590_1.pep
MGSSSSPAPPPPMIGRAGNLTVFITPPSPASTPRGASRTPPPESPRSDVSTPTPQRAAPSLSASASPRNHESPVAAPAVVFTPPPPPAPVKVAPP

SEQ ID NO: 32921 - protein, 112 aa, Sorghum bicolor
  unsure (1)..(112): unsure at all Xaa locations
  Clone ID: SORBI-28MAY03-C21640_1.pep
MTAVLRRAVAQRFASSSSPATFGLRRFLQEQPAFRPALSPDRGFMPLAADRIRDLGVVGVAFPRINLDGLVPPAAPATAPARREPTDAAALPAAASLTGXEARKVLRATQME

SEQ ID NO: 32922 - protein, 241 aa, Sorghum bicolor
  unsure (1)..(241): unsure at all Xaa locations
  Clone ID: SORBI-28MAY03-C21600_1.pep
MDAVLPSLLIGGGLSVSVSIPTATKAGSQSISVPHLSTSALRSTPRRRGRRRLTLLASSSQLPPTPLSAASTESQSRSSRWVVVMDTPSAAAGGSRVSRADAVDYYAATLAQVVGSEKEAQMRIYEASWDGAYEFRCEIDEDASKELASMTSILSVKPYMKXDQSRXNHILSLSTSNLVIISDSASTSSSGKNEFWLVRMEKPGVEVVTKAQMVDHYTQILMKVLGNEQDAQVSIYHISWE

SEQ ID NO: 32923 - protein, 86 aa, Sorghum bicolor
  Clone ID: SORBI-28MAY03-C217_1.pep
KPSLLYVSAAAAYSSKENMQSPVSKYMLETNMKGENVQIWFDMARHHLSTMIGAYRKQHILFFIVGKINCKKYWLLCLDSTFGAAS

SEQ ID NO: 32924 - protein, 134 aa, Sorghum bicolor
  Clone ID: SORBI-28MAY03-C21726_1.pep
MGKPLIYEILEKPASSSVIGICSLIWWLIQKRGIGYADVGLSYEAAVDGGQYWRIITSAFSHISVVHLVFNMSALWSLGVVEQLGQIGLGVEYYLHYTLVLVVLSGLLVLGFYHMMIQRFKVEYFRRVTAGGYS

SEQ ID NO: 32925 - protein, 54 aa, Sorghum bicolor
  Clone ID: SORBI-28MAY03-C2182_1.pep
FETRTLVPILVVLIYFICKTTIYFKKTCFNFILKVKLSSLTKLVEKIINIYDAE

SEQ ID NO: 32926 - protein, 130 aa, Sorghum bicolor
  Clone ID: SORBI-28MAY03-C21826_1.pep
MMVMGYFRSTNKSATSAAGGKNKKKAKNSCAPAAREEAAGLREALLDQPAAAEEDGGVPKGYFAVYAGEESRRFVVPTGYLREPAFRDLMERAADEFGFAQAGGLRVPCAEEDFEDLLRRLQRKNGGAVG

SEQ ID NO: 32927 - protein, 153 aa, Sorghum bicolor
  Clone ID: SORBI-28MAY03-C21192_1.pep
METAAPARVQALAETGVSRLPAQYIQPPEDRPTPSPSPVAAAVSVPVVDLSSSTAADAVSAACADWGAFHVVGHGVPRELLDAVREAGLAFFRAPMGDKLRFACDPARGAAAEGYGSRMLANDDSVLDWRDYFDHHTLPEFRRDPAHWPDFVP

SEQ ID NO: 32928 - protein, 126 aa, Sorghum bicolor
  Clone ID: SORBI-28MAY03-C21334_1.pep
NYSKTRCHLGKLTLLLIVFAIALSVQPVIVNGMCTDKEKKDILQHCEDYLKHGAPIPSLHGPCCAAALEVPVLDMQCIVDLLTAKEKSEYKEANILQLKHLCYPLSSEPPTNQVMHGLKGSAAMRH

SEQ ID NO: 32929 - protein, 99 aa, Sorghum bicolor
  Clone ID: 7217293.pep
MSYQAPPPGTAAYPPPGTAYPPPGQQAYPPPGQQAYPPPGQQAYPPPAYGAPPPMAAGGYPPPPPPQQQQQDSKGGSNDGFLKGCLAALCCCCMLDMCF

SEQ ID NO: 32930 - protein, 153 aa, Sorghum bicolor
  Clone ID: LIB5050-003-R1-XP1-E8.pep
FFFFFFFFFLSSPLFFNFGALKAAGPQRHPCILVDHRLLLGRLPPTPAACVAPIADPAPRRPAMSYQAPPPGTAAYPPPGTAYPPPGQQAYPPPGQQAYPPPAYGAPPPMAAGGYPPPPPPQQQQQDSKGGNDGFLKGCLAALCCCCMLDMCF

SEQ ID NO: 32931 - protein, 151 aa, Sorghum bicolor
  unsure (1)..(151): unsure at all Xaa locations
  Clone ID: 30967293.pep
LCNSVIFFLSFLIKFCRGPEFSQKKTCVEWRKRRNSGWVRISNSLSQHGELCSGVGPPEGDEHQRPDRLLRRRHRSPHLLRPPRRVRRRRRRGRGGLGPPPXASPRDSSLASGSWLAWLHYTHTASYCCCCWWLEIDRRRRGRARRRMEAF

SEQ ID NO: 32932 - protein, 120 aa, Sorghum bicolor
  Clone ID: LIB5050-002-R1-XP1-G4.pep
FFFCLQKYSTNTPPFEAKKRRNSGWVRNSNSLSQHGELCSGVGPPEGDEHQRPDRLLRRRHRSPHLLRPPRRVRRRRRRGRGGLGPPPPPAHATHHLPQAHGWLGYTTRTQLATAAAAGG

SEQ ID NO: 32933 - protein, 124 aa, Sorghum bicolor
  Clone ID: SORBI-28MAY03-C21911_1.pep
SRAATASPRIIPACAAPAEVQSLCLRWAVEGIAGGKVVEHAVDAVLGRALAVAAVQLLVRVVVAGDVPALDAHHRARLRRRQRRPADLTQHDEPGEEEDAGEREQRLHGGHFLLHFALLIAGVL

SEQ ID NO: 32934 - protein, 210 aa, Sorghum bicolor
  unsure (1)..(210): unsure at all Xaa locations
  Clone ID: SORBI-28MAY03-C21940_1.pep
MDAAGGEQLSLAAVRDALVRLEDSVVFALIERARHPRNAPAYAPAAGGGGGYSLVEFFVREAEALNAKAGHYQKPEDVPFFPQDLPSPLFPTKPSPKALHPFALLVTVNDAIWKMYFDELLPLFTVDGDDGNYAQTVALDFACLQVLSQRIHIGXYVAEVKFKDAPQDYSRLIKAKDSNSLMDLLTFKAVEEKVKKRVEKKARTFGQNVT

SEQ ID NO: 32935 - protein, 164 aa, Sorghum bicolor
  Clone ID: SORBI-28MAY03-C21945_1.pep
FGLDIRFGPADIEELVRKALQLSCNAKPINHPTYDDPNNGKAYAIFKAKDAADAAISKINSGLVVGGRPLYCSKGLLEVPKPPKNLVGHLSSHIKIGHKQRDEQSKAVATSHCSQPNTIEYDLALDWMLLREKQDQSFRILHKKHREARKVFASLGNKSLKAEK

SEQ ID NO: 32936 - protein, 251 aa, Sorghum bicolor
  Clone ID: SORBI-28MAY03-C2198_1.pep
SGLLPFWGKARPALGQSFLVAQSQLTATAVQYRRRDDGTTAEAAMLRPLYPAATMVYFQCMFASITVIILAGSLLARMNIKAWMAFVPLWITFSYTVSAFSLWGGGFLFQWGVIDYSGGYVIHLSSGIAGLTAAYWVGPRSASDRERFPPNNILLVLAGAGLLWLGWTGFNGGDPYAANIDSSMAVLNTHICASTSLLMWTLLDVFFFGKPSVIGAVQGMITGLVCITPGAGEYRLPSRVASFRLLQSILV

SEQ ID NO: 32937 - protein, 116 aa, Sorghum bicolor
  Clone ID: SORBI-28MAY03-C21986_1.pep
MAGKLIANLIVMGSTIIGRAMLQAYRKALDNANKTGVAHEAINNIRRASKTMTEQEARQILGVSENSTWEEIVQRYDNLFERNAKSGSFYLQSKVHRAKECLETVYQKNKQDEPPN

SEQ ID NO: 32938 - protein, 212 aa, Sorghum bicolor
  Clone ID: SORBI-28MAY03-C22_1.pep
MSTITSCTLLSLGSAAWPAVYSAGRPSPVAVASLSSQRRPRPLSVCCATSQKGDHNPKTDLHPFNIPAFVLVHPVPPREERWQLEEDAEKVNLWFEVPGQSQYDLAVEIDEDVLVIKKKVHVVGGDVGQRSPGGGGGVNDYAPQSRKGGAAPEASKEAAQQGGEVIYARMLLPAGYSREGVEAELKSGVLRVTVAKIKERARRKIDVGILVK

SEQ ID NO: 32939 - protein, 89 aa, Sorghum bicolor
  Clone ID: SORBI-28MAY03-C22004_1.pep
KSIRLTYHARTMYYAIPLKPAAPMFPSITFPPNTDWCIFPSSLLYRKKIQRGREKKERKSSTKSKAPSHTLHPEWTSLFMCFATCNCLL

SEQ ID NO: 32940 - protein, 227 aa, Sorghum bicolor
  Clone ID: SORBI-28MAY03-C22062_1.pep
MKITVMTVDEQILTLDVDPDESVENLKALLEVETRVPLQQQLLHFNGKEIQNVEKLSAIGVRDGDLVMMLPTSERSSQDTLRINPADGTAVNPQAFQQHIRGDSHLMAQLLQNDPQLAQAILGDDTNELQNILRSRHQQKTELKRKQEEELALLYADPFDVEAQKKIEAAIRQKGIDENWEAALEHNPESFARVVMLYVGYGRSMVVLLKAFVDSRAQSTIISKSCA

SEQ ID NO: 32941 - protein, 132 aa, Sorghum bicolor
  Clone ID: SORBI-28MAY03-C21509_1.pep
MATLTSPPASPASTATSPVSRLRPPPPSLLRLRFWPAPVAAAAAVPSPIALGPGCRSSSGIRCRAAAGPSPPSSEPPPSPHGWQEKLSSLQDRARIFFAVLFWMSLFFWGSAWDGSNNSGGKKRQRFRKKSK

SEQ ID NO: 32942 - protein, 109 aa, Sorghum bicolor
  Clone ID: SORBI-28MAY03-C2152_1.pep
FLLAHELPQEVGDFGILVRSGFTVSKALFFNFLSALVALAGPARVRSLGKDPGHSSLIEGFTAGGFIYIAVAGVLPQMNDQKTTLRSSVAQLISLSMGMLVALGISLVE

SEQ ID NO: 32943 - protein, 250 aa, Sorghum bicolor
  unsure (1)..(250): unsure at all Xaa locations
  Clone ID: SORBI-28MAY03-C21534_1.pep
MSGKQQDKSIMGMPGFVVDFLMGGVSAAVSKTAAAPIERVKLLIQNQDEMLKSGRLDRKYDGIGECFSRTAKNEGVLSLWRGNTANVIRYFPTQALNFAFRDTYKSMFAYKKERDGCAKWMAGNLASGGAAGATSLLFVYSLDYARTRLANDAKTAKKGGERQFNGLVDVYKKTLASDGIGGLYRGFMPSVAGIVVYRGLYFGMYDSIKPVLLTGSLEGNFLASFALCWXVTTGGGIASYPXDTIRRRMM

SEQ ID NO: 32944 - protein, 210 aa, Sorghum bicolor
  unsure (1)..(210): unsure at all Xaa locations
  Clone ID: SORBI-28MAY03-C22268_1.pep
ITATNTGNHNPAKIIPDHVQXHNTECAATALGWLXPGAGSVPLPXRTHEGTVEFPARRIPAPVDQIAARNQDYYERGAVLSPVDENLEAMLGATIENVDAPSVSQPNELRQDVLDPSGLQYDVPSVSSHADSNTNASQPSTMEDPQGNNQAHTFSHLSNLMQANPLSTSSLLGSNQNHAALHGLEFDLPPYLEAKYNTGSTTHPRPAISM

SEQ ID NO: 32945 - protein, 240 aa, Sorghum bicolor
  unsure (1)..(240): unsure at all Xaa locations
  Clone ID: SORBI-28MAY03-C2227_1.pep
YSAVEDVQLCKSWIHISNDPIIGNDQSGKTYWERIANDFHMNRDFEXDRTPNSLEHRFGIIXTSGMKFHGFFEEVQRRHRSGVPYQEHLGEAHGRYVRKESAKKFQFEQCWLTLRNTQKFESTLEVSKRPTKSRELNLSVGTQQDSETTAQGQESSSIPSTKTTRPPGRKQSKDKLKKNEGDDGYKDMMQNFLVMKTEEQMMKKARWEKDMLLEERKLKVEEQRLQWEQEQKIXMFCDVT

SEQ ID NO: 32946 - protein, 127 aa, Sorghum bicolor
  Clone ID: SORBI-28MAY03-C22329_1.pep
NPTVPRCIYMIEHMHVSRYSSSESLESLGWNSLTSVSMLPCLSFHCTRRLGPLRPLRAMPPGGCCGSSAVRSPAASTSLEPMPPEDADRETAAGEEGGGFLPLPLHDELLRMRRSIAGWHQLPVARA

SEQ ID NO: 32947 - protein, 199 aa, Sorghum bicolor
  Clone ID: SORBI-28MAY03-C2235_1.pep
MGMVLGKITVETPKHEVLHTGAGYEIRKYPPCIAAEFTYDPKEWKGNPDGGFTVLANYIGALGKPQNTKPEKIAMTAPVITTGGGDDGESAEKIAMTAPVITTGEPEPVAMTAPVITDDQQAPGKVTMQFLLPSKYTKVEEAPRPTDERVVIREVPERKFGVARFSGVATEKAVRAKAEGLKAALEKDGYAIKGPFVLA

SEQ ID NO: 32948 - protein, 229 aa, Sorghum bicolor
  unsure (1)..(229): unsure at all Xaa locations
  Clone ID: SORBI-28MAY03-C22354_1.pep
PGLVHISLSLSLSLVLVATPAWATVAALHQASRSSSPAPSSHQPCSTIISVKGMGMDHMMRLGAGVAHQISRAEPMPDRRSRFWQTDVPPAPRIDIICPLPCRPSRPQLLNRPSPKSNGALPLYRADPTCDIVDLILNKNDPDVDTDSSSQVAFFCGSPPARTNNPVINDPQFGKKTPSFSPLGSSFGKIAAGRVEVGSPTCXASSPKVRIEGFACGNKEPPHCAVTFA

SEQ ID NO: 32949 - protein, 201 aa, Sorghum bicolor
  Clone ID: LIB5048-002-R1-XP1-B5.pep
MISSFITGILTLVLGYAYPAYDCYKTVELNRPEVEQLRFWCQYWILLAFLTVLERVGENFVSWLPMYSEAKLAFIVYLWYPKTRGTAYVYESFFKPYIAKHETEIDRNLLELRTRAGDMAVLYFQRVANYAQTRSYEILQYIASQSQTQRSRPQAQQQQQRPPPPRTRQVNPAPSTVPAPSAPPMTQPAQSSVPPTPCRPP

SEQ ID NO: 32950 - protein, 198 aa, Sorghum bicolor
  Clone ID: LIB5121-005-A1-PF1-G1.pep
MIGSFITGILTLVLGYAYPAYDCYKTVELNRPEVEQLRFWCQYWILLAFLTVLERVGENFVSWLPMYSEAKLAFIVYLWYPKTRGTAYVYESFFKPYIAKHETEIDRNLLELRTRAGDMAVLYFQRVANYAQTRSYEILQYIASQSQTQRSRPQAQQQHQRPPPPRTRQVNPAPPPVPAPSAPPMPPQAAPTSSSSPS

SEQ ID NO: 32951 - protein, 86 aa, Sorghum bicolor
  Clone ID: SORBI-28MAY03-C22370_1.pep
MSGTPVGVDNTSRRKFDKEEYLERARQREQREKDEARKGKERGPPVQRQPLKHRDYEVDLDSRLGKTQVVTPIAPLNQQAGYYWSV

SEQ ID NO: 32952 - protein, 170 aa, Sorghum bicolor
  Clone ID: SORBI-28MAY03-C21848_1.pep
MPLQLPPPVNPQRLSPAESRERTVGFFQGLGVDVPLPASAERPDAYSSLVRAIVSSAVVTSSRVSCTITISPAVANQYNTLHGGAVAAVAEAIGMACARAAAGDKEMFLGELSTAYLAAARLNSEVDVEAQILRKGRSVVVTTIDFRLKDTKRLCYTSRATFYIMPMASL

SEQ ID NO: 32953 - protein, 228 aa, Sorghum bicolor
  unsure (1)..(228): unsure at all Xaa locations
  Clone ID: SORBI-28MAY03-C21875_1.pep
MSPAAATTTAFAAVSVAIPNPTAPSRGRVRLPLRGVPAAARRAVASMAVSAPRSGAAASFLERRESERALHFVKYQGLGNDFIMVDNRDSSVPKVTPEEAAKLCDRNFGIGADGVIFVMPGVNGADYTMRIFNSDGSEPEMCGNGVRCFARFIAEIENLQGTNSFTIHTGAGKIIPEIQSDGQVKGDMGEPILSGPDIPTKLLXYKNKAVVQAELAVEGLTWHATCVS

SEQ ID NO: 32954 - protein, 223 aa, Sorghum bicolor
  unsure (1)..(223): unsure at all Xaa locations
  Clone ID: SORBI-28MAY03-C21763_1.pep
EGPAGPGIHNSHTLSTSNKLLSTLIHPTKPTKPPPSRCVSPPLPPLSSPPALPTPRSTPSSPVSPLPXAVSPLTSAPSSVPSPPTLAPVLHPSPATPPLVLHLSPLPSRATPPLPSAALHLRPPLLLARVPLRSHLLPAPSRAVLALLSLPPALPPPALLVLPTTTTSPPWVPSLVVSLPSLVSCKQLDLQGLPSTPDMKSLFRQFLSSASDISHELNTLRLL

SEQ ID NO: 32955 - protein, 111 aa, Sorghum bicolor
  Clone ID: SORBI-28MAY03-C22649_1.pep
MAAAGWLRRAAAASMPRLPSGLPLIPPPPPAPLTEAQSLVVPGLGAAAGPAMELMAVPKKKVSKYKKGLRNGPKALKPVPVIVRCRCCGRVKLPHFYCCSGERGNPSESSS

SEQ ID NO: 32956 - protein, 143 aa, Sorghum bicolor
  Clone ID: SORBI-28MAY03-C22918_1.pep
MAPSSPPPFLVLSVALWLLLLASSHTRGAEAAPPNTEALSLLCNGASYGAGDPFATSLAYVLSELVSATPARAGGHDFYDISPYPAAFAYGHAACRAALSAPDCATCLRSAVSQMDASCGHSVGARAVLVDCSVRYEQYAFVD

SEQ ID NO: 32957 - protein, 163 aa, Sorghum bicolor
  Clone ID: SORBI-28MAY03-C22957_1.pep
PTESTSTWSCHGDVHVMPSMASICCAAYTTGLAEAAHDADDEAGDAVIAPAVAAAERVVPDEALQAPVPRQRAGAVQDRRRRDRRAAGRHARREPNHRPQEQREQGHELLAMAAAGNVAAGWRRRQLATKSRRCRLLESTASRNAGGCRCVSECLTATALVPG

SEQ ID NO: 32958 - protein, 257 aa, Sorghum bicolor
  Clone ID: SORBI-28MAY03-C23070_1.pep
MLRRAAPTTAALCRRALSATPSSSRTAAATAAASSSAVNSILLRSLKEHYLEVCKMTPPPKVSPPEPFTIVKGALDQPSGPVLRREYGDDGEEISISVARLANILPAGADFDSDGAGEGGGMSASISQLFLHVDISKPGSGKSMQFLCGLYPDALGIHSVCLRSKNAESLNGDMTSKGGGEYRGRIFQELDEKVRDALHLYIEARGINEKLFRFLQAWLYVKDHRNLIRWFKSVGSAISEPKPSKVSGNPCWRNEII

SEQ ID NO: 32959 - protein, 273 aa, Sorghum bicolor
  Clone ID: SORBI-28MAY03-C23176_1.pep
MRPAKAAGGKVSNIAESRLERPTDPAGMAARPAGCGSLFGCFGSSSSSSHENGGSTKKKGGKKKKKKSKQQQKVAAGSGSAAARSLPSRMSFNELSLSGMVSPEDLSLSLVGSNLHVFTIADLRAVTRDFSMTNFIGEGGFGPVYKGYVDDKTKPGLAAQTVAVKLLDLEGGQGHTEWLTEVFFLGQLRHPHLVKLIGYCYEDEHRLLVYEFMTRGSLEKHLFKKYAASLPWSTRLKIAIGAAKGLAFLHEAENPVIYRDFKTSNILLDLDYN

SEQ ID NO: 32960 - protein, 155 aa, Sorghum bicolor
  Clone ID: SORBI-28MAY03-C23193_1.pep
MSFAPPEAHQQFQHILRLLNTNVKGGGKIMFALTEIKGIGRRYSNLVCKKADVDLNKRAGELNSDVLERIVTIMQNPAQFKIPTWFLNRQKDLTDGKNSHTLSNAIDQKLRDDLERLKKIRSHRGLRHHRGLKVRGQHTKTTGRRVGKSIAGKKK

SEQ ID NO: 32961 - protein, 131 aa, Sorghum bicolor
  Clone ID: SORBI-28MAY03-C23198_1.pep
MDEEEHEVYGQEIPEDGDMDGADVDMAAAGDDATKLQELDEMKRRLKEMEEEAAALRDMQAKVAKEMQGGDPSASTAEAKEQVDARSVYVGNVDYACTPEEVQQHFQACGTVNRVTILTDKFGQPKGFAYA

SEQ ID NO: 32962 - protein, 125 aa, Sorghum bicolor
  unsure (1)..(125): unsure at all Xaa locations
  Clone ID: SORBI-28MAY03-C22224_1.pep
MSTPKVKTAQLWNKSKDELASQLTDLKSELIQLRTAKVTXGSNTKLTRIHDVRKGIAKVLTVINANQRAQLRLFYKGKKYTPLDLRPKQTRAIRRRLTKHEASLVTEKQKKRNTHFPQRKYAVKA

SEQ ID NO: 32963 - protein, 106 aa, Sorghum bicolor
  Clone ID: SORBI-28MAY03-C22262_1.pep
VLPNDIAEDQVKRMKAPTVAPQPGPPINQPSVVISDALAKFIGTDGTFPQDDAQKYLWDYIKANQLEDVINESILCDSKLQELFGCESIPMSGLSEMLGHHFIKKT

SEQ ID NO: 32964 - protein, 199 aa, Sorghum bicolor
  Clone ID: 30970754.pep
QQQQAAAAMSIRKALGAVKDQATIGIARVTGAVAPDLDVAIVRATSHEDAPPDERHAREVLRLASATGAAPACVASIARRLSKTRDYVVAAKCLALLHRLATSTASDHADPTEGGTEGGVGTPSFLHELLRPTLTGRRAGEPALALLLDFRDDAHAASWDHSTFVRAYSTYLLDRVRFLVLLLPAPRFAAADDSRVAGP

SEQ ID NO: 32965 - protein, 104 aa, Sorghum bicolor
  unsure (1)..(104): unsure at all Xaa locations
  Clone ID: LIB3481-005-Q6-K1-B9.pep
EAPSRXGGXRARHPRDADRRLVLDRAQRLADGHGGEEVGGVGADEGGVVPRRRVRVVAEVEEQRQDGLPRAAAGEGGAEQLVEEGRRADAALGATLGGVGVVGR

SEQ ID NO: 32966 - protein, 101 aa, Sorghum bicolor
  Clone ID: SORBI-28MAY03-C23390_1.pep
MAAAVSFSRVRALPTWSSSVSGDDHHAYSSVLAMSVSARPRSTGARPLRSPARMMGNVNEGKGLFAPLVVVTRNIVGRKRFNQLRGKAIALHSQVINEFCK

SEQ ID NO: 32967 - protein, 108 aa, Sorghum bicolor
  Clone ID: SORBI-28MAY03-C23426_1.pep
FAVLVLLYFYSHYFFASGAAHIGAMFAAFLSVASALGTPSLFAAMVLSFLSNLMGGTTHYGIGSAPVFYGAGYVPLAQWWGYGFVISIVNIIIWLGAGGFWWKMIGLW

SEQ ID NO: 32968 - protein, 237 aa, Sorghum bicolor
  unsure (1)..(237): unsure at all Xaa locations
  Clone ID: SORBI-28MAY03-C23455_1.pep
MLARLATLSLALFSLTAAAPLEKKQHGVQVIETCSVSGDVALTFDDGPFNYENDISNSLNGAKATFFLNGNNYECIYNRIDQVRALHAAGHTLGSHTWSHADLTTLDWDGINSELEKVEQAFIRILGLKPLYFRPPYGSYNDLVLQVLGSRGYKKVFLWSDDTSDSDGGTVQQAKSTVDSVANNSPNPAIILMHSPEPATAYDTVPYAVGRLEGAGYQLVAVDTCLGXNGEWPYEYV

SEQ ID NO: 32969 - protein, 226 aa, Sorghum bicolor
  Clone ID: SORBI-28MAY03-C23477_1.pep
MGKATPRVRYEPGPAFEEVKEEAMLDISPADSTEFWLIQWPKDQIDFLDFHGKELSLKLRSDGNMGSLESSSGKSYELVSFAAQKPDATVFLPSGSETKPVGKISRRVSLVHYPKPEELAKPSFGSLTPSIKKSAGSKKTMSRFTSASKNRSSQGSALSLGQRSAEPTSKHKGKRKDESSLGHSNVSGKSSQGSQAGGVGSNMASKMPQSPSEKSQKKRKKVKIVE

SEQ ID NO: 32970 - protein, 176 aa, Sorghum bicolor
  Clone ID: SORBI-28MAY03-C23482_1.pep
MSHDTASHHPVAAATGQAAAAAPAPAHDPGGGSECRFCEMTRQHHPQCSRRLPKRIILVRHGESQGNLDMSAYTTTPDYRIPLTALGAEQARAAGLRIHDVVSSPGGNWKVYFYVSPYARTRATLREIGRAFPRDRVIGAREECRVREQDFGNFQVEERMRAVKETRQRFGRFFFR

SEQ ID NO: 32971 - protein, 94 aa, Sorghum bicolor
  Clone ID: SORBI-28MAY03-C23600_1.pep
PSKRAAYSLKSVEDLPVLVVAGSEDALVSVKSAQAMASKLVNSRIITISGCGHLPHEECPKALLSALSPFISTLVPSQDLLQRLYNILVPFRSS

SEQ ID NO: 32972 - protein, 143 aa, Sorghum bicolor
  Clone ID: SORBI-28MAY03-C23688_1.pep
MNSDYTTTSWPPHRKNQALSRPKAMPAKWDDAQKWLVGMSNGGGRADGGTHGGGGARVKPRNSNADDRRLLGSSSQNGRVSCSSVDGALEYNSMVVAAPAPSTPPRQTGGEGDDDDVEETKKIDCMVQQQHGHGHGHGSPHKA

SEQ ID NO: 32973 - protein, 185 aa, Sorghum bicolor
  unsure (1)..(185): unsure at all Xaa locations
  Clone ID: SORBI-28MAY03-C2372_1.pep
ARGLITDNEPPKLRFNRVDASKRMQDVVKKLRLVRQDVSGIIATLGSNWSVRPNIAQSRPITTSESIEQKLYGRDHIMNSIIHVITKSEHSAEVLTVIPIVGPGGIGKTTLAQHIYHSGEVQQHFDVKVWTCVSLNFNVNKLLTEIKKYIPKIDGESSNGTNYXELIGQRLKNKKLLLGLDDIWD

SEQ ID NO: 32974 - protein, 49 aa, Sorghum bicolor
  unsure (1)..(49): unsure at all Xaa locations
  Clone ID: SORBI-28MAY03-C26390_1.pep
KHNILMTYASRLVDLFSLKTGSVLHTMAIFSTEQCQPQPTAHSSXFLGI

SEQ ID NO: 32975 - protein, 58 aa, Sorghum bicolor
  Clone ID: SORBI-28MAY03-C26391_1.pep
SLFRSVRTGGTKLLPCFDIYKTKLTLAQMPKLAPCELPVHTPFCLTLHILGRMITCGI

SEQ ID NO: 32976 - protein, 70 aa, Sorghum bicolor
  Clone ID: SORBI-28MAY03-C23853_1.pep
MSDWGPVVIGLVLFVLLSPGLLIQLPGRHHFVEFGNLQTSAVSILVHSIIYFALITIFVIVIGVHITTGN

SEQ ID NO: 32977 - protein, 335 aa, Sorghum bicolor
  Clone ID: SORBI-28MAY03-C2396_1.pep
ARGALILCVLGFMCFWSVHRRNKKPGNGNKPCCDKIPVSQIPDVSKEIAVDEVREQHHAVVHNLRVQQESHHTLAVQEKPHHEKDSGKMLGHLVRSKSSDADNLSQCSSAAYQCERAGSSYSGDEGSSGNARRQYAQYATVSASPLVGLPEFSHLGWGHWFTLRDLEHATNRFSKENVIASGGYGVVYRGRLINGTDVAVKKLLNNMGQAEKEFRVEVEAIGHVRHKNLVRLLGYCVEGIHRMLVYEYVNNGNLEQWLHGAMRQHGVLTWEARMKIVLGIAKALAYLHEAIEPKVVHRDIKSSNILIDEEFNGKLSDFGLAKLLGAGKSHITTRV

SEQ ID NO: 32978 - protein, 144 aa, Sorghum bicolor
  Clone ID: SORBI-28MAY03-C23884_1.pep
MLGFSTGQLLVILGACSVMMKPSDMVKIARTAGRMTGRAVGRLIVARRQLDEILGQSAATQVHKELKDAMTQLDSIRYEVQNLSRLTPGQFMMKQHNTGMAEAGKSDSDDGPTTNQEKFRQEIRSIIRDEITNFVSTTEARKLD

SEQ ID NO: 32979 - protein, 220 aa, Sorghum bicolor
  Clone ID: SORBI-28MAY03-C2405_1.pep
MWPSTTSWLPFLYPPPGSAYVAAMSAVSLVSMANAGLAELRGEHMAYSKFWHVVAGGGNNNKRGGGGGGTGALLMRSRDGMLLAYAPALLAAAASFAVPGAVEGARAQLLSAALAAHFLKRVLEVLFVHRYSGSMPLGTAATISCSYLLSTATMIYAQHLSHDLPDPAVDMLYPGVLVFAVGLAGNFYHHYLLSRLRARTGDGGGDDKGYKIPRGGLFGL

SEQ ID NO: 32980 - protein, 132 aa, Sorghum bicolor
  Clone ID: SORBI-28MAY03-C2406_1.pep
QLVPVHDHQRSNQTAVYYMRGQSHPEHRQAQMFQAAAQSVQTHTRKTQPQTVVEVPQVTSQAPEFYPQPQHQWQHQTGQQVQSQARQPQPQVVQQQQYSNIQQGPAQMIQLQTSSPHAHSTPQVTVVYPPYG

SEQ ID NO: 32981 - protein, 119 aa, Sorghum bicolor
  Clone ID: SORBI-28MAY03-C2415_1.pep
TRPERSKMVVAQTVETGAQTAATLTAQTEQMKRIGNELDTVHFSLKKASKLVKEIGRQVATDKCIMAFLFLIVVGVIAIIVVKIVHPNNKNIRDIPGLAPPAQNYQNRRLLWAEAFIGP

SEQ ID NO: 32982 - protein, 73 aa, Sorghum bicolor
  Clone ID: SORBI-28MAY03-C24220_1.pep
MIIPVRCFTCGKVIGDKWDAYLELVQADYDEEDALTALNLNRYCCRRMLMTHVDLIEKLLNYNTLEKTTGTDS

SEQ ID NO: 32983 - protein, 157 aa, Sorghum bicolor
  Clone ID: SORBI-28MAY03-C24235_1.pep
MENPPSIIVTPIAPAVSAQFTRFTFSKLYIRRTSPGSKELTVDGRPSDHLGTRNVSDCPIFDGPGSNAILVARIQGTITQISNAHELYTIVFEERLKGSTIVTEGIMTEGSDEWAIYGGTGVFAMARGVIKRKNLADKSGGNTDELTMEVFCPVFGS

SEQ ID NO: 32984 - protein, 174 aa, Sorghum bicolor
  unsure (1)..(174): unsure at all Xaa locations
  Clone ID: SORBI-28MAY03-C23242_1.pep
MELASTDLAALGAADLVRVSASIPRAAPRTFALLTACLVFPLSFAVLAHSLFTHPILRRIQGATHNELAQWLRLFAYQFLYLIALFTFSLLSTAAAVFTVASLYAAKPASISASLTALPPIXLPRLLRTFLWVSLLMLAYHLVFALTVLLLLIVFIPNASESAAPPSLSFVLFL

SEQ ID NO: 32985 - protein, 103 aa, Sorghum bicolor
  Clone ID: SORBI-28MAY03-C2328_1.pep
MVSWKRKCGGGGESPARGAGEEKAVPRGHVPMLLAGGANGEEVRRVLVPVRLLSDPSVAELLDMAAQRYGYGQPGVLRVPCDAGHFLQVLDGAMHRCGITSAA

SEQ ID NO: 32986 - protein, 150 aa, Sorghum bicolor
  Clone ID: SORBI-28MAY03-C23311_1.pep
MAAASSMLTAASLSFSPLPAPRLPAAASFAPPRRAAAALVVRAAAASSKSPAAAETAPKKKRATGITQPKPVSSALQAIVGEPVIPRTEALKRLWAYIKEHNLQDPSDKKVVICDEKLKVLFAGRERVGFLEIAKLLNPHFVKREGTPRS

SEQ ID NO: 32987 - protein, 26 aa, Sorghum bicolor
  Clone ID: SORBI-28MAY03-C2429_1.pep
IMKIGSSQNLGSWYSDATQIRSTIGC

SEQ ID NO: 32988 - protein, 140 aa, Sorghum bicolor
  Clone ID: SORBI-28MAY03-C24355_1.pep
ARGRCVLHAAWAAPTGLPAETLVDRYVTVGAYCLLRSCTIEPECIIGQHSILMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 32989 - protein, 233 aa, Sorghum bicolor
  Clone ID: SORBI-28MAY03-C2436_1.pep
RPRLDWRRRLRVVLGADKGVAYLHELADPPIVHRDIKSSNVLLDERLNAKVSDFGLSKPLGDEGRGQVTTQVKGTMGYLDPEYYMTQQLTEKSDVYSFGVLMLEVATARKPLERGRYIVREMKAALDRTKDLYGLHDLLDPVLCAAPSAPEGMEQYVDLALRCVEEAGADRPSMGEVVSEIERVLKMAGGAGPESASNSMSYASRTPRHPYGGDSPFADYSSAGLPSARVEPK

SEQ ID NO: 32990 - protein, 113 aa, Sorghum bicolor
  Clone ID: SORBI-28MAY03-C24376_1.pep
TRALTSAQENWRNEPHGGVRRPSGFLHGRTQELHWTHDFRAAATGAALHFVVANLEQRLWQELAAAGDVWRAWRVLRAWCVRSHGVTDPPMPSMTSLGARAAISGCGAKCKRM

SEQ ID NO: 32991 - protein, 239 aa, Sorghum bicolor
  Clone ID: SORBI-28MAY03-C24405_1.pep
HEGDWLEGGVGGPCSGGLAAGRAMSAAAASSVTKFIKCVTVGDGAVGKTCMLICYTCNKFPTDYIPTVFDNFSANVSVDGSIVNLGLWDTAGQEDYSRLRPLSYRGADVFILSFSLVSRASYENVLKKWMPELRRFSPSVPVVLVGTKLDLREDRSYLADHSAASIISTEQGEELRKQIGAVAYIECSSKTQRNIKAVFDTAIKVVLQPPRRREVTRKKMKKSSNQSVRRYLCGSACFT

SEQ ID NO: 32992 - protein, 285 aa, Sorghum bicolor
  Clone ID: SORBI-28MAY03-C24485_1.pep
MRSPPPTPPPWRPRRLHSVVPVLLLVVAALAARGVGADDLASDARALLAFRDAVGRRLAWNASDVAGACSWTGVSCENGRVAVLRLPGATLSGSVPAGTLGNLTALHTLSLRLNGLSGALPADLASAAALRNIFLNGNRLSGGFPQAILALPGIVRLSLGGNDLSGPIPAELGNLTHLRVLLLENNHFSGEISDVKLPPLQQFNVSFNQLNGSIPASLRSQPRSAFLGTGLCGGPLGPCPGEVSPSPAPAGQTPSPTPVPSGSGGGWRRRQWRRHQRWKRGRKWP

SEQ ID NO: 32993 - protein, 155 aa, Sorghum bicolor
  Clone ID: LIB3476-022-P1-K1-A8.pep
SYDYSPSPPRGYRRRTRSPSPRGRYGGRGRDLPTSLLVRNLRRDCRPDDLRRPFGKFGRVKDIYLPKDYYTREPKGFGFIQYFNPEDASDAKYHMDGQMLLGREITVVFAEENRKKPSDMRARERMSGRSRSYDRRLRSRSPGYSDSSRGRSRSH

SEQ ID NO: 32994 - protein, 103 aa, Sorghum bicolor
  unsure (1)..(103): unsure at all Xaa locations
  Clone ID: LIB3481-009-Q6-K1-C9.pep
MSAREPKGFGFIQYFDPEDASDAKYHMDGQMLLGREITVVFAEENRKKPSDMRARERMSGRSRSYDRRLRSRSPGYSDSPRGRSRSHSPSHSPAPXXKHYSRS

SEQ ID NO: 32995 - protein, 92 aa, Sorghum bicolor
  Clone ID: SORBI-28MAY03-C24511_1.pep
NPYFPGGAIAMPKMLNDGAVEYEDGTPATEAQMGKYVVSFLSWAAEPEMEERKLMGVKWIFLLSLALLQAAYYRRMKWSVLKSRKLVLDVVN

SEQ ID NO: 32996 - protein, 84 aa, Sorghum bicolor
  Clone ID: SORBI-28MAY03-C23754_1.pep
TIQELPTSQPALPLAPPPPWRCPLPPLTKHRPLRVRADASRPPTRDATSGCLSLCLLLPLYLSFPMATACRLAAPLGLAPLPRG

SEQ ID NO: 32997 - protein, 93 aa, Sorghum bicolor
  Clone ID: SORBI-28MAY03-C23829_1.pep
TIAAAITAAAPAPAPAPAVGDKRASPEPTASSDSSSPSSSSSSGTPKRRKRGEAAAATMAMALVPPPPAQAPVQLTLPAHPWFAAGPVQQLVS

SEQ ID NO: 32998 - protein, 127 aa, Sorghum bicolor
  Clone ID: SORBI-28MAY03-C23855_1.pep
MAKQKIVIKVPMSSDKSRSKAMALVAAAGGVHSVAIAGDGKDQVVVVGEGVDSIKLTTDLRKKMGDAQLVEVGEDKKKEEKTKPDPVADAVAAYYNSQYYYHYPPPPPAVAVAYDPYSRPGSTCSIM

SEQ ID NO: 32999 - protein, 102 aa, Sorghum bicolor
  Clone ID: SORBI-28MAY03-C24547_1.pep
ARGTMLVSGGLAGVASWVCCYPLDVVKSRLQAQGMGATPRYRGVVDCFRRSVREEGLPVLWRGLGTAVARAFVVNGAIFSAYELALRFLASGSGPRLVMEEN

SEQ ID NO: 33000 - protein, 167 aa, Sorghum bicolor
  Clone ID: SORBI-28MAY03-C24565_1.pep
QPPPMPPTPTHSFTETLHHNHHWSPPLPSVLSSPPRYLFEMSHHQHHKPPPPPPVMSLPSRSLFETSHWHHHKSPPPPPVLLSPPRRLFETSHHHHHHSSPPPLPPMPLSPSHNLFETSHHHHHSSPAPPRPPVPSSSPRRLFETSHHHHHKSPPPPLVISSPPHSV

SEQ ID NO: 33001 - protein, 155 aa, Sorghum bicolor
  Clone ID: SORBI-28MAY03-C24579_1.pep
GTLPPYHKSEPVPQEKGLVEKVVGRTFDSSVLESHQNVFLEVHTPWCVDCEAISKNVEKLAKHFNGLDNLKFARIDASVNEHPKLKVNNYPGLFLFLAEDKSKPIKLSKKSSVKDMAKLIKEKLQISDVETVAAPDNVKDDVETVAAPDSVKDEL

SEQ ID NO: 33002 - protein, 148 aa, Sorghum bicolor
  Clone ID: SORBI-28MAY03-C24583_1.pep
HEAENSSRKVIFEIEELKDVKPGNRADNSKTLGQVATDEQNQIEDRLNHERLQSLRLKQELADVENRNAELTEELHLVRDKLSIEQTRASQLENEVSEIQQRLQKMDILEKEFESLRSELDSTVSEEAASSGNQLHRSRSRGFWRWNG

SEQ ID NO: 33003 - protein, 177 aa, Sorghum bicolor
  Clone ID: SORBI-28MAY03-C24586_1.pep
DRVRKPSDHHKLKYKSRSQFSTKVILKDGQISLMGEGSPSIAGSLTGKPSDGRLINSYNCDLEDLPMMLLQQVASQVIHWLHDEAMVLGMNVTRDFLCLYFDLDQGETLGLVAHVDPDDTYGCISWYLTVDHPMEEGKMSADSPELEKRRFLGYLSLEVLYSTLMDLIKLCSTGVQH

SEQ ID NO: 33004 - protein, 111 aa, Sorghum bicolor
  Clone ID: SORBI-28MAY03-C246_1.pep
EHTVAGGLFSVSPFRLVWRTAYVVVTALVAMVFPFFNDFLGLIGAVSFWPLTVYFPIQMYMAQAKTRRFSPAWTWMNVLSYACLFVSLLAAAGSVQGLVKDLKGYKPFKVS

SEQ ID NO: 33005 - protein, 87 aa, Sorghum bicolor
  Clone ID: SORBI-28MAY03-C24630_1.pep
RGGELTGESGMGYLWRVRLSSFAAGAATASAAGFFLIYKDHLIARAAITRQVEDIKETSEKHYASLNKRISALESRKESGTIKEASD

SEQ ID NO: 33006 - protein, 180 aa, Sorghum bicolor
  Clone ID: SORBI-28MAY03-C24844_1.pep
TTGDGTSTGCPVPAAPSDGATAAAAGRDAVPVPSPPCLQQGDSGTRRGTPADASATAVRVQPGVRPARRPRHRRDLVGDDDEAAAATHADAAAAADVAVPCLSVPAAEAGGYAFPGVVSGGSSSLAWHFVVTAADGHACSPADAAVATAAADGAFLRAVPRWQAASAAEVDVAGHPSAAD

SEQ ID NO: 33007 - protein, 130 aa, Sorghum bicolor
  Clone ID: SORBI-28MAY03-C24240_1.pep
TRERPSLDRDDDGDRHKKRKKGKHSDRDKDKGKERDSKDRHSKEKEKSKRKDKDAVFKEISKDDYFAKNNEFATWLKEEKGKYFSDLSSESARDLFLKFVKQWNQGKLPSQYYEGITSGPRSAHNWNIKT

SEQ ID NO: 33008 - protein, 55 aa, Sorghum bicolor
  Clone ID: SORBI-28MAY03-C24265_1.pep
LDSGGLTHWSHKILVDLLPHFVYSATTSILRHLYRVNICCKCSHTVSQKHIESHY

SEQ ID NO: 33009 - protein, 232 aa, Sorghum bicolor
  Clone ID: SORBI-28MAY03-C24706_1.pep
GGKRKSAKVMQLDGTSFRVKPPAAAADVLRDHPGFQLLESEEVKLLGARARPLAPDAPLRRGRLYFLVALPRRAPAGPMRRAWSGNLNVGARERLESLKLARRSTSDLSSLPAHAASASAPTSPLPGRGAASPLPGAGGATPVRLKMRLPRAQVEKLMGESKDPAEAAAKIMELCGAHASARVTPERPPGILRSPRFAKTPEWGAGFMLPAPAPAKTPQRWPTLPRTNEKKA

SEQ ID NO: 33010 - protein, 258 aa, Sorghum bicolor
  Clone ID: SORBI-28MAY03-C24711_1.pep
HEDHVQHTVAPVENHVQHQDPLEYKAGNVIYDETYPEEHIPSFPSSTDVKRDSPLAPPHPPLSPTLQEPVEEAPKTYASVLRRNVKATMATAETQQTQQLAPQAQSAPVQEKSNLDNHRAVSTPEDEEEFLSVYVGNLSPSTSVFDLEKVFQAFGRIKPDGVAIRSRKEAGVFFGFVEFEDMSGIQNALSASPIELNGRLVHVEERRPNCGFPRGRRGRGRADFSRDQAGGRYDGEYATRLKGTGHQKKSGRQYDSYY

SEQ ID NO: 33011 - protein, 193 aa, Sorghum bicolor
  Clone ID: SORBI-28MAY03-C24727_1.pep
ARGKREEVLHIDLPRMSRITVMQQLSILRQSGGEIMQNMNASDTPLDIEPLTTADMGEHVVCTPRQILLHPAYHGGWKVLRSCREDGRVDLTYKHKTHGRFRSKKQVLNYLDCLLEKQKESADPAKQCSGVSQAPSFQPYQQGYPSTTSSYSSGGPSLKPSSTIYPPSYYYKAPPPPQFQQQQLPQQSPPREQ

SEQ ID NO: 33012 - protein, 125 aa, Sorghum bicolor
  Clone ID: SORBI-28MAY03-C24731_1.pep
MLLLLGLATGLAVAGEAEKQQQDGGGGAASSGGGGGHGSKISPAVLFVVVIAAVVLFVSCLLHLVVRLLLRRGRARARAEADGGVDAAGGGGGGGEESALQRQLQQLFHLHDAGLDQDVIDALPV

SEQ ID NO: 33013 - protein, 179 aa, Sorghum bicolor
  Clone ID: SORBI-28MAY03-C24736_1.pep
CCQGDKRLLVYEHMCNGSLDSHLFERNDVAAVLHWSTRYQIAIGVARGLSYLHHSCHQCIIHCDIKPENILLDESFVPKIADFGLASVIGRDFSRVLTTFKGTMGYLAPEWLSGVPITSKVDVYSFGMVLMEIISGRRNASVVCSNNSRGHVTYFPVHAMSQLHEGDVESLMDPNLHGD

SEQ ID NO: 33014 - protein, 199 aa, Sorghum bicolor
  Clone ID: SORBI-28MAY03-C24764_1.pep
ARGQLILKSLRWKGKGLAKSALDSSKPQTDSLDGQVTNGLKKAGSLRFYKPKFKYIFCDMDGTLLNSKSQVTARNAEALREARSRGVNIVIATGKARSAVIDALSMVDLSGRTGIVSESSPGVFLQGLLVYGLEGRQIYKRNLDQEVCREALLYSLENKIPLVAFSQDHCYSVFDHPLVDSLHYIYHEPKAKIVSSIDQ

SEQ ID NO: 33015 - protein, 269 aa, Sorghum bicolor
  unsure (1)..(269): unsure at all Xaa locations
  Clone ID: SORBI-28MAY03-C24812_1.pep
DKAKEXECERKENLYPSLVVELCSFEHRIVFQESGANFYTPAPVSLSNELVTVWDPELGRTNPSEHKQLKLARSLTRGIVDRDLKPSSNERKLLQTIIKFPPTRTLHVDEKQLVWKFRFSLMSEKKALTKFVRSVDWSDNQEAKQAVELIGKWEIIDVADALELLSPDFESDEVRGYAVSVLERADDEELQCYLLQLVQALRFERSDKSRLALFLVNRALSNIEIASFLRWYILVELHSPAYARRYYGTYDMLENSMMKLVGREDGDED

SEQ ID NO: 33016 - protein, 175 aa, Sorghum bicolor
  Clone ID: SORBI-28MAY03-C24520_1.pep
MKDRRGSSGGGGDRFAVFPFSMGCMSQSAVSVADPSEKKAQGDPSSSSSSAAAAVTTANTAAQGSSEEGAVKAAAATPGLVATGVSRLMKGIRSLSHMFAAYDGDEEEEEEREMVIGYPTDVQHVGHIGWDGHNNTVGGAGAAMASMVNAFSLPSSLSLHHLDMAMDRAAAHASA

SEQ ID NO: 33017 - protein, 217 aa, Sorghum bicolor
  Clone ID: SORBI-28MAY03-C24526_1.pep
RSEMFNPCKEDSASGFRIEPPRPTPVTESSEDPQRAYPTRIFHSGPLVNQSQPSKAGGGKNGELQVPGVANHPVLVSTRSGLRTDDSSRTMVAQAEAFAHGRRLSESINEHFSNSGKYDQVFPKKDERNSRADGAIGYGSKGNKIHHSGPLTCPSGNVDEMLKENDRQIQEVFRRTRVEKSRARRDHGHHQGGIRPGDFGAIPVFPSSRSSYQAIQQ

SEQ ID NO: 33018 - protein, 118 aa, Sorghum bicolor
  Clone ID: SORBI-28MAY03-C24545_1.pep
ARGFLLAAAEFAAATRSPSAFVQNAIYSNRITIFSKTYCPHSMRAKRIFRDLKEDPYVVELDTREDGRDIQNVLLDLVGRRTVPQVFVNGQHVGGADDTVNALSNGQLEKLLGKSQSQ

SEQ ID NO: 33019 - protein, 152 aa, Sorghum bicolor
  Clone ID: SORBI-28MAY03-C24944_1.pep
MTADGDSPDKIQGRSHQSPRVSGFQYSPSPQRQNGSASERAINGFDSTMDAKRRASPVPAHHNSKQMNNNHNSATTTSSAPAKVTREQRQSLLDLDKLDSARKRLQENYQEAQNAKKQRTIQVMDINDIPKPKNRDAFIRKSASSGLPARNR

SEQ ID NO: 33020 - protein, 156 aa, Sorghum bicolor
  Clone ID: SORBI-28MAY03-C2495_1.pep
VPAQCIKQDAGEQRHGSLLCGFEHLTALEATHQQRSEAGFTEYYNIEARNEFRCAGVSVRRLGGESKGLVLPMYANAHKLVYIVQGRGVFGMALPGCPETFHSVRSPFEQEVATAGEAQSSIQKMRNEPQQLYQFHQGDVIAVPAGVAHWLYNNGD

SEQ ID NO: 33021 - protein, 141 aa, Sorghum bicolor
  unsure (1)..(141): unsure at all Xaa locations
  Clone ID: SORBI-28MAY03-C25009_1.pep
ARGLSRHLASLPIQAKHXRINCIRTAIKRNMEVQNYAYAKQMLDLLYSKAPPTKQDELKSLIDMCAQRGLTNKSIDPFEDPSQFCSVTLSRLSTIGHDVCDLCGAKFSALSAPGCVICGMGSIKRSDALAGGPGPVPSPFG

SEQ ID NO: 33022 - protein, 168 aa, Sorghum bicolor
  Clone ID: SORBI-28MAY03-C25015_1.pep
PVLIFFSAQTLTHTHVVDPDAQQKIVIRVCMCCDKCRSKAMALAAATCGVDSVELDGKYRDEVVVVGEGVDSVKLTRALRKKVGHADLLHVSEVGIKKGQQEAVGHRGAIQPAAVGQTRRRHPTRRRRRPRRHPTRRRRRSRSPSSATTATLSATDTTRATATATATS

SEQ ID NO: 33023 - protein, 245 aa, Sorghum bicolor
  unsure (1)..(245): unsure at all Xaa locations
  Clone ID: SORBI-28MAY03-C25058_1.pep
MLSRLLPRRHHRRLLQTVLRAGAAPEVDLHQRLCSSSAASSPSLSIWRRKKEMGKEGLMAVAQLKRLAALPPAGAHPRLEQFMRSHVSRLLRTDLLAVLAELLRQDHVILSMKIYGVVRKEIWYRPDMYFYRDMLYMLARNKKIDDTRQVWADLKSEDVLFDQHTYGDIVRAFCDAGLIDLAMEIYEDMRSSPDPPLSLPFRVILKGLVPYPELREKIKQDFLELFPDMIVYDPPDTFXDVDEEQ

SEQ ID NO: 33024 - protein, 156 aa, Sorghum bicolor
  unsure (1)..(156): unsure at all Xaa locations
  Clone ID: SORBI-28MAY03-C2506_1.pep
EQNVVLISVPSVLSKDLAPPGKHILHAYTPGTEPFSLWEGLDRKSAEYRRLKEERSEVMWKAVELALGPKFSRERCDVKLVGTPLTHKRFLRRNRGTYGPAIKAGEATXPGQATPILQLFCCGDSTXPGIGVPAVAASGAIVANTLVPVSQHSEAS

SEQ ID NO: 33025 - protein, 144 aa, Sorghum bicolor
  Clone ID: SORBI-28MAY03-C25063_1.pep
TRLPRCRWTTCHPGCWWHARPARCCWTNAASRRSTSARLLVSSLACVLGAQQQQSPAGSGTTAAVNVGHEQDQEPPPPRARTRDDAPAPAPAPAPAGVDDDAPGEMPRSIIDVDVAGLDVMDYYVTDALCFRDSYDLPSDGFSF

SEQ ID NO: 33026 - protein, 340 aa, Sorghum bicolor
  Clone ID: SORBI-28MAY03-C24669_1.pep
MGGGGGELTPTSTPSSPSSSSEPLHPEFAEYVAVSPISDDDESCRVCDDDEVDAIRCRQLREAKEHFNRQLREAKEFHFNRQLREVKELIRRYKPGDWVEGVGGAKAGHFLLPEITTLLLVGPRGSGKSTLVNRITRVFDKDDDPFAPDRAQVSCNSTSNRTIFLHEYPIPRNSSAICIYDTCGWSNDPKKNFKMLHQWMTKGISHGETIMWDNDEGNKTGGIKPLGRQYSFLRYITRKVNFVIFVVDGVAVLESIDSNNKGYTEILHQTFMYPFLSIGDDKPVVVVTHGDRLSIQQCAHVQNELTELLNIPAQQIYAIPGSDDFQTDMAVLDMLHYCVR

SEQ ID NO: 33027 - protein, 113 aa, Sorghum bicolor
  Clone ID: SORBI-28MAY03-C24686_1.pep
ARGSTTITIAVFPSPPSVLLLTSATGSVLILGSASEAWQQLAISHRPRPPWRRRRRRRAPPRVVVGAGLTGRPSIGASPTCSWWPPSSPRTRFTRAPLHGGRELPQERREGFS

SEQ ID NO: 33028 - protein, 176 aa, Sorghum bicolor
  unsure (1)..(176): unsure at all Xaa locations
  Clone ID: SORBI-28MAY03-C2470_1.pep
MPGAAVASPLLLSLSSSSSPFLSSSSTSFLPPHSAAVRTKTAVSVLRALRAEAATLPVLSFTGEKVGEVTLDLKSAPPSTARAVVHRAIITDRQNARRGTASTLTRGEVRXGGGKKPYQQKKTGKARRGSQRTPLRPGGGVVFGPKPRDWSIKINRKEKRLAISTALASAAVAEDA

SEQ ID NO: 33029 - protein, 155 aa, Sorghum bicolor
  unsure (1)..(155): unsure at all Xaa locations
  Clone ID: SORBI-28MAY03-C25163_1.pep
HEAPGTGPARSARPAPAIAPRRPLPSRGSASGGPPGAPAPPHAPPPRPRSPPRPSRCPPQHAPCPPRPGSPFGSTGLPGRGVPPPCQPPPSRGRPLPARPQGCPPGVPAPSPPXPAPLRPGQGPRAPPAAEGFARPPPHLAPLPIQAKHRINCIR

SEQ ID NO: 33030 - protein, 131 aa, Sorghum bicolor
  Clone ID: SORBI-28MAY03-C25198_1.pep
LTTEGARPPLPWRCPPPHRRLQRDLGERPWCGSAALLQARARRGSARAPAPRGPSSPTRPLAPSRVRPRPGPPPRLPSVPPPALPRPRPLPRAQLHRITTPLDNVAVGSITGYIFFFLLASPIVEDLLVAM

SEQ ID NO: 33031 - protein, 81 aa, Sorghum bicolor
  Clone ID: SORBI-28MAY03-C25245_1.pep
GKMTASSPLNSSSGKPQIEASTLGHLVCDPFQSYQPTSRELVCILHKILTRKKTGLLKCIVFPCPVKPWLHIPLSTVLQKP

SEQ ID NO: 33032 - protein, 143 aa, Sorghum bicolor
  Clone ID: SORBI-28MAY03-C25246_1.pep
CQQKTTHLCPAKAHWQNLKVPLCSCTIPFNLLLDHHMVPLCNRITFKILALSAIPLSRCALLLSTYSNQYLILAKMTYDVLQGLFSPQTQYFLCCPPAEVMHLLLSENEVHISAVEVNVFQHEHAAVPSIVLQRKVFDTFMLP

SEQ ID NO: 33033 - protein, 51 aa, Sorghum bicolor
  Clone ID: SORBI-28MAY03-C25254_1.pep
SLIRAIRRLEEVLQQLILASKSIGETELEAKLEEAVNKIKRDIVFAASLYL

SEQ ID NO: 33034 - protein, 153 aa, Sorghum bicolor
  Clone ID: SORBI-28MAY03-C25257_1.pep
DEMRECKIGPNSRTYDVILHYLIKSQKFEEAYNVFQRMGMDGCEPQLNTYTMMVGMFCSNGRVDMALNVWKQMGERGVLPCMHMFSALINGLCFENRLEEACVYFQEMLDKGIRPPGQLFSNLKEALVEGGRISLAQEMASKLDAIRKTPFRG

SEQ ID NO: 33035 - protein, 96 aa, Sorghum bicolor
  Clone ID: SORBI-28MAY03-C2526_1.pep
RILVWLSKYQFFSIITFVDAQLSYNHIDPSCKPRGLKLCFIRPPILQLKMKNELIGSDYLRHDCSVHIVDVGFVLLLCSHPLENQQISYSPCHTRC

SEQ ID NO: 33036 - protein, 111 aa, Sorghum bicolor
  Clone ID: SORBI-28MAY03-C25258_1.pep
YKCDSSTETGDHELGPNGTDDVSKNSEQSETEQTVHVPSICFVDLHKLKVFHTLKLAKGQDITAIALNKENTNLLVSTADKQLIVFTDPALSLKVVDQMLRLGWEGDGLLQ

SEQ ID NO: 33037 - protein, 186 aa, Sorghum bicolor
  Clone ID: SORBI-28MAY03-C24845_1.pep
ARGAPRGIKTDWIMHEYRLADADRAPGKKGSQKLDEWVLCRLYNKKNNWEKVKVEPEPEAAAHHNRQSAAEDSMSDSFQTHDSDIDNASGMQQQQQQQQSFFGDMVQGQAMNMRNNGIGTVTVKEDNDWFTDLNLDDLQASYNMAHMVNPNPVVQTVNLVAGQGHGYLQSMSSPSMKMWQTILPPF

SEQ ID NO: 33038 - protein, 63 aa, Sorghum bicolor
  Clone ID: SORBI-28MAY03-C24902_1.pep
QPLAPICEVCGTAKPKIAKAKYMTWSCKFCTLENSTKLDKCSACDQWRYSYGPPVATHGPSYD

SEQ ID NO: 33039 - protein, 136 aa, Sorghum bicolor
  Clone ID: SORBI-28MAY03-C24927_1.pep
HDGAGIVTRESGETSSSSSSLDARRCYSMGSYQYVLAEASLQVSVHRRHGDGHARAGARLRGVGSNPAGTETGGSGGTEGKRIGAGSKGDSFSVSKIWQWPRNGKGKLPVLASDDSPAMNMNGGRLPWQRPSPGDS

SEQ ID NO: 33040 - protein, 144 aa, Sorghum bicolor
  Clone ID: SORBI-28MAY03-C25296_1.pep
LPPVSFKEWDGLVRICFNRKNRTLGSLFKTKRVLELLEKNYKTMQSLQLTRDADMGEQKMSADDVALLANMVEDLNMETGDEKEDDEMEMDDADMAGDGAASFKEKIMGILQQGDFAEKRGSKLSQVDFLYLLSLFNKAGIHFS

SEQ ID NO: 33041 - protein, 192 aa, Sorghum bicolor
  Clone ID: SORBI-28MAY03-C2532_1.pep
AEDPAAKRFIISFGADRVVSLDGIDFVRCEVVGQSFMLHQIRKMIGLAVAVMRNCAPETIYDVAFRKDVNLNVPTAPEVGLYLDECMFTSYNKKWNDSHPAVSMEPYYEEAEEFKVKYIFPHIAAMEHKEGAVALWLHSLNHRNYPDFRYMETAEPKVGAEVKSIDAGPEAKVGAEVDNIEEAQMPSGNLSE

SEQ ID NO: 33042 - protein, 134 aa, Sorghum bicolor
  Clone ID: SORBI-28MAY03-C2531_1.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDDDN

SEQ ID NO: 33043 - protein, 138 aa, Sorghum bicolor
  Clone ID: SORBI-28MAY03-C25330_1.pep
LGKDFNPNEMARMIACAAACVRHSARRRPRMSQVVRALEGDVSLEDLNEGVRPGHSRFFGSYSSSDYDSGQYNEDMKKFRKMAFNNNYTSSQYSAPTSEYGQIPSASSSEGHQTQEMESGAMKKGGYSGYSSGYSGAS

SEQ ID NO: 33044 - protein, 135 aa, Sorghum bicolor
  Clone ID: SORBI-28MAY03-C25338_1.pep
MVARRYVWIYAAVQFLLVVFFTHLFYRYLHLQAVISIILATFAGFGVGMTGNSIAIEILRWRARRVAPPTQQQARRHRRARAPPQQQQAAPASDSDHQPSSQPSAADVGVGVGVGQHDAMAAAGDVENPPVPQAA

SEQ ID NO: 33045 - protein, 175 aa, Sorghum bicolor
  Clone ID: SORBI-28MAY03-C25335_1.pep
PEVGEIWAIYRNWSPGWVPSSKDACEYAIGVITARTEASTKVLFLTQVDGYRTVFRPDTERSILEVPTKDGLRFSHRIPSFHLTREKGGALCGFYELDPAALPGPFLAGGTPGRPAVALLGRRLDDSRSLFRCVCVRCPLALAARAPAVGPGPCGSGSALLVGPLRSPSAPSCHV

SEQ ID NO: 33046 - protein, 231 aa, Sorghum bicolor
  Clone ID: SORBI-28MAY03-C25355_1.pep
MELELEAATRRFHLWFRGLRSLRRDLASARWSDDAAAQLPALVGRFVAHLESYCAARAGLDPVWTLSAPWATPAERGAAYWLAGWRPTTLVHLLYTESGRRLEAQLPDLLLGVRSGNLGDLTPAQLAQVDDLQRRTVAEEDALAREMALVQEGHGVVAAPSADGSGLLDVAGLVRTARAVLDRADALRLRTVKRAVEILEPAQAAELLVAAADLEIGFREFGLKHGSGRDG

SEQ ID NO: 33047 - protein, 114 aa, Sorghum bicolor
  Clone ID: SORBI-28MAY03-C25385_1.pep
LAHVRFMEYLDVKPFMDPSFVDKGRTLYRLAGVVQHIDIGNGKRSLKSGHYIAYVRARRLGHQQEGSSCSSSWFCADDSDIKQVTLEEVLNCEAYILFYERMEGEDISGIRRQN

SEQ ID NO: 33048 - protein, 143 aa, Sorghum bicolor
  Clone ID: SORBI-28MAY03-C2509_1.pep
MKSRRQSSGGSSAACAAGEANTHTHSSGGGGCKLERKDVEKNRRLHMKSLCLKLSSLLPPAATHASLLADAAAAASNPNNKDSVTQLDQLDSAAAYIKQLRERIEALKQRKAGGPGPAGCNGGGAVTASASASSASGRARVRM

SEQ ID NO: 33049 - protein, 224 aa, Sorghum bicolor
  Clone ID: SORBI-28MAY03-C25145_1.pep
TRWVRKKTGVPVIRLQSKESAEELLEKDQTFVIGLFKNFEGAEHEEFVKAATTDNEVQFVETSDTSVAKVLFPGITSVEKFVGLVKSEPEKFEKFDGEFEEKAILRFVELNKFPLITVFTELNSGKVYSSPIKLQVFTFSEAYDFEDLESMVEEIARAFKTKIMFIYVDTAEENLAKPFLTLYGLESEKRPTVTAFDTSNGAKYLMEADINAKNLREFCLSLLD

SEQ ID NO: 33050 - protein, 260 aa, Sorghum bicolor
  Clone ID: SORBI-28MAY03-C25153_1.pep
TRRQRAVGSPGSEGFMFDLVDSSQLDTTTMPRLSPLSLIPIDQDSSGTLSVQIPQKSFRSLTLQFRGDIANNAERSAIKKKEGTLTNTTTEAEKDVLENGDVNKSIKHAHSILRDIHKSIFLVQVFDMVIRETFVQSQGINVTGMCEDFLQLAIGQECSLCLSLELSRQNSISETVGQEDHMDTDYTENLAVATVNGKESSNKDVRGFPNPKCLEIYLLHMFHENILRKLREKSRHMVRYQSSAQAAPDDCGLLSDFCMT

SEQ ID NO: 33051 - protein, 54 aa, Sorghum bicolor
  Clone ID: SORBI-28MAY03-C25452_1.pep
MVRMRFPKRYLIVLLTFVCTNVCYIERVGFSIAYTVAADAIGVNQANKGMILSM

SEQ ID NO: 33052 - protein, 95 aa, Sorghum bicolor
  Clone ID: SORBI-28MAY03-C25427_1.pep
EFIAAFLFCLPFLSPQKSCVCVTLLNTISKALFECPCIHINPHVLRWIGVEISLVSPPIHTWASKQAMVFLKISDACNYSFFCHYVYSRFQRFDN

SEQ ID NO: 33053 - protein, 208 aa, Sorghum bicolor
  Clone ID: SORBI-28MAY03-C25453_1.pep
VDKITDPVERRATQDQIAYFGQTPSQLLTVPHMKRKPLAEVLQLQTIFRNPSELKSYVLPHPDRCNVPASAMLVSNDSIVVVDVNVPAAHVALHQWQPNTPDGQGTPFLFHHGRNSTNSTSGALMRIFKGSASSAEDFGFPRAIAFAASAIRSSAVVAVTCDKEIITGGHVDGSLKLISPDGAKTIETASGHIAPVTCLALSPDSNYL

SEQ ID NO: 33054 - protein, 120 aa, Sorghum bicolor
  unsure (1)..(120): unsure at all Xaa locations
  Clone ID: SORBI-28MAY03-C25456_1.pep
MEHALISRRFPTDPNEYKLYEEIGEGVSATVYRALCVPVDILVAIKVLDLEKCNNDLDGIRREVQTMSLIDHPNLLRAYCSFTNGHQLWVVMPYMAAGSALHIMKTSFPEGFDEPVIATX

SEQ ID NO: 33055 - protein, 131 aa, Sorghum bicolor
  Clone ID: SORBI-28MAY03-C25459_1.pep
MARSIDSDYIDFSHMGGFDMGIDFNGFEENVKKFMELPIKYLDSAHDKAVEFIEDVHAIFYGPFTDHEVPNNDQSNCYVITESSPTSIEKELVGPNIEPSTPASFITMENSSTGCDTDQTESFSTKSTGLS

SEQ ID NO: 33056 - protein, 185 aa, Sorghum bicolor
  Clone ID: SORBI-28MAY03-C25493_1.pep
MADWEGIPARERRQMEEILQLDMEELNVEVVDDNDEEEEEDEGDGNEEDDVVDAFLRDNNGDGVASTSGPFTFNRSLASLHTYLGEVDDTRGRVTLLDGGTVLNLPMFYLQGVVLFPGATLPLRVIEDRLVVTIDKALRLVDAPCTIGVVLMRRLPNRRHYATASVGTTAEIRQLGRLEDGSLNV

SEQ ID NO: 33057 - protein, 138 aa, Sorghum bicolor
  Clone ID: SORBI-28MAY03-C25488_1.pep
ANSAIVDRPLAFFFFPLPPLLCDRRLIGKEPIEPLSRFQSQDCFWPSLPAEPAMEKKETPPMHSRDLQDEATAASVVSSEQRPRPHLCIDIPAEDHLPTPTHGGMSIITTPPSTRRGQQQTSSNIATTPVSSPSSSRP

SEQ ID NO: 33058 - protein, 279 aa, Sorghum bicolor
  Clone ID: SORBI-28MAY03-C27511_1.pep
ARGIDKERRGDYLGKTVQVVPHITDEIQEWIERVAMNPVDGTEEAADVCVIELGGTIGDIESMPFIEALGQFSYRVGPGNFCLVHVSLVPVLNVVGEQKTKPTQHARRGLRGLGLMPDILACRSTHPLEEHVKVKLAQFCHVPIPNIINLHDVTNIWHIPLLLRDQKAHEAILKVLDLQCVGKVAREPQLSEWTERASRCDRLKTPVRIAMVGKYTGLSDSYLSVIKALLHASVALDRKLVVDWVPSCDLEDSTAEETPDAYEKAWESLKGADGVLVPG

SEQ ID NO: 33059 - protein, 179 aa, Sorghum bicolor
  Clone ID: SORBI-28MAY03-C27530_1.pep
ARGVMKQQNRAEEAIEAIKSLRHRGSDHAHESLDNILLDLYKRCGRLDDQISLLKHKLQLIHQGHAFNGKRTKTARSQGRKFHVTLEQEATRLLGNLGWALMHKENYTEAEGAYRRARLIGPDNNKMCNLGICLMKQGRVLEAKDVLKQVRPAAVDGLRGADSHLKAYERAQEMLRDLE

SEQ ID NO: 33060 - protein, 166 aa, Sorghum bicolor
  Clone ID: SORBI-28MAY03-C27533_1.pep
MARRSSSSSSGAWRYLNPAYYLKRPKRLALLFFVFVAATFAFWDRQSLVSEYESEISRLEDDINRLHDQLRKAGVHLDENPVVSNRNSRKDLVEIDPVNNERREKVKEAMLHAWNSYVKYAWALLEPQPQSKNGINSFGGLGATLVDSLDTLYIMGLKDEFEKARE

SEQ ID NO: 33061 - protein, 299 aa, Sorghum bicolor
  unsure (1)..(299): unsure at all Xaa locations
  Clone ID: SORBI-28MAY03-C25517_1.pep
MGALTDSRKRLSADHCLSADHRLPYPSFPPPSLTPPSKRAKLAPFPELDPSTSTVPPIRPSPQIIHSTATASASSTPGPSSSCITTASTPLPQRRRLPPPPPIQRPIHAPQRNLRVFRLGGAARTHAAGYSWLAPSSPPPRSLGLQQFVELVKSVSHPAPPTPAATTDATRQAEAEADAVPLEVITIEEDKEVRKQQDEEVRGGVVXRRGPIYKELYKASQQKRDAKLKTLEFEVRLAEEGRLGLERLAEALPRITPKKEEVPEPFVPLTDEDEEMVRQALNGKNSRERVALHEPSNIV

SEQ ID NO: 33062 - protein, 171 aa, Sorghum bicolor
  Clone ID: SORBI-28MAY03-C25530_1.pep
RLDDAALATAPGASERKPTGKSPPKGVAEGSPPKRSRSPRNKSPRRQDKWPAAALPLLTVPESSELIVEAAGRASDEKRCKCNHVITDSAIEKLIASLRSKDAWTCYGCWHEFKKGIIRIRPEKSDLLICVTCYDHLCCGVGSIAYPFGHSRAHALKKKHWFAVLYCDPER

SEQ ID NO: 33063 - protein, 177 aa, Sorghum bicolor
  Clone ID: SORBI-28MAY03-C25534_1.pep
CDGRYDTQFHSLFRTLDTAHHKDFHQPNLTGASINNGGPREPWHDIHSKIEGPAAWDVLYNFEQRWRKQGGSIDLLVDLKALVNLIIPPSPVMFPEDQETWNVQLFRSIDGGACYGFPSTPEAAAQSGLVSGKNNVLDRSIQDAYIHAIRRAKHFIYIENQYFLGSSFGWKADGIKP

SEQ ID NO: 33064 - protein, 99 aa, Sorghum bicolor
  Clone ID: SORBI-28MAY03-C25543_1.pep
LDEVTIKRKQIRENLKVLQQAYKTLDEIPLDAEAVERGGYSSLDSDAIGLPRAHGLSSSLHGFNDGSSPYSTPKQSRSRRSNHSGEQPPFNPNMSGNGF

SEQ ID NO: 33065 - protein, 96 aa, Sorghum bicolor
  Clone ID: SORBI-28MAY03-C25544_1.pep
DSSDCSCLCTCRKFEFMGIPCCHMLKVLDYRNIKELPQKYMLKRWRRTAKSADEDNEGNATNANGSSLNAPAPPANHHGLQSFSAMIQDASVSNMH

SEQ ID NO: 33066 - protein, 108 aa, Sorghum bicolor
  Clone ID: SORBI-28MAY03-C25556_1.pep
GHMVVPMEVVHMVLQEVMVREDMTAMVGLEAWVVVAAPVVGAPADTTLMENDHPVSLGSDNKSIPSLISATEKMGHSIHLVESAASEQFFSPWSYSLHNKDSSLVAEP

SEQ ID NO: 33067 - protein, 109 aa, Sorghum bicolor
  unsure (1)..(109): unsure at all Xaa locations
  Clone ID: SORBI-28MAY03-C25574_1.pep
THTGACLNSVDTGSQVCALLXNKNERELLSSHGFTQNQLILWKYPSMVKLAELNGHTSRVLFMAQSPDGCNVASGAADETLRIWNVFGTPETVPKAPYTGIFNSFNHIR

SEQ ID NO: 33068 - protein, 139 aa, Sorghum bicolor
  Clone ID: SORBI-28MAY03-C25577_1.pep
MMKHKPYGRKVDVYSFGLILWEMFSGTIPYEELNPFQAAFAVFDKNVRPVIPTSCPAPVRLLIEQCWASHPEKRPDFSQIVQILEKFKSVLDRDGTLDNMPSSICQLETHDHKNWLAHWVQKLKHSHPDLSGPPPPKLL

SEQ ID NO: 33069 - protein, 75 aa, Sorghum bicolor
  Clone ID: SORBI-28MAY03-C25399_1.pep
ANYLLGKLPLVYGWRAMLGLAALPSAVLAVSVLAMPHAPRWLVMQGRVDQALVVLRRVSDTPGEADVRLAEIKAR

SEQ ID NO: 33070 - protein, 110 aa, Sorghum bicolor
  Clone ID: SORBI-28MAY03-C25413_1.pep
PPLQNHLSLKPSTQNHDLMRRLARPASTLLGRSVRSGPCTLATDAQGLFEEMPPPPAPPKLPCHTLFVHACQVLSRTHTSGFCTVAQRFTDEHASAEPLRFTVTPGDAFG

SEQ ID NO: 33071 - protein, 128 aa, Sorghum bicolor
  unsure (1)..(128): unsure at all Xaa locations
  Clone ID: SORBI-28MAY03-C25421_1.pep
GRRRRVADESAPPRRPRLRSQEPAAPAPARRRASASWAPSPPPSPSXTTSWCCAAPAPPPNXRRSPPRRPRGPAHQQQRTARPTTRPEAAAPAGPRRRTRRPAAGTGTPPPRPVVDDDGSASLPPSRI

SEQ ID NO: 33072 - protein, 93 aa, Sorghum bicolor
  Clone ID: SORBI-28MAY03-C25614_1.pep
VPANEPSSGQWFYVDVPMIARACGLPENTVYIEDINEDISPTNPYPVPKDVNTLIRHSVMPDDHLKYTFTWYTLSAAVTYMASKRIKAKKVRM

SEQ ID NO: 33073 - protein, 169 aa, Sorghum bicolor
  Clone ID: SORBI-28MAY03-C25622_1.pep
LSSLAGIIASLARLPRGLPRLARPPPPRPPPRAALLSIATVFTFIASFSVGVGPITWAYSSEVYPLRLRAQGASVGVAINRVMNAGVSMTFVSLYKAVTIGGAFFLFAGLAVLAATFFYFLCPETQGRPLEEIEEVFTRGWRARLPSSEAPVVELPVSSVTDGNAKARP

SEQ ID NO: 33074 - protein, 171 aa, Sorghum bicolor
  Clone ID: SORBI-28MAY03-C25642_1.pep
RHHQHGRWQARIGRVAGNKDLYLGTFSTQEESAEAYDIAAIKFRGLNAVTNFDISKYDVKRICASTHLIGGGDACRRSPTQPPDAPALAIDAAGADRSSHAPGGGDQAVSDNSDTSAGHRGAHLLHGLQYGHPMKLEAGEGSSWMAAATAAAARPVAGVHQLPVFALWNDC

SEQ ID NO: 33075 - protein, 127 aa, Sorghum bicolor
  Clone ID: SORBI-28MAY03-C25643_1.pep
EAQVWRDLAQSNEAAANALRGELQQALDAQQARLCGGGGADDAESCCCGENDVAAGAGAGAAGAEDGETSSSPAYGRRTCAVCGEGAAEVLLLPCRHLCACAPCAGAARACPACGCAKNGSVCVNFS

SEQ ID NO: 33076 - protein, 216 aa, Sorghum bicolor
  Clone ID: SORBI-28MAY03-C25672_1.pep
TVKIPWRRIIFSLPVWAIVVNNFTFHYALYVLMNWLPTYFELGLKLSLQDMGSSKMLPYFNMFIFSNIGGVIADHLITRRILSVTKTRKLLNTIGFIVSAFALMALPLFSTPSGTVMCSAISLGFLALGRAGFAVNHMDVAPKFAGIVMGVSNTAGTLAGIVGVGLTGNILEAAKASNKDLTDSETWKTVFFVPAYLCIFSSVIFLIFSTGEKIFE

SEQ ID NO: 33077 - protein, 114 aa, Sorghum bicolor
  Clone ID: SORBI-28MAY03-C25679_1.pep
AGTCISHDSSTSVSSCADDPSMLTDNMVNFVDVDLRHGQKHMKNDKIEVYPVHQRENASFKKMFLRNLSRKLRWSKKQADTNQAMTFGSQDAENLGRYQLVSSSDDLEDGWEVL

SEQ ID NO: 33078 - protein, 244 aa, Sorghum bicolor
  Clone ID: SORBI-28MAY03-C25682_1.pep
NAFLKMAHSVEFKADATHEHVLPSLAEETKKLLKKDTTIFTPLVAKWHPQAAVVSASLIHKLYGNKLRPFLEHAEHLTEDVVSVFPAADALEQYTMSVMASVTGDDGLDSICRNKLAPYQIESKSGTLVLRWVNGQLERIETWVKRAADQEDWDPISAQQRHGNSIVEVYRIIEETADQFFAFKVPMRDGELNSLCRGLDKAFQVYTQLVTAPLVDKEDLAPPVPVLTRYKKELGIKAFVKKEV

SEQ ID NO: 33079 - protein, 144 aa, Sorghum bicolor
  Clone ID: SORBI-28MAY03-C25686_1.pep
MMHMLVAPDGGGGELQPYGAPPAEQELELLRDNADDGLEGHVRCLRCGISGNATPHMRRGPDGPRTLCNACGIAYRKGKMRRMIEAEPPIDEASLAKLVPEVGMEFVSEEKAYEFYNKYAGHVGFSVRKSTSHKSSENITKVRT

SEQ ID NO: 33080 - protein, 118 aa, Sorghum bicolor
  Clone ID: SORBI-28MAY03-C25928_1.pep
HTKHAGSSSPAIHCRCSTALTHMDMLHAQDHSMSAHFWVGVGLPLPAFDTTTCPPLAPPFDAPTTSKTLPVPVLKMVPSLRNTQRSQADPAQSQYFTLTRPLAPSAARHCHWRSSHAG

SEQ ID NO: 33081 - protein, 118 aa, Sorghum bicolor
  Clone ID: SORBI-28MAY03-C25504_1.pep
MEDVVAVVAPLPAPPAPTFSPAAAGLTLIAAAAADPIAAAVVGAMEGVSVPVTVPPVRTASAVDDDALPPEGEARGGDPSVAGSPCSVASDCSSVASADFEGVGLGFFGAEGGPMVFE

SEQ ID NO: 33082 - protein, 219 aa, Sorghum bicolor
  Clone ID: SORBI-28MAY03-C25509_1.pep
MAAAARAALPRPHLSLPSSSRRSSPRLSLTPSSAPPARRGGAATSVAAGTSAAPQQHQVTARLGDVIEAQQFDRDALNEIFEVAREMEAVERGSHGAPSRVLEGYLMATLFYEPSTRTRLSFEAAMRRLGGEVLTTENAREFSSAAKGETLEDTIRTVEGYSDIIVLRHFESGAARRAADTANIPVINAGDGPGQHPTQALLDVYTIKREIGTLDGIKL

SEQ ID NO: 33083 - protein, 259 aa, Sorghum bicolor
  Clone ID: SORBI-28MAY03-C25511_1.pep
HEALFDAMQNLGINQKEVKQVAWNFVNDWLKTTLCLQYKPQYIAAGSLYLAAKLHNIKLPLHGAQVWWHQFDVAPKPLEALVHQMMELTAVKKLMPARPNPVKLKETLCEAKLSLSNSPDSVLNQSSLLISSSSPDIGEPDQVQVDSCQYLISSHTGDCRVSGPDSSLLNTCANRNVSCKAHDEESLDQALITKHDNGMMSSSNQTSLDATIGTEGSAMKQDVSHCNDFNIRVNDESLNQVSRNQHGGVPLPDVVSLDA

SEQ ID NO: 33084 - protein, 202 aa, Sorghum bicolor
  Clone ID: SORBI-28MAY03-C25719_1.pep
TRHASHDSPYRTGRHVPLSQSRHDPLTSVATSAVDSRADLTNPYDDDQPNTSSNSPTGIGSPTRPYSPGMRSFASQKRSSNDQGDSGEIQMQSFHDGAPPPPPIAHSWRKIERWLENNFEELFDNLCEGCTQNDINELEHELDCSLPLEVRESLMAHDGQERPGLPTGVIFGCMLLDCEEIVQEWKNWRVVNDEFLSNNSNS

SEQ ID NO: 33085 - protein, 201 aa, Sorghum bicolor
  unsure (1)..(201): unsure at all Xaa locations
  Clone ID: SORBI-28MAY03-C25723_1.pep
MRRLLAHLHPHAQSLLAPLPSKPSIATKLPFLLPRRLLPEAGSPPAPSLPSPSPPATDVTNTELKKRLETYYGVDEEAELPSVAEAVLERNLTGAHSETDDDLIEELRRKPXPEVGDQDFESDFEEMHDTDEELSDLYNAREHVEKKIKNNELFNMDDTKWDAWMKEATDKGCFPNMKVCEGILEDMLYWDKLLPDEIKQK

SEQ ID NO: 33086 - protein, 297 aa, Sorghum bicolor
  Clone ID: SORBI-28MAY03-C25726_1.pep
TRLLKEFIDTDTVTDNGKIVGTQKEEVQPMSGGQERVLRPVIRLPDRNAILTRINPENRDTSVFVKLRPAWEELRSYLTAKGRKRFEVYVCTMAERDYALEMWRLLDPARGLISPQQLSERVNCVKSGSRKSLQNVFRDRGCHPKMAMVIDDRLNVWDDKDQHRVHVVPAYTPYYAPQAEMANAVPVLCVARNVACNVRGGFFTEFDENLLRKVFELYYENGLLDLPYAPDVGDYLVCEDTNFVPGNKDQAPIPEGMRGNEVEKRLNGQSYRWEQREGQQMSFSTRSPDDEGMPIRG

SEQ ID NO: 33087 - protein, 209 aa, Sorghum bicolor
  Clone ID: SORBI-28MAY03-C25732_1.pep
HEAYHRMRKLFYWKGLKADVDNFVKQCEICQKSKHSTTLPAGSRQPLPIPSRVWQDISMDFIEGLPKSEGYTVILVIIDRLTKYGHFIPLKHPYTATIVAHAFLDNIVKLYGLPRSIVSDRDQIFTSRFWQHLFTKYKITLSLSTAYHPQTDGQTERLNQCLEMYVRCAVQDAPTTWKAWLPLAQIWYNSSHHSALGCSPAKALYGIDP

SEQ ID NO: 33088 - protein, 144 aa, Sorghum bicolor
  Clone ID: SORBI-28MAY03-C25741_1.pep
MGLNTTEGGTLTGTRQVGPRGKSMGKEIDSISRGLGTMIPIIVKEGKRRLEAPMQAAKLASESGIIIRQHIPIYTNWTEYKKDRHQLNNLKGKLKGRLAMHVDGLPGSAAWEDFRMGAPRQMRYTRCARSFLAHPPFSGGPLRP

SEQ ID NO: 33089 - protein, 177 aa, Sorghum bicolor
  Clone ID: SORBI-28MAY03-C25761_1.pep
HEARPHVAASLSKHLRLRLRGGGEHCLLPSRASTSHTSSPAPPPPSRPPAAAAPPPPGAAKEASAWSKLFLFAPGAITFGLGTWQLFRRQEKIEMLDYRTRRLEMEPVVWNEAASSAALRDPAALEFRKIVCEGDFDEEKSVFVGPRSRSISGVTENGYYVITPLIPRSTESGSLQS

SEQ ID NO: 33090 - protein, 106 aa, Sorghum bicolor
  Clone ID: SORBI-28MAY03-C25779_1.pep
SQRQSSMASRAIISRRKYFLDHVNTPVISSSAFSTFQHGRLRFEVEPRTEQQFLERSSGDSKCEKEQHSMNLIKKDLLGFGYGFRQHPAYVISLSHGGIGKNEYGL

SEQ ID NO: 33091 - protein, 266 aa, Sorghum bicolor
  Clone ID: SORBI-28MAY03-C25781_1.pep
HEATILSDCTIQQKLVFSLNGKELDRSVTLYQSILQDQINVGSDIILDMQFWRSVHDITFRAANPEANITAVNPEANGSPRHSSTAMSSINENITGFTWQMLPFFPSMLLGKLPCKLDRSGPSYDILFMLHILEGLNRYSFHLVSDERNRSFAHGRITNLNDLKAEVFSIPQQEFVSAKLTDKLEQQMHDPLVSKSFCLPLWCTELMSACPFLFSFEARWKYFQLTAFGSLKNHHGHMIDASVNSVAERASNHSRKKFKVDRDDIP

SEQ ID NO: 33092 - protein, 80 aa, Sorghum bicolor
  Clone ID: SORBI-28MAY03-C25581_1.pep
REHCLEDQHVVFRDQVQNSSPARNEEYHFQVELAGLILGRGVGSDREAAKLLAAEEALKTLKSTSDPQIKKYLRPVRCNG

SEQ ID NO: 33093 - protein, 121 aa, Sorghum bicolor
  Clone ID: SORBI-28MAY03-C25604_1.pep
LQGAKSLLSGLYQCLRSLKEVMVHKDAKLVDAVQPQLRMDPNKPVLYSFLFILPFLLPVSLSPSILCVFPCMRVKFNSCGRCTASGLCVSSDGYQSCINFLCGLCMWIRITGLLYSLQPDV

SEQ ID NO: 33094 - protein, 152 aa, Sorghum bicolor
  Clone ID: SORBI-28MAY03-C25817_1.pep
TRLFSLQPLSCFYEDSPEQSGKKVNCIIHLGPSSVTRSVDYQNWMKKFGATQHIMAGHEIKNMEIPILKGSARISSRLNFVCPQLFPSSGFWSVQPPNDVMENDKNASLEACGSVSAQNLLKFHLRPYAQLGLDRASIPNLFTYKDIVQELV

SEQ ID NO: 33095 - protein, 269 aa, Sorghum bicolor
  Clone ID: SORBI-28MAY03-C25836_1.pep
MEAFSGFYVDEKAARVENIFLEFLKRFKESDGAGEPFYEVEMEAMRSRESTTMYVDFEHVMRFNDVLQKAISEEYLRFEPCLRNACKRFVLEHRAGENRAPIISDDSPNKDINIAFYNIPMLKKLRELGTAEIGKLTAVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECR

SEQ ID NO: 33096 - protein, 149 aa, Sorghum bicolor
  Clone ID: SORBI-28MAY03-C25843_1.pep
ARGEHDMQSFVSSKDEAAQGLRKSVQKLKVLHGSGITALDDLAGEIDMNSQTTFERLNSQIQSHTSALEKCFGGIASEADSLLNELQCSLSKQEERLAHFAKKQREGHLRAVEASRSISKITAGFFHSLDVHASKLTSILEDTQSVQDQ

SEQ ID NO: 33097 - protein, 164 aa, Sorghum bicolor
  Clone ID: SORBI-28MAY03-C25887_1.pep
TREQFDEDSNGEIDKEELKHCFQKLEISFTEEEISDLFEACDINEDMGMKFNEFIVFLCLVYLLNEPAVSEAKIKMGLGNLEATFETLVDAFVFLDKNKDGYVSKDEMIQAINETTTGERSSGRIAMKRFEEMDWDKNGMVTFKEFLFAFTRWVGIDENEDDDE

SEQ ID NO: 33098 - protein, 145 aa, Sorghum bicolor
  Clone ID: SORBI-28MAY03-C2589_1.pep
TTVFPVGEPGPRAAGTTTTKKAAPAVKLLTNVEKLRLLTKAERAGLLSAAERAGLSLSAVERLGLVRKAEELGALSAATDPGTPGNLLALALPLLAAGPAVVYLVPEEQAWQVALQAVAALVCVVGGAAAVAASTFVSRLQGSSS

SEQ ID NO: 33099 - protein, 64 aa, Sorghum bicolor
  Clone ID: SORBI-28MAY03-C25906_1.pep
QGCRISRTQLLKKLLEIEIYISNQNSLVVLLQKSESKMRAQWTAANEHELQFHHLPKTQKEMQN

SEQ ID NO: 33100 - protein, 113 aa, Sorghum bicolor
  Clone ID: SORBI-28MAY03-C25903_1.pep
HEEEGFYVTAMATAGSRWAVVMSRNSGFSAQVVELDFLYPSEGIHRRWDNGFRITATAATWDQAAFILSIPKRKPADETQETLRTSAFPSQHVKDKWAKNLYLASICYGRTVS

SEQ ID NO: 33101 - protein, 249 aa, Sorghum bicolor
  Clone ID: SORBI-28MAY03-C25703_1.pep
VRGKKSKRMKSSLKKKTDISKHLDGLKTSPVADSRTLDKKTVDDVLSERKSGRTLRSMSKKEGAWEGLKRLAKDGNEELTGKSKDASVLKENNQRYGAGSAHKRGRITEDGYHRLGDSNAEDLTSDKRRSGHNENSISKRVSISEHGRKKKKLSELMAGTGRPNSASGGKTRGKRLLHDSVEKAEDPDHHSKDTLVTRKRKKLNTLGDLSSQSEPLSRKKSTKVGELMSKAAGNSIQAAPAVGANSAVS

SEQ ID NO: 33102 - protein, 134 aa, Sorghum bicolor
  unsure (1)..(134): unsure at all Xaa locations
  Clone ID: SORBI-28MAY03-C25718_1.pep
MPPLSTGSRNPLAKCYGDRFIPERSAMDMDLAHYLLTEPRKGKENPTARVSPAKVAYRKQLAEKLLNNRTRILAFRNKPPEPESMLTDPRADATQAKPTKQRRQIXQSAEKVLDAPELVDDYYLNLLDWGSSNV

SEQ ID NO: 33103 - protein, 219 aa, Sorghum bicolor
  Clone ID: SORBI-28MAY03-C25983_1.pep
KGWQQAAVAFGSAFGALLDPRRADLIAALGETTGKPAFDLVLQRMKNSAEGREVLLERPRVISSQVSHAWDMPQNTFGAAYAQFMGSRNFSPDDRPPVRFMDTDELAYVATRAREVHDFWHVLFGLPTNLIGETALNVIEFEQMFLPMCMLSVVGGSARFSEKQRTLFFQHYFPWATKAGLKCTDLMSVYYEKHFHEDLEEVRRNWGILPCPNPQKSNV

SEQ ID NO: 33104 - protein, 115 aa, Sorghum bicolor
  Clone ID: SORBI-28MAY03-C25987_1.pep
WGYFSQRTGLLIQLEDSHLLRMKSGKGHRRSENIFWETSMESVISDYRCIDGVNIAHGGHTNVTLFRYGEGSVNHKRKLEETWTVEEADFNVHGLTADYFLPPADLKKDVDDQNK

SEQ ID NO: 33105 - protein, 98 aa, Sorghum bicolor
  unsure (1)..(98): unsure at all Xaa locations
  Clone ID: SORBI-28MAY03-C25993_1.pep
VGPATASAVLAAYAPDVAPFMSDEAMLAALANAKEYTLKQYLSFADKLQAKAKELSIGEEXSHPRDVERALWSSAIASKSPASGNPKSESKMHGKRKR

SEQ ID NO: 33106 - protein, 144 aa, Sorghum bicolor
  Clone ID: SORBI-28MAY03-C26005_1.pep
YYTGKDERLLGPASFKLFIGPGHGGGYGLMVRRWVVIYLKVYRRRRHLLRRSELQSRRVLLLAPHAQTSWHGNGGVRVVWGRWRRGVDEEAGQHKEHKDDEDRVHGHGAALHSACSLASRAAGVSHSRDELRTKGAKILKLPRA

SEQ ID NO: 33107 - protein, 95 aa, Sorghum bicolor
  Clone ID: SORBI-28MAY03-C26051_1.pep
IIVIATRDACFSKQQSVIQQLLSRKGRLIVMCSRGDASAVCPSGSCRVIEVPQVADCLQPVINIIPLQLLAYHLTVLRGFDVDQPRNLAKSVTTQ

SEQ ID NO: 33108 - protein, 154 aa, Sorghum bicolor
  Clone ID: SORBI-28MAY03-C26081_1.pep
SNQLDARFSSAVTAGFEDSDISSKSLLSSFDDSLKLDHGICDNVKSIVMTSRTELHDLEHGHYEKTKVVTGNADRSLGDDYKVDEATCSTPRRREINIPDSQSIRGLVTPLDDLVKAFWDSRTPTKLALTGNGKQQLAGSTTPETQRAPLAAIN

SEQ ID NO: 33109 - protein, 117 aa, Sorghum bicolor
  Clone ID: SORBI-28MAY03-C26121_1.pep
MAETVGFASGDAAAWRAALAAYDRRLAALDKPDLVAVDSFYRHDLPALLRCRDPDPFLAKPELVRLLQWKLSRGKWRPRLMDFVKGLDDAVVETASRKAFAALPDLRRAITELTLLK

SEQ ID NO: 33110 - protein, 242 aa, Sorghum bicolor
  Clone ID: SORBI-28MAY03-C2609_1.pep
MATAVPAASLRAPSSSPAAAARRLGAGAPSLRKRHCAVAPVAAACGPAPPRQLDNEEAACSGRRRVLVAGAAAFLSRPNPAAFAAEAKKGFLPVVDKKAGYSFLYPFGWEEVAVQGQDKVYKDVIEPLRPVSVNSIPTSKEDIRDLGPPDKVAEALIKKVLAPPTQKTKLIEAKENDVDGRAYYTFEFTGQAPNYTRHALGAIVIANGKFYTLTTGANERRWEKMKDRLHTVVDSFKIENRI

SEQ ID NO: 33111 - protein, 72 aa, Sorghum bicolor
  Clone ID: SORBI-28MAY03-C25792_1.pep
MIAEKPSWIRHEGLQIFSIDIQPGGLRFATGGGDQKVRIWSMKSVDKNNANNDSSQGLLATMRDHFGSVNCV

SEQ ID NO: 33112 - protein, 145 aa, Sorghum bicolor
  Clone ID: SORBI-28MAY03-C25814_1.pep
MYTVRPHAATSTVILNCTEAPLDCLPLCPGGGEAPCSAYALPPPPPLPVIPRAPVAADRHAPVRLLLVISLLSAFLFLSLALSTLLLYRRRRLILRRRRRLAAAAAAEGADDDDGGGGFGDEEEGGGGGVVHHVWYIRTGGLDEA

SEQ ID NO: 33113 - protein, 109 aa, Sorghum bicolor
  Clone ID: SORBI-28MAY03-C26202_1.pep
TVKSELDKYLSEDNEEHSKGFDILKWWKDNATRFPILSRMARDLLAIPISTVASESAFSAGGRTLDDFRTSLTPTMVERLICANDWKWNLSCTPLVNYSAPQLSEEGAS

SEQ ID NO: 33114 - protein, 165 aa, Sorghum bicolor
  Clone ID: SORBI-28MAY03-C26197_1.pep
TRGEFVDEPKPHRSEDCVSLLAELDTFNNQQGQSPSPSNVQELAERTLKAYLNVRRGVEQLMSKYTVKACGYCSEVHVRPWGHNVKLCGAFKHHWRDGKHGWHDAVVDEVIPPNYVWHVPDPSGPPLRSSLRSFYGKAPAVVELCVQAGAEIPDEYRPMMRTDIV

SEQ ID NO: 33115 - protein, 193 aa, Sorghum bicolor
  Clone ID: SORBI-28MAY03-C2622_1.pep
ASGGFSNGFFPFIIAEKDVCSEVSELESIFESSSNEHANVNDDARDQALEFINELGWLPHRANRMSKEDETDTSLAAFNMWRFRNLGVFAMEREWCAVIKMLLDFLFIGLVDVGSRSPEDVVLSENLLHAAVRRKSVNMVRFLLRYKPNKNSKGTAQTYLFRPDALGPSTITPLHIAAATSDAKDVLDVLTDD

SEQ ID NO: 33116 - protein, 182 aa, Sorghum bicolor
  Clone ID: SORBI-28MAY03-C2625_1.pep
MLLNSHNGAVEVDEIEIEVQNNPGGGVGIQPERQTVLEKLKELSSLRQQAAISSQDCTDSGSDQCVPDVRQTNPNLSCGLFDATMEDKTSFDECHGNAEVMQIITHLQMRTEALEKKLIGSDREILSLREVVKDSGRKVQQLEYLVDELQFKFDSSLSLLGSMCNTLAKPSIFLIGGYNGVT

SEQ ID NO: 33117 - protein, 47 aa, Sorghum bicolor
  Clone ID: SORBI-28MAY03-C26349_1.pep
SAISTRHVDRPCRASACWEQILWQLLMISLTDNLQLNYTVDWPGRTV

SEQ ID NO: 33118 - protein, 69 aa, Sorghum bicolor
  Clone ID: SORBI-28MAY03-C26388_1.pep
KTKFYHVQKVEAEFSWLALPAYHPFRISFRYKTYPDILRTIHPEKESGTETQSVALSRPQTQSLLPALF

SEQ ID NO: 33119 - protein, 47 aa, Sorghum bicolor
  Clone ID: SORBI-28MAY03-C26386_1.pep
HVSYDLLSLPSDVDQLLLEKLEAEIQCFILTRASQDWKLLTKDQFAR

SEQ ID NO: 33120 - protein, 195 aa, Sorghum bicolor
  unsure (1)..(195): unsure at all Xaa locations
  Clone ID: SORBI-28MAY03-C25931_1.pep
QEEAXXXGLELEPCMDAVNVGWKKNMLLEDVVDIDIGYDAPPPSFTAGMELQKERRARIEAAKQRIDAIRKAPAAPAAKANNSEDVVSNEYAPPPQKLTRKSRGGKKLDDTDHILLSDNMADSSGVRKKRRRRGSCDGIDWEDCIIELLLLHGANEDEIEQGQYRRLLELHVFSAVSGGKLNTWQCCVSSLQYRS

SEQ ID NO: 33121 - protein, 141 aa, Sorghum bicolor
  Clone ID: SORBI-28MAY03-C25945_1.pep
CMNSSFWTGPVAVASNWAANLQAQEPAGSSEAAKVVGPGLARLADLRAAAGAGGRAVELVCARAERHASVLHAVAEAPQLLRLRPARLRRQRRGNNRHRQPQHRRCGSPGRRGHRVILLGSAGLRICSLKFRLAQVVNLGD

SEQ ID NO: 33122 - protein, 211 aa, Sorghum bicolor
  Clone ID: SORBI-28MAY03-C25815_1.pep
ATAFPEKTSKASAAPFRSCPLFLLPCCCCFSEPLVAAVLCCLFVLCARLCARSPAPCARHLAGLPLRPLPGARASSASRFIKCVTVGDGAVGKTCMLICYTSNKFPTDYIPTVFDNFSANVAVDGTTVNLGLWDTAGQEDYSRLRPLSYRGADVFVLAFSLVSRASYENVMKKWLPELQHYAPGVPIVLAGTKLDLREDKHYLLDHPGAVP

SEQ ID NO: 33123 - protein, 42 aa, Sorghum bicolor
  Clone ID: SORBI-28MAY03-C26400_1.pep
KFIVVVDETKLVDGLGGSGLAMPVEVVQFCWKYNLVRLQELF

SEQ ID NO: 33124 - protein, 96 aa, Sorghum bicolor
  Clone ID: SORBI-28MAY03-C26406_1.pep
VVFTSISMSHPHILLLDEPTNHLDMQSIDALADALDEFTGGVVLVSHDSRLISRVCEDEQRSEIWVVEDGTVNRYDGTFEDYKDELMEEIKKEVEE

SEQ ID NO: 33125 - protein, 40 aa, Sorghum bicolor
  Clone ID: SORBI-28MAY03-C26408_1.pep
YRPGLFHFHTNNQSNMSKLCKFLRDGSIIFFPGHRCLEKS

SEQ ID NO: 33126 - protein, 38 aa, Sorghum bicolor
  Clone ID: SORBI-28MAY03-C26420_1.pep
VAIIMPKAENGGYVTGSCCHSHCVWWTNISPMQNLDSG

SEQ ID NO: 33127 - protein, 43 aa, Sorghum bicolor
  Clone ID: SORBI-28MAY03-C26432_1.pep
TTPAQCLVSLCISPSLQDRFSGACGDTAARQVGSAACETKQWL

SEQ ID NO: 33128 - protein, 38 aa, Sorghum bicolor
  Clone ID: SORBI-28MAY03-C26435_1.pep
IKLYTMFYNLDKQRSLHYVLESGRVCRKFPKVLGDPCV

SEQ ID NO: 33129 - protein, 93 aa, Sorghum bicolor
  Clone ID: SORBI-28MAY03-C26446_1.pep
MALTLHINNTNKAPYIDGTNYAYWKVKMTAHLRSINREVWKVTETKFEVANQNTPTRVEEKKLQCNDIAISALHEALDDSKSRTLRLLMMHGQ

SEQ ID NO: 33130 - protein, 57 aa, Sorghum bicolor
  Clone ID: SORBI-28MAY03-C26470_1.pep
DYSQWLTPMPASRRTAAAAAAEREHDVWKFKPYPLRVAMLTTIYGFGLYKWWMYVSS

SEQ ID NO: 33131 - protein, 137 aa, Sorghum bicolor
  Clone ID: SORBI-28MAY03-C2647_1.pep
MAEQSGAQNAWDMLSDEQSQKHITTGAGDLNDILGGGIHCKEVTEIGGVPGVGKTQLGIQLAINVQIPVEYGGLGGKAVYIDTEGSFMVERVYQIAEGCIRDILEHFPHSHEKSSSGKKQLQPEHFLADIYYFRICS

SEQ ID NO: 33132 - protein, 95 aa, Sorghum bicolor
  Clone ID: SORBI-28MAY03-C26155_1.pep
MTAPADKGKKAKTEADGGEENEQIDGALVLSIEKLQEIQDELEKVNEEASDKVMEVEQKYSEIRRPVYLKRGDIIKTIPDFWLTAFLSHPLLSEL

SEQ ID NO: 33133 - protein, 108 aa, Sorghum bicolor
  Clone ID: SORBI-28MAY03-C26171_1.pep
GWLRDFLWAQASQVIQSYGSSLSAYGLFFLGAHFVWAFSLMFLFSGRGYWQELIESIVWAHNKLKVAPATQPRALSIIQGRAVGVTHYLLGGIATTWAFFLARIIAVG

SEQ ID NO: 33134 - protein, 51 aa, Sorghum bicolor
  Clone ID: SORBI-28MAY03-C2619_1.pep
MSFEMKLKYRSYQLCICGFQIDSTYTLRIDKPTEFFTTNDPSTLVVLILPV

SEQ ID NO: 33135 - protein, 145 aa, Sorghum bicolor
  Clone ID: SORBI-28MAY03-C26543_1.pep
EPGAKMLNPEVYPRPTGEVYICGMSKDENPPDDPATITGEPDSIAMLHKIAGKVSSQLKKEEGAEVVVEQACYLPCTTDGLPVIGEMPGVKGCYVATGHSCWGILNGPATGAALAELILDGKAKIVDLEPFSPARLLKRRSRRGA

SEQ ID NO: 33136 - protein, 58 aa, Sorghum bicolor
  Clone ID: SORBI-28MAY03-C26535_1.pep
SLHGLPPERVIGPAPELVDDDKNPRMYMDTDFATFLEYLTSAEGKHKSFLHTRRLITS

SEQ ID NO: 33137 - protein, 59 aa, Sorghum bicolor
  Clone ID: SORBI-28MAY03-C26545_1.pep
EKWSYRSCKTNSENFLHYLKVGIGQCCWDVNISPFKVPCISIGVKLLGSEYQILRGSLH

SEQ ID NO: 33138 - protein, 170 aa, Sorghum bicolor
  unsure (1)..(170): unsure at all Xaa locations
  Clone ID: SORBI-28MAY03-C2662_1.pep
ISSAGAYXPVREISRQSRLFAALSKKVIDLDELRMLAAQGVPDAAGVRATVWKLLLGYLPNDRSLWEQELAKKRAQYAAFKDEFLRNPVEISRQVQTEGHHNVNEEHVDNGFLHRSEVTRGEHPLSLGKTSAWNQFFECSEIMEQIDRDVKRTHPDMHFFCGDSSFAKSN

SEQ ID NO: 33139 - protein, 96 aa, Sorghum bicolor
  Clone ID: SORBI-28MAY03-C26556_1.pep
HHSKKWIFKKEQDWCGLESACRAFTFAPQVTVLLESWPELVKMGKHLILQPHLIYHYADESASAAHSVGTRRQGGCSRSIQSDIRSAEQTEGAAAV

SEQ ID NO: 33140 - protein, 145 aa, Sorghum bicolor
  unsure (1)..(145): unsure at all Xaa locations
  Clone ID: SORBI-28MAY03-C2663_1.pep
AXNAPAYVGVLNACSRAGLLEDGLRCFDRMRLEHKFAPNAQHYGCMVDLMARAGRLDDARALIGSMPTGPTDTAWRSLLNACRIHGDLDLAESALEELRSLGAANAGDYVIVADMHARAKNWAAAAPTRPEAXDWGLAQXPGXXA

SEQ ID NO: 33141 - protein, 119 aa, Sorghum bicolor
  Clone ID: SORBI-28MAY03-C26639_1.pep
YIGFFGVDGKRWRRTTSGEEENHVVLPVWWLWLGGNNNNKIGLREVLAAARTRRPCIARKYSWGVYLGDEKKRSGHFPIHQWLACFGCYQQSSTYPAKASLKPLFCNFFTCKRSLPWAP

SEQ ID NO: 33142 - protein, 169 aa, Sorghum bicolor
  Clone ID: SORBI-28MAY03-C26642_1.pep
YMTNAVVSFALGPIVLPALYFVGQEVLEHAVKDEEYDELFRLMSTCGRLLNDSQSFEREGNQGKLNSVSLLVRHSGGSMSIEAAKKALQKSIDVSRRDLLRLVLRKESVVPRPCKELFWKMCKILHLFYFQTDGFSSPKEMVSAVNAVINEPLTVQNTTSSFLSSSSGK

SEQ ID NO: 33143 - protein, 83 aa, Sorghum bicolor
  Clone ID: SORBI-28MAY03-C29349_1.pep
LTSLYLLVSDQQASSSVACTTLMPPRDLREGMAGCYSSETARPTELIIVPRHLTDDRRCYYYCSNDASRFTTAICLVTIIASI

SEQ ID NO: 33144 - protein, 253 aa, Sorghum bicolor
  Clone ID: SORBI-28MAY03-C29318_1.pep
MEKAMLLLLLSLCASRLGGAVAQQYQYWTPATATFYGGSDASGTMGGSCGYGDLYSAGYGTQTTALSTALYGDGASCGACYLVTCDATGTQYCKPGSPSVTVTATNFCPPNYDDANGWCNSPRRHFDMSQPAWETIGVYQAGVIPVNYRRVSCQRSGGIRFAISGHDYFDLVTITNVGGAGAVAAAWIMGTGGTDWLAMSRNWGENWQSGAYLTGKALSFKVQTDDGKVVVADNVAPANWQFGSTYQASVNFY

SEQ ID NO: 33145 - protein, 108 aa, Sorghum bicolor
  Clone ID: SORBI-28MAY03-C26676_1.pep
PERWLSADGTRFEPHDSYRFVAFNAGPRICLGKDLAYLQMKNIAGSVLLRHRLAVAPGHRVEQKMSLTLFMKHGLRMEVRPRDLGAVIDELRGAGGYDAAARATAASA

SEQ ID NO: 33146 - protein, 112 aa, Sorghum bicolor
  Clone ID: SORBI-28MAY03-C26682_1.pep
ATHQAAAPATPGEALAEAAGSRGWLREYVDRLASSASSLSGRWSARWSQGHHSARWSQGQGHHSRSQSQSQSYRQEDSWRWDPEAATGAAMHRAPDEEEPAFVALYRWIVGV

SEQ ID NO: 33147 - protein, 140 aa, Sorghum bicolor
  Clone ID: SORBI-28MAY03-C26687_1.pep
DRSVAFCNQDKKQRNEESLPSTSHWRSIKQHVLSHGSSRPLSLKHSLDTSLSDSREASTSLPAEGGPMLVNIPRTTEQGVEYGRPPSVPSSTLVELTTRLDFFKERRSQLMEQLHSLDLGHGSTSHGFPYKPSSPWNSPK

SEQ ID NO: 33148 - protein, 172 aa, Sorghum bicolor
  Clone ID: SORBI-28MAY03-C26701_1.pep
GLKHCGPCVKVYPTVLKLSRSMVDNTVFARMNGDENRGCTGCRSATSTAAAPACASCWAAPSGAPGPASGWAPPCGGCRGPCAATPSSRAGTATATPPASRSSGPRASSRCPLSSPAAPVRSAAARGVAAEASPPPPPPPNRNLSHIACMGDPSLLVLRFLWILSLYGFVVF

SEQ ID NO: 33149 - protein, 161 aa, Sorghum bicolor
  Clone ID: SORBI-28MAY03-C26708_1.pep
RNVLIRLEAEVAKVVETQTGLERQLELIETHQREVDKALQSMEEEAERIFQDERVLLREDDAASARDTMYEQAEVVEHELQHMTEQVKSIIQTMNATQGGELESADSMTPFDVAVRILDNQLRSLMWIDEKVNEFSGRIQRLPSNSASAERDSGIPRFWLS

SEQ ID NO: 33150 - protein, 132 aa, Sorghum bicolor
  Clone ID: SORBI-28MAY03-C26739_1.pep
VVNEATASDGNMHFIAGDMFESIPPADAVLLKNILHEWGDENCVKILQRCKQAIPSRTAGGKVIIIEMVRGSSQGDSKINEMEVIRNMFMLCINGVERDINEWKKIFSDAGFSDDYKIMPVLGPFSVIEIYP

SEQ ID NO: 33151 - protein, 101 aa, Sorghum bicolor
  Clone ID: SORBI-28MAY03-C26715_1.pep
APRQLLPLPVLRQWRRHGPRQPPPTTTNNRSSSPTSTSSRRWRTRRTRTVSTWRRRRSSSATRTPTPAPSCNGNGRRRRRRRRWVSLAWYASASSLIRRQL

SEQ ID NO: 33152 - protein, 186 aa, Sorghum bicolor
  unsure (1)..(186): unsure at all Xaa locations
  Clone ID: SORBI-28MAY03-C26748_1.pep
FYSTGSQYTPEQYAESLADDYSRLLQVMYRYGARKVALIGVGQVGCSPNELAQRSADGATCVPQINAAVRIFNRRLVALVDRFNALPGAHFTYINVYGIFDDILRAPGAHGLTVTNAXGCCGVXGRNNGQVTCLPFQTPCANRHEYLFWDAFHPTEAANVLVARRAYSAXSPSDVHPVDLRTLARL

SEQ ID NO: 33153 - protein, 122 aa, Sorghum bicolor
  Clone ID: SORBI-28MAY03-C26500_1.pep
DADTLVEYHSHWGQCSERPMTELDQYLQAPHLTTSEPVGLKGAVGKPSDLQWWKEHSRNYPTVARMARDVLALPCISDWKAATRTATLAISESGSKQWVEELVCTQDWLTPAGANQESTDDL

SEQ ID NO: 33154 - protein, 44 aa, Sorghum bicolor
  Clone ID: SORBI-28MAY03-C26509_1.pep
ERSDRRQSALYLTGSGSNTQPALTISTTSARPQTSIQIPDTPQI

SEQ ID NO: 33155 - protein, 187 aa, Sorghum bicolor
  Clone ID: SORBI-28MAY03-C2653_1.pep
MGIDLVAGGRNKKTKRTAPKSDDVYLKLLVKLYRFLVRRTKSNFNAVILKRLFMSKTNRPPLSMRRLVKFMEGKSGPLARPVGTVTDDKRINEVPAMKVCALRFTETARARIINAGGECLTFDQLALRAPLGQNTVLLRGPKNAREAVKHFGPAPGVPHSHTKPYVRSKGRKFEKARGRRNSRGFKV

SEQ ID NO: 33156 - protein, 117 aa, Sorghum bicolor
  unsure (1)..(117): unsure at all Xaa locations
  Clone ID: SORBI-28MAY03-C26806_1.pep
TLQAAPNQIREPILPQIAKSYLRIKDSNMKVEVVMKYLAEKLGIARSHQVELTCRGQVLPPLLLVKCVRETIWCSTALREEEAVDLYXRRSSAATDHVMTLCYSTSRNTKLVAPLNL

SEQ ID NO: 33157 - protein, 176 aa, Sorghum bicolor
  Clone ID: SORBI-28MAY03-C2682_1.pep
MCDLVARTGRHLQRYENGRRLVAGCIPFRYRDINDEASDDEQKKLVEVLMISSQSGPGLLFPKGGWENDETVEEAAAREAIEEAGVRGDLVQLLGFYDFKSKQPEAMCRAAIFALHVKEELASWPEQNTRQRSWLTVPEAAEQSRYPWMQEALVTGFSAWLENWRNGGGRVDRNER

SEQ ID NO: 33158 - protein, 143 aa, Sorghum bicolor
  Clone ID: SORBI-28MAY03-C26832_1.pep
IHTPPGSAALRSLLARHARAAGAPACSPQINQMEYTLPHLQDPMGGGTNPKTARARLLHRHQGISPRRAQPTRILKEDRGFLRLLNRRLRVALAPEARSILSALTTGGGAGVGRRDLGLWAAPLGLGWRAGRKPALLKNERRL

SEQ ID NO: 33159 - protein, 249 aa, Sorghum bicolor
  Clone ID: SORBI-28MAY03-C26837_1.pep
MEALKKQASKLREHVAKQQQAVLKQFSARYNQDPSLVDEAELECHQNLQRLYRAARAAKHFQRNIVRGVEGFIAISTKQMEIVKKLAEDCCKYGNDHQHFGFALARASEEFGKSHKQIEKEREDLLKSLGEQVFEPLREMIMSAPLEDARLLTYRYQRIRQDMESQIADVMRKQLKSKESSGNTDNSVKLQHAESKLSDLRTTLAALGREATAAMEAVEAQQQQVTYERLLAMVDAERTYHQNAADILN

SEQ ID NO: 33160 - protein, 214 aa, Sorghum bicolor
  Clone ID: SORBI-28MAY03-C26850_1.pep
FNTATVGVLADGFMARDLTIANTAGPDAHQAVAFRSTGDRTVLDGVELLGHQDTLYAHAMRQFYTRCRVAGTVDFVFGNSATVLHDTALVVLPRQLRPEKGENDAVTAQGRTDPAQPTGIVLSRCAVNGSDEFLALYRENPGVHHVYLGRPWKEYSRTVYLGCTLAEIVQPQGWMPWNGDFALKTLYYGEYDSAGPGAGAASRRVAWSSKVPKE

SEQ ID NO: 33161 - protein, 80 aa, Sorghum bicolor
  Clone ID: SORBI-28MAY03-C26889_1.pep
PDINATLIDAALREDADSVKYYKLEFRVESPSFQRHNVAVCCARDGKLYTMNAQAPESAWKAVQKEFFAMADSFSLVNDA

SEQ ID NO: 33162 - protein, 141 aa, Sorghum bicolor
  Clone ID: SORBI-28MAY03-C26844_1.pep
MDGRRPEMRRTMTLSEQLSTPDPAIRDFLKIPHDADVGEGNSTSVGGGSDRTTGWKPLRDRLRLRRAVGAWQKPKPGAAAAHARTNSGDVGNISSANNRSNKYNYSPGEAAAAFSRTFSRAPSLRAPSLKSTPTFSRVAYT

SEQ ID NO: 33163 - protein, 87 aa, Sorghum bicolor
  Clone ID: SORBI-28MAY03-C26655_1.pep
ATAAALAALFGTVAAMSASASAAACSCKRTAALMCRAKKVSEEEMETVALVERLEECIDGLEAGSDKVFRSLVQTRVALLNIHTHIF

SEQ ID NO: 33164 - protein, 161 aa, Sorghum bicolor
  Clone ID: SORBI-28MAY03-C26661_1.pep
VERERVRVEAAEDIAAARAAAERGAHQEAMEILMSRQQAVVQSGAALGGDAAMQSLGAELQEMGQLVSNGNSYARSGRAFMLSGMSRHSHQRASANMVNMGGYMNMAAEASSSSFATPAMRAMLLRSRKAREESSVEQQQPSKARKEAESSALPEPGVVNQ

SEQ ID NO: 33165 - protein, 111 aa, Sorghum bicolor
  Clone ID: SORBI-28MAY03-C26949_1.pep
SFIFKFRFRFAPRASLLRLSSSLLLVICNKCLKINKEYYYYNYVLCVSTLFLCKKAENKYGGDPSTRQTHFDYTTPQFRYILCTLYLTHTHILDYAEYCFQHDKLTSLKCF

SEQ ID NO: 33166 - protein, 127 aa, Sorghum bicolor
  Clone ID: SORBI-28MAY03-C2696_1.pep
SADAWVEVVTGVAKKQNKEKGPNSTSKSNKPSSKMTSRPESHSKATKVAAPPKDDDDESGEKYEEEEERDNTLCGSCGTNDGKDEFWICCDKWERWYHGKCVKITPARAEHIKHYKCPDCSNKRARA

SEQ ID NO: 33167 - protein, 181 aa, Sorghum bicolor
  unsure (1)..(181): unsure at all Xaa locations
  Clone ID: SORBI-28MAY03-C2698_1.pep
MARKHGWQLPAHTLQIVAITVFFLLVVAFYAFFAPFLGKQVVEYIAIGIYTPVALAVFILYIRCTSINPADPGIMSKFEDGLINIPINGSEIEGMNLPQKVNNATRNYXKTSTCRSSLDGHSNQRGSSIGEANMNLGSQLPKKRSSCWLLGGLLCAIFVKEDCRKTDDSEQQANGEEALFC

SEQ ID NO: 33168 - protein, 314 aa, Sorghum bicolor
  unsure (1)..(314): unsure at all Xaa locations
  Clone ID: SORBI-28MAY03-C27000_1.pep
MDGLAAPSPSHSGATSGGGASHRKRKLPPSSLSDATADEDDDTTAPSSPSTAPSSPSRPSSPSSSHSDDDEDDSLHTFNAARLDGAPGGGSASGRPPKPDSSSVSAASAAAAAAAGGGPKLEPGSATAGDGKEDPKGLFTDNLQTSGAYSAREEGXRRQEDSGRLKFLCYSNDGVDEHMIWXLKNIFARQLPNLPKEYIVRLVMDRTHKSMMVIWNNIVVGGFTYRPYAXRFGEIPFCAITADEQVNGYGTRLMNHLKQHARDADGLTHFLTYADNNAVGYFVKQGFTKEITLDKERWQGYIKDYDGGILMQCK

SEQ ID NO: 33169 - protein, 188 aa, Sorghum bicolor
  unsure (1)..(188): unsure at all Xaa locations
  Clone ID: SORBI-28MAY03-C27001_1.pep
MARGAALLLLAAAFAAALLPDAAESRILLTLHDFGAVGDGVADDTKALADAWTAACTAGDNVILNVPAAGTFQIWPLTLAGPCRSEIKLLISGDIVAPESPSDWGQGQRSQWLHFHKVQDLKITGGGIIDGRGQQWWAQSSLMGAQPAPKAVHFEDCQGISVKGITLQNSQSYHLTFTRSSXVEANYL

SEQ ID NO: 33170 - protein, 258 aa, Sorghum bicolor
  Clone ID: SORBI-28MAY03-C27021_1.pep
TRGPAIIPAQPLWPHPHPPQPTGFQQPPFQSYPAGPVGFLGRPIVGASAVTTAFANVQPPGVSTGGDWKIQASTNPGSEQPTHASAEPDSTGHGARVNERLEENRNTGVQDSDAWSAHKTETGVVYYYNALTGESTYQKPTGFKGEPEKVATQPVPVSWDKLAGTDWSIVTTSDGKKYYYDSKQKVSSWQLPPEVCEILKNAESGSLKEGSTSVQDAATIENKGVISIDASTPAIQTGGRDSLPLRQTVAPASPSALD

SEQ ID NO: 33171 - protein, 151 aa, Sorghum bicolor
  Clone ID: SORBI-28MAY03-C27041_1.pep
MAPSFARSISFPLSPSRSSSTKSRAASGYHARSVSLPCRSHPILAHLHAHISAVRAWAQDPAATGAATGLAHVDALHAALGDLLDLPEAQAALTLSATGDRLLDAFLRLADAHGSFQEAVVELKRDVAEALAAVRRRDGARLASALRSQRK

SEQ ID NO: 33172 - protein, 190 aa, Sorghum bicolor
  Clone ID: SORBI-28MAY03-C27047_1.pep
TSCIPFHNIIILRSNSIDTEGTDQSNPCAICLAAMGAAGGQAIFTAECSHTFHFHCISASVAHGNLVCPLCNARWRELPSVVQPQPAPMPRTQPQPLRRPERMHHVQPLPMRHVPLHGWQPQLHPEEPQVFDDDEQVEPPPSGDQAAASFRSGGTLAVTTHTEYSAVARDSSRDNFAVLVHIKAPGMTDA

SEQ ID NO: 33173 - protein, 175 aa, Sorghum bicolor
  Clone ID: SORBI-28MAY03-C26759_1.pep
YKFPKDTPLVFYKGGKPIEPPLDIHSGLKVVLKSIASYIEREVPRKTLKLWRTQSPRHFYGGEWDHNGSCVSDRLLEEHELNSWFDPRFGGVNKEARMVNLAIQEALAGSEIPFLNLTYMSEFRADAHPAIWLGKKDAVAVYGQDCMHWCLPGVPDTWVDILAAQILHHFKQGKG

SEQ ID NO: 33174 - protein, 145 aa, Sorghum bicolor
  Clone ID: SORBI-28MAY03-C26786_1.pep
CSARRNKERAVSAGAVVPLVHLIGERGSGTCEKAMVVLGSLAGIAEGREAVVEAGGIPALVEAIEDGPAKEKEFAVVALLQMCSDSPHNRALLVREGAIPPLVALSQSGSARAKHKAETLLGYLREQRQGVGCRAGAVTATSLAR

SEQ ID NO: 33175 - protein, 99 aa, Sorghum bicolor
  Clone ID: SORBI-28MAY03-C26794_1.pep
ATSSGGTTTPTCQAALGGGVARTMRSAVLGGSTPSHIDRSGDFDLPLPTATASASSACTRDGALPPPLHGWRVGTCPTLADLVDCINPGYQRMTRQAMT

SEQ ID NO: 33176 - protein, 160 aa, Sorghum bicolor
  Clone ID: SORBI-28MAY03-C27074_1.pep
MPRLRLPLVLLLPIALTLLLFLLFPSSPRPRSPPPQPLPCGAALSDAADGRWVPTPSPAPPPLYSPSCPFHRNAWNCLRNGRPQLPALSWAPTRCGGAVVPRIDAAGFLAAARGRRIGLVGDSLSENLVVALLCALRSADDGARKWKRRGAWRGGYFPKE

SEQ ID NO: 33177 - protein, 158 aa, Sorghum bicolor
  Clone ID: SORBI-28MAY03-C27093_1.pep
RLRTVEIVTGTATTATRAAARHPARTSHSLPFYPGSVLSPPSRPHCHLKYWWARPLQCSTAPGCDLVRLGGGGGGTRLGLCFLGGIGAVGIQELAGHGRRVRGWIEAWRKRRVVASSSSVLGSGLAGRGRGARRGGGLELRQGQLILPDRPLYCVISL

SEQ ID NO: 33178 - protein, 242 aa, Sorghum bicolor
  Clone ID: SORBI-28MAY03-C27101_1.pep
MPAFKAPAPGFAVRFSPFHENRLLAATSQHFGLVGNGHLIVLDLAAAGPGPGAAPVPVFSFPTSDALFDCAWSESHDSLCAAASGDGSVRLFDAALPPAQNPVRLLREHAREVHGLDWNPARRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHGYA

SEQ ID NO: 33179 - protein, 183 aa, Sorghum bicolor
  Clone ID: SORBI-28MAY03-C27102_1.pep
MVSLAGSQIPSPSPGQSPCAAARPQRRQGHPVRTIRSALLQPDSSPGSPSPASRDGGADAGDSDIENLTDSVIDFHLRELAATAGPAHPAAVAKSSSAINAAATELLDLSRDFSDYSSFNSDISGELERLAAAAGAAVPRSDAPDAAAVDLNDLESMDLSADAAPLERVEPFVLACVQALGPD

SEQ ID NO: 33180 - protein, 157 aa, Sorghum bicolor
  Clone ID: SORBI-28MAY03-C27103_1.pep
MPGIHRYTAVLVVLTISTRLLLLAAAWPALPDPASLQPSLLFPSTGATSPTQTQSAGGASTIPAFPEQSEAAAAAATSVCQLTPSPPLLPAVLASCNADAGGSKGALPPRLRCCPALTAWLYAAYAPTALSGRGVGEASVAASAEAAAVVDMPVLPD

SEQ ID NO: 33181 - protein, 106 aa, Sorghum bicolor
  Clone ID: SORBI-28MAY03-C27120_1.pep
RSIRRSRHDTYHTVEVSSSSRSSTLSPPWSQQLGTCCTMTARAAAAGRATTTPASTTSASPPNWRPRRRLRGSRTRASRQDPLGCWPWQTMTSWTRRPPGLARAPR

SEQ ID NO: 33182 - protein, 127 aa, Sorghum bicolor
  Clone ID: SORBI-28MAY03-C27153_1.pep
ERFVYVSAADFGLLNYLLQGYYEGKRASEAELLSKFTYGGVILRPGFIHGTRRVGSVKIPLGLVGSPMQMVLQNAKLLTRLPLIGPLLTPPVSVASVGKVAVRAATDPVFPPGIVDVYGIMRYSEQN

SEQ ID NO: 33183 - protein, 203 aa, Sorghum bicolor
  Clone ID: SORBI-28MAY03-C2693_1.pep
SGPMLESVLYFCRRMTNEALITIAKNRPNFTCFRLCIIEPHTPDYTTHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSLTLGACRQLARKMPRLSVEVMNDPRRGCPLDSFTDESPVETLYVYRTIAGPRSDT

SEQ ID NO: 33184 - protein, 220 aa, Sorghum bicolor
  Clone ID: SORBI-28MAY03-C26940_1.pep
FHSDARRDEIQTRNPSGPNVFSGSGNKIQGSTGTIKAHSGAPQSSLRSLKSLRSVEQYYHTLQQMKWGPMTEHVLDNLHCKIDARRANQVLKLLHDHTVALGFFQWLKRQPGFKHDGHTYTTMIGILGQARQFGVLKKLLDEMSRAHCKPTVVTYNRIIHAYGRANYLKEAVKVFEEMQEAGYEPDRVTYCTLIDIHAKAGYLDIAMDLYGRMQEVGLSP

SEQ ID NO: 33185 - protein, 131 aa, Sorghum bicolor
  Clone ID: SORBI-28MAY03-C26947_1.pep
MATAAVARHHHQQRSAQRARGRGRRGGIRCSSPAQEFASLAAVFRRRLVVGATTAAAAAVGANFGGVTSFLLSLSPELGRSLRLDVLYPVGGFTRCLDSDNGFEFIYPSSWVGDQTLLYREVKKAELQRSL

SEQ ID NO: 33186 - protein, 72 aa, Sorghum bicolor
  Clone ID: SORBI-28MAY03-C27213_1.pep
MDNPEMQRFLQQEQQKAMMNDMVGKLTSVCWDKCITSAPGSKFSSGESTCLTNCAHRFLDMSVLIAKRFEMQ

SEQ ID NO: 33187 - protein, 129 aa, Sorghum bicolor
  Clone ID: SORBI-28MAY03-C27221_1.pep
FNLRLKETVASLRKTHPDAAFTYVDVYTAKYKLISQAKKLGFDDPLLTCCGYGGGRYNLDLSIGCGGKMQVNGTSVVVGNSCEDPSKRVSWDGVHFTEAANKFVFDQIVAGVLSDPPVALRQACHSRGQ

SEQ ID NO: 33188 - protein, 205 aa, Sorghum bicolor
  Clone ID: SORBI-28MAY03-C27266_1.pep
VKASNVLLDSNFQARVADFGFAKLIPDGATHVTTKVKGTLGYLAPEYAMLGKASESCDVFSFGIMLLELASGKKPVEKLNPTTKKTITEWALPLVRDKKFKEIADPKLKDSFVEDELKRMVLVGIACSQDKPEQRPIMSEVVELLKGESTEKLSNLENDDLFKPDSSFQSSSGPDSSDCVTEERSPKADAIEEAVDSSETVPSAR

SEQ ID NO: 33189 - protein, 166 aa, Sorghum bicolor
  unsure (1)..(166): unsure at all Xaa locations
  Clone ID: SORBI-28MAY03-C27291_1.pep
MATAATATGTAGSRAAALPLLLLLLSLALPLRAYGAGGDCHFPAVFNFGDSNSDTGGLSSLFGAAPPPNGRTFFGMPAGRYCDGRLVIDFIAESLGLTHLSAYLNSIGSNFTQGANFATAGSSIRRQNTSLFVSGFSPISLDVQXWEFEQFINRSQLVYNNKGGIY

SEQ ID NO: 33190 - protein, 182 aa, Sorghum bicolor
  unsure (1)..(182): unsure at all Xaa locations
  Clone ID: SORBI-28MAY03-C27299_1.pep
MREAVTVQVGGFANFVGSHFWNFQDELLGLADDPGAAPGFRTAALDLDVLYRAGETQQGVATYCPRLVSVGSRGSLGSLSSSGTLGSSSSAADQPNIFTWSGNVTKSVAKPHERNLFLQSLSEGESNPSSSNGRNNARENIEDKDXXENLENGVIFWTDYSKVQYHPQSLYELYGSWTDFDK

SEQ ID NO: 33191 - protein, 162 aa, Sorghum bicolor
  Clone ID: SORBI-28MAY03-C27328_1.pep
ARGLNLPSSGSFACGFFPHSFPRLGFHAPGGNAFACMPRKEQRGAAVVSRSKRMGSARSARGGPKLTPAEEELLHRQALAMAIHQHLDAGGSMSRRIDAGASLSRRMAPGSTSSRRRGDLPDSVTNAKPAPIVLENLETKKIVLVHGERFGAWCWYKTISHL

SEQ ID NO: 33192 - protein, 126 aa, Sorghum bicolor
  unsure (1)..(126): unsure at all Xaa locations
  Clone ID: SORBI-28MAY03-C27329_1.pep
MEMVVAAPELPAEVERALIRDITVAXDAHAKDGDTFFLITTRRWQSWIDYLIQDLTGATSNGYHHHDFGSKTPRRPGAIDNTDLIDDASFEVSNTEIEIHDNLVEGRDYILVPQQVWEKLHGWYGX

SEQ ID NO: 33193 - protein, 144 aa, Sorghum bicolor
  Clone ID: SORBI-28MAY03-C27059_1.pep
PPPVEGAAVRGPGRGPRRRADRGEGGPGAAPAMSEWREEDDDGARCIGPRRRPRTLHRRSPLPRPSPAPAAQALTGARERSLAGARWTTPSPVTAGSAPRRRALDAPLAGARWMGTSPAPGGLATAVGVRWQSLEWASNNSTLV

SEQ ID NO: 33194 - protein, 130 aa, Sorghum bicolor
  Clone ID: SORBI-28MAY03-C27042_1.pep
RGARGTPHPAPPPRQRRRSTRPPLRRAPAPPPPPAAFPSPPSPPPRWPATAPAGSTPSTSRCRSSPPLPRSEARAAASRRRAATGRRTGPPGMESRRGPSRRRRRRSSGGEEDGGGARGGSCTGRVDLLV

SEQ ID NO: 33195 - protein, 258 aa, Sorghum bicolor
  Clone ID: SORBI-28MAY03-C27066_1.pep
MAAATEKTAEDIRRELQELQRQHREITERLRDPRGLRRGAPGPGPGPGGARPLRGFVRPPVGAESGDQPPQKRRLLSAVVKVDGAENNNNEEGTKDVDGAGHEPSSGVTEGSDRRGFNNGGFRRDGNLRMQRRVDYNSLPEPAPRELPRNEDPNLVRRNKRMLGQLLVGTLEKFQQEDKKLSNSEAFLRRSETQRKAEQKVREESERLRQQEREQIAEKRKRDMTLRARVAAKAEEKRLELLYIQWTEHHKRLSNFLR

SEQ ID NO: 33196 - protein, 99 aa, Sorghum bicolor
  Clone ID: SORBI-28MAY03-C27424_1.pep
ESILSLEEMKDDGESVPVRAPGNDGPSCGIKLKRGRGLRDFQREILPGLVSLARHEICDDLHSIGYEIRKTRSRRSPGDEGSPPTRIRLPRRCSTAWNR

SEQ ID NO: 33197 - protein, 201 aa, Sorghum bicolor
  unsure (1)..(201): unsure at all Xaa locations
  Clone ID: SORBI-28MAY03-C27457_1.pep
RIYIWGYNHSGQTARKARGGPGGAARGTEXQLHRWGKGGGARRAATASGRGPTGGAAPGGRPFTRGANEFGQLGDGTEESAKEPKKVKSLETEFVKSVSCGAHCTAAVAEPRENDGTVSKSRLWVWGQNQGSDYPRLFWGAFTPNTVIKQVSCGAVHVMALSEDGLLQAWGYNEYGQLGRGRTSQGLQGARVLNAYARFLD

SEQ ID NO: 33198 - protein, 135 aa, Sorghum bicolor
  Clone ID: SORBI-28MAY03-C27466_1.pep
SLEEERAYIASGLRKLEQKLQFYSNNSVSVDLPSPDVKDDLSDKVYVIEDFSLDRQESSIESKEAGSLTTSGKIDLDAVQEEISKLNRRLKTLEGDRSFLEHSINSLRNGDEGLMFIQEIACNLRELRAIAIDKK

SEQ ID NO: 33199 - protein, 259 aa, Sorghum bicolor
  Clone ID: SORBI-28MAY03-C2748_1.pep
LQRATVDSKSQVGSIFQVLNTKESPPTYFQTNKFTTAFQEIVDAYGVAKYQEANPGVFTIVTFPFLFAVMFGDWGHGICLLLATLYLIIREKKLASQKLGDIMEMMFGGRYVIMMMAVFSIYTGLIYNEFFSVPFELFGKSAYECRDPSCSDATTDGLIKVRDAYPFGVDPVWHGSRSELPFLNSLKMKMSILLGVAQMNLGIVISYFNAKFFRNSLNVWYQFIPQLIFLNSLFGYLSLLIIIKWCTGSKADLYHVMIY

SEQ ID NO: 33200 - protein, 190 aa, Sorghum bicolor
  Clone ID: SORBI-28MAY03-C27497_1.pep
IMLTASPSSQVKPQQWATCRISVASSAAFLPPPPAAAGRSVVPVESRRTTTVASAALGPVSTEPAERSPAPQPPPQSSDDDDEETMLGNYVPVYVMLPLEVVTTENEVEDSGELRAQLRRLREAGVDGVMVDVWWGIVEGAGPGLYEWRAYRELFRIVQAQGLKLQAIMSFHACGGNVGDAANIPIPRWV

SEQ ID NO: 33201 - protein, 168 aa, Sorghum bicolor
  Clone ID: SORBI-28MAY03-C27484_1.pep
TAAVQTIAIIPVLPRGVLQLGSTGLVMENTNFVMFAKKLCSQLNNRSSMAVSASAKNGSSQHGQSRPDTATVSTSTPPHALLNASLLKVVQQNGHPVREHTVYAKPDLRFLQQASFCESQFGRNLWSVGMNSSLTSPSLTSVKNHSLLMNNIGQLQLNNNAHSSADLA

SEQ ID NO: 33202 - protein, 153 aa, Sorghum bicolor
  Clone ID: SORBI-28MAY03-C27502_1.pep
MNGGGGGRRRYSSEQLLFDVPTNAGAAARWAQQRGGVRRGDGEIFVSVEPATPARLRGGDAAAGDSPGQRQQLSPGLLDLHAFDTELIPDFQVPGMYDGAQKFGYGGGLDESDMRFTANKLMSKSTVFPDGNYLKAFTEKEKAAPVAKIKVVV

SEQ ID NO: 33203 - protein, 153 aa, Sorghum bicolor
  Clone ID: SORBI-28MAY03-C27158_1.pep
PKGQQRRARGRTGKGGAGLLRPRAAKNLGPVTEPEAAATPQLATRLKRSPAAGRGGRTPSPSRGTEGAGLRQPGSSPLDDGRRQRRRPPAGGKPTRGPEPDSPDAASQHDSTGGPRHGRTAPRWVRQPSSPTGDQPEGRTPQSTQPPKEQPQR

SEQ ID NO: 33204 - protein, 132 aa, Sorghum bicolor
  Clone ID: SORBI-28MAY03-C27173_1.pep
LSDIQMQKKEARGIFELIKSLFNQAEREWVGFLGPIHIWQGMDDRVVSPSVAEFVRRSVPGATVHKLLDEGHFSYFCFCDECHRQIFSTLFGIPQGPINPAPQPSEVVSELTEETTVPDNATDQEQGKSGLP

SEQ ID NO: 33205 - protein, 180 aa, Sorghum bicolor
  Clone ID: SORBI-28MAY03-C27205_1.pep
VTRFLSWDDTTSESQSPCNPRLSSRLPDVDDDESERHVLVQNIMSSAGLGTSQSCMVFTGWHSPDHPLDPVLCNKLSELQEKSSYRRLLFDCVNVALIEIGENALLSAFPWSKTHSRTWRGTSSPDLGVAVWSILKDWIYGARMFVVSKRDNAGIILDRIVKQEVEARGWVKLRMAQGLT

SEQ ID NO: 33206 - protein, 182 aa, Sorghum bicolor
  Clone ID: SORBI-28MAY03-C27579_1.pep
MPSDELPQVPGEIEPSQSTSEGNADPYTSQFTILEEHYAVSEEGNIKGILEQVDVPEITGRSSGEFHQRIASAADPHTNELVLENAHHGASEDANQKDNCGDIHVSQVSAGSKTCGEVNKIEPTGDMGAHKLIVQDPSGSAPKDLIDKDYVDEPHISATTVRSSGEIPQDHSATEEYPKTSD

SEQ ID NO: 33207 - protein, 200 aa, Sorghum bicolor
  Clone ID: SORBI-28MAY03-C27588_1.pep
MASAARTTPGPGRSVVVLVSLATLLLVTFVSTVESYDGRHAVAHSAMARRSRLGTRHVQHHHRRTTTVPHRYVLAEKSSPTGGGSSPKNRSSSPATANNASAPAPAASQSDGGRRHRSHKHRVRNWIIGFVVGSVAGVISGLVLSVLFRLALNCVRGRYRSRSGVMIFTPKLIRRPEHLAFLEKEDGGTGTCTGTSGGLS

SEQ ID NO: 33208 - protein, 166 aa, Sorghum bicolor
  Clone ID: SORBI-28MAY03-C27626_1.pep
MSPSIHMCFNIVYEKIVDNFLLIVAVPLTIAAATIAMARLEPNESADPIQTFSHSQILSILLFLATAVIVYYMQRPRMVYLVDYACFRATYNYRVPSAAFVEHVRQVSHFSERSVRFLTRLLERSGLGEETCLPPVGQYIEPYNYCTLEVAREEAQLVVFSAIDDL

SEQ ID NO: 33209 - protein, 156 aa, Sorghum bicolor
  Clone ID: SORBI-28MAY03-C27561_1.pep
LAGSCLRRRYFEEIRVLKASHRSGYISSAWLPSLPALPRPPSGPADPSSAPGRGFPVSPSRLEFLGLRKAPAGGGRRHPSARCSCPHGAGSGTKEEMAGLSDFEFFKILIPGMYEEALRLPTKFGEILGARRDLKLRLTGGEMMPLWDVEVFVDEK

SEQ ID NO: 33210 - protein, 129 aa, Sorghum bicolor
  Clone ID: SORBI-28MAY03-C27639_1.pep
ARGSSFHQTPPHLRVSSRDTHVFPQAISQWQALPRSWQHCANKRNSNDRVMDDSANYKNSNHDWQLSKHEDSYSISKCVQILNGMVELSQVEKSVAPDVFLQPGNREIFISLSGDVRAMWLKRKIQHLA

SEQ ID NO: 33211 - protein, 304 aa, Sorghum bicolor
  unsure (1)..(304): unsure at all Xaa locations
  Clone ID: SORBI-28MAY03-C27647_1.pep
MEASSSSYASAPAALLPLLAAPPRFLHLPLRRPSARRNGFAIWGGGGLLLQPPLLGPGSRARCRTTCCASSPEQAEVLLGGASLVSLAAVALLTTLQLIWLRWRSARQGDFPEIVHEHGKARGNKTLGASKAMYDSNWATQLTQDSHWLSEPFVSGRVTVDEMHGKAGNFPCANSVHKETQAYSIITPWISMDTPLYISRPEEVSCSTSTANSSINKDTSLSGMPHSVSQGQDKSKCLSNRTGRVAGLPYQFLSLSGQKKEAQNSQGHNDKQMDTNTKDANLVGCPQSDQEEHLDXTSLSSFER

SEQ ID NO: 33212 - protein, 167 aa, Sorghum bicolor
  Clone ID: SORBI-28MAY03-C27648_1.pep
MAAPPGGAGIVWQTPANPPESHDYIIRNGRRYVRPYYFEFISHVKNRWAGKTIVDLFTDESKGRSRDYYVHAVKCGRLQVDGQTVHTDYIVKSSQKISHFLHRHEPPVLAGDISILQNEVDVVTICKPASVPVHPCGQYPKNTVVGILQAEHGLTPLFPVHRLDRLV

SEQ ID NO: 33213 - protein, 265 aa, Sorghum bicolor
  unsure (1)..(265): unsure at all Xaa locations
  Clone ID: SORBI-28MAY03-C27370_1.pep
LEEADENKEGAVFAVVALPAGGVKPNDGAEAVVAGEEENPKDGVVVAAGAGEETVVLLKRGAEVVDANRDEPVATPNPKAGADVAVEAALDAAAPELNEKPNDGAEAAGVVVVEPDADEPKLKPVAAPEKGLGVDAAEAAGPNRLAVAAADEVAPNGLGVVAAEEAPPNRPGEAVPPNRPEEVAAEPVADAPKRPGLLAAAEAAPKRPGLLAAEVAAPNKLGVVPAEDAGVAPKRDGADAADEAAAVDXPNEKAVDPKPKAGEPR

SEQ ID NO: 33214 - protein, 96 aa, Sorghum bicolor
  Clone ID: SORBI-28MAY03-C27403_1.pep
TCTAPSLPPAPAAAFTGNTPEWPAGRDLDDLADAIGPREKPYPQAQLPSPPPFGRSRSFSKWISRLAGCSARALSHSRASIGVSGEFQEGREGREE

SEQ ID NO: 33215 - protein, 251 aa, Sorghum bicolor
  Clone ID: SORBI-28MAY03-C27405_1.pep
MTLRLLAEVSPQDLLVALSELQTHVLSYIKSMALKCAVDLSIHDTIHRHGGAATLADIAADAKIHPAKVPDLQRVMELLAATGIFTATASKKDDGSAETVYGLTTACRFLVGHRNLSPMVPFLVSPLVGSSFFSLSDWLRKEPAAAGAGGAGSLFELAHGCSHREMAKQDAAFSSVVNDSMAADSQLFLEVVIMDKGRIFRGLSSLVDVGGGHGAAAQVIARAFPRIKCMVLDLPHVVNEATASDGNMHFI

SEQ ID NO: 33216 - protein, 126 aa, Sorghum bicolor
  Clone ID: SORBI-28MAY03-C27713_1.pep
LSYRTMGDECIRKGKKKVMEKLQIEMYHHVWSSYVRWLRIRTRRWCFRGVWGRGGVGPRGGRVGGWRVGGRQVPALVVSDVARCPRKRCYRDSGQEECGDEDHAAGAGHCCCCWWWLLCVSRWCLV

SEQ ID NO: 33217 - protein, 142 aa, Sorghum bicolor
  Clone ID: SORBI-28MAY03-C27723_1.pep
MCKVVITIPSLVRLRRTLRRWRSRAAEAASSSSSSLASVPAGHVAVSVQGTAPSSGPRRFVVRVAHLSHPAFLELLRQAEEEYGFPAAPGPIALPCDEDHFLDVLHRVSSSSSCCCGPVAARRGRGDARPLLQGMAVEKLVW

SEQ ID NO: 33218 - protein, 213 aa, Sorghum bicolor
  Clone ID: SORBI-28MAY03-C27728_1.pep
MLAVSSSQLTDYRISSRDLLPAPRRQVARASSGPAAWRLEAALFHPALGVGGAERLIVDAACHLAAHGHDVHVFTSHHDKNRCFEETVSGLFPVTVYGDFLPRHVFYRFHAVCAYLRCIFVALCVLLRWPFFDVILVDQVSVVIPLLKLRASSKIIFYCHFPDLLLAQHTTMLRKLYRKPIDMIEEITTGMADLILVNSKFTAATFARTFSCL

SEQ ID NO: 33219 - protein, 119 aa, Sorghum bicolor
  Clone ID: SORBI-28MAY03-C27738_1.pep
QAGGSHRRQESAQASFAHFGTTSPFGSFGLPPSRQLGPTTGNFRFGMVPPGMTIPMPSLGSLAPTKMVGSSSSMQGYPGLMMPGEPKVEPVSQPLFPMANASPPAYQQMLSRPPFGHQM

SEQ ID NO: 33220 - protein, 124 aa, Sorghum bicolor
  Clone ID: SORBI-28MAY03-C27748_1.pep
MTLAPPAAKKPPSKKKGGNSVWTRPASRKGKKKARQPGGHGPGGAAGAAGGSNPRPSAAAGEEFVLVPATRLAAERSDDAPGQPVLLSRVFKSERIELSEDRLTASSTKGFRMVRATRGVASGA

SEQ ID NO: 33221 - protein, 89 aa, Sorghum bicolor
  Clone ID: SORBI-28MAY03-C27758_1.pep
MPSIQKALPPELADNVLRLYRECLRRAKYIGHQKHNTELLVTMVRQQFKKNMHETDPEKIQKMKDDAARGLINHILYESEKITGRKFSG

SEQ ID NO: 33222 - protein, 168 aa, Sorghum bicolor
  Clone ID: SORBI-28MAY03-C27769_1.pep
HEAPPPLLLRAPASSPLLSRAPALKEKGTETEVLPRRFALCPGFFGSSLVPRSPSRPPLRRTARIRHPAVFPFRDSERGSRYVERTHVPVPLLPTPPQPQPQTQPQRLHPRPRRLERYRGAACRASLTWRIYQQQQQPPEALFQVVIRLHGYVSGARTRFWRTAEAGG

SEQ ID NO: 33223 - protein, 156 aa, Sorghum bicolor
  unsure (1)..(156): unsure at all Xaa locations
  Clone ID: SORBI-28MAY03-C30703_1.pep
RTRPAAAGSGIPEVKAYLNGGEAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRXGKCG

SEQ ID NO: 33224 - protein, 100 aa, Sorghum bicolor
  Clone ID: SORBI-28MAY03-C30719_1.pep
PREVRVQDSDGNITEKICDASGEDPDCCRCLSMFSLRIQDHFAYVGVDMEADDWSTCRIITAQSVRQFRRELASNIIMTKHDIDVSIVEPSVQTDRSSCS

SEQ ID NO: 33225 - protein, 112 aa, Sorghum bicolor
  Clone ID: SORBI-28MAY03-C30722_1.pep
PTRQNKCTGVVGVFNCQGPGWCRVVALRVRGCGRFGAYCSRRPARRRRRPPGARRAPYPRAGAGVLQMGPADRCLEVLPACRSVAMVLSAYSFLSGFTIKRVCATWKGVCNA

SEQ ID NO: 33226 - protein, 102 aa, Sorghum bicolor
  Clone ID: SORBI-28MAY03-C27828_1.pep
MAADGGPATAALDEALKPFQERASEAEIRIAKLEALLYNKDDLSRGSEATSSAVKDLRSKLDAATAECLTEKEKNKKLIMENEKLQYRMTHLIRAIKEAESR

SEQ ID NO: 33227 - protein, 162 aa, Sorghum bicolor
  Clone ID: SORBI-28MAY03-C2787_1.pep
MPDSDNESGGPSNADFSSPREQDRFLPIANVSRIMKKALPANAKISKDAKETVQECVSEFISFITGEASDKCQREKRKTINGDDLLWAMTTLGFEDYIEPLKLYLHKFRELEGEKAATGVRAPPPASRSRTGSRRRRQRTMARAGPSAAMACTAAPAEAGAA

SEQ ID NO: 33228 - protein, 245 aa, Sorghum bicolor
  Clone ID: SORBI-28MAY03-C27882_1.pep
GGRRSRSAWIQGQRRPSRVRKEKEPVWMAARKENPELIACQAPNGRITRAQAAANRRSFGVLPSVPLPAKTDRKQTTQGKMKRGSSYDNTSASTAISGPQPKRRTVLRDVTNLRNANSNKTFAAAPKVQTRPSLRTGRTVTRGKQCTKRIPKIPQPAGNGGSFANDSSIAEETQEKLLAQKEEPILLLENRGSLSLQNVERNRDSACHEAFFKERNVRDICEPSVSKNGDSSVLDIVDIDKDNGN

SEQ ID NO: 33229 - protein, 229 aa, Sorghum bicolor
  Clone ID: SORBI-28MAY03-C27885_1.pep
ICATKAPAAVRHFLMPPSSQMAIQLTLLILISCSLYSMYPSSSSSFSESSSLALLVLVISTCLSLLFTNLRKLLRDNNTHKANKAAPASMEEAVTVFQEKSIVPQDEALEDLMGGSLSDSSECTTNDDEEGTEEGSVSDEADDDDDDDDESLIEISLVDGHYVGGAEQAEQRRAYNYKKDLLAEFLPDLLLDRRDFFDILSEISEEDSLIEIDIARGSIKCSANLDIKA

SEQ ID NO: 33230 - protein, 134 aa, Sorghum bicolor
  Clone ID: SORBI-28MAY03-C27935_1.pep
KLLFAISFVSTKLLKMGTKLYVPNFLTAFEHICIHAGGRAVIDEIQRSLGLSDKHVESSRMTLHRFGNISSSCLWYELAYIEAKHNMQKSDRVWMIGFGSGFKCNSAVWECIVPTHSEDGPWATCIHRYPVHDP

SEQ ID NO: 33231 - protein, 154 aa, Sorghum bicolor
  unsure (1)..(154): unsure at all Xaa locations
  Clone ID: SORBI-28MAY03-C27958_1.pep
EDASLGAVANISMKETRIVFDPXWSGIYTAEVSLLRTLRSLKHRLAAGSRLPNVTILLPTEKKQVDIDEKEKTLKLAGRIGQAVGSLLRRLGISYQGDESHGRMRINGLTLRRWFNPKLNNKSSAAAADLLPLPSRLAKGIAGQQRDIRNLSLE

SEQ ID NO: 33232 - protein, 152 aa, Sorghum bicolor
  Clone ID: SORBI-28MAY03-C27984_1.pep
MLPDITILHLNILANKHAFGASAFHALRMCSGIRKLMLEFLAPTVVEAQTTCPPGCICGEHQNWETEHLVLNHLKEVEITRMRGSEHEVTFVKHLFIWGTALEKMMVFFDKSVTESAAKELSQVLRSFARPEIRMEIHTYLDMVMMMYEPED

SEQ ID NO: 33233 - protein, 107 aa, Sorghum bicolor
  unsure (1)..(107): unsure at all Xaa locations
  Clone ID: SORBI-28MAY03-C2768_1.pep
MLLPQIPMTLQDGDIINIDVTVYLNGYHGDTSRTYLCGEVDDATKQLVKVTEECMMRGISACKHGASFKEIGKRISEHAEKYGYGIDSFVGHXVGRIFYXEPIIWHT

SEQ ID NO: 33234 - protein, 121 aa, Sorghum bicolor
  Clone ID: SORBI-28MAY03-C27699_1.pep
MWAPGSPGRLPALEECVEGEDGEAYHGAMASCWGRFGAAALWRRLRQRLSLVRRMRRRGRSSLLGAGGLNYDPLSYAQNFDDGCLELEEHEPDFSARFAPARHAAGFPRPTAAARDVVATA

SEQ ID NO: 33235 - protein, 89 aa, Sorghum bicolor
  Clone ID: SORBI-28MAY03-C27719_1.pep
GGTTKMVIRSISALHVPSIGEEPGDDWRGQAFEQRLLLETAGCTASLQQQQQRHCSSFHNMIYIYIFIYANGSCVSCTLCKKKNMYGWN

SEQ ID NO: 33236 - protein, 143 aa, Sorghum bicolor
  Clone ID: SORBI-28MAY03-C28131_1.pep
ARGGLLAAGAVLLCSLVILMLWRKLKRGRRPARPLQLCAAAVGRGRAAWCRVSVSRLGTARSGWADMLVRACLLSGFMSLWSSWGFETGLPPSTAGVSSLAWCLLSFPACRMQAFSPCAYFFKCFFNCPQVLLACLQSVFMLM

SEQ ID NO: 33237 - protein, 80 aa, Sorghum bicolor
  Clone ID: SORBI-28MAY03-C28163_1.pep
VTLAACNIKSLSIVFLLKPLQNIYQTQACCTTNYPRPPCTSQHRNNFLGPRLSSFLLFRSIQVPNVVMILLKYVLHILLR

SEQ ID NO: 33238 - protein, 113 aa, Sorghum bicolor
  Clone ID: SORBI-28MAY03-C28193_1.pep
IPSMTLGFLANYLAELTLTDYEFLKFLPSLVAASAVFLARWTLDQSDEPWNQTLEHYTSYKCSDIQLCVCALRELQHNTSNCPLNAIREKYKHQKFDCVANLTSPELPRSLFS

SEQ ID NO: 33239 - protein, 105 aa, Sorghum bicolor
  Clone ID: SORBI-28MAY03-C28230_1.pep
IMGNTNISLERLSTAAGRFHGAARAADRDMGHAVVPGCLGSPLANAWTPERHCSPARRSRARPTLHVSSAEQPGGGVGQLAALAPAGGALNLALCPCMLCSVSYA

SEQ ID NO: 33240 - protein, 153 aa, Sorghum bicolor
  Clone ID: SORBI-28MAY03-C28258_1.pep
TRVISTSPGKKQEAMDRLGADAFVVSKDAEEMKAAASTMDGIINTVSANIPLAPFMSLLKPNGKMIMVGLPTKALEIPPFDLIMGNKTLAGSCIGGMRDTQEMLDVAAKHGVTADIELVDADYVNTAMERLAKADVRYRFVIDIGNTLKNADQ

SEQ ID NO: 33241 - protein, 113 aa, Sorghum bicolor
  Clone ID: SORBI-28MAY03-C28240_1.pep
VLLDSDWGTEGVLKDEEALCLDGTFYGNVARFINHRCFDCNIIAIPVEIETPDHHYYHLAFFTTREVKPFEELTWDYEIDFDDVNHPIKAFKCHCGSAFCRDRRRMSSVRRRI

SEQ ID NO: 33242 - protein, 151 aa, Sorghum bicolor
  Clone ID: SORBI-28MAY03-C28280_1.pep
KVVTTLSLMVASIIAVIVMCLRDYISYVFTKGDDVARAVSTMTPLLAVTIVLNGIQPVLSGVAVGCGWQAFVAYVNIACYYGIGIPLGCVLGFYFDLGAMGIWGGMIGGLIVQTLVLIWVTLRTDWNKEVEQARMRLNKWEDKKKPLLAED

SEQ ID NO: 33243 - protein, 70 aa, Sorghum bicolor
  Clone ID: SORBI-28MAY03-C2777_1.pep
MNVRRPYFHRCGYLTEQHARQHINNFSLLFQKQAKSQQQGIFSYSSRKGLNSLLRKGLDSLLRQGKKLFQ

SEQ ID NO: 33244 - protein, 82 aa, Sorghum bicolor
  unsure (1)..(82): unsure at all Xaa locations
  Clone ID: SORBI-28MAY03-C27773_1.pep
MAMGRASAATLLVALAVLARRWMAXXTCDDKLPAQLAGNFSGLACAPIWNNFVLRYAQGKDNVLRVVLSTMYSTGWVGDGVL

SEQ ID NO: 33245 - protein, 107 aa, Sorghum bicolor
  Clone ID: SORBI-28MAY03-C27823_1.pep
VGGNAVVEVLVVAMQVIPEPHRASPRPRRTSPPRAPQARQQPLHRRSRPAAAAPGVAPPAAVQSEQRRRHIYDCSLVSRNSQTLSSQVRVTSCSLPRGQDRAGTGSS

SEQ ID NO: 33246 - protein, 120 aa, Sorghum bicolor
  Clone ID: SORBI-28MAY03-C27785_1.pep
TRLLDRRAGALAALLCYLCWAASGALAARLGFSVGWKVVLVAQLVCWTMQFIGHGIFEKRAPALLDNLVQAFLMAPFFVLLEILHTFGGYEPYPGFHDKVSKLIEEARKEWEDNKSKKSS

SEQ ID NO: 33247 - protein, 88 aa, Sorghum bicolor
  Clone ID: SORBI-28MAY03-C28329_1.pep
QAAQSQGKQAINNDRNPNVRHTMNLAQDMAAGKAQLTTSVALPSSQWKNYSDSRSKGQFDAVHHNQGTVNITSSSNMLPTFQHNAPAK

SEQ ID NO: 33248 - protein, 256 aa, Sorghum bicolor
  Clone ID: SORBI-28MAY03-C28333_1.pep
PIHPCVVRVRIRITSLGSIGNTQTCHAIRVAKHFFFDLVSVPVLPPGADAAVVLDGHGVALDELEAIGDRLRVERVGPRDERRRLSAAGRRHRRLVSPGPPGHDENPPAAAPCAAAVAAAAAAASRGRQLPHEQAHVAADEAQEREQLGAQPPHGEPVPRAQPEPPRRAPSPPAALLQPHVALRRLRVMQRARHPAPACLQLHCHARTAAGARVCVPVYGTHRGRGRQAGNVSLCPVRAAAGSCELCVRAWCRWCG

SEQ ID NO: 33249 - protein, 188 aa, Sorghum bicolor
  Clone ID: SORBI-28MAY03-C28337_1.pep
GSGGESIWGKPFKDEPNSKLLHSGRGVVSMANSGPHTNGSQFFILYKSAPHLNFKHTVFGMVVGGLTTLSAMEKVPVDDDDRPLEEIKILKVSIFVNPYTEPDEEEEKAKEEEEKKKDEDYDKVGSWYSNPGTGVAGSTSTGGGVGKYLKARTAGSVDVTGSAGAADDSSKKRKATASSVEFKDFSGW

SEQ ID NO: 33250 - protein, 189 aa, Sorghum bicolor
  Clone ID: SORBI-28MAY03-C28338_1.pep
MAAVGARPVLYHHPAPAGDAASMSSYFSQGGSSTTSSSASASFSAALAPTTTTLAEQFDISEFLFDDAGVAGAPGVFADGSAPVVVSDAAAAAGGGAISAAAGSAAAAAEAVPERPRTERIAFRTRSEIEILDDGYKWRKYGEKSVKNSPNPRNYYRCSTEGCNVKKRVERDRDDPSYVVTTYEGTHNH

SEQ ID NO: 33251 - protein, 86 aa, Sorghum bicolor
  Clone ID: SORBI-28MAY03-C28360_1.pep
PDGSGAGGAPPGFAVLPDGPGAGGGGGGGGGSLLTVAFQILVDSVPTAKLSLGSVATVNSLIACTVERIKAAVAADNIGGGGAVPQ

SEQ ID NO: 33252 - protein, 175 aa, Sorghum bicolor
  Clone ID: SORBI-28MAY03-C28365_1.pep
NDLQCYAAREEVRKQNLTGITFQQIIAPEMLFSIDLKCPTLYSWQNFTNQTRLTNGALGRVKTQEAILCSPPHAPHRPTDPGNEELQSEPPNEQQLALETPKPEPGTNHESPPPQSHQYTHHTPAGRVPPWLLLVANSAGNNPGQRSRTLGRGPPAGCGLPAGQGNGGARNGILV

SEQ ID NO: 33253 - protein, 155 aa, Sorghum bicolor
  unsure (1)..(155): unsure at all Xaa locations
  Clone ID: SORBI-28MAY03-C28368_1.pep
MGKKIRSANGTSTPVRSMNQAVSLREETSGRTHVDDVSLLRVKHLQRLAAWAGAEAGVGPIGALLGRRLAASAEAAGVPLXAATFLCQRCETILKPGFNCTVRIRNKRNKAKRRKKSNCCQNSVSYACHFCGDQNLVLGSGKXVVKSLLPLRDHS

SEQ ID NO: 33254 - protein, 151 aa, Sorghum bicolor
  Clone ID: SORBI-28MAY03-C28023_1.pep
QSTIITTGTCTAYSQGGWLLASDLFTWSRQVVSARATDRSHPSRKPGGQPPLIPRGSGPGQSPGGWPVGGARNTRGRQAENERAPRHTHPLRQPARGSLRPRCTAGPQDPSGPGKTGPKCAQQQEARGAPRAEAQQCQRRCGPRLGSSLPP

SEQ ID NO: 33255 - protein, 112 aa, Sorghum bicolor
  Clone ID: SORBI-28MAY03-C28049_1.pep
LVIAITKDLPDVEGDRKYQISTLATKLGVRNIAFLGSGLLLANYIGAIVVAFTMPQAFRSTVMVPAHAVLAAGLIFQTWVLEQAKYTKDAISQYYRFIWNLFYAEYIFFPLI

SEQ ID NO: 33256 - protein, 111 aa, Sorghum bicolor
  Clone ID: SORBI-28MAY03-C28039_1.pep
YPPWPLPLQLDQGKKILSFVISKADLHYFVLVDSYSAVGELDQYHQTLRNQQNSCRLPRGRCSRSVASVADVHLGVGPPGFAGYQFCWTVTTSWLLAQVDDGGLHDTLPLN

SEQ ID NO: 33257 - protein, 162 aa, Sorghum bicolor
  Clone ID: SORBI-28MAY03-C28507_1.pep
MEEELMSEWKTHVKHWPDKLLPVNNFIQSSIIKDCALSLCSTGDKFSVPSIIAFVCITKEADLMRELLKRGAKPTDDMIQQSSVIRMCALGLVNLKTASAAAMLGIAKEAKMMCDWMKRENRLVAFSMSAPSDLEVRLIRIRTLDFMISILQDSSFPSSKML

SEQ ID NO: 33258 - protein, 219 aa, Sorghum bicolor
  Clone ID: SORBI-28MAY03-C28525_1.pep
HEADILAGGGAASDPGSRPPQLASYQVRKVHRCEPRGVLNVSYRLGPIVAPQARAVDEAAGGAGAFVGYPVPRQFYAPSYAYLPSPLSLAPPPPPAQAAGRDAQLHPPPQYSLPAATYSQAYPQQPAANYPQQPAAGRAALPAPASGESNGKLDFGVGLGAGLVSGAIGGMLVAGDVMMSDAAAYNSGYRAGLADGGAAAVYKNSYRVHDKVEAKRAAV

SEQ ID NO: 33259 - protein, 237 aa, Sorghum bicolor
  Clone ID: SORBI-28MAY03-C28593_1.pep
MKKTVCVTGAGGFVASWLVQRLLSRGDYLVRGTVRDPSDPKNAHLMALDGAGERLRLFKADLLDRASVAAAVAGCDGVFHVASPGPAVEPTNPDVEIMAPAVTGTQNMLEASHAANVRRVVVVSSVAAVIANPTSIPDDAVADEDCWSDEDYCRATKNWYCLSKTVAEREALAYGERTGMDVVTVCPPWVLGPLLQPTVNATSMGFVKYLKGENTDEKRRNMVDVRDVADALVLTYE

SEQ ID NO: 33260 - protein, 154 aa, Sorghum bicolor
  Clone ID: SORBI-28MAY03-C28549_1.pep
LALAMASGEAEPLQYTTTALRVSIHCEGCKKKVKKVLHSIEGVYKVTVDAAQHKVTVTGNVEADALLRRLHKAGKQAALWPSPPAPAAPVAEAKKPEDAATAALPAAAGDSGAKDAQDAKPKEAEAKEKPPENSEGKEKKPAKDKKAEKGEAAA

SEQ ID NO: 33261 - protein, 193 aa, Sorghum bicolor
  unsure (1)..(193): unsure at all Xaa locations
  Clone ID: SORBI-28MAY03-C28603_1.pep
HEGDITTATGGSHAAGGQGKMRVLHAALCETMRLYPPVAWDSKHAAAGDVLPXGTRVERGDRVTYFQYGMGRMESIWGADAAEFSLQRWLSLPEDNVTPPPAAVAAGVSPFKYPVFQAGPRTCLGKEMAFVQMKFGASTVLRRFELVPVDEGRVPVFVPLMTAHMAGGLNVTVRSRREPPIAAAAAASSGNSN

SEQ ID NO: 33262 - protein, 59 aa, Sorghum bicolor
  Clone ID: SORBI-28MAY03-C2863_1.pep
PLRFHMYSLYPHMALKSLYSNTPLLFPMPVQIYVAKTNGLPPLRRISRTRGRTAWVDQE

SEQ ID NO: 33263 - protein, 259 aa, Sorghum bicolor
  Clone ID: SORBI-28MAY03-C28653_1.pep
HEGPWIFTVGASAHDRVYSNYVVLGNNLTIQGVGLAPGTDGDCMYTLVAAPHALKNNTVSPTEMSLGECQDSSRLDADLIRGKILVCSYSIRFVLGLSSVKQALDTANNVSAAGVIFYLDPFVLGFQLNPTPMHMPGLIIPSSDDSKVLLAYYNDSLVRDETSGQVVSFGGVAKILGGLNPNYGNSAPKVMFYSARGPDPEDNSLSNADILKPNLVAPGSSIWGAWSSLGLDSAEFAGESFAMLSGTSMAAPHVAGLAA

SEQ ID NO: 33264 - protein, 129 aa, Sorghum bicolor
  Clone ID: SORBI-28MAY03-C28690_1.pep
TERGAAGRRLVEAGAADAVAAAATWPGAVADPRRADEHRAPAAAAAALRSPPPACFPAVAADPGEDDPRHDGQPQDDRAVERLASQAALRHAQEPIRPHLSLSLSLCELVLPCPYPVLLLVPGGGGGPV

SEQ ID NO: 33265 - protein, 253 aa, Sorghum bicolor
  Clone ID: SORBI-28MAY03-C28284_1.pep
ARGARACNRALRLLPNSIATQLASSRSGARFRSLAVHAQLSTEDDAYSTEPLKKVQVTQSLRRTRRRGTGGARQSLVSVGTSCGGGDQWSSDIELTLRQLHLDDLIEDGQRDADVLVHLLVQQHTQFGMSIKGRVLTSFRKICDSCSLPYCTNIDERFNLTVLSSTRRDQSGLPDLGDTDPSVIYVRPGDEVDLDSVIQETVRLTASAKSSCSETCEKSTVVWQYGGSQKKKISSQRWSKLLDLKKTLDKAPK

SEQ ID NO: 33266 - protein, 88 aa, Sorghum bicolor
  Clone ID: SORBI-28MAY03-C28285_1.pep
HEVDVKGQDMELLPFGAGRRMCPANGLGLRMVQLVLANMVHGYAWRLPGGMAPEELGMEEKFGISVSRMHQLKAIPEPRLPDHVYFGP

SEQ ID NO: 33267 - protein, 183 aa, Sorghum bicolor
  Clone ID: SORBI-28MAY03-C28305_1.pep
HEAWPVLWVIKGADTLPDDVDEWLQHNTGGDDGQCLAVRGWAPQVAILEHPAVGGFLTHCGWGSTLESVTAGVPMATWPFSAEQFLNEKVIVGVLGIGVSVGVTKPTEGVLTGAKDGGGGGARAKADVGMEQVKRALDMLMDGGVDGEARRTKARELKAKAKSALEHGGSSYMNLEKMIQFAA

SEQ ID NO: 33268 - protein, 109 aa, Sorghum bicolor
  Clone ID: SORBI-28MAY03-C28813_1.pep
HEAQKLHQIYTVIAVTMEGRMATVVVVLILGCFVVLSQSQLTNQDESPCYCMRYARYFTNKYFCCVGLKAPTPSQCYSSDYQCNRNCCTATAPAPATGTNTGTNTSNNS

SEQ ID NO: 33269 - protein, 140 aa, Sorghum bicolor
  Clone ID: SORBI-28MAY03-C28828_1.pep
MLQDTMGKKKLYLVESCGALLMVRRMVCCSVAGEAAVSGQCEFEVFKADLERSRWVNVTSLGDDQMIFLGRSCSRPVTASQYGMPGDQIFFLDDVMENCKYSFHEETTSVSVYDMRTGEVSSPLPMIWKHEMILATWLFP

SEQ ID NO: 33270 - protein, 136 aa, Sorghum bicolor
  Clone ID: SORBI-28MAY03-C2890_1.pep
QNYIIHSFMKRISANHTLTLCENSSTCRLCLALAKNHQSPHVGNNLLRVIIIYFTNSCMDDGDLQRCGSSSTCPSFSSCYSTCEAGSGVLFSNHQSDSHLTWISKRNSWQIFFLVQFVVLVLTAVNGTGGRPGIRT

SEQ ID NO: 33271 - protein, 104 aa, Sorghum bicolor
  Clone ID: SORBI-28MAY03-C28869_1.pep
MAASEANNKQQPRRHHFMLVHGICHGAWCWYKVATALRRAGHRATALDMAGCGAHTARLADVHTFEEYSRPLLDAMAALPAGEQVVLVAHSHGGSSVALAVERF

SEQ ID NO: 33272 - protein, 131 aa, Sorghum bicolor
  Clone ID: SORBI-28MAY03-C28902_1.pep
LGGEERTDAEVMLDGKVPVVTVRGSDWMWRAFLPEGADRNHPAAHVTDENADLADGFPPAMVVIGGLDPLQDWQRRYADVLRRKGKPVRVVEFPEAIHTFFFFPELPDCARLAEAMKAFIDDSNASSVSAA

SEQ ID NO: 33273 - protein, 90 aa, Sorghum bicolor
  Clone ID: SORBI-28MAY03-C28985_1.pep
LALNSLLRPFSFASACKGQTPRTTTTGLHLATIVKLLYKLDDFRSTGEKTLISRTQSPRLAPVSISHSPCGVDYNQPLQNSTHQRGSNLH

SEQ ID NO: 33274 - protein, 91 aa, Sorghum bicolor
  Clone ID: SORBI-28MAY03-C29312_1.pep
CRRRRPRRWPRPRRRPPWPGPRCPRRGCRGGGSASTRRSRSPRAGRGPPPPRTSSPGCRRRRRRSARAPRRWPRWPEPEPSKASSSICYLC

SEQ ID NO: 33275 - protein, 261 aa, Sorghum bicolor
  Clone ID: SORBI-28MAY03-C28386_1.pep
ARGDMGFEPEVRAILSQTSSVRQMVMFSATWPLAVHKLAQEFMDPNPIKVVIGSEDLAANHDVMQIVEVLDDRTRDSRLLALLDKYHQAQSNRVLVFVLYKKEAARVETMLQRRGWKAVSVHGDKAQHDRTKALSLFKEGKCPLMIATDVASRGLDIPDVEVVINYSYPLTTEDYVHRIGRTGRAGKKGVAHTFFTQANKALAGELVNVLREADQVVPPALMKFGTHVKKKESKLYGSHFKEITADAPKSTKITFGDSDED

SEQ ID NO: 33276 - protein, 107 aa, Sorghum bicolor
  Clone ID: SORBI-28MAY03-C28418_1.pep
MNAADSGDMDMAATLADMFDTGAGAGAGAPPKGMPAAAIAALPVTAFTEDTVTDASGEPIGCSVCLQDFEAGETARSLPECGHTFHPPCIDVWLLRHASCPLCRRAV

SEQ ID NO: 33277 - protein, 93 aa, Sorghum bicolor
  unsure (1)..(93): unsure at all Xaa locations
  Clone ID: SORBI-28MAY03-C28460_1.pep
PRHRVPALRRRHGRRQXRALHGRSRRARRHRPQPPPPQQQRRRRPWIRLQMNSEGRDVRKNSSFFRRDRQRRKTPQGSGIKSLFFFCRLSVSN

SEQ ID NO: 33278 - protein, 111 aa, Sorghum bicolor
  Clone ID: SORBI-28MAY03-C29245_1.pep
FDKNRGVVPNLRGRVLSSESEIATVERGLYVVGWLKRGPAGIVATNLHCAEETVASILEDDKKGVLRPPSGSKKHGRTGLLEILEQKNVRFVPFSGWEKIDSMEKMQGRVR

SEQ ID NO: 33279 - protein, 103 aa, Sorghum bicolor
  Clone ID: SORBI-28MAY03-C29249_1.pep
LNPPVCTSTGAPRRGNSVRRKRAALGAAVSVWVHRGGQGQISITPSAANAMRRRGGERWWWAPEVCRGDAGPNPNPKPSSSSRAPRRRRRGGPRRRRRRRRAG

SEQ ID NO: 33280 - protein, 141 aa, Sorghum bicolor
  Clone ID: SORBI-28MAY03-C29267_1.pep
ARGSSQTGKWSNLVSAAVPFVVYYVARPGVLVGNALYWMPLGHGYGIAEFDLDTHTLALVECSSGAKDLKGRSRILLAQNGVLCLAILSGHSLQMWERKVCSEGVASWVLRKSDKLQKILGRRYHLQKSSLCKYIWFRFVC

SEQ ID NO: 33281 - protein, 141 aa, Sorghum bicolor
  Clone ID: SORBI-28MAY03-C29282_1.pep
YSRTERMASNRGTDAAATTPWIHSGVTAASDHRSQINHGPATDAHGAASGGDGGRWSGEGRGGGHLGRVEPPQLPRAQRQEGAEGDLHCDGHAGEGDPEPLPEVEPAPPGRRWRDRGPRSVPPVPVAVPLRGRGSRGRPRA

SEQ ID NO: 33282 - protein, 126 aa, Sorghum bicolor
  Clone ID: SORBI-28MAY03-C2927_1.pep
SESLNSSSVDLSNYKKVVSGGVASNKYVRTRLNQVAENNGLQLVSPPPSLCTDNGVMIAWTGIEHFAVGRFEDPPAANEPDDKQYELRPRWPLGEEYSEGRSVARSLKTARVHPSLTSMIQGSLQK

SEQ ID NO: 33283 - protein, 142 aa, Sorghum bicolor
  Clone ID: SORBI-28MAY03-C29288_1.pep
HEAELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 33284 - protein, 142 aa, Sorghum bicolor
  Clone ID: SORBI-28MAY03-C29290_1.pep
LEYAWRLYKKGRTLELLDPAVKSSAVPEQVELCVRIGLLCVQADPRLRPDMKRVVIILSKKQSKLEEPTRPGVPGSRYRRRPHGLRGSHYSAGSSSGTSSPSTSATTSHASASASASNAMTTSSTHTMRSQGLPSHREDEES

SEQ ID NO: 33285 - protein, 138 aa, Sorghum bicolor
  Clone ID: SORBI-28MAY03-C2871_1.pep
SGLVSLLKLSSRFPPTSERIKDIVAQNKGNTVLELQQRSIEFSSIIQRHQSIKSSLLERMPVLDEANYLVKRAASTQAAVSSVNSAPAATSGGPLKLPNGVAKPPAAPLADLLDLSSDDAPVTTSAPTTAPNDFLQDL

SEQ ID NO: 33286 - protein, 177 aa, Sorghum bicolor
  Clone ID: SORBI-28MAY03-C28750_1.pep
MAKPRKPRTLAPDPSVAAARLPWHPPAPPVPTAVLISLAALLVRVLVSVGPYSGQGAAPKFGDYEAQRHWMELTLHLTPSDWYRNTSDNDLAYWGLDYPPLSAYQSLLHGRIINASLPEAVALRSSRGYESMESKLLMRWTVLSSDLLVFFPAALWFVWAYMKVGIGISGEERREGW

SEQ ID NO: 33287 - protein, 228 aa, Sorghum bicolor
  Clone ID: SORBI-28MAY03-C28757_1.pep
MRSRFCCIGGAYAMAAAENEIKIGQVDDVQELHRTGLTTVPDRYIRDGDDRPDGDNVCALAHIPVIDVGDLPRGDDELDKLRLACEEWGFFQVVNHGIAHELLDEMEKLTREFFMLPLEEKEKYPMAPGGIQGSGHAFVFSEDQKLDWCNMLALGVEPASIRQPKLWPTAPARFRETLEAYSAEVRKLCRTLLAHIAETLGLAPATFGDMFGEAVQAGRMNFYPPCPR

SEQ ID NO: 33288 - protein, 71 aa, Sorghum bicolor
  Clone ID: SORBI-28MAY03-C28760_1.pep
MVAYVLLDSPEDSIINLKEACFKVGEKVELKKYMDSFPFPYYVMLQNIEALPRTLADLIRQWFELMQSANE

SEQ ID NO: 33289 - protein, 142 aa, Sorghum bicolor
  Clone ID: SORBI-28MAY03-C2939_1.pep
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 33290 - protein, 97 aa, Sorghum bicolor
  Clone ID: SORBI-28MAY03-C29411_1.pep
LLNFTQPSHPSRPTTAKQSTEPTRTLQVQLATKRRRLINVTHTAISLQPPSASPKLRNVTYPCIYRDHHQQQQQVTTTTTTTTGCTRALRLRRRWLY

SEQ ID NO: 33291 - protein, 87 aa, Sorghum bicolor
  Clone ID: SORBI-28MAY03-C29412_1.pep
NCRSPRRDSQLKCPSILSLNFCKQINSVYKLTGGCSMLILSTSTYFRFTPCLLLRTHNILFNSFFYSQCFIMPVYCILHTSLVFYEA

SEQ ID NO: 33292 - protein, 94 aa, Sorghum bicolor
  Clone ID: SORBI-28MAY03-C29463_1.pep
MLSGSTRQLDGDYEHCVKVIRQLECDGHIEICFRMKFLTWYSLRSTDQERKAVTTYVKTLSDDPSSLAEQLVDSFGEILNSKKAKTGFCNKLWH

SEQ ID NO: 33293 - protein, 103 aa, Sorghum bicolor
  Clone ID: SORBI-28MAY03-C29462_1.pep
HVTVDSQTMHPTANHGFRLQNEPIAESKNFTYSLVHDSAGGSVQADGPMQTSENLGHLIGQSNPVPNEAHLNDFSGAPADELPIEDAAHEPEIPNILLQFDWD

SEQ ID NO: 33294 - protein, 110 aa, Sorghum bicolor
  Clone ID: SORBI-28MAY03-C29466_1.pep
LVPLVLLACLCRNNKFKTLFDKANIRIIKRRSRGQQVTPWAHREGVARPLFGGTQVCHLVRRHKGPLWTLLVGPEAQKWGRPTPHQRRFQGRWPPTDLPHMSHMLICPCR

SEQ ID NO: 33295 - protein, 76 aa, Sorghum bicolor
  Clone ID: SORBI-28MAY03-C29476_1.pep
WAWALRNTCYVTLLSPDRPTPLFHERSAETKSAVNFRQQFCFFFGKCICYFLFLDRTIIVSLSLLRHSIFFFTFFC

SEQ ID NO: 33296 - protein, 98 aa, Sorghum bicolor
  unsure (1)..(98): unsure at all Xaa locations
  Clone ID: SORBI-28MAY03-C29478_1.pep
TNEIEQMIDDAAKFKSSDEAFTKKXESRQQLESYISRVEELVSDPSMSMKLKRGNKEKIESALSDAMAQLEVEDSTPDDLKKKELALKRLMTKAMATR

SEQ ID NO: 33297 - protein, 129 aa, Sorghum bicolor
  Clone ID: SORBI-28MAY03-C2899_1.pep
AAERPVNKDSLLGRFIDGTDAYRDARFKLIPSIVEGYWMVKRAVGTKACLLGKAVTCNYLRQDNFLEIDVDIGSSSVARSIIGLVLGYVTSIVVDLAILIEAKEEKELPEYILGTVRLNRVNPDSAVSI

SEQ ID NO: 33298 - protein, 155 aa, Sorghum bicolor
  Clone ID: SORBI-28MAY03-C29172_1.pep
ARGEGEATSVDWCASEVGKIATSSDDSTVRVWSTKKMDCTNVSSPTVIRKRITAPNTEYRRSSSHEHATTSRDAVACTSGDGELQSGCHSPLQPRALDFGTPESTKKRAFTLVQEEALDARKSPEVQMNSPSSVLSPPPSLKRRTIRDYFASAAS

SEQ ID NO: 33299 - protein, 116 aa, Sorghum bicolor
  Clone ID: SORBI-28MAY03-C29196_1.pep
GKQQQSPHPHQQQHSGAGASPSSSSVTTSSVKRRGGGGDSSGGGVEQGDGCDSPSGGAGGGGMVAAACPRCFLYVLISRSDPRCPRCESHVPAPPAPAPAVSKKPRIDLNVGYLGT

SEQ ID NO: 33300 - protein, 120 aa, Sorghum bicolor
  Clone ID: SORBI-28MAY03-C29553_1.pep
TIQRIIETAGDNEAQLFEALSIPEELQKVLSKYEKLKEPVCVELEPEPAMIPVTVEPEESPRTVSKEDAHVRKPGGSGDQSSRDDLLQDLDDMIFGKKGATSSHQDTTPRKDNKDDFISF

SEQ ID NO: 33301 - protein, 153 aa, Sorghum bicolor
  unsure (1)..(153): unsure at all Xaa locations
  Clone ID: SORBI-28MAY03-C2960_1.pep
WKALKTXFVKEVTGFISFLSALRSRRRDIFQRREFLKFENIHWYGSDLSEPRWEDPTSNFLCMHINAELDEKLPDSTGGDLYICFNANEESASATLPAIAEGSMWLRLVDTSLAFPGFFSRGSNPEIHKVLGFSSYQVNAHSCVLFESKRVLS

SEQ ID NO: 33302 - protein, 96 aa, Sorghum bicolor
  Clone ID: SORBI-28MAY03-C29555_1.pep
FHVIMLKCDRAHSSCSDHVADKKCTFVGFSSVEQFSRNGSTPHVQVLSCRISPDLCFCPICQEYLATGSVVSIFLKDYDIQVLTAALQQGCQLVAV

SEQ ID NO: 33303 - protein, 122 aa, Sorghum bicolor
  Clone ID: SORBI-28MAY03-C29646_1.pep
QRGIAMCPNNMDGIHSQASVSTGFTAELAGPGWSLVSDLEAPLAFFNLEAWVVRLLLVGRFPTPPLAVALLGRDNRFFAGALTCTGLSFGLLVDREAKFEGSELTSSVISFGGFTFILDDSK

SEQ ID NO: 33304 - protein, 99 aa, Sorghum bicolor
  Clone ID: SORBI-28MAY03-C29687_1.pep
WCPSEGWGRLLQLPRPPLLGLLTSLTSRGCTRMWRTTCSSSDTSFFTGVVEVEQARVDFAVWQHRMEFMLLSFAGRVLLHSFNVFEVVSLKLQVGEGYA

SEQ ID NO: 33305 - protein, 114 aa, Sorghum bicolor
  Clone ID: SORBI-28MAY03-C29689_1.pep
FKRDQEGIKTGTCMLRSLKATDKYRKNNAEHHRHPSQLICSLNSIVASSRTSHHGKNAIPNVVIVREEGLRHHLRSQFNSLSRYFVPDNRRQSRRSAPWPCRRRNSRRRDRYLR

SEQ ID NO: 33306 - protein, 120 aa, Sorghum bicolor
  Clone ID: SORBI-28MAY03-C32290_1.pep
TASKNDANVYDVHVVDDIRFSTEVKGLIGRSFSEATMQAERLQTRAAADDLLGKSLNAIKGAQDKIRHAANERRQSLQLQLLEDIANQLQGIKDAAEAGRQVYCATPKSSKRSLGVVLRH

SEQ ID NO: 33307 - protein, 164 aa, Sorghum bicolor
  Clone ID: SORBI-28MAY03-C32311_1.pep
LPRRPQFPLASVAGALQRRINARYDDLARASEAQCLTIEQVNEFVNSLIDARNELLQRYENVERSFKIKKAMLSNHRNYRSSYERLFEQVRRLETERDNLKKDAAIYNYIQERLQKSAAYKMIMELGTMEMEAQEISFEELLAKEKEDTAFWQRNGKMRSFSSK

SEQ ID NO: 33308 - protein, 149 aa, Sorghum bicolor
  Clone ID: SORBI-28MAY03-C32332_1.pep
ARGPSSPSTFGASMAGIPSGEGSGDARNRSTIWERFPPYPAHVVRFYHEHKDILGEILSGLSHLPTHEMMDALGEKLKEHSLSKVPLVHSSDDEEDEDDEDEGDKEDKGEEDREGGRLKLMDDEKKPLGAEEHQVYSECERECKKPKIG

SEQ ID NO: 33309 - protein, 136 aa, Sorghum bicolor
  Clone ID: SORBI-28MAY03-C29871_1.pep
MASASRRAGPLPGGKPAGAGPGRIGMPPAGLPCAPPLPGCMPAPPMPGWPIAIGMPPRGLPPPIEPMPGKPAPPPAPVMWGGLIVMPHAGGSMPPIMGPPRPAPAGTRPLLPCPGWFPPPGAPPTPPLPFCGGCCA

SEQ ID NO: 33310 - protein, 171 aa, Sorghum bicolor
  Clone ID: SORBI-28MAY03-C29872_1.pep
ARGPALSGGGGGSSVRPWGSSGGTSVSSSGKRIQKELLDLNASDCSAGPKGDNLYHWLSTIIGPQGSPYEGGVFFLDIVFPPDYPFKPPMVTFKTRIYHCNIDSTGKVHLDILKDGWSPAFTISKVLLAIKDIISNPDPYTPLVMNISRQYLTDRAKHDEIAAEWTMRFAR

SEQ ID NO: 33311 - protein, 107 aa, Sorghum bicolor
  Clone ID: SORBI-28MAY03-C29886_1.pep
YEETGAAVHKIEGFKPKVKSIRQFGKYERENMKNRANGGDGPVPISVFLVASVLKENSPKLLQEARGIDDIIRILNDVNGNLDAKRACVVALKLHRKYHKKLQEKKS

SEQ ID NO: 33312 - protein, 83 aa, Sorghum bicolor
  Clone ID: SORBI-28MAY03-C29900_1.pep
LTQPINALAFVFDGINYGASDFGYAAYSMVLVAIVSIICILTLESYSGFIGIWIALVIYMSLRMFAGFWRIGTAQGPWAYLRG

SEQ ID NO: 33313 - protein, 159 aa, Sorghum bicolor
  Clone ID: SORBI-28MAY03-C29905_1.pep
LIKKSFKINGGMGNGRAKVFINGYPISDRAVRKAEKIAGPIYPGEYWYDYRAGFWGVMGQPCLGMIPPYIAEFNYPMPKNCAGGNTGVFINGRELHQKDLDLLVGRGLPDSPDRSYRVEISGKVSDEVSGEELYCLGKLAPTVEKMKRGFGMRVPRIIQ

SEQ ID NO: 33314 - protein, 183 aa, Sorghum bicolor
  Clone ID: SORBI-28MAY03-C29922_1.pep
TEMKKVLNQYLEEKTDLERVINREKQRSARTKLSRLKILHECRLLRERLQECSAKFLAEEQDNFTIDPSSLPDALDLLATSDNRIRLLVAEAQLLARDDEQGSSDDGDNSDSRSSLTMSSEDAKVTDEDTTKMLSDLLIDNAQLRLRLNAVIRNAVNTAVKPEKEGSGEVLPKKTVLNWLLDR

SEQ ID NO: 33315 - protein, 110 aa, Sorghum bicolor
  Clone ID: SORBI-28MAY03-C29950_1.pep
MAGYMSRGPPNGCVYVCNLPPGTDEDMLAEYFGTIGLLKKDKRTGRPKIWIYRDKVTNEPKGDATVTYEDPHAASAAVEWFNNKDFHGSTIQVHIAESKSKEAFDNPTSL

SEQ ID NO: 33316 - protein, 169 aa, Sorghum bicolor
  Clone ID: SORBI-28MAY03-C29935_1.pep
FPEDGTESNGQQVFDETESQNQLENLTLSQVGSSLPVSMEDTTFDHDTVTLKTDTKQQARGTCTPGNSHVDRELSIRDNSSQAISKNAEKKISLLGHGHHGKQVVELLLSNGGEEAINQFCQRWRQIFVEAVHPRYLPSGWNINHSGRRDFGDFSVYKPPRKDAQSARD

SEQ ID NO: 33317 - protein, 133 aa, Sorghum bicolor
  unsure (1)..(133): unsure at all Xaa locations
  Clone ID: SORBI-28MAY03-C2952_1.pep
MSVEILDGSTVRSFVEDEGAFNSSVDGRFAALDADHDGLLTYAEMAGELMSLRVLEKHFGVDEAAVAPDELAGLYRSLFARFDRDGSGMVDRHEFRAEMKEVMLXAVANGLGXLPVQMVVEEGSFLKVAVDRE

SEQ ID NO: 33318 - protein, 127 aa, Sorghum bicolor
  unsure (1)..(127): unsure at all Xaa locations
  Clone ID: SORBI-28MAY03-C29507_1.pep
XGVMGSSLGFASYTAFCYLIASMGLQMLWSFALACLVGWATPTYSRLSCPLLVRLPVVGVWVTAILSFAAASSSAGVVILFQKDVFFCRRYTQLPCGKYELATAFAFLSWALSATSALIMFWLLAAF

SEQ ID NO: 33319 - protein, 180 aa, Sorghum bicolor
  Clone ID: SORBI-28MAY03-C29522_1.pep
RQHAADVTVTYLRTEKYYEELASSVFCGVLPGDGWSGRMEDSMLQGCIPVIIQDGIFLPYENALNYNSFAVRIQEDDIPGLISTLRGINNTQVEFMLGNVRQIWQRFFYRDSILLEAQRQKGLFSEEAPWSVEVSKLPHDDDAFATFIQVLHYKLYNDPWRQGLLQTKETRLPNICSRTS

SEQ ID NO: 33320 - protein, 80 aa, Sorghum bicolor
  Clone ID: SORBI-28MAY03-C29527_1.pep
DQQPKSAPLLHPFSLPPVPPVPPYGMPLLQPFPPPKPLPLLTPASYSQVVTREQVGAALLRLAQNDNFIDMAYREMAKRP

SEQ ID NO: 33321 - protein, 73 aa, Sorghum bicolor
  Clone ID: SORBI-28MAY03-C30055_1.pep
FTYFNFIYTIIEIFSGQILPTRSTTHSTCPTDLGAQIRSMITTLHTVSIASNQTSVSCVAGSILPIAQIKKPP

SEQ ID NO: 33322 - protein, 129 aa, Sorghum bicolor
  Clone ID: SORBI-28MAY03-C30100_1.pep
SRMSSGATEKRMRMMVGSLGRWYGGGAHGKEQSTDRSPPWRRWTAARLAMEDLPSEDEARSLDWIGRTGPDQTEAKTRRFQTLTRAQEPKHGTIEQQVLGQRGDRGPGEKLPKEKVNQARKEEDRRSLV

SEQ ID NO: 33323 - protein, 172 aa, Sorghum bicolor
  unsure (1)..(172): unsure at all Xaa locations
  Clone ID: SORBI-28MAY03-C30114_1.pep
ARGENDGLASNADSAQFQSDELEVPDVTEETMCDAGVADAQALNRVRVVPPPSDGQKIFQIDPMLQGYKYHLEYRYSLYRRIRSDIDEHEGGLEAFSRSYEKFGFNRSAEGITYREWAPGALAAALVGDFNNWDPNADRMSKNEFGVWEIFLPDNAXGTSPIAHGTRVKVTM

SEQ ID NO: 33324 - protein, 224 aa, Sorghum bicolor
  unsure (1)..(224): unsure at all Xaa locations
  Clone ID: SORBI-28MAY03-C30131_1.pep
HEGSTFDERDQIRERRRMQYARWKEECKEMDSHVGSGKIITAPVITEDGFPIKDPLVLLEATSDTQGTSTTTTTNGSSGNGIDVDNNSMNLVLDKQIIGWKLTLHQIGLDVLRTDRTMVFYENKDNLSKLWDILAVYAWIDKEVGYCQGMSDLCSPMIVLLNDEADAFWCFERLMRRLXTQQSVGVENQLQHLASIIQVLDPKLHGHLETLGGGDYLFAFRMFM

SEQ ID NO: 33325 - protein, 200 aa, Sorghum bicolor
  Clone ID: SORBI-28MAY03-C30164_1.pep
ARGPHVLKKVSHEEDRSNFPTVTIADIDRTMKKYSASLLHALEGVSSRLSQMEGRTHQLENSVDELKLTIGNYNGSTDGKLRHLENMLREVQAGVQIMRDKQEIVETQLHLAKLQTTKADAQLSENSGSGQAGSQQHTVAPPQAAIQPQQVLTPSQPPALPALPAPNAPPPLPTLQSQPPSQFPSHLQHSQVPSVPSVAP

SEQ ID NO: 33326 - protein, 184 aa, Sorghum bicolor
  Clone ID: SORBI-28MAY03-C30173_1.pep
TRAFFGFGTLWLAVTKTVAMPYWVLWIALCIGTNSSAWLGTAALVTNMRNFPLSRGTVAGLIKGYVAVSAAVYTETFNGMLGNSPTNLLLLLALGIPTACIVVMYFVRPCTPSLDEDNSTEHSHFMYTQISSVVLGIYLMVATILGDTLKLSQAVTYLLFGIMILLLLAPLAIPIKMTLYPNKQ

SEQ ID NO: 33327 - protein, 116 aa, Sorghum bicolor
  Clone ID: SORBI-28MAY03-C30206_1.pep
VCSCSRLWGHPALHVELTFLRLALCQGDCFLVPRELVELSFVCRKSVRQPKIADSGVWMAPVGNHVVDISSDEEDLFMGTSLKLPEPLDPPVNLSRFMDHICGVADYVTGEDIDDL

SEQ ID NO: 33328 - protein, 125 aa, Sorghum bicolor
  unsure (1)..(125): unsure at all Xaa locations
  Clone ID: SORBI-28MAY03-C29765_1.pep
GSLLHISRHLALEHVRVPIFSTEPRQLVPDALLHPFIPGSSLDRVLXVHPSRMRSHGQLVLLALRSLLAPRALPALLQEGWISIIFSDEICSPWMVVLLGIGITMIIVLVSFAVTTRKRTSKLKV

SEQ ID NO: 33329 - protein, 109 aa, Sorghum bicolor
  Clone ID: SORBI-28MAY03-C29753_1.pep
DEFGNLKKKFRSKALHTESAQALPGSGRAGWEVEHRGSSEREGRERSRDRRRDDYDEKETRNRDRGDHGRDQRRSRSRSRDRERERGRERRRDHEYERSQERDRDRRHR

SEQ ID NO: 33330 - protein, 127 aa, Sorghum bicolor
  unsure (1)..(127): unsure at all Xaa locations
  Clone ID: SORBI-28MAY03-C29842_1.pep
AANPNSRIGIQYEPGSSLGVWYQSYRLARGALPAFYQGHRNTTXAXLALAGEVQLATAVVSGLQDAQRTGAVPLVFRADVPVRVEVGSXKLWKVTSRVRCDLVVDRLMDVSSPIKIKASNCKFSLKL

SEQ ID NO: 33331 - protein, 188 aa, Sorghum bicolor
  Clone ID: SORBI-28MAY03-C2987_1.pep
MAAALCLPRAGAPFILLRASRFAPWAAPVLRRRLLSGPPTAGELPPPALPPISKLADPPVVGTPEPPLPFRSVEAEILRDIDPVVQLIKDILHSERYGDGECLCPKDENVVVEKLLSYHPRAHDKIGCGLDAIMVDRHPEFVESRCLFVNRTDGVWMDFSYQKCLRAYIREKYPSHAERFIREHFKRP

SEQ ID NO: 33332 - protein, 185 aa, Sorghum bicolor
  Clone ID: SORBI-28MAY03-C30228_1.pep
TRNTSVTRARFEDLNAKSFAGTLDPVQQVLKDSGLAKSQVDEIVLVGGSTRIPRIQKLLSDFFDGKKLEKSINPDEAVAYGAAVQAGILSGKATSAETQDLLLLDVVPLSLGVAMEGNIFAPVVARGQTVPTIKKRTFTTVVDNQTTVQFPVFQGERTNCSDNTSLGEFTLAPIPPMRAGEAALE

SEQ ID NO: 33333 - protein, 233 aa, Sorghum bicolor
  Clone ID: SORBI-28MAY03-C30257_1.pep
TRGELRLGVRRAIQLKNEALFEDFSARGTKRHTLSAVADSLKHRSVFHISYNPRATASEYIIPYHKFLKSLNHPVCVGARINFQCHNEDVSERRSGMVVRISEIDPMKWPGSKWRSLLVRWEDGAECNGQDRVSPWEIEVAGGSVSVAHSLSASSSKRTKLCAQGNLDVPTMWNGCTDSVETGKLPRVLQGQELMGFRTRHVPCAPQTAEAAKLQSSDASKFLSNARDCALSA

SEQ ID NO: 33334 - protein, 151 aa, Sorghum bicolor
  Clone ID: SORBI-28MAY03-C30261_1.pep
MARRRRRQRQRQQQRWEPELNEDVTAEILLRIPPDEPAHLFRASVVCKLWLRVASDPAFLRRYRDFHRGAPLLGFFYNPDSSGPFPGFLYNPDSAASWRPQPRHGKGCARCVYDCRHGRVLLGEISRSKLVVWDPFSNHCEELQAPSSLCP

SEQ ID NO: 33335 - protein, 192 aa, Sorghum bicolor
  Clone ID: SORBI-28MAY03-C30298_1.pep
SRPAVVIDNGTGYTKMGFAGNVEPCLITPTVVAVNDSFSSSGQPAARGAPARGNWLAQHSAGVMADLDFYIGEEALARSRASTSHSLSYPIRNGQVENWDTMERFWQQCIFNYLRCDPEDHYFLLTESPLTAPETREYTGEIMFETFNVPGLYIAVQPVLALAAGYTTTKCEMTGVVLDVGDGATHIVPVAD

SEQ ID NO: 33336 - protein, 117 aa, Sorghum bicolor
  Clone ID: SORBI-28MAY03-C30315_1.pep
EESPGGDDRSPIASNWAATARASSYLASWWSISRRRTRGGRGRSRRVPSRSCGTFSLHDHEQSCPPPHPGPLTTILHATRRERPSPLYGRFTTEEHTVPRTTNQLSVSYRFLPSLAS

SEQ ID NO: 33337 - protein, 106 aa, Sorghum bicolor
  Clone ID: SORBI-28MAY03-C30333_1.pep
MLAIRSTKCPVAFVGVAGALVVLVTAVHVFMVPILPASLDYFGARSSISRPNNVLPAVGVVDSRLRGRFPSDSYGAVAFRGAPWKAEIGRWLAGCHANSSSVDVTE

SEQ ID NO: 33338 - protein, 67 aa, Sorghum bicolor
  Clone ID: SORBI-28MAY03-C30334_1.pep
MESRRGGSTAAAEDAGGGMPSFGPPQHAIHTDVNSMQPSRVTDFGALAQSAGFRIEDLANLNANALF

SEQ ID NO: 33339 - protein, 158 aa, Sorghum bicolor
  Clone ID: SORBI-28MAY03-C30035_1.pep
MKVRRSDPVLVHATGDDAATQEYYFLSNLDQNVAGLMKTVHVFSVPRETRIVDDVAALLRDSLSRVLSHYYPLEGRLAVREDGRLAVRRNDDRRRGVPFVEAVSDYELHQVVGDLAAAAPGAEFLGGDLVYVDNDMQNENALEAPLLTVQVTTFKCGR

SEQ ID NO: 33340 - protein, 268 aa, Sorghum bicolor
  Clone ID: SORBI-28MAY03-C30038_1.pep
TRGTADLRHFALYAFAGRSGDRRWSRKNENIQSQPSDASVMLPQHNYKLDVHALNSHQPGQFECREFRESILGIMPHHWDRREDTTLQLAHFRKHKRKQVKKTPGKAVINSVNKPTGHNPPGKDASNRIPRALGKAADMAGSNKARKAQRMQYVPTITNHTQVWWVPNVIVAHEKEGIEAVHLASGRTICKLHLTEGGLHAHINGDGVLDHVHVVGGNGIKEQTVVSGSMEVLKPCWAVATSGVPVREQLFNVSICHYNHFNMVHHGD

SEQ ID NO: 33341 - protein, 215 aa, Sorghum bicolor
  unsure (1)..(215): unsure at all Xaa locations
  Clone ID: SORBI-28MAY03-C30381_1.pep
AQWAGLCNGMAAGVMLAASFDLVQEGQVYGSGSWVVFGILGGGIFIWLCKKFLEQYGEVSMLDIKGADASKVILVVRVVTLHSFGEGSGVGVSFAGSKGISQGLLVTIAIAVHNIPEGLAXSTVLASWGVSPQKAMIWSIITSLPQPIVAVPAFLCADAFQKVLPFCTGFAAGCMIWIVIAEVLPDAFKEATPSQVASAGTLAVAFMETLSTVLL

SEQ ID NO: 33342 - protein, 144 aa, Sorghum bicolor
  Clone ID: SORBI-28MAY03-C30383_1.pep
MATHGGGPRPCHLLILLAAAALYSASSPAGAFYLPGVAPRDFQKDDELQVKVNKLSSIKTQLPYDYYFLDYCKPEAIKNSAENLREVLRGDRIENSVYNFKMRRDESCKVVCRKQLSQEAAKNFKEKIDDEYRVNMILDNLPVV

SEQ ID NO: 33343 - protein, 64 aa, Sorghum bicolor
  Clone ID: SORBI-28MAY03-C30398_1.pep
PPRHSVGMRGEESSTGAAASRKEAARGRSLCIAWLRRRQALGSSMALRLRLRPLGRPTRVRPSC

SEQ ID NO: 33344 - protein, 167 aa, Sorghum bicolor
  Clone ID: SORBI-28MAY03-C304_1.pep
RVRNLQLAVACAGAGGSRHLFLANNISFVLSRVADGDGVAAMLGAAFAARRRSRLEQHLASYAASSWGPVVALLDTPVCGRGKPAKILAEFNAAFTRTRDSEVCREVPDPVLRAVLRHALSDMVVPAYCAFLQKQPKLWKSVRYTADDLAESLSELFEGEVTDARKI

SEQ ID NO: 33345 - protein, 75 aa, Sorghum bicolor
  Clone ID: SORBI-28MAY03-C30411_1.pep
RSFYSKAFSHSLLNRKKLKLSISTYLCQCIVQFQFVAEPLTIINSWNPIASEDLFHLRSCSLQRIFFFTQLNQIC

SEQ ID NO: 33346 - protein, 63 aa, Sorghum bicolor
  Clone ID: SORBI-28MAY03-C30402_1.pep
PYGIIEGQPGIEIFLSPLGAWRSCSSSPPLPQIADHGSSSPQTPTPTLPRLSFLLPPQQGQAP

SEQ ID NO: 33347 - protein, 156 aa, Sorghum bicolor
  Clone ID: SORBI-28MAY03-C30444_1.pep
HEVQMSEQFNRELSLTGKIPSGMFNSMFDFSGCWQKDAANTKSLAFDGWYISLYTVALSKSRILLRDHVTHAVPSTWDPAALARFIEKFGTHIVVGVKMGGKDVIYLKQQHSSSLQPAAVQKRLKDMSDKRFLDANGQYDMNNKDVYGKDKHDARD

SEQ ID NO: 33348 - protein, 127 aa, Sorghum bicolor
  Clone ID: SORBI-28MAY03-C30149_1.pep
LLSSLIAGSSFMVQLGAQVVWLSSKLNPDWLCAAATILLGTNLSSDLASIVLVSASRTAQLASDAAPFLSGKLSRTSRYFTWSVSEEASDPEFFFACGGGPRRPARKTEAEGRAGRSRWDGGRRATC

SEQ ID NO: 33349 - protein, 173 aa, Sorghum bicolor
  Clone ID: SORBI-28MAY03-C30220_1.pep
MSFSDDGKMKGCQPNLFRTKDKKVAKRTDRAGCSTSKSGSSNSKSPSSSPFRKLSEVRSIRLSHFLSHSSNATKYEHVRIFVSTWNVGGKAPTAELKLDDFLPADDHSDIYVLGFQEIVPLNAGNVLVIEDNEPAARWLALINRALNQPVDTDADIFQHKPSPSLDSPHPSQH

SEQ ID NO: 33350 - protein, 72 aa, Sorghum bicolor
  Clone ID: SORBI-28MAY03-C3024_1.pep
LSQPNRYGWVSVANASDLTSALKEMNGKYVGNRPIKLRKSTWKNRIDFESLEKGKTQPQKKIKLQKRSVLHK

SEQ ID NO: 33351 - protein, 103 aa, Sorghum bicolor
  Clone ID: SORBI-28MAY03-C30504_1.pep
MSVLIVTSVGDIEVDLHTDRCPLTTKNFLKLCKMKYYNGCLFHKVEKDFLAQTGDPTGTGTAGDSVYKYLYGDQARFFDDEIRPELRHSKTGTVAMASAGETA

SEQ ID NO: 33352 - protein, 181 aa, Sorghum bicolor
  Clone ID: SORBI-28MAY03-C30507_1.pep
HEAHLGGEDFDNRLVNHFVNEFKRKHKKDLTTNARALRRLRTACERAKRTLSSAAQTSIEIDSLFEGIDFYTSITRARFEELCQDLFRGTMEPVERVLRDAKIDKSSVHEIVLVGGSTRIPKIQRLVSDFFNKDPNKSINPDEAVAYGAAVQAAILSGDTSSKSTNEILLLDVAPLSVGIE

SEQ ID NO: 33353 - protein, 204 aa, Sorghum bicolor
  Clone ID: SORBI-28MAY03-C30523_1.pep
HEARSYGQWARGRYLALSGNELTGEIPEELGNLTTLRELYLGYYNNFTGGIPPELGRLRALVRLDMANCGISREIPPEVANLTSLDTLFLQINALSGRLPTEIGAMGALKSLDLSNNLFVGEIPASFASLKNLTLLNLFRNRLAGEIPEFIGDLPNLEVLQLWENNFTGGIPTNLGVAATSLKIVDVSTNKLTGVLPSKLCAGE

SEQ ID NO: 33354 - protein, 74 aa, Sorghum bicolor
  Clone ID: SORBI-28MAY03-C30562_1.pep
HLICCADSKNKRMLGYSKLLIFTRAAKVEYSDAGSTRKSMQLGPCFLMILHKSSHIINKITLACFTGVPQNSMK

SEQ ID NO: 33355 - protein, 183 aa, Sorghum bicolor
  Clone ID: SORBI-28MAY03-C30526_1.pep
MAEIAGDEAPTPPPPPPTSGEASRDPHTSTPASTGSNKPPLRTTKPGVKRLILTASVLLSFLVGLPFLLKSTEIHRSPLPSDAITALAHRLHSTPPSFPCSLHAVFLRSVPDRSDASLSRRLEQSISAQLQLLPATSTAGNVSVSVTVELAGGCSSSSSSSVGSDWQCGTVTSADLVIGDEVF

SEQ ID NO: 33356 - protein, 83 aa, Sorghum bicolor
  Clone ID: SORBI-28MAY03-C30569_1.pep
VVLSNRSYYYQSLTKYSAIATSQNSAVKPRGRSLGKADKGTLSDHSWGGTECNEYLKNWLWKVKKKKKELAGGNHSGVLSDLT

SEQ ID NO: 33357 - protein, 83 aa, Sorghum bicolor
  Clone ID: SORBI-28MAY03-C30579_1.pep
FFIGNFTEVFDLHIFIETFLRNDSRLCYRATSFSFSVFYICSIIGYSAIICTVHFNLRASIGCTVRSAWGIMNSVACGCSEEG

SEQ ID NO: 33358 - protein, 159 aa, Sorghum bicolor
  Clone ID: SORBI-28MAY03-C30340_1.pep
MARSRRGGFGGGGGNVKVTPNLAWDREGTRMLNLSVLRRLDPGVADILITAAHVVAYSFDEGQGEWTRKPVEGSLFVVKRNTQPRFQFIIMNRINTENLVEDLLTSFEVEVQSPYLMYRNAADEIIGIWFYDPQECQEVAHLFSRIAYAYSRASPKTNL

SEQ ID NO: 33359 - protein, 301 aa, Sorghum bicolor
  Clone ID: SORBI-28MAY03-C30336_1.pep
ARGTKEGFAVAARDCTHTFIEKFDKGSEDAAIQQVKWDPSKVKDKLKCDIEAHVASVRAAKLSELCAKYEAQLTKALAEPVEALLDSACEDTWPAIRKLLQRETKAAISGLESALSAFELDEATEKELLVKLENHGRSVVESKAKEEAGRVLIRMKDRFSTLFSRDADSMPRVWTGKEDIKAITKTARSASMKLLATLAAIRLDEDGDDIENTLNLALVDTSRPGTTDRSIQSFDPLASSSWEKVPEEKTLISPVQCKSLWRQFKAETEYTVTQAIAAQEANKRNNNWLPPPWALAAMAIL

SEQ ID NO: 33360 - protein, 101 aa, Sorghum bicolor
  unsure (1)..(101): unsure at all Xaa locations
  Clone ID: SORBI-28MAY03-C30368_1.pep
MEMYLVEDLDLLDDDDEFGGFGVTVGSGTPRPDKQTYDTSAGEYRNGKDMQGIPWERLNYGRNDYRRMRLKEYKNYESLSRSHELVDXECKQVDRGSTFYD

SEQ ID NO: 33361 - protein, 163 aa, Sorghum bicolor
  Clone ID: SORBI-28MAY03-C30376_1.pep
MGDNLMDKVNALGERLKIGSAEVSRKMSVGVSNMSFKMKEFFQGQNMADKIVDEATLETMDTPDWATNLEICDMVNTDRVNSIEVIRAVKRRIMLKNPRVQYLSLVLLETIVKNCDKAFSEIAAERVLDEMVKLIDDPQTIVNNRNKALMLIEAWGESGDDLR

SEQ ID NO: 33362 - protein, 153 aa, Sorghum bicolor
  unsure (1)..(153): unsure at all Xaa locations
  Clone ID: SORBI-28MAY03-C30613_1.pep
ASGCERSWSYFEHVHSKKRNKLEHQRFNDIVYVHCNLRLRQRSKSSTRNYDPISLEEIGKXEAWILEDDPPRLNSEELEAFRTELSTLSIQCSDDLVLNLDALEESDEIMEDQSLRHQEDAFDYGGISLDVGRPSPGGADAAVQDEWDPLNFY

SEQ ID NO: 33363 - protein, 135 aa, Sorghum bicolor
  Clone ID: SORBI-28MAY03-C3062_1.pep
SGPGPVSSTLQGYAMANMLFYSGSLLWGADRTDPVMKLSFLWRRPRVVRKHMDFIAGVLDGHILLGCDPGTWKAYVSQFMFLVVKFVPSWLRDIKLETLKKIAAGLRSWHEHDLALSLLERGGPQAISLVVEAFM

SEQ ID NO: 33364 - protein, 184 aa, Sorghum bicolor
  Clone ID: SORBI-28MAY03-C30634_1.pep
HEAGLGLSSVATLQAFQPFFVELTMPYSVIRGEAFTLKATVMNYLPTSLPMAVQLEASPDFTAVPVGNDQDSYCLGANGRHTSSWLVTPKSLGNVNFSVSAEAQQSPQPCGSEVATVPETGRKDTVVKVLIVEALSAMIWPEGIKREHTFSSLLCASDAELSETLSLLLPPTVVKDSARAHFSV

SEQ ID NO: 33365 - protein, 132 aa, Sorghum bicolor
  Clone ID: SORBI-28MAY03-C30660_1.pep
MAGEAAERVAAAVEAVGSGGWEFRNAYRRQLLALSRRIRLLGPFAEELREARRGRPAEEEEEQERALAPLADALEEALDLLQLGRDGSRIFLVLDRNKVMKKFHESIAQLEQALCDFPYDKLDISDEVTEQV

SEQ ID NO: 33366 - protein, 131 aa, Sorghum bicolor
  Clone ID: SORBI-28MAY03-C30640_1.pep
HEGSGGDSEGASVSGGPSAAELRRELHTALGTAKWQLDELARAIRSNDLVISAGKGTRARHDDFVMAIGHRILEVEKNLRESNVAEGRGPLSWVHLDEDERDDLAAFLSASPFQQKDKVVTIPSAGDIEVG

SEQ ID NO: 33367 - protein, 195 aa, Sorghum bicolor
  Clone ID: SORBI-28MAY03-C30665_1.pep
MGSYKYKYCMCFTRKFRSPDAQPPPDVRAAYLSFASDVHALRRFLSQAQAEHPADVDRILALLTAASVGHGIARLVTRSPAPAMPTLDDFFAFLFSPELNPPMGPPHQVHQDMSAPFSHYFVFTGHNSYLTGNQLNSDSSDVPIIKALQRRVGVIELDMWPNSSKTNVDILHGGYEFCFPNTFIIFTTWNYWYCK

SEQ ID NO: 33368 - protein, 112 aa, Sorghum bicolor
  Clone ID: SORBI-28MAY03-C30699_1.pep
MENLRRLLNPLALNLQKMELELTCPVCLKLLTSPTTLPCYHTSCSKCALTPTSKGYSCAICKSGYCSQDLRPASHLESIVSIHRSLSSTVCTMIEQQDAQVNIPGTSISCII

SEQ ID NO: 33369 - protein, 190 aa, Sorghum bicolor
  Clone ID: SORBI-28MAY03-C30449_1.pep
HEGEELMWDKVAKSEYGSLLSMDGSLDTWSWSLNVPVLNSLSEDDEVARGSQEHRDAVECYKQQRRKVSHLKKTIRSTKGFKEFQKIIDIRNFTKEKIERLEARSRRLTRRIRQIEPTGWKEFLQISKVIQEARALDINTQVIYPLGETAAAIRGENELWLAMVLRNKVLLDLKPSQLAAVCGSLVSEGI

SEQ ID NO: 33370 - protein, 175 aa, Sorghum bicolor
  Clone ID: SORBI-28MAY03-C30467_1.pep
SRKNLCVHPQASAAAARDSVDTGCRRLAPAWVREKAASDPESTPLCEFYETFDRAAAAGDLASFMPPGGYTLADLRALGRERRVCPYFLARQMVKYANVVVYSYQYLLDPKVASIVSREMQKECVVVFDEAHNIDNVCIEALSVSIRKQTLEGAERNLRRISQEIDRFKATDANR

SEQ ID NO: 33371 - protein, 109 aa, Sorghum bicolor
  Clone ID: SORBI-28MAY03-C30486_1.pep
GDVQVLAVEGKEEKTIMGISAKWIKSLVGIKKHEKGRNAECSDARSCVVQLLHKQEHSVNTESVPVAEELRVQAEPLAGDINTETISNSASSPSTSLQVQISQTELGTK

SEQ ID NO: 33372 - protein, 83 aa, Sorghum bicolor
  Clone ID: 30967614.pep
GRTRPRAKLSGPSLASPPHAACWDALDHHRCHHRLDLGRWHSWPPAEGQEGDHLPLLPKPYPSPTSILSKIRPQQSQILSRRE

SEQ ID NO: 33373 - protein, 58 aa, Sorghum bicolor
  Clone ID: LIB3481-017-P1-K1-G12.pep
GCTNQANLKSQIRKQNGYGLLLAAYPHVRCAGCRSMVPHHESSSSMNGTIEEWKEIRR

SEQ ID NO: 33374 - protein, 130 aa, Sorghum bicolor
  unsure (1)..(130): unsure at all Xaa locations
  Clone ID: SORBI-28MAY03-C30725_1.pep
VGAHLASGSWTLSREQGNKLLASRFRGDRLYLCDWPGCVHAEERRKYMVFRGVFHNFARSQVRRALRDTRRXTVAVECAFCGCKEAWDLYSAFCLRGFYGYRAGGEPVVRAYVCENGHVAGAWTERPLYS

SEQ ID NO: 33375 - protein, 113 aa, Sorghum bicolor
  Clone ID: SORBI-28MAY03-C30727_1.pep
ARGWRLPEVLVIHLKRFSYTQFTRNKLETFVDFPTTDLDLSSYIADKSKQPSSHYRLYAISNHYGNMGGGHYTASIYHEEGKGWYKFDDDYVTPMSEDSIKTSAAYVLFYRRE

SEQ ID NO: 33376 - protein, 169 aa, Sorghum bicolor
  Clone ID: SORBI-28MAY03-C30742_1.pep
FFLFGAVALLIAGLRFQSAVGLLAPGPRLADVQDCGRWRVLGTCIQGGALRSGLANGGSGRADGCRLGMVSPRFLGCLGRGDGAFRVRGCCSRSSVLSTAASSWFSCVRTIQQCALVLGDACPVGLPLPRGYRLLAPLFLSPLSLLLQSVTPSLGLCPWAGCARPLRFV

SEQ ID NO: 33377 - protein, 87 aa, Sorghum bicolor
  Clone ID: SORBI-28MAY03-C30746_1.pep
INSVFFSYNAGLQGETVPEIIARLKRDLVPTIKSGLLYWPTCDFITFKFVPVHLQPLVSNSFSFLWTIYITYMASLKKADVEVATST

SEQ ID NO: 33378 - protein, 111 aa, Sorghum bicolor
  Clone ID: SORBI-28MAY03-C30766_1.pep
RRFSGGGPVIVDQGTVFVTFICNKNAIAGLQPFPRDIMSWSGQLYGKVFDRFGEFHLRENDYAFSHRKFGGNAQSITKNRWVHHTSFLWDYDVKNMDYLKIPKRAPEYRLA

SEQ ID NO: 33379 - protein, 210 aa, Sorghum bicolor
  Clone ID: SORBI-28MAY03-C30769_1.pep
AGAGVPASTVKRGRGRPRKEKTLETGDLKVAQMTEGQHKALPAQAVDQGGLMQNEVEARILQSFGTPLMEKRGRGRPRKRPLETETTETQVDALVKKRGRGRPRKARPFETGSVETAVEVSRDLAEDGPEKDGDVVSGKKAEAQGVLLVEEIDNGTADAGCLVVPREEVAIAPMDAGGVLLSGEEAAVAPMDAGCATPRVDPMDVGTKSH

SEQ ID NO: 33380 - protein, 195 aa, Sorghum bicolor
  unsure (1)..(195): unsure at all Xaa locations
  Clone ID: SORBI-28MAY03-C30582_1.pep
RXGFIRYREHRFHTSLEKTRRFYPHVNNMDGFFVAKLKKLSNTIPADGEDEKAISNEQETAVPGEDEKTVQMKNQKKAKVTNKRTSVTKDTGGHKHESNRPGKHLKKNKDKDTKEIDGPESTETNGDRKEEHREQTKQRSHKRKFASNNSKKAGPESNLGVKEKRQVSDKKPKRKFKLRREWEAEKKKDAKRRKI

SEQ ID NO: 33381 - protein, 120 aa, Sorghum bicolor
  Clone ID: SORBI-28MAY03-C30610_1.pep
HEGAKSEHQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 33382 - protein, 85 aa, Sorghum bicolor
  Clone ID: SORBI-28MAY03-C30596_1.pep
GRRGSIQNLRMKKESAETEAVDQDVNSAAAEHSRGTGPVADGVGSSKQTFPNDTTPMSIDEPNVLKVEQQSPNKLQDQPTMHQKP

SEQ ID NO: 33383 - protein, 89 aa, Sorghum bicolor
  Clone ID: SORBI-28MAY03-C30835_1.pep
VPESEFTWPNATLSRLWLGSVISTCFHMLPSTKEVFLALCFLLCSILFDILHRCFFECHTVILIDVHHIIQPVLTSNLLHPSYATIFSL

SEQ ID NO: 33384 - protein, 248 aa, Sorghum bicolor
  Clone ID: SORBI-28MAY03-C30847_1.pep
ARGKRAPTPETYLAKIYAHSSIGQLQRAFGTLREFENAYGNSEDIDLELFSPFTSLHPLVVACCKDGFTTLDSVYVQLENLSRADPPYKSVSALNCVILGCANIWDINRAYETFVAIKEKFELTPDIHSYNALLCAFGKLKQTGEACNVFQHVLTLGVKPNSTTYSLLVDAHLANKDPKAALAIIDEMVDAGFTPSKDTLRKVRRRCSRESDFDSDEKVQSLAKQFNYRLGGENRREMLYSIEYNPVY

SEQ ID NO: 33385 - protein, 91 aa, Sorghum bicolor
  Clone ID: SORBI-28MAY03-C30862_1.pep
TFMEHSLKLRSVYTDVEDFDGTKDASKEPLVTSYNRKFMGTVDYIWASEGLHTVQVLDTFPKEILKQTIGFPTKKWGSDHIALACELAFTK

SEQ ID NO: 33386 - protein, 149 aa, Sorghum bicolor
  Clone ID: SORBI-28MAY03-C30890_1.pep
HEGSASLLGNLPTQIAATIDAGSDAISEEVEANAEHLTCCDHVTACQAARRNGVRSRLSLDGYNWRKYGQKKVKGSEFPRSYYKCTHPSCPVKRKVETTIDGRIAEIVYSGEHNHLKPGKPCLPRKPLSSTSTEVVVCDMRGTDDTMRE

SEQ ID NO: 33387 - protein, 214 aa, Sorghum bicolor
  Clone ID: SORBI-28MAY03-C309_1.pep
ASAAAWGGIIINSSVELEPGVLTAIADGRCVPGRPAPTVYAIGPVIWFAAAPEHQQPHACVQWLDTQPSASVVFLCFGSNGVLDAAQVREVAAGLERGGHRFLWVLRGAPAGGSRHPTDADLDTALPTGFLTRTRGRGLVWPAWAPQKEILAHPAVGGFVTHCGWNSILESLWFGVPMLPWPLYGEQHLNAFELVREMGVAVHLRIWTTERTWS

SEQ ID NO: 33388 - protein, 139 aa, Sorghum bicolor
  Clone ID: SORBI-28MAY03-C30918_1.pep
APLITPKLEIGNMKDSSNPLSNPAYTRALLIKQQEQLLQQFKLGSLQQLRQEQQLYIKGPALFENDDPPPVGPLGTRCQLCKLDIAFRPQGDAGRDANAPPVVAVLACHHVFHSRCIESVYGLAEPAQCLACLEPGAAH

SEQ ID NO: 33389 - protein, 112 aa, Sorghum bicolor
  unsure (1)..(112): unsure at all Xaa locations
  Clone ID: SORBI-28MAY03-C33521_1.pep
MERQRLFATAEXGGRALYRLHAVTVFLGICLLLGYRATHVPAAGPGRAAWLGMLAAELWFAFYWVITQSVRWCPIRRRAFVDRLAARFGDRLPCVDIFVCTADPQSEPPSLG

SEQ ID NO: 33390 - protein, 224 aa, Sorghum bicolor
  unsure (1)..(224): unsure at all Xaa locations
  Clone ID: SORBI-28MAY03-C33526_1.pep
TRACRVDTAMQVYHDMLASAPFSPSAVTYRHLTKGLVAAGRIRDALDLLREMLSRNAGADSLVYNNLIAGYIDLGDWDKAFELFNELAERCLVYDGVVHTTFMEGYWRQGKDKEAMDNYQSLLDRGFKMTPATCNVLLETLFKHGKHKEANDLWETMIDNHTPPSFIGINAESYNVMVNQCFREGKFKEAIEVFHRQPRKNVQMDVGCFNNIIGKLCENGMLXE

SEQ ID NO: 33391 - protein, 188 aa, Sorghum bicolor
  Clone ID: SORBI-28MAY03-C33528_1.pep
MRGTMPATDSSSPAAAPLSSIGRSIAWSLRRDQNQIHSFPPPPPDDATDAFQRRAAHLLNNLLAPPAADDVLSLAWTRRLVDAFLLCLEEFRALLFGSGDAPAARPPLDRLVADFFDRAVKALDLCNAVRDGLDLVRQWRKHLAIAAAVLSSSSSPPPLGEAQIRRARKALTDLTILMLDDRDGGGVV

SEQ ID NO: 33392 - protein, 71 aa, Sorghum bicolor
  Clone ID: SORBI-28MAY03-C30946_1.pep
KGSKGFMYELLAGSLRSEDLRTEELLDGLFFSPLGCVWMQPWPGAPAGVGNFPVPLSKHALIFLRHANILT

SEQ ID NO: 33393 - protein, 149 aa, Sorghum bicolor
  Clone ID: SORBI-28MAY03-C30967_1.pep
KFLEKAELNHPEGTKETDVQNSNGATQCITVVVPRGYHGGAVSKSSRPSGLIKRWRSGGCCDCGGWDLGCPIRVLNGDGCGSLPEGESQDSRSVELSIKGAKNETMLKLVNITEDLYILYFNSSISPLQCFSTGIAIVHSQAPQLCPKL

SEQ ID NO: 33394 - protein, 244 aa, Sorghum bicolor
  Clone ID: SORBI-28MAY03-C30985_1.pep
QLQSSSNSLLEQSARLNSNFSAPSYSDNNQFYQPATIHGYQLTSYLKQMNASRNPYSSMPLDPQRLPKSSVSAVPTYVDSLMNARNHNLLASLGATPSQIPATSRVGSMMPERSYYDPSTVDGNENSGSPAYSKKYHSSPDMSGIIAASRAALLNEAKLGGAIGPQSYLSRLASERSQYANSAARPAAPLAFDELSPPKLQSDIFSAQSSMSPSARSLWAKQPFEQLFGMSSAELSKGDFNLSG

SEQ ID NO: 33395 - protein, 93 aa, Sorghum bicolor
  Clone ID: SORBI-28MAY03-C30988_1.pep
SETELVCAHSRDSTLLADLGSLITYNYCAEWTTTHESEVKDSLIVTLYQYVNQTKRFFSCWSVLAHFSDDFGSQITFMAFNILFMLDCSCTFL

SEQ ID NO: 33396 - protein, 178 aa, Sorghum bicolor
  Clone ID: SORBI-28MAY03-C30992_1.pep
TRPRRGAQRGVRSGRAGPPPARASAPPSPAALPASRASRPRCPAAARAAVASSAPPPLRLATASPPHAAASGGGALGGVRLAGGCGGGGGPGRAPGPMPRRGSAPGAACGPDLRGPGPPAVGLPGVLGSIGSSAMASCTSLHAWPPPAVPPERWSPLKAYHATAKSVLDALLINWNAT

SEQ ID NO: 33397 - protein, 147 aa, Sorghum bicolor
  Clone ID: SORBI-28MAY03-C30996_1.pep
MATAGAFHAGGRLLLPLRRSPRGPSPSPWSHVRTHLISSKPPPSAPLPPPVPPARPSPVGSAFGSLSRKTGALGAGAGAGAGVVGWYLGVLDARPVLTKSVTAAAIFTVADLSSQMLSLGPEDSFDYLRTMRMASYGFLISGPTLHL

SEQ ID NO: 33398 - protein, 139 aa, Sorghum bicolor
  Clone ID: SORBI-28MAY03-C31020_1.pep
MQGEMVVPVASPSSAAPAPSAGRLHPTYKEMIMQALTELRDPGGSSRSAIANYIADHFSGLHSRHDALLSVHLRSLRSHGQLRLVSGNYFVSAATQQPAPGQKRGRGRPRKNPDLAPSASVPAYQGPKRGRGRPRKDAQ

SEQ ID NO: 33399 - protein, 132 aa, Sorghum bicolor
  unsure (1)..(132): unsure at all Xaa locations
  Clone ID: SORBI-28MAY03-C30793_1.pep
TASEIRXPMFSACRWHAKQMWELNANGNLVSSYSGLCAKVESRDEGGTSGGRAWVATGSKGEIYLAFFNLDSVSRKMTVQISDLGKVLRRTFLKKELCSCTEVWSGKNFGPVKEEISAVVNSHGSMVFEITC

SEQ ID NO: 33400 - protein, 179 aa, Sorghum bicolor
  Clone ID: SORBI-28MAY03-C30805_1.pep
RSPARERDRDRDRDRDRDRKPERHHRDRDYDRDRDYDRDYGRGRERDRDRDRERDRNRDRDRDRHRLRDDDYNRDRDRDRERDGRERERRDRDRGRHRSRSRSRDRRDRDREDGEYRRRRGRGSASPRGRGEDGGPREEPKRKKEKKEKKGEGNAPDPNDPEIIEMNKLRASLGLKPLK

SEQ ID NO: 33401 - protein, 132 aa, Sorghum bicolor
  Clone ID: SORBI-28MAY03-C30818_1.pep
PFYTLMVVAPNADITKRTVESSAPYVALGLLGACLPAPSSTPGTRRAMFASKYWLPELPGIVRMFASEMTVASAWIHLLAVDLFAARQVYHDGLKNNIETRHSVSLCLLFCPVGILAHVVTKVLTGAVGRSH

SEQ ID NO: 33402 - protein, 131 aa, Sorghum bicolor
  Clone ID: SORBI-28MAY03-C30829_1.pep
MARSVSYVSAAKLVSMARGNPRLAIIDVRDEERSYQAHIAGSHHFASGSFEARMPELARAASGKDTLVFHCALSQVRGPTCARMFSDYLSETKEDSGIKNIMVLELGFNGWEGSGQPVCRCTDAPCKGTCC

SEQ ID NO: 33403 - protein, 113 aa, Sorghum bicolor
  Clone ID: SORBI-28MAY03-C31141_1.pep
MSGAALCAALTELGVDGEDPLDADALEWPFQYEEARPLLAWICSCLRPSNVLSPSHLAQYEQLVEEGRLLEGEDLDSAFDSISAFSSKKDNQEAVFGLEETILDIREAKLAYR

SEQ ID NO: 33404 - protein, 255 aa, Sorghum bicolor
  Clone ID: SORBI-28MAY03-C31156_1.pep
HEEREEELLAYWWREYAECSAGPRGSLVESDDSAYLYKVEEERVGVPVKGGLYEVDLMRRHCFPVYWNGENRRVLRGHWFARKGGVDWIPLREDVSEQLELAYNCQVWHRRKFQPSGLFAARVDLQGSTPDLHALFTGEDDTWEAWLVFDTGPKLGSNTIKLRRGFSPSESASTNPSQDELRQTKEEEMDDYCSQVPVGHLVFMVHGIGQRLEKANLVDDVVDFRRVTANLAERYLTSYQRSTQRVLFIPCQWRK

SEQ ID NO: 33405 - protein, 140 aa, Sorghum bicolor
  Clone ID: SORBI-28MAY03-C31184_1.pep
MESEIMAPYETKQNCEIRVFESSDEMATDLAEFISQASEISVKERGYFAIALSGGPLVRHMRKLCEAPYNKTLDWSKWYIFWAEERAVAKNHAESNYKLAKEEFISKVPIPNGHVYSINDNATVEEAATDYEFVIRQLVK

SEQ ID NO: 33406 - protein, 76 aa, Sorghum bicolor
  Clone ID: SORBI-28MAY03-C31212_1.pep
TRLLSHFTTLCCDRSANEDYIKLTLFSSTSCLNILATQLFRRDRSDWERMYSFRHSLEFIHHLTYEVLKDAILSLV

SEQ ID NO: 33407 - protein, 145 aa, Sorghum bicolor
  Clone ID: SORBI-28MAY03-C31256_1.pep
SQTKKICSGQLSTTLTGEAGAPPDPDADGFGLQPHDKQKGHTSCSFFDKTTSCSCSSWSRNQGEHTGGSGSGLPPRLGIYRAQSPHGTAARPGRERALPLLDLISRPLPPAPFELFDHMSARLFFFSVVTTSPTISYTCSQMPLV

SEQ ID NO: 33408 - protein, 231 aa, Sorghum bicolor
  Clone ID: SORBI-28MAY03-C31278_1.pep
LEARVPPRPPAFPHPVYDAAPSCIPPALAPPEGDMVARAFTFTRHDVAAIKGSLPTRRRGSAATTFEVLTAALWRAHTAALELPAHEEVRLAFAVGFRGVRELGLPAGYYGNVVLPSAMVTTAGELQASSLGDTVEMVREAKAAAVTAEYVRSTIDLLVLRGRPSMLAPANLLVVSDHRHLGLHRLDLGWGVPVYGGIATVFSGAMFLVAVRDGDGEEDAVAVPIMLPRPD

SEQ ID NO: 33409 - protein, 142 aa, Sorghum bicolor
  Clone ID: SORBI-28MAY03-C31284_1.pep
SSRMRGEAAAVVAVPPSALPVIRPAVPRHPATVAPPPPELQLLPASSAAASSSAPPLTSTSLSTTTTASQKQEERPHAAATTTKLQLSIGPIVTATGADAAAVVGEDEEDSEAEELRRAMEEKAAADAARERARGEAAAAER

SEQ ID NO: 33410 - protein, 69 aa, Sorghum bicolor
  Clone ID: SORBI-28MAY03-C30923_1.pep
NAIPSQNTTAWPTCKAMTKLQATQLWVIFAKKNGIYSVVYMNFLRPRSPPNLAMKDVVLEQVVQLDHPA

SEQ ID NO: 33411 - protein, 44 aa, Sorghum bicolor
  Clone ID: SORBI-28MAY03-C30928_1.pep
YYYSDCVISSSMITDRINEMGGRLGGACICVSRQQCSAGGILSN

SEQ ID NO: 33412 - protein, 190 aa, Sorghum bicolor
  Clone ID: SORBI-28MAY03-C30936_1.pep
FVIEDIDCSVDLQQRAEEGQDGGTKSSPPPSEDKVTLSGLLNFVDGLWSTSGEERIIIFTTNYKERLDPALLRPGRMDMHIHMGYCCPESFRILASDYHSITDHDTYPEIEALIKEAMVTPAEVAEVLMRNDDTDIALQGLIRFLKGKKGDAKNSQGENVEHVTKEEEKEMMPTKKDDPVDQNLNDAGKQ

SEQ ID NO: 33413 - protein, 138 aa, Sorghum bicolor
  unsure (1)..(138): unsure at all Xaa locations
  Clone ID: SORBI-28MAY03-C30940_1.pep
PDLQNALNWACGPGNVDCSAIQPSQPCYQPDTLASHASYAFNSYYQQNGANVVACDFSGAGIRTTKDPSYDTCVYLAAGNXDEHNEFDISSSSEQLWSSSMRQILHHFPPHAGPRDGCSYAVIYGNAPASLCRCGDER

SEQ ID NO: 33414 - protein, 55 aa, Sorghum bicolor
  Clone ID: SORBI-28MAY03-C3136_1.pep
RSSIGGPFFINSHRHLSASVWTSTIAVQLHIKNSERFTTIDQKGIVLRLSKHYVP

SEQ ID NO: 33415 - protein, 200 aa, Sorghum bicolor
  Clone ID: SORBI-28MAY03-C31382_1.pep
MAASGFGGSEAFRLSAAPGAGTLKLHKGDITLWSVDGATDAIVNAANERMLGGGGVDGAIHRAAGPELVQACRKVPEVKPGVRCPTGEARITPAFELPVSRVIHTVGPIYDMDKHPEVSLKKAYENSLKLAKDNGIQYIAFPAISCGVFRYPPKEASKVAVSTAQQFSEDIKEVHFVLFSDDLYNIWHETAQELLSQFQK

SEQ ID NO: 33416 - protein, 131 aa, Sorghum bicolor
  Clone ID: SORBI-28MAY03-C31385_1.pep
PFPESALNEQAGKMLLENYEEYARHARLYTGIHAIKPKNKSKSGVISESTTALNVGQSNTVLGENTPLASAAISTSAAAKALGKNSLDQNAATSDPVVGASAAPKKDAPHAVKVPVDKKKMDARKKSLKGL

SEQ ID NO: 33417 - protein, 69 aa, Sorghum bicolor
  Clone ID: SORBI-28MAY03-C31388_1.pep
RKEKKESEHADGPVQLSKFLGRDKEKEEGPQRSAISGKKIMIKLEKTKEDKAAESKRNELLKFLNASYD

SEQ ID NO: 33418 - protein, 129 aa, Sorghum bicolor
  Clone ID: SORBI-28MAY03-C31413_1.pep
NLSPMAKCQKHVSIQALWLLSMVLLASSVVYARTINGQTKEDINTRSVTMMTRSASSIIGSGEHPLRGTCVETHNGWWLCGKMQFRKISGLRSVLQQALCWEFGLISALLSNGIILEALVNDVTLSSNQ

SEQ ID NO: 33419 - protein, 174 aa, Sorghum bicolor
  Clone ID: SORBI-28MAY03-C31419_1.pep
MAFSAFSWPFRRRGSGGGAGGSGASKSAATAAEEEELGVTPQLLDFLRTLSPDAFKAAALQLQGGSTEAAAGDLTSWQERHAVLVLSKAKELAKIRYDLCPRHMKDKQFWKIYFLLAKSYISPYELRAIQKEKIRRMETENGKSKEVITVEVEMQESKGSSLSRTSERDLESQV

SEQ ID NO: 33420 - protein, 69 aa, Sorghum bicolor
  Clone ID: SORBI-28MAY03-C31430_1.pep
TRLIVNQVLPPSASDCRFCAAKRREEARAFRAILEDHQLGGLKLIQAQLLDMEVKGVPALRFLSDSVWK

SEQ ID NO: 33421 - protein, 192 aa, Sorghum bicolor
  Clone ID: SORBI-28MAY03-C31037_1.pep
HEAGFLENACLVGLIPVVMNFAEPNRPKDVRVQASLFLQQLCQASTLTLQMFVACQGIPVLVSFMEPDYATCRDMVHLAIDGIWQVFKLQHSTPRNDFCRIAAKNGMLPRLVNTLHSLNEATRFASVSGSGASVTQNGSTPRRRSGQLDPSVLESCKARLDHHHSSGSLQSLQADADKHHILMDASSSPRFS

SEQ ID NO: 33422 - protein, 198 aa, Sorghum bicolor
  Clone ID: SORBI-28MAY03-C31022_1.pep
MLHQTLIPSSFSPSVSASSSSPFLHAPNAATTTTTTTAPGGSCTPPAFPRGSSAMPSYAHHHSSSPLDDGKMDVLKCGNSVPPEDDAAAAGALVEKDGLSVEDLLDLEEFGEPDKDGAEHEDDAPALAAAVEEQPKAESQPLSVVTYELPPPPPPPELVDLPSHDVEELEWVSRIMDDSLSELPPQPQPPMAAVVASL

SEQ ID NO: 33423 - protein, 179 aa, Sorghum bicolor
  Clone ID: SORBI-28MAY03-C31051_1.pep
MANRTDPLAKSIHGTNPQNLVEKIVRSKIYQSTYWKEQCFGLTAETLVDKAMELDHTGGTYGGNRKPTPFLCLALKMLQIQPDKDIVVEFIKNEDYKYVRVLGAFYLRLTGTIADVYQYLEPLYNDYRKIRHKLSDGRFPLTHVDEFIDELLTKDYSCDTALPRIQKRWVLEASGTLEP

SEQ ID NO: 33424 - protein, 232 aa, Sorghum bicolor
  unsure (1)..(232): unsure at all Xaa locations
  Clone ID: SORBI-28MAY03-C31511_1.pep
ARGGVAVNYGSSLSSNSKGASRSWERNELPQDHRYSTSEGAISYLNSPDVSFQNHHIMLPMLQDSSVDEYMRVSVAEPIGALLLSEVMSGQQNSGGSTSSRSDGSEYDIVPKSYTSTPRNFPSRRSFLSKPIHPVSFPEHAPEAQETQSPVAIARSNNPLCSEFNGTGELRFPGPMDYGSGSHGESGNWSAASSMDLTDLSERPEAGQAGPLRPNNVMQXTRCDLCEKLLTK

SEQ ID NO: 33425 - protein, 90 aa, Sorghum bicolor
  Clone ID: SORBI-28MAY03-C31543_1.pep
RPQRSDLLLPRYLCRLPKCCCQHRLCPTIAQQPEQPAAGTRRRRRLGALPTAAPPRAAHALSAGAAPRRRSRPPPARFGWDFGGRRKPRA

SEQ ID NO: 33426 - protein, 226 aa, Sorghum bicolor
  unsure (1)..(226): unsure at all Xaa locations
  Clone ID: SORBI-28MAY03-C31553_1.pep
MGRRGSSDRLEALSLEIERKLQKALVSNSQRLQILQQLFADIALKVDDRARDAIMSENDDGIAPVDEREDGWLCFYEILSSHFVRVPESGRRILELIVQLWSQSFASNIFALLFHKWLFEAPLDEKEISLRYSSALVQGATNVFWIDIQTNTRHFLSLYXFSRFMFFYDQDHLLSSFLEHFPTFPNSFLVGGPADYFVIELTDQLQKLKIEPVLLHYLSRMSILQG

SEQ ID NO: 33427 - protein, 234 aa, Sorghum bicolor
  Clone ID: SORBI-28MAY03-C31630_1.pep
MGLRGRGALALLLLLFVHGGGQQAAEAAGGGAFVRVQAPRFVHNGKPFFANGFNAYWLMTLGADPAQRGKVTSALSQAAGAGLSVARTWAFNDGGGSSGALQYSPGRYNENTFQGLDFVLAEARKYGIKMILSLVNNYDSFGGRKQYVQWAREQGQAIGSDDEFFTNPVAKGLHKNHIKAVLTRVNTITGVAYKDDPTIMAWELMNEPRCQSDVSGHTIQSWITEMAAHVKSID

SEQ ID NO: 33428 - protein, 215 aa, Sorghum bicolor
  Clone ID: SORBI-28MAY03-C31635_1.pep
MMHPLRRFLLLLLLLLVGLLPAAVWSLAPPRFPRHQHRSRPGVNGVGDYEYETRYFRQRLDHFSFPGVADEDEAAAFFQQRYLVGRGGGWAGPGGPIFFYCGNEGDIAWFASNSGLVWEAAPRFAALVVFAEHRYYGESMPFGSKAKAYNDSKSLAYLTAEQALADFAVLLTDLKRNLSAEGSPVVLFGGSYGGMLAAWMRLKYPHISVGALSSS

SEQ ID NO: 33429 - protein, 180 aa, Sorghum bicolor
  Clone ID: SORBI-28MAY03-C31695_1.pep
MDAEAGVAGADQLPRRQYYMNLLLLAYQSFGVVYGDLSTSPLYVYKSTFSGKLSQYQDEETVFGVLSLIFWTFTLIPLLKYVTIVLSADDNGEGGPFALYSLLCRHAKLSLLPNQQAADEELSSYYRNGFAPRNGSSPWLKRFLEKHKKMRTVLLLIVLCGASMVIGDGVLTPAISVLSS

SEQ ID NO: 33430 - protein, 89 aa, Sorghum bicolor
  Clone ID: SORBI-28MAY03-C31715_1.pep
MQGGGGVSCAVAGEAPTPGPPHHRHRVGAGGRLGLTIDPAGGDDGEAPAERIGRLVRESPVVIFARRGCCMCHVMRQLLAAVGAHATVI

SEQ ID NO: 33431 - protein, 203 aa, Sorghum bicolor
  Clone ID: SORBI-28MAY03-C31348_1.pep
MAAARAALRLQRQSLAANPFLFSGHGLRYRKLEVILTTTIDKLGKTGDVVKVAPGHFRNHLMPKMLAVPNLDKFAILVREQRKLYQREEEVVVKQVTKEDDDARLQEERLKQYQAAAKRLDNALLVLRRFISTGNELRTPVTKDEIVSEVARQLNITIHPENLHLQSPLASLGEFELPLRLPQDIPRPEGKLQWTLKVKIRRK

SEQ ID NO: 33432 - protein, 150 aa, Sorghum bicolor
  Clone ID: SORBI-28MAY03-C31344_1.pep
SAGVTLLYLIIGRTPFGGDPEQNIKEIAKLKGSEELWEVAKLHSCESSYPSDLFDVKFPLCPVNLREWCAANTRRPDLLEMIPTSFFNLVDKCLAVNPRCRLSSEDALRHEFFAPCHDSFRKPRMLRRSAGSDAACSSSHQNTALTAKQS

SEQ ID NO: 33433 - protein, 105 aa, Sorghum bicolor
  Clone ID: SORBI-28MAY03-C31358_1.pep
MRVTSYQRLSSERPEGGAAARAAWAWASLRRAAAGVARLYAARRRRSCMRRLWVARPLRAKAATRYEYDSASYARNFDDGAWMADEGVSWNARSFGACRVAAVES

SEQ ID NO: 33434 - protein, 104 aa, Sorghum bicolor
  Clone ID: SORBI-28MAY03-C31941_1.pep
FLFSHTAAPRVSYPLPSSRPPPPGPPPGGARRPAPPRRLRLLHYQQSQLPHRSLLGSPGRCLRTYEPGADVDLSVVQPAGGGGRPVTKKGRSLIVLRLLPFVGC

SEQ ID NO: 33435 - protein, 180 aa, Sorghum bicolor
  Clone ID: SORBI-28MAY03-C32008_1.pep
MLPHRHSPAPSLSASSLSWSAAIAVSRIPPARGLALHPSVPPPASGNRQSPVVCAAWTRRSRGEAEQRPNRKSWKQRTDMYMRPFLLNVFFSKRFVHAKVMHRGTSKVIAVATTNAKDLRLTLPSLVDDNACRTIGRLIAERSMDADVFALAYEPKKNERIEGKLGIVIDTIKEHGIIFV

SEQ ID NO: 33436 - protein, 186 aa, Sorghum bicolor
  Clone ID: SORBI-28MAY03-C32009_1.pep
MAITETAARKLLHGGAAGTIAQGVADLGGISFGLWEMVTSFFADIIAYLFAALAGAAHLLVLPLEVLWQSLVTVVTTAAGAVASGLDGLCHYVTGFFAQIFAAIAGAAHLLVLPLETLWQWLATSATDAAGSIASGIDGLWQHVTGFLAHIFAAIAGAAHQFVLPLETLWQWLATSMTDAAGAISS

SEQ ID NO: 33437 - protein, 267 aa, Sorghum bicolor
  Clone ID: SORBI-28MAY03-C32027_1.pep
ARGPEVARGQEQGPAADVWALGCMVIEMATGRAPWSDMDDLLAAIHRIGYTDAVPEVPAWLSAEAKDFLAGCFKRHASARSTAAQLVAHPFVASSSAAARDLQDAQPAKQQALFPSPKSTLHDAFWDSDTEDDDGADEMSTGAAERIGALACAASALPDWDSEEGWIDLQDDDRSGTVDAPPAATADVADYFVWAEPSDAAELEHQFVAAGAADVSVHLHRLPSRIAGAVVAGATTISQGSYLPTHLGVHDDGIGKVESHRALTETE

SEQ ID NO: 33438 - protein, 112 aa, Sorghum bicolor
  Clone ID: SORBI-28MAY03-C3203_1.pep
RPRNSCNASHLRSEAVSAGVWRVHASRDSELQGSSASSPFDRQQGEGRGPAPPFPASSVGNRQAQAQAQASSGSRENPSRVIRVVPHTARTASESAARILQSIQMERKQNDP

SEQ ID NO: 33439 - protein, 239 aa, Sorghum bicolor
  Clone ID: SORBI-28MAY03-C32052_1.pep
ARGKRIESKEKAILEFYQQFACVGGDLVFSESLCEELQKKFFQQKCELGRVGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLAQVFDQTNPLTQTVHGRKVSCLGPGGLTGRTASFRSRDIHPSHYGRICPIDTSEGINVGLTGSLAIHAR

SEQ ID NO: 33440 - protein, 124 aa, Sorghum bicolor
  Clone ID: SORBI-28MAY03-C32083_1.pep
EVPLTANWSYSSAFVYFVVANAMVCLFSAAALAACRSRAAMVPVMVGDLLALALLYSAVGAAAEFGILGERGNSHVRWAKVCNVYGRFCDRAMAAVIVSLIGAFANLVLLMLNILTIHKSSSYY

SEQ ID NO: 33441 - protein, 194 aa, Sorghum bicolor
  Clone ID: SORBI-28MAY03-C31432_1.pep
MLEAKPPSPGSGAAGAAAAHIHSHRRWAAPLLASVLLSSLLISASLFFSSSRALLLSFSPLPSAASAEPLFVEAKLRQQMRAEERPARGAVPRIAYLISGSAGDGAALRRTLRALYHPANTYVVHLDLEAPAAERAELAAAVRADTVYARFRNVKVVTRANLVTYRGPTMVANTLHAAAILLREGGDWDWFINL

SEQ ID NO: 33442 - protein, 181 aa, Sorghum bicolor
  Clone ID: SORBI-28MAY03-C3148_1.pep
ARGLNPVFLQVLQAMVQMGVLVPTSAHASAHASAQFFLNSFEERLAAQRKEREMATAELGFKKQLTKEEKFEKRKQRLAAIGEDLLAIAADQPFRFPATFTFVVRAFSVLDGIGKGLDPRFDITEIAKPYAKELLRFNEAGVEVVVKDAKKRWERQSRAFYNLFRQPDRVEKLAQIIERLE

SEQ ID NO: 33443 - protein, 112 aa, Sorghum bicolor
  Clone ID: SORBI-28MAY03-C31510_1.pep
LGTVTELVCHMGNCVQSSGGGVSSCAVAVEAGRQQQQLLLQRRKSAAGDEEEEVIIDQGAAAPSSVMKVKMVLTKGELGWLVAQLKAGDRRLEDVLQEMARKRDGRRSAEAD

SEQ ID NO: 33444 - protein, 87 aa, Sorghum bicolor
  Clone ID: SORBI-28MAY03-C32167_1.pep
AHSRGRPTIVNPAIELPGIEDTVVLFPRMHACLYVPHRHECSNKPQYVVARYPFPSVFHPSTHTQELYIYSHTQTDTQVNRCSRLNY

SEQ ID NO: 33445 - protein, 46 aa, Sorghum bicolor
  Clone ID: SORBI-28MAY03-C32189_1.pep
YFHPDAGGMLLITNEWRALLLVYILYQSELSASILINYGLYLLLYR

SEQ ID NO: 33446 - protein, 56 aa, Sorghum bicolor
  Clone ID: SORBI-28MAY03-C32198_1.pep
TLTLTTSNYQRQSAVGAVVLLCQSTTRICRVVVFPISVMANGIVDCYYGKKKKKKK

SEQ ID NO: 33447 - protein, 97 aa, Sorghum bicolor
  Clone ID: SORBI-28MAY03-C32205_1.pep
MKVRASVKRLCGFCKVVKRRGIVFIHCTANPKHKQRQGFSTIAEAAAACVHLPPPPPASGSASAAAFAEASKVARQEMSMKFNWPLGLAALLKNGEK

SEQ ID NO: 33448 - protein, 61 aa, Sorghum bicolor
  Clone ID: SORBI-28MAY03-C32202_1.pep
IHLTHAVRTQCAMNVTSALLPSPFSIEYRYPKRITEDSKSDMTKISPPLPACLEMEGTPHI

SEQ ID NO: 33449 - protein, 150 aa, Sorghum bicolor
  Clone ID: SORBI-28MAY03-C32248_1.pep
ASMVHPATGYSVVRSLSEAPRYASVISDILNNRVPAEYLLGNSQNYSPSMLAWRTLWPQERKRQRSFFLFGLALIIQLNNEGIQTFFEAFFRVPKWMWRGFLGSTLSSVDLILFSFYMFAIAPNQLRMNLVRHLLSDPTGSTMIKTYLPL

SEQ ID NO: 33450 - protein, 145 aa, Sorghum bicolor
  Clone ID: SORBI-28MAY03-C32278_1.pep
MVATAAATPAAMAAPLPRVAAPESSAAAGPSAGPSAAGVAAAAAGEGTNSSSVDEEEGGVVEAVVGAAAGPDFLDDDDDGDGACAAAAGVGVEATAAAAGALAGAGVFLAAAASGALAGALAVAAFGDAAGASAAALRAATTARM

SEQ ID NO: 33451 - protein, 213 aa, Sorghum bicolor
  unsure (1)..(213): unsure at all Xaa locations
  Clone ID: SORBI-28MAY03-C31726_1.pep
MLRALNPSPSPTPLRARPACRASPRRRPRGAWARPRASAQPPVPPPAGDRLCAPSRGAAAQLAAPDVSAAAPGARGELEAFLEVVPARMRRGLALHQEVRHLVEVVMDLGRRPIARFPSGDWVISDQVVTADXYLLQAVAKVGDFSEDNRSGINHSLHRISAIRNRKAQILGLTCRVGRAISGSAEMIRDLVVGGGSILVIGPPGVGKTTLIR

SEQ ID NO: 33452 - protein, 117 aa, Sorghum bicolor
  Clone ID: SORBI-28MAY03-C31767_1.pep
TIAAQSSRLASPRVPSTLASSSAPTSAAPAASSWGSADCSISPSAPSPSSPAFITSSSSSTLSLPSRSASARASMSRASASDLSSPSDASRPRSSGAVTSPSLSESNAWNASTRLLM

SEQ ID NO: 33453 - protein, 160 aa, Sorghum bicolor
  Clone ID: SORBI-28MAY03-C31780_1.pep
QFRLPRTKARGVNGISVRVKYCDTCMLYRPPRCSHCSICNNCVERFDHHCPWVGQCIGLRNYRFFYMFVFSTTLLCLYVFAFCWVYVIKIRDAEQLSLWKALLKTPASIVLIIYCFLCVWFVGGLSVFHLYLMSTNQTTYENFRYRYDRRDNPYNRGILD

SEQ ID NO: 33454 - protein, 179 aa, Sorghum bicolor
  Clone ID: SORBI-28MAY03-C31940_1.pep
MASASNALRVFFILAILCAVCTAKRTGAKTGDSAADSAASGASGTFDISKLGATGDGKTDSTKAVQDAWTSACRATGSATVLIPKGDYLVGPLNFVGPCKGAITIQLDGNLLGSNDLAKYKASWIELSHVDNIVMTGSGTLDGQGTAVYKKAKTGTVKAMPNTLVLFYVTNGTVSGIKL

SEQ ID NO: 33455 - protein, 166 aa, Sorghum bicolor
  Clone ID: SORBI-28MAY03-C32355_1.pep
MTQQSMVALVAAGVLLLAGVASAEKAGGFVVTGRVYCDPCRAGFETNVSKSVAGATVEVVCRHFEASKETLKAEATTDDFGWYKLEIDQDHQEEICEVVLKKSPDPACAEIEEQRARARVPLTSNNGIKQKGTRYANPIAFFRKDPLKECGAILQKYDLKDASDTP

SEQ ID NO: 33456 - protein, 170 aa, Sorghum bicolor
  Clone ID: SORBI-28MAY03-C32361_1.pep
AANIMQNLIAGANQFQQQFQNPNFSDAGANQFPPQFQNQNFSGPGANQFQQQFQNPNFGGFPNQTPMPFPQFMPQTGTPANPMPFGGRPPVNSPFGPVPMGQGNFGQPPNSQGFTNLAAPPRGDGEQDSPPQFSSRQFHQGSPSFGRGRTQQRGGRHSSGRGGRGGRHRR

SEQ ID NO: 33457 - protein, 166 aa, Sorghum bicolor
  Clone ID: SORBI-28MAY03-C32409_1.pep
MLRQRLICAIDSELEAISEQVEKEKLERCRKTLLGYLQRICALGPSHVGPNFLLLPDFESKCGVTASPNGKEDILVSSKCHVSEILGFARAPDAETKNATESETETSTYSLDSEALRNSIVSGFQFATNAGPICDEPMRGVAFIVEAHLLSNNSDVAIPSDDNIFT

SEQ ID NO: 33458 - protein, 129 aa, Sorghum bicolor
  Clone ID: SORBI-28MAY03-C32445_1.pep
MDAANSVTPGAVSHILAHPSTGSDGAVPDLVVQVLDLKSIGTGSRFSFMATDGKDKIKAMFPTSFASEVRSGNLKNLGLIRILDYTCNAVNGNNGKVLIVIKCELVCQALDAEINGEAKKEEPPIVLKP

SEQ ID NO: 33459 - protein, 53 aa, Sorghum bicolor
  Clone ID: SORBI-28MAY03-C32453_1.pep
LMFSMLAIFYSYLTQLQVYTCIMILSIWLSDPLFYTKTFYSKKIGYLAGSIKG

SEQ ID NO: 33460 - protein, 59 aa, Sorghum bicolor
  Clone ID: SORBI-28MAY03-C3250_1.pep
LNSLVANIPATISSTSPLLLLNTSLLVEMTPRGRVCLLLWYGPHARTLHLCKECIHRPW

SEQ ID NO: 33461 - protein, 162 aa, Sorghum bicolor
  Clone ID: SORBI-28MAY03-C32557_1.pep
ARGVAVLAGDFMFAQSSWFLANLENIEVIKLISQVIKDFASGEIKQASTLFDCDVTLDDYLLKSYYKTASLIAASTRSAAIFSGMDTTICEQMYEYGRNLGLSFQVVDDILDFTQSAEQLGKPAGSDLAKGNLTAPVIFALQDEPRLREIIDSEFSEPGSLA

SEQ ID NO: 33462 - protein, 85 aa, Sorghum bicolor
  Clone ID: SORBI-28MAY03-C32144_1.pep
CRGDTVAINNSLERYQDIDPTFSGTREYKLLADLAASMDEGDVDKFTDAVKEFDSMTRLDPWKTSLLLKAKNELKKKDEDEDDLT

SEQ ID NO: 33463 - protein, 162 aa, Sorghum bicolor
  unsure (1)..(162): unsure at all Xaa locations
  Clone ID: SORBI-28MAY03-C32139_1.pep
GQEKPVFFSLNAIISHIKPDQNMWYRACKTCNKKVTEAFGSGYWCEGCQKNDSECSLRYIMVLKISDPTGEAWVSVFNEHAEKIIGCSADELDRIRKEEGDDSYILKLKEATWVPHLFRVSVTQHEYMNEKRQRITVRSEAPVEXAAESKYLLEEIAKLTAC

SEQ ID NO: 33464 - protein, 54 aa, Sorghum bicolor
  Clone ID: SORBI-28MAY03-C32147_1.pep
SFNSIPSDRINKNTTWHYSPQLLALMIRTWHCSPQYFFLQVLVCEFMRVHLSSF

SEQ ID NO: 33465 - protein, 157 aa, Sorghum bicolor
  Clone ID: SORBI-28MAY03-C32660_1.pep
HHGLALLLVVALALADAAAGRFVVEKNSIQVTSPDELKGKYECAIGNFGVPQYGGTLHGWVEYPKSNRKACQSFDQFDISFKPKQAGGRPTFVLVDRGECFFTTNAWNAQNAGAAAVLVVDDKSEPLITMDNPEEGKEHLENITIPSVLITKKLGES

SEQ ID NO: 33466 - protein, 284 aa, Sorghum bicolor
  Clone ID: SORBI-28MAY03-C32668_1.pep
HEDEAEVLPPVPKIEIQLEPHHQTLPVGTISAIMGERVIVEGSVQHNPLNEGSILWITESRTPLGIVDELFGPVKNPYYLVRYNSEEEVPAGISAGTNVSFVADFADHILNMKELYAKGYDESDPVGNEEEEDLPDFSDDEKEAEYKRSLRQAKRRTDRQHEPMKTSGDRKRSQSRGSGIRKPMPPRNLDTSAPGHQPRPHFRRSDMARAGAENTAHSLGPQNAPMIAPTMLPAGTMNPAMPSPVPLANQMGGCFMNPAQQQFLPQQPNMVWPGGFPQPPHPNM

SEQ ID NO: 33467 - protein, 83 aa, Sorghum bicolor
  unsure (1)..(83): unsure at all Xaa locations
  Clone ID: SORBI-28MAY03-C32703_1.pep
VADVGMVELLLQYGASVNMNDXRGRTPLHHCILKGRHQHAKLLLSRGADSQAMDRDGRTALQYAIDSGTSDEDILALLEDHSR

SEQ ID NO: 33468 - protein, 140 aa, Sorghum bicolor
  Clone ID: SORBI-28MAY03-C32729_1.pep
RRALSSPPAWSSGLRPLRPSPVLASLCFPWRSSCQGWSSGFPSLQWMRFVLAAPWPGALSPAPCGAGSHDGCLRPRALQVLRLRTCQVFRCSCVPGGAARRLGFCNFALLLCLRPFLTVGSPSGVRPWRYSAGFNEGCIS

SEQ ID NO: 33469 - protein, 178 aa, Sorghum bicolor
  Clone ID: SORBI-28MAY03-C3274_1.pep
MHEFRLEGKLPQPSPRSAKDEWAVCKVFNKELAARTEPMAAAVAGAELERVGSLGFLNELLDSAELPALIGADVDEVIDFKGPASTSGLHAGAPGTSYLPVKMEEHALLQQMQYQQQPPPMFYSSQYFSLPAMNSGDLPPAIRRYCKAEQQVVSSGQTASVVSPSRETGLSTDRNAAG

SEQ ID NO: 33470 - protein, 109 aa, Sorghum bicolor
  unsure (1)..(109): unsure at all Xaa locations
  Clone ID: SORBI-28MAY03-C32787_1.pep
XSPQPVMTGKFSPVVYVQPVPQEAMHGTPLGFQGWPRPVLLNSYQPSMQKFQGNTPVYLXPSSHGNWEPAIGGTKPCTTCAAVPGHSSHHGPCCKQHGPRKIHVNLSYQ

SEQ ID NO: 33471 - protein, 123 aa, Sorghum bicolor
  Clone ID: SORBI-28MAY03-C32797_1.pep
GRAMSFVCKKDDLDSPKLLGYPSKPIGLFIRRSIIFRSDSNGEDLEGYAGAGLYDSVPMDEEDEVVLDYTTDPLIVDRGFRNSILSSVARAGHAIEELYGSPQDVEGVVKDGKIYVVQTRPQM

SEQ ID NO: 33472 - protein, 180 aa, Sorghum bicolor
  Clone ID: SORBI-28MAY03-C34807_1.pep
KLRAAILADFGSYTDPREITFSTLKSCTYLQHCLSETLRLWTVVPGNSRRANTLTTLPKGGGPDGEGPVVIPAHAEVNYSIHVMHRRKDLWGPDADEFKPERFVGRRPGWEFLPFNGGPRICIGQQFALTEASYVVVRLLQRFDAMEPAKGQLDDVVRSKLALTSCPAKNVTLRFREAKE

SEQ ID NO: 33473 - protein, 108 aa, Sorghum bicolor
  Clone ID: SORBI-28MAY03-C34810_1.pep
QSCMFLLDSLDAAGIDADSAGKIEKFLIQPRIEDSVLGRGKVDKPIAWRSAFAGAGFAPVPPSSLAEAQADCLLKRVQVRGFHVEKCGVGLTLYWQRGELVTVSAWRC

SEQ ID NO: 33474 - protein, 126 aa, Sorghum bicolor
  Clone ID: SORBI-28MAY03-C34814_1.pep
SLEEVSSSIPDDQLRMIDNINSLMSELAVEREELLRALRIESSNCSKLKDLNKDLTQKLEIQTHRLELLTSQRMANENALAKPIDTRSINDAAIYADEGDEVVERVLGWIMKLFPGGPKRRTSKLL

SEQ ID NO: 33475 - protein, 131 aa, Sorghum bicolor
  Clone ID: SORBI-28MAY03-C32823_1.pep
TGKMAFNLEGPENERSLSLHFLSAMKEDRLIDIIDDHIKSDNDTWLLEEVAELAQECLEMSGDRRPAMRDVAEKLDRLCKVMQQPWVPAQHDPEEMESLLGQSSVASLEIVSTGNFSMEKRILQWLLESGR

SEQ ID NO: 33476 - protein, 155 aa, Sorghum bicolor
  unsure (1)..(155): unsure at all Xaa locations
  Clone ID: SORBI-28MAY03-C32836_1.pep
ESPGNMSILEQNYSKVKFIVRLKXRNGRVKHLYEDLYIDGNDIKFDSAPSVSIEVNQSLVPKVQFNLELSEKERSDRANVVLPFEHQGNGEPIRIYDGRRSLPEAQRDPNLTAPALVDEMKAPKSGTAKGEIHYFRDSDDEQPDSDEDPDDDLDI

SEQ ID NO: 33477 - protein, 152 aa, Sorghum bicolor
  Clone ID: SORBI-28MAY03-C32842_1.pep
MIVASAVPDFLMGIITGAGIQGVMMLNGGFFRLPNDLPKPVWRYPMYYVAFHKYANQGLYKNEFLGLTFPNNQAGGAATVSGGQILTDFWQVEMGYSKWVDLGILCGMVVLYRVLFLAIVKLTEKVKPMIKGFRFRNTAPSVHVAEKGSGTP

SEQ ID NO: 33478 - protein, 145 aa, Sorghum bicolor
  Clone ID: SORBI-28MAY03-C32862_1.pep
CAGLETVLQSSRKCLCVLVKDRDDPNLGLKINVTKALRLPAVCNAPANISDCPRLLNLPPGSKDAQVFEQFARQAAAQGTAPSGGGSAAKASASPQKSGAAAGHAQRWLGVGSSRVGGGRGDGGARAVAVALALFAAGPLAFLLG

SEQ ID NO: 33479 - protein, 135 aa, Sorghum bicolor
  Clone ID: SORBI-28MAY03-C32849_1.pep
MVALPPSRKAMPNKRAFGTDLTNMDNKRGKLDTSAENKVKLMQGAGNIVKTFERQLGQGKRSDFVYGPFHPASAKKQETDDQTVKQQERKTIQDWENLAVSFRPQYQNQALNDLFGHYVEAWKSWYLDLTRETRS

SEQ ID NO: 33480 - protein, 77 aa, Sorghum bicolor
  Clone ID: SORBI-28MAY03-C32879_1.pep
NLTFFFVNKRNLTVGKHTDWITSIFQKEKTTLLLSATAMNILYIARYCGKHQSSFVGSFLLKRTNGLTRSGYSTRSG

SEQ ID NO: 33481 - protein, 157 aa, Sorghum bicolor
  Clone ID: SORBI-28MAY03-C33013_1.pep
MGKLLCDPSAAAVAEALPPSPAPAPPPPLLAWSAPSPVPSPEPSTSPTGWDAVWALEDQQRRRLHRIWERGVAWKPSSPGAGEALAAAAAPAPAPAVVFRLDHGGEVDADGNCLFTAARTAAAAKADARELRHRAVRRFAEVYAAAGEDDKAAVDAA

SEQ ID NO: 33482 - protein, 149 aa, Sorghum bicolor
  Clone ID: SORBI-28MAY03-C32579_1.pep
MASLSDIGVAAGFNVLTAVAFLLAFAFLRLQPINDRVYFPKWYLRGMRDNPIVSGAAVQKFVNLDGRSYLKFLNWMPAALKMPQDELINHAGLDSVVYLRIYITGLKIFVPITVLAFLVLVPVNWTSDTLGHNNVVYSPIDKLSISNVP

SEQ ID NO: 33483 - protein, 59 aa, Sorghum bicolor
  Clone ID: SORBI-28MAY03-C32580_1.pep
FEIEVLSSFFNSMYYAHEFLEYIKKITTFCISSILAGGDTRTLVTNTFSIFLAIIGLHI

SEQ ID NO: 33484 - protein, 96 aa, Sorghum bicolor
  unsure (1)..(96): unsure at all Xaa locations
  Clone ID: SORBI-28MAY03-C32613_1.pep
APRRQPSSRSPPPFSWPPWPPSPRPPPAPXGRRHRGXPCSPPQGRGTVRTCGGRHRWPPRGRGARRRSSPAPPRGPPRRRGRSPAQPPPAAEPRPP

SEQ ID NO: 33485 - protein, 254 aa, Sorghum bicolor
  Clone ID: SORBI-28MAY03-C32641_1.pep
RDMVSQRSFDWLRERDQLRAEMKAGNVFQGMREGPIKFPPTYKFQRHQLGLSGYDSGEKKRIPAWCDRILYRDSRSVSIAECSLECPVVAAITAYEACMDVTDSDHKPVRCIFSVDIARVDELIRRQEFEKITESNKKVCSLLRELHFVPDTIVSTNNIILENQDDVILRITNNCETSKAAFEILCEGQSIGKQDGTKSELLLRASFGFPLWLEVQPSIGLIEPGETMEVAVHHEDFFTQEEFVDGVQQNWWCE

SEQ ID NO: 33486 - protein, 246 aa, Sorghum bicolor
  Clone ID: SORBI-28MAY03-C36060_1.pep
MAVEVVTSELVAPSETTPRRALWLSNLDLAARNGYTPTVYFFRRRCPQPQDGSGGDDDDRAPQQPSPDFFSADVLRAALAAALVQFYPFAGRLRAGRDDDGRAEIDCNAAGALFVVARSAAALEDFDGFAPSKAMNDTFVPKYDSTAGPDAPLLLLQVTFFRCGGVTLGTAMHPFVIDGRSAFHFIRTWASIARGDTAAAAVPPSLDRTPLRARPLPTVLFDHTYEYGGRTSRPPTTGGNNKAAEY

SEQ ID NO: 33487 - protein, 175 aa, Sorghum bicolor
  Clone ID: SORBI-28MAY03-C32958_1.pep
ARGSAASAATVEAEARVAAGGRSVFAVDCVPLWGYTSICGRRPEMEDAVAIVPRFFDVPLWMLTGNAAVDGLDPMTFRLPAHFFGVYDGHGGAQVANYCRERLHVALLEQLTRIEENVCAANLVDMEFKKQWEKAFVDSFARVDDEVGGKAIRGGGGEAGTSNAAVALAPEPVAP

SEQ ID NO: 33488 - protein, 128 aa, Sorghum bicolor
  unsure (1)..(128): unsure at all Xaa locations
  Clone ID: SORBI-28MAY03-C32979_1.pep
MAEDKVGRIFVGGLSWDTTERTLERTFGQYGKVIEAQVVLERETGRSRGFGFVTFSQPRAVDAAIRGMHNGQLDGRNISVNKAQPRNSDDGYGYGGGGGGGYXXGARGGYRSGGDVVPAASDDCFKYG

SEQ ID NO: 33489 - protein, 197 aa, Sorghum bicolor
  Clone ID: SORBI-28MAY03-C32983_1.pep
RSRSRGEGSWACGPCGGTRTRDRSRRRLWGSGRTWGSPYRILPGCSSRSQEVSLCLSHYITLGTKSKLSLAARRTETKARSKAWGRRRCRCCLVPGQSPSPSVVRATRVTDPRRQPSDAPPGTTRRGAARGAGSAEANGNRRRESATRPGRIGAWARGRAGARYCVAPCSVVSGVCAPARAPLPVGVDARGVETNSS

SEQ ID NO: 33490 - protein, 233 aa, Sorghum bicolor
  Clone ID: SORBI-28MAY03-C32995_1.pep
MMPPTATATAVFLSAPPPSFSTRRRRSRLPAISASLSPSSSSSSSEEPLLVRAARGEDGLPRPPAWMMRQAGRYMAEYQALAKRHPSFRERSENTDLIVEITLQPWRAFAPDGVILFSDILTPLPAIGVPFDISDSKGPVIQSPVRSEEQVRELVPIDLDMLQFVGESLKILRNEIDGKAALLGFVGAPWTIATYVVEGGMTNTYTNIKSMCHTAPDVLRSLLSHLAPAISDY

SEQ ID NO: 33491 - protein, 204 aa, Sorghum bicolor
  Clone ID: SORBI-28MAY03-C32992_1.pep
ARGRAFCDAPDSGARRSQDHTEKVAGVKAPPDVLDVAIVGGGMVGLAVACALSNMPLTKHLRVAIIDSNPALKSRGYLDKNSIPDSRVSTVTPATMSFFKDIGAWEHVQQQRHAFFGKMQVWDYTGLGYTRYNARDVGKEYLGCVVENKVLCNSLLLRLQEELDDIENVIYPTRLVSLTFPLKSRQAGMKPTSSEPLSVGHTTE

SEQ ID NO: 33492 - protein, 184 aa, Sorghum bicolor
  Clone ID: SORBI-28MAY03-C33002_1.pep
HEVWLQRDFSIYVCNLFDTGQASKVLQMDRNSLEHLLHHFCGVTANKEYQAADWRLRPLPDEMIKYAREDTHHLLYIYDLMRLRLVNESSGENDLLLEVCKRSNEICLQLYEKEQLTDTSYLHIHGLKENELNARQLSVLSSLYRWRDGIARAEDESTGYILPNKTLLEIAKEMPVTSGKLKRI

SEQ ID NO: 33493 - protein, 46 aa, Sorghum bicolor
  Clone ID: SORBI-28MAY03-C32800_1.pep
DPKMKEAFENIKFYKFYPVKTPDTPDVNNVKARYINRYYRNAHYLM

SEQ ID NO: 33494 - protein, 108 aa, Sorghum bicolor
  Clone ID: SORBI-28MAY03-C328_1.pep
MEERRRPRARGSGRRPSPRAAGTALRRKKVRELRRLVRGGEEAPAGALLVRAADYIVRLRARVELLRALAAVYDDVDVAAAAPSPLELAVADDDGADAASADADAWAA

SEQ ID NO: 33495 - protein, 99 aa, Sorghum bicolor
  Clone ID: SORBI-28MAY03-C32806_1.pep
AKGQTMLLLLLVQNSTILITTQQCGTHEVTRQYDRTSTSMPSDRVKLQTSGKYRYHISIYVSYSYIYTGKVRVKCQLLEQIKHKQIYLSQQQLKSIQLL

SEQ ID NO: 33496 - protein, 102 aa, Sorghum bicolor
  Clone ID: SORBI-28MAY03-C32810_1.pep
FSDSKVRALSPGFYIGSTLIRALPHVYDVFRRQHFVPSLRPSYMYASPHDDLFSLAWDIVIPCGALLLSVLLFFQQWRGGAFFLCSKNRKTREYEMVSTVSS

SEQ ID NO: 33497 - protein, 200 aa, Sorghum bicolor
  Clone ID: SORBI-28MAY03-C33133_1.pep
MAEAVVRCLRDARRDGEHAPALAVEGSLQCCSLAAGAMLHIAAAFASQVAAGKAQARGLVVVAFDRSPQVYLEFMQRRGLDANALNRCVRILDCYSDPLGWKQKIQNQQHQGNSAKLSTNKENITVYRSVKDVTKLLSFTTELGGDFEGEGKKYFSVAVDSISSMLRHASVPSISGLLSNLRSHEQVSSIFWMIRSDLHE

SEQ ID NO: 33498 - protein, 123 aa, Sorghum bicolor
  Clone ID: SORBI-28MAY03-C33116_1.pep
MSGSSNGNLDKLSWSSAKTISSVIDDVAEYEIPWEDLDIGERIGLGSYGEVYHADWNGTEVAVKKFLDQDLSGVSLEQFKCEVRIMSRLRHPNVVLFLGYVTQPPNLSILTEYLPRGSLYRLL

SEQ ID NO: 33499 - protein, 151 aa, Sorghum bicolor
  Clone ID: SORBI-28MAY03-C33134_1.pep
HEAKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFSVLTRSIKFQLSKFFDDSPTSSGDSSPESSTNSTKNENRNEKSET

SEQ ID NO: 33500 - protein, 187 aa, Sorghum bicolor
  unsure (1)..(187): unsure at all Xaa locations
  Clone ID: SORBI-28MAY03-C33138_1.pep
GRAYPLRPQRMGTRPPLPPAADTHRSXQDITTPSSVRRSDFSRATGPSTPTPPLPPVPFAAACSTLISSDGWGNGNGNERPLPKGNADPSVLRMDPPNAEPSASTSSPPPPPSSWACWRRGGLGVHLGTFGRCCCCCCPDAMFKCFAGRRARGMLSLLASEDWNSWRPGPCWSKSSCCACLLVLCLV

SEQ ID NO: 33501 - protein, 92 aa, Sorghum bicolor
  Clone ID: SORBI-28MAY03-C33139_1.pep
MLLKSKFKLATAIGIVLSMLSLLVHLFLANYSAGGITNYSMHMDDVLPFGQRPRPRRLWGPLIPLDHLHPFAKPSKSYAAPSKHNGFIYAKI

SEQ ID NO: 33502 - protein, 117 aa, Sorghum bicolor
  unsure (1)..(117): unsure at all Xaa locations
  Clone ID: SORBI-28MAY03-C33206_1.pep
ARGQPPPPELPATXPPAISPDLTMAGYPPPGSGYPYGPGGGGGGYGAPPPYGSSPAPSAPPYGETKPPKEGKTSSSSSSGGSAPPYYGGAPPPSHPSYGGGGGYGAPPPQDGAPPPQ

SEQ ID NO: 33503 - protein, 311 aa, Sorghum bicolor
  Clone ID: SORBI-28MAY03-C33505_1.pep
EKTPNQYLQWRYANGDDREVLMKQTRVLTAEDKAQMETPIDLGDGRGPRKIEALIGRSKYKKSFQYEVKWLHMLPKFNSHLSRETLIEKGFTKLVQEFDDHESSREGLGYRVLEPKVISKHFEDLGLDPEIANHNEISGLSGGQKVKVVLAGAMWNNPHLLVLDEPTNFLDRDSLGGLAVAIRDYKGGVIMISHNEEFVGALCPEQWHVADGRVTHKGHLAVNMDRFEDSRPGSSNVSSNVSSAAPSTNGTPVMSEAEGGKDDMKFRARKKKKMTKKELKEREVRRRLRYIDWLNSPKGTPQPPNTDDEAD

SEQ ID NO: 33504 - protein, 184 aa, Sorghum bicolor
  Clone ID: SORBI-28MAY03-C32882_1.pep
SKAKNEKKGKGEGKKRKRDDDTEDGDGKDGKKVKKGAEEKQDIMYANVFVDPKEARRRKKRRVKNKKKALEQAKRLQEAKKDPEKASKIAWDTARRRAAGEKLHDDPKLIKESLKKEEKRQQKHAAQWKERQKTVDKQKKEKQKKRTENIRDRAHQKKMRKIEKREKKLMRPGFEGRKDGYVNE

SEQ ID NO: 33505 - protein, 159 aa, Sorghum bicolor
  unsure (1)..(159): unsure at all Xaa locations
  Clone ID: SORBI-28MAY03-C32930_1.pep
CQRHTSSQNQRXNPEKPIDLLRKVDGNNMCADCGASEPDWASLNLGALLCIECSGVHRNLGVHISKVRSLTLDVRVWEPSVINLFQSLGNMFVNNIWEEMLPDDNSSADGSDTSQYLSVSKPKHKDVFSAKEKFIHAKYVNKEFIRNHSMDENQLAQQM

SEQ ID NO: 33506 - protein, 160 aa, Sorghum bicolor
  Clone ID: SORBI-28MAY03-C32933_1.pep
TRDKCAARKDSSPPPPPSRMRSSTRTDKSGSAAKSALDELRAKRTMRQQAPEARTSRFTDLLPHSGSPTRRRAGSPPSDGSNDGDNRGRLNDHGRIADDSRDDEFDESPSRLDPLKFDDVKSITLRRSKLVKWFMEPFFDDLISGCIVRLGIGKTKSGNP

SEQ ID NO: 33507 - protein, 137 aa, Sorghum bicolor
  Clone ID: SORBI-28MAY03-C32951_1.pep
AASAAPPPRAPPAAPPPLPLPPPPPPPPRALPRPAVARAGAGRRHAHAPAGAPRPGAPPPARGAPAAAVPPARRPAPADPRDPAGRARHGRPGPGPGGGARAPGGLTLLGADGTGIRIRDLMAWGGLMGSGHDYYER

SEQ ID NO: 33508 - protein, 256 aa, Sorghum bicolor
  Clone ID: SORBI-28MAY03-C33241_1.pep
HEAELHGLNKKNKRKSEQPKGVGVLDGEVQMGSSESVGPVSISKLETNALFAAACELRNISNEADVKRGANSSCSTKGLARGKAKGKPKKTTAKRQASNRKNKSKGGNDIRQATDLDSEVQSGKTDEQAEIDASKVSAYDASVSASTSNDKFNHSSALRNSANGKPLPPVQFHALDSDQHVLDVWKPSVIIVYHPDITFVREIEVYKAENSSKKLKVYFLFYEDSTEVQKFESSIRRENEAFESLIRQKSLMMIPV

SEQ ID NO: 33509 - protein, 181 aa, Sorghum bicolor
  Clone ID: SORBI-28MAY03-C33242_1.pep
MGNKKKPKPSRNKKKPKTSADQALALDYVRAWAHPAPPPPEPSAADADDFLPILATRGGDVLFELHSHSNHSDGFLSPSALVERAHRNGVKVLALTDHDTMAGIPEAVSAASKFGIRIIPGVEISALYNPREVAGAGETVHILAYYGMCGPSRPDELDSMLLNIRDGRYLRAKNMLQKLTT

SEQ ID NO: 33510 - protein, 128 aa, Sorghum bicolor
  Clone ID: SORBI-28MAY03-C33249_1.pep
SCVGVFRDDRIEIIANDQGNRTTPSFGAFTDTERLIGDAAKNQVAMNPHNTVFDAKRLIGRRYGDAEVQSDMKHWPFKIVEKNGKPIIEVEFKGENKQFTPEQVSSMVLVKMREVAEAYLGGTVNNAV

SEQ ID NO: 33511 - protein, 112 aa, Sorghum bicolor
  Clone ID: SORBI-28MAY03-C3325_1.pep
MSEDHKGVHNLKNKEQFEEVMAVKDSLMVVDCFATWCGPCKVIAPQVVKFSEKYPNARFYKLDVDEASDVAGDLGIRAMPTFILSKNGTKVAEVVGANPKALETAIQNNIDA

SEQ ID NO: 33512 - protein, 132 aa, Sorghum bicolor
  Clone ID: SORBI-28MAY03-C33280_1.pep
MPEVKCGAAEKVKPAASPSAEKPSEIAGNISYHAQYNPHFSPLAFGPEQAFYATAESVRDHLIQRWNETYLHFHKTDPKQTYYLSMEYLQGRALTNAVGNLGITGAYAEAVKKFGYELEALAGQEKDAALGN

SEQ ID NO: 33513 - protein, 177 aa, Sorghum bicolor
  Clone ID: SORBI-28MAY03-C33286_1.pep
MTTDRLLHFLRAPTGSPAAAPTRAARRGPLQAQGVHFCQGAAVMRRASLSCSGTSSGREGGLTYKDAGVDIDAGAELVRRIAKMAPGIGGFGGLFPYNDDYLVGSTDGVGTKLKLAFETGIHDTIGIDLVAMSVNDIVTLGAKPLFFLDYYATSKLDVDLAEKVIKGIRDGCEQSDC

SEQ ID NO: 33514 - protein, 141 aa, Sorghum bicolor
  Clone ID: SORBI-28MAY03-C3302_1.pep
MEISLLHDESDAGTTSLLPLPLLSYSPRSMVPIQVPSSSDLESILSPDPIYSDLQLKEINYNAAAMDESTEFLHLILSGNDEGYNTRTELQVWDVLDFYVSENFSALQFDSLMGFTNEVSTSYNDCMNLVDMVERPVARLS

SEQ ID NO: 33515 - protein, 91 aa, Sorghum bicolor
  Clone ID: SORBI-28MAY03-C33029_1.pep
TGRRDGRRTVERQARAAEAVVGELHGATMAGGGDHHRNHHHRQNTVSSHGAAHLLPHHRDTDEGSISRLAKSSSHEIYSCDSKSQIKYSSS

SEQ ID NO: 33516 - protein, 310 aa, Sorghum bicolor
  Clone ID: SORBI-28MAY03-C33106_1.pep
TRKHYEKSGWNKNRKGKFPDSNSYRDLVFRFFVQKGGGSGYASPVTIGSMLFDGNSLVDQDPHFQHVTAEMKQRLLNVSYDIYYVGNWSLESFHRRHISAEGVYDTKTGSLCMIACRELNVSSDCGTRVTAQFSSLDAKGAQHVKGTIKSLRKKTDPLFFKTLDIASYGMYVEQVDESIWRMDLESTMALISMTLACIFIAVQLFHVKKVPEALPAMSITMLVVLALGYMIPLVLNFDALFKNSNKQTVPLSGGGWLEVNEVMVRIITMITFLLQLRLLQLAWSARSVDVSKAESWSAEKKVLWICLPLY

SEQ ID NO: 33517 - protein, 152 aa, Sorghum bicolor
  unsure (1)..(152): unsure at all Xaa locations
  Clone ID: SORBI-28MAY03-C33042_1.pep
MRPLLALAAACALLVAAGAAAAEEAKNSTNKFRQREASDDMLAYPHLDEDALLQPEGPKHVELRWQTEVSSSIYATPLVADINSDGLLVVRLPSFXSPLRCACGHGGGRGIALATYNGVVNFFRVSGYMMMDKLEVPRRKVRKDWYVGLNPD

SEQ ID NO: 33518 - protein, 163 aa, Sorghum bicolor
  Clone ID: SORBI-28MAY03-C33316_1.pep
GRAAPAPVPSTAPRREVRAAVSGSPRASCPLPSRRKRAGTPSSRPPPPCATRRSGEVLVLEIEGAADGGAGLRRYCWSEGRGASRMILNSPAAPACASIISSMRAIACAAAARRWSAAAPEIPGRRVWPPPPPRGASIGVGGGWPPNRRRFDFSLTFRFRPRA

SEQ ID NO: 33519 - protein, 132 aa, Sorghum bicolor
  Clone ID: SORBI-28MAY03-C33307_1.pep
MDDNDMGVESQRELMTAAPAARPGTGSGGGRKHLSSIANRVLRQCSLTLDRSVDDLVADFELGLKTAAVGNYSRKLVEFCSLQALQIITSHDIGEKINDGSLSRFTFDMMLAWETPTPSDQQVTMESIAKER

SEQ ID NO: 33520 - protein, 282 aa, Sorghum bicolor
  Clone ID: SORBI-28MAY03-C33326_1.pep
MEKELDGFTPPGVGYGNITEETIQRLKKEKLSKSERKRQAREAKRAEAEEDSALVCSRCHSLRNYGLVKNDKAENLIPDFDFDRFISSRVMKRSAGTPVIVMVVDCADFDGSFPKRAARALFEALEGRRNSKVSETPRLVLVGTKVDLLPWQQMGVRLDRWVRGRAKAFGAPKLDAVFLISVHRDLAVRNLISYIKESAGPRSNVWVIGAQNAGKSTLINAFAKKQGVKITRLTEAAVPGTTLGILRVTGVLPAKAKMYDTPGLLHPYIMAMRLNNEERKMV

SEQ ID NO: 33521 - protein, 188 aa, Sorghum bicolor
  Clone ID: SORBI-28MAY03-C3333_1.pep
MEARVAAGVPEDEESGLLPRPSATGRRPSSRGPRFPPPPAAWVTVDGPLGLPLEDAGGHARRFFLWGFACLPFLWAINCYYFWPVLRSPAASSPSAFASIRPHVVRSAIGFTIFSVVLITWATTFIVGGERLFGPVWNDLVMYNVADKAWHHWIHGIACDVFLISTGLGPTKSEMICSMDLRKNCYYL

SEQ ID NO: 33522 - protein, 193 aa, Sorghum bicolor
  Clone ID: SORBI-28MAY03-C33332_1.pep
GRRSLLSLMVAPPASMVEDTALRSPMPVPEKLADAPAAAPAKKKPSSSSNDKKRKGKGLPDLALAAEAPVTKRKGKGLSHPVSTSEIPIAKKPKTGDVPTSTTELARSGIAIAATHTTVQTLVTGCRPRGPRCPCSKMWTLTARRHSRYAIFCWHYLILQIIGMKMQAKFCDNTCWQHIYIAETLNQALHLHK

SEQ ID NO: 33523 - protein, 158 aa, Sorghum bicolor
  unsure (1)..(158): unsure at all Xaa locations
  Clone ID: SORBI-28MAY03-C33385_1.pep
PRRRTRGNTWSACAPSAPRQSRRSADMPTGRRARARARRRRRSRPACSNTWHWRPAPRRRWSIRPPRRTSAGRKTPXPSSAAPTSRTAASLRLLWARSGRRRRRREKGTLDSGRAGVAGEGPRLGAALASPEKALEPGGGGPVCEEGLERRDELRAFS

SEQ ID NO: 33524 - protein, 117 aa, Sorghum bicolor
  Clone ID: SORBI-28MAY03-C33354_1.pep
LPTFVQARDEAADGASTIASTKKQVLSSCLDILLRAADSRQSSTHHNVARTETVILLINTAALKVRRLGDAAQRRARKDTPSALPPSRRARTHMRGGNMVQGLPTKHGAEYEPYARG

SEQ ID NO: 33525 - protein, 159 aa, Sorghum bicolor
  Clone ID: SORBI-28MAY03-C33208_1.pep
MHLYLGLAIWGVVAFVIYKAINYVLARRQRAAKARDTGASEALSFPIAGFGGFQYLKLLLKADKEQLFPDWLIRRQRIMSELHGREVSTFKTYTMFHDTYFTSDPRNIQAMLATQFSEFELGPVRSANMGQMLGQGIFTQDGKAWEHSRALLRPNFVRD

SEQ ID NO: 33526 - protein, 98 aa, Sorghum bicolor
  Clone ID: SORBI-28MAY03-C33215_1.pep
AEDGACADAMAPRLPPARPGPSLGEISPSPNRRPPLIRSSPGEGREIWRRGRVGVGIGGFGMRVAQLPNPARPPNVWAFASPAIFFFFFFGASAWPRA

SEQ ID NO: 33527 - protein, 145 aa, Sorghum bicolor
  Clone ID: SORBI-28MAY03-C33220_1.pep
MAAELHKPLGAITADDLAAAAPGCDATALHSALRRALDSHGPAAVWAELCRSVLRPSVPFAVHRMLYYGCFAGFPSPTPPAWTPDPKEAALTNVGRVLEARGRDFIGDAYKDPITSFPDLHKFSNENPETYWKMVFEEMGVQFSV

SEQ ID NO: 33528 - protein, 95 aa, Sorghum bicolor
  Clone ID: SORBI-28MAY03-C33238_1.pep
RRTSSSLAAASASGAGCCCRTAASSLSSAAAVVAWTPIAGAGCGHGRPALYGMAWYILLLLPGARRARARAAPARRPSPRFGWELGVVAETCASC

SEQ ID NO: 33529 - protein, 194 aa, Sorghum bicolor
  Clone ID: SORBI-28MAY03-C33431_1.pep
HEVSLDFPAGKIVALVGGSGSGKSTVVSLIERFYEPLSGSILLDGHDIKELDVKWLRRQIGLVNQEPALFATSIRENILYGKGDATMEEINHAAKLSEAITFINHLPDRYETQVGERGIQLSGGQKQRIAISRAILKNPSILLLDEATSALDAESEKSVQEALDRVMVGRTTVVIAHRLSTIRNADTIAVVDGG

SEQ ID NO: 33530 - protein, 196 aa, Sorghum bicolor
  unsure (1)..(196): unsure at all Xaa locations
  Clone ID: SORBI-28MAY03-C3342_1.pep
RVRILLNLNCFAQYALCGLNLXSGRSQRPPIGVGLTISVAIGAAAFAGLYNIISPLGKDYDTEHADIDQEAQIDVASTESGRPTSRVKSFERRYSFIQSDERRFVERRPQWVGGLMDFWDQISIAYLSLFCSCCVFGWNMQRLGFGNMYVHIATFLLFCLAPFFIFVLAACNXANDSLQVALVLTGLFLCFFGLLY

SEQ ID NO: 33531 - protein, 153 aa, Sorghum bicolor
  Clone ID: SORBI-28MAY03-C33453_1.pep
HSSSAEQRHYDCCRYFPSRSRPPPPGCAAGPVLRPPRPHRAAAAAAHQRHRTAVDGVLSNDGGCWKKPRDVALRRRSEKRESSPIVSHINHRSVAIDREVYSRIASSQQNPCASHYFSFLGGGRRRRWTLPLAGPAPATMLTNTSRARLLLDA

SEQ ID NO: 33532 - protein, 127 aa, Sorghum bicolor
  Clone ID: SORBI-28MAY03-C33474_1.pep
RRRWLALQSPAQRSCTRTTTPSPGLNAHRRLRARLPGPYVSSPLPLHLPPLSLQGARGRVAALTRPSLLYGRRELPLRRGLLQRAHGTDVSIPCRQPHVPRPTYASPTNLAPCSACPPSVQSKASTQ

SEQ ID NO: 33533 - protein, 158 aa, Sorghum bicolor
  Clone ID: SORBI-28MAY03-C33490_1.pep
MAGSRFGSFKSEKGDSASAAAGAGADGAAQRRDPYEVLGVGRTATDQEIKSAFRRMALKYHPDKNGDDPVASDKFQEVTFSYNILSDPDKRRQYDTSGFDAIESDSQELELDLSSLNTVNTVFAALFSKLGVPIKTTVSATVLEEALNGSVMVSQLQL

SEQ ID NO: 33534 - protein, 210 aa, Sorghum bicolor
  Clone ID: SORBI-28MAY03-C33494_1.pep
TRIQYKQELGTAIVNFARIVPDGLLVFFPSYSMMDMCVEFWKNRNHSNSASENTIWQRICKHKQPVIEPRQSSNFQSAIEDYRAKLHDSSSGAIFFAVCRGKVSEGLDFADRAGRAVIVTGMPFATPTDAKVRLKREYLDKQGTPSNKNTKTLTGEEWYVQQAARAVNQAVGRVIRHRHDYGAILYCDERFAWPNYQSQMSYWLRRHIKC

SEQ ID NO: 33535 - protein, 197 aa, Sorghum bicolor
  Clone ID: SORBI-28MAY03-C33506_1.pep
TRPLYDQLAQKARDGIKIPLQDVKGLGKKAPVATLPATANVLRAVETFGGGVHRVIVVDEQNDNEVVGIFSQFRLVKFLWENAQTFPAVNQLYPQSLGDLGVGSRQVLSINADRPLCDALRLMDNEGISSVAVVDNQFNVVGNISSTDVKLLTRSSSLPLLRNTCTHFITVILSTRGLAEGKDSFPVFHVNPSSTLA

SEQ ID NO: 33536 - protein, 148 aa, Sorghum bicolor
  Clone ID: SORBI-28MAY03-C3328_1.pep
KGQAPVATLRPFGSARPARKEIRSRSEALQLQEWAAEHCSAPYRAPELWDCPSHADIDERTDIWSLGCTLFAIMYNVSPFEYALGESEGSLQLAIVNGQLKWPAGPKPPYPDELRQFVIWMLQPQAAMRPHISDVLLHVDKLIAKYLP

SEQ ID NO: 33537 - protein, 208 aa, Sorghum bicolor
  unsure (1)..(208): unsure at all Xaa locations
  Clone ID: SORBI-28MAY03-C33292_1.pep
HEANPLGGAVYLVKDGQLPSKIRTMSRDADGYSAAYRITQYVTRLFKSPDLFSVDKVPSALRAAYLRNIAVSVQLADDNLGLAGANGFWAQYNSDVEAEAMTFMSDAQPFVTHELKNLVETWSKDDDNAPLLSWATSLLSEIDVGATSPAYYHARAYAVLIADPIEITGWKNSQTAQLQETLKTTRSSKNVLQLLAFLNAXREPLSYA

SEQ ID NO: 33538 - protein, 82 aa, Sorghum bicolor
  Clone ID: SORBI-28MAY03-C33297_1.pep
MAAWVRAALLAAAAVAAYTAAAAVPAEALSLDVHHRYSATVREWAGHHRAPPAGTAEYYAAPAPRGRRRRSLAAGPAAGGGG

SEQ ID NO: 33539 - protein, 242 aa, Sorghum bicolor
  Clone ID: SORBI-28MAY03-C33301_1.pep
MEDELISESDSGSDGEVHPLNEQDLADSVDGIHGNKCEHPTDAPETILQDEFSRLPSMKTFDRSNNLSFKESNLEEKICQKLLTKTFSNSERLGMIWPEPPLDMLAQCLPDSTKSFASGKALRSYLSFKSVNGDSDPFAAEVPDFNINCAAVKRKRPYFVRIISKQMVGVYLSIWVRRSLRKHIQSLKVSTVGVGAMGYIGNKGSISVSMSIYQTHFCFICCHLTSGEKEGDELKRNADVQE

SEQ ID NO: 33540 - protein, 245 aa, Sorghum bicolor
  Clone ID: SORBI-28MAY03-C33533_1.pep
TRDKMLFQRSQHSSMINGLHGRYQMYGPVVRLAKRWISAHLFSSFISEEAVELVVAYIFLKPFPFHAPSSRVAGFLRFLRLVASFDWTFSPMVIDINNDFNLKDEKEINDNFMLSRKSYEQSPHDIEPAMFLATSYDKASEAWTKQSPSKSVLKRMAAYAKSSAQLLTNLILHGQSGEYTWECLFRTPMSNYDAVILLHQEKLCCPHHVLFPAETPEGKLVVWGKPSKDFCPYMPLNKGAVKGFH

SEQ ID NO: 33541 - protein, 328 aa, Sorghum bicolor
  Clone ID: SORBI-28MAY03-C33542_1.pep
TRKRYMELTKGAADNYHRSWWKRHGVVLDGEIAALFFKHGNYDLAVKSYEKVCALYSAEGWEELLADVLPDLAECQKILNDEAGYLSSCVKLLSLDSGLFSSKERQAFQSEVVRLAHSEMKHLVPLDVSSLITFARGAGPPLELCDGDPGTLSVAVWSGFPDDITLESLSLRLSASSSADEGIKAIKSSDSHVLVPGRNIISFNIPPQKPGSYVLGALTGQIGKLSFRSHGFSQDGPVETDEFMSFEKPTRPVLKVRKPRALVDITPAVSSALLMNELQWIGLIVKPIDYSLKGGILHIDAGAELKIEESQMIEIEIYGSDVECANSA

SEQ ID NO: 33542 - protein, 159 aa, Sorghum bicolor
  Clone ID: SORBI-28MAY03-C33547_1.pep
MNILARISGGGDRAAATEPPPPQPMCWVEISESVSRLCSFDAAGSGGGSISVKVIQDARPIHDKVVDSFLNKFFPSGYPYSVNEGYLTYTRFRALQHFSSAMLHVLSTQSLLFAAGLRPTPAQATAVSWILKDGMQHAGKLICSSMGARMDSEPKSWRI

SEQ ID NO: 33543 - protein, 168 aa, Sorghum bicolor
  Clone ID: SORBI-28MAY03-C33585_1.pep
MGSVVVLYTWMVRGHLHPMAQLADRLAGHGVPITMAIADVPSSSDSHQTVARLSATYPSVSFHLLQPTTARSGDKADPDADPFITLIADLRATNPALLAFVRSLPSVKALVLDFFCGCALDAAAELGLPAYLFFTSGASPLAAYLHIPVMRSDVSFGDMGRSLLHFPG

SEQ ID NO: 33544 - protein, 126 aa, Sorghum bicolor
  Clone ID: SORBI-28MAY03-C33593_1.pep
NDWRSDCEMSSLPSMHGTKENQPTPTLLPRPEHPRQIKQSPGARWSVALPAASGHVRRSASCLAAERSVPGPSLGGGGVGGGSEVRQGAALSLEKQLAGQEERARRHGHGRAGGGQKTERRERAGS

SEQ ID NO: 33545 - protein, 172 aa, Sorghum bicolor
  Clone ID: SORBI-28MAY03-C33603_1.pep
ARGGTLAMSWGSGTSNFPYLITPDQGIQLQAVEDGTRYESILNNNQWPQTQALVSQPNVTAIVFANANSGEGYINVDGNYGDRRNLTLWKNGDELIKNVSAICPNTIVVLHTVGPVLLTEWHNNPNITAILWAGVPGQESGNAIADVLYGKTSPGRSTFTWGRTRESYGTEV

SEQ ID NO: 33546 - protein, 179 aa, Sorghum bicolor
  unsure (1)..(179): unsure at all Xaa locations
  Clone ID: SORBI-28MAY03-C33617_1.pep
HGAGQSPPPPPPPPXAAAAAAAATCEHVVEKPAICTADELHYAPVPGTEWRLALWRYRPPPEAPKRNHPLMLLSGVATNAIGFDLSPGASFARHMSMQGFDTWIVEVRGAGLSMRGSELAAANTKSDITPGPNLDESSTTKAIVAIPAENMFTSQHQISEVPVIADKNMVGTSISEEPQ

SEQ ID NO: 33547 - protein, 198 aa, Sorghum bicolor
  Clone ID: SORBI-28MAY03-C33393_1.pep
TRAQCRFEAFERQMKPAEEARGDANVKYGWLGSRKSDIVRILINGLGTTANPVEKAGLSAGVYLSPENRAFTSVGLCDVDEKGVQYMLLCRMILGNVEAVEPGSQESFPSSEIYDSGVDDCSNPKCYVMWPSHLSTHIRLEYLVSFKLVPKVRNYLLDLKGLWFNPSLKEVGMDISTLQPVMCETGEGPTSPWISFRV

SEQ ID NO: 33548 - protein, 114 aa, Sorghum bicolor
  Clone ID: SORBI-28MAY03-C33395_1.pep
MATGQLFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGV

SEQ ID NO: 33549 - protein, 112 aa, Sorghum bicolor
  Clone ID: SORBI-28MAY03-C3341_1.pep
PRCEPKAQILSIPKGAGSKKTQSSMILQVQTFSRCLNMFLSRLVYDVTAYSGWMKVPECGRSCSRGAGCLDAKVPPSTSSAMAALQLEMSADVVDWPGRVVMCAHGDVLAAW

SEQ ID NO: 33550 - protein, 250 aa, Sorghum bicolor
  unsure (1)..(250): unsure at all Xaa locations
  Clone ID: SORBI-28MAY03-C33652_1.pep
LVELVHGKRLNAQKFSIGGTPRKVLYHNESRTLLVLRTGLSGASSSSDIVQVDPQNGVLLSRYKCEPGETAKCMQIAKIGNDQVLIVGTNKSAGRPMMSNGEAESSIKGRLIVLSLXAVESPRESSSFIPASSFNPSSSHSGSPFHEIVGYTTEEFSSNSLCSSPDEFCCNQIQAEMAGQLRSLTHAILNGAVLAVCPYLDRYVLAAAGNTIYVFGFTNENPHRMKKCAVGRTRFTITCLKTFASRIAVG

SEQ ID NO: 33551 - protein, 111 aa, Sorghum bicolor
  Clone ID: SORBI-28MAY03-C33665_1.pep
QRDVHWHGREGVEVGCDGLSRGSDEQCPEDCIISRCCENYKYCEHSEKFSCLEFCTLNVLKLQNASSSYGQSAPRHQVACGSTCTADGDGGYAGGILRQITHYFLPCSAGR

SEQ ID NO: 33552 - protein, 188 aa, Sorghum bicolor
  unsure (1)..(188): unsure at all Xaa locations
  Clone ID: SORBI-28MAY03-C33669_1.pep
MRAGGGARPRHAPLSPTASATATLLVPASVAMPAPRLAHLRHLLLSQRSAPARSLAPNLGHPLPGPLHPSLLLARAMAGVAHAGLATGSTEYEEVLGCLSSLITQKVRADTGNRGNQWELMAKYVQILELEESIAQLKVVHVAGTKGKGSTCTFAEPILRSCGFRTGLFTSPXLMDVRERFRLDGLDI

SEQ ID NO: 33553 - protein, 108 aa, Sorghum bicolor
  Clone ID: SORBI-28MAY03-C33693_1.pep
ILVVLYLNCSPMHPVSVPSQPFTATPAKQVVSSSNALRKAIHFVNLRRAGKSSGNLAMNSISKPAPGSETSGREDFAVGDKDAVVIVDHGSRRQESNLLLNDFVEMFR

SEQ ID NO: 33554 - protein, 189 aa, Sorghum bicolor
  Clone ID: SORBI-28MAY03-C33697_1.pep
TRLQLSLAIRLTSQAFLAGAPPPPELLFGCGSGVVAEHHAAGDGADDPEAISYRLWVNGCLSWGDKITHGFYNIMGIDPHLWAMCNVAEEGRRLPSLAALRAVDASESSLEVVLVDKGADSVLLDLERRALDLVRALGVTLDLARSLAVLVSDHMGGALRSEDGDLYLRWKAVSKKLKKRQKCVVVPIG

SEQ ID NO: 33555 - protein, 155 aa, Sorghum bicolor
  unsure (1)..(155): unsure at all Xaa locations
  Clone ID: SORBI-28MAY03-C33699_1.pep
AATATVTFSPSPPSFLNSQLRRIHRPASTTTIAFFARRFCGVKPSPNRSRGKSAPVAPPDHGFGALEAELWRLRRLVELQIHRFGTEADAAYRDLRSAVREVSGDRVVLTFRRSSLRYFAGALLFLLACAVAARVLLGIVLRAWWRRGLXRGFWG

SEQ ID NO: 33556 - protein, 74 aa, Sorghum bicolor
  Clone ID: SORBI-28MAY03-C33742_1.pep
PSMGMIIPGVHLMATEGHGKDGVGDGGASNKWGGSLTWLCAHVHVTFGSELLNNVELEVFPLNSEKHFNFFRFA

SEQ ID NO: 33557 - protein, 174 aa, Sorghum bicolor
  Clone ID: SORBI-28MAY03-C36017_1.pep
ARAEDWLDKFSPWEIPRHDVVFPVRFFGHVEILPDGSRKWVGGEVLKALAYDCPIPGYKTKNAISLRLWEAKATAEDFNLFQFNDGQYESAAQLHAKAQQICAVLYPGDATEEGKLLRLKQQFFLCSASLQDMIARFKERKSDRVSGKWSEFPTKVAVQLNDTHPTLAIPELMR

SEQ ID NO: 33558 - protein, 220 aa, Sorghum bicolor
  unsure (1)..(220): unsure at all Xaa locations
  Clone ID: SORBI-28MAY03-C36053_1.pep
MAVQAQHLLNPAFLPHHDLAHAFRALEGAAVGAAVGGNLFLDELGFVGCAPPAPAPIGDAPFVDAQPRSELTCNGSGGDNNNNVFLPRKRARVAPGFLDDGSHQQQGLVLPLPLPPHVQVFAGDVQTCRAGGCGAASTSGRAAVASNAVLSQLYHQGVEIDALVRLETERMRAGLQEARRRHARAVVAAVERAAXGRLRAAEADLMRARCRNAELEERLX

SEQ ID NO: 33559 - protein, 186 aa, Sorghum bicolor
  Clone ID: SORBI-28MAY03-C33797_1.pep
LIAGPLLSAVHIYGVVQEMRATPVNTLNPQRTAMIVADFIKSGKVSSPAELRYREDLLFPNRVIEEAGSVKIGQPLRRVLSPSLVEQLRATFPDEKFLLTQKSNKTYMVLEQSASGEDALRGWLVAAFASEMERSGIVSRDTVLKEAYEKTKMVFPSFVSEVRSRGWYTDQFLDGNGSRVAFAKFQ

SEQ ID NO: 33560 - protein, 278 aa, Sorghum bicolor
  unsure (1)..(278): unsure at all Xaa locations
  Clone ID: SORBI-28MAY03-C338_1.pep
DGAASASCPLAALRSGHSYQRHHRCLLVSCHRQSGPVFNPRSSSSYTSVSCSAPQCDALTTATLNPSTCSTSNVCIYQASYGDSSFSYCLPTSSSSSGYLSRCSYNPGQYSTTPMAKSSLDDSLYFIKMTGITVAGKPLSVSASAYSSXPTIIDSGTVITRLPTDVYSALSKAVAGAMKGTPRASAFSILDTCFQXPRRRGFARXPQVSMXLXAGGAAXEAEGRPXPAXVDVDSXHXTCLAFAPARSAAIIGNTQQQTFSVVYDVKNSKIGFAAGGCS

SEQ ID NO: 33561 - protein, 108 aa, Sorghum bicolor
  Clone ID: SORBI-28MAY03-C33802_1.pep
SHILGITGSNFGDTQKHRMASTNRTKILHTADRVTITLATATGPQALYYKYVLETHQSVSCTVRFTEVQSVDLSPRAIKKKTVEAMQCVPDTLSVQTSDLLCRHLLCH

SEQ ID NO: 33562 - protein, 150 aa, Sorghum bicolor
  Clone ID: SORBI-28MAY03-C33804_1.pep
PNIQFRDDVFGFACKIFIDFLEITCCQAGDYPSRKGSSEIGSMPFPPGVGERSSGEIGNSENYEVITADRAIDESNVGNRILRNMGWQEGLGLGKDGSGIKEPVQAKSVDVRAGLGSQQRKADPSLEAQAGDSYKTIIQKKAMARFKEMS

SEQ ID NO: 33563 - protein, 170 aa, Sorghum bicolor
  Clone ID: SORBI-28MAY03-C33812_1.pep
DVGARDGTLALFAAGDEAVVAWLAPLFAHLGRVTHMGGPGSGQSSKIATQVAVAGAVVGLGESVAFARAAGLDAPLFLGAVSKGAAGSRIMDIFGDRLLRREFVSAGSVRYIVKDLGMALEVGDGGEEANVLPGAALYRQMFSAMVANGDGNLSLQGLITVVERLNGIGK

SEQ ID NO: 33564 - protein, 142 aa, Sorghum bicolor
  Clone ID: SORBI-28MAY03-C33836_1.pep
WAVRAPVAPDADSTKRFEGRGEAALEALLPDGFLDRTRGRGLVVPTWAPQVEVLRHPATGAFVTHCGWNSTLEAVTAGVPMVCWPMYAEQRLNKVFVAEGMKLGVVMEGYDEAMVKAEEVEAKVRLVMESQQGKELRDRVAV

SEQ ID NO: 33565 - protein, 59 aa, Sorghum bicolor
  Clone ID: SORBI-28MAY03-C33823_1.pep
GHEPMQREIIFSVQERISNGHYSSPTPLCTNDEQIQTHRMYISGTSNDLWVALSVTSWD

SEQ ID NO: 33566 - protein, 127 aa, Sorghum bicolor
  Clone ID: SORBI-28MAY03-C33628_1.pep
MQRRVVGMADGDARGRTLGAVIKEKDEELALFLEMRRREKERGAAAAAAAAAADQLLLSGDAVAGDGMLLLDPPPPAEPKPAAYKVAGCGFRRAPGGADDFLNADAGDKNDYDWLLTPPGTPLFPSL

SEQ ID NO: 33567 - protein, 171 aa, Sorghum bicolor
  Clone ID: SORBI-28MAY03-C33634_1.pep
MATCRKMARVDVAELKQRLVKRLGRERAAKYFAHLTRLLNLKLTKVEFDRLCVATIGKDNIALHNALIRGIIGNALSGVPPPSRQAVTGQSGTTTAPSGQCVSVVLPVVGNVGAVLDSGDGELARERGAPVGKVVSVEDGEEVEQVRSAPCVQSRSPITTPLGISVAGGSA

SEQ ID NO: 33568 - protein, 171 aa, Sorghum bicolor
  Clone ID: SORBI-28MAY03-C3365_1.pep
ETPVEVVKEQDKEFNKQATDAIIPSMPGHVVQAFTLLKSSPEAQSVVASLASDRNVWEAVLKNEKVMEFYKNHQTTLVATFPEEAATVESLGNFEDATSENASNTELPTGSPFSDFVDNAKKRVMDVIYNITDFFKDLFDSAGAQDGASPSAEKAPSAAEMALSGSSWLWP

SEQ ID NO: 33569 - protein, 111 aa, Sorghum bicolor
  Clone ID: SORBI-28MAY03-C33882_1.pep
SLCEGLQRRLHSNGTGVTVQAIDALNRGLDEFLRRLIKPGVDLSRVRASSRRNSKANERFAGRMNSLQQSNQGQCTTLQDFAVAVQSDPRLLGPNWPTQIEKIQSMSFGGE

SEQ ID NO: 33570 - protein, 80 aa, Sorghum bicolor
  Clone ID: SORBI-28MAY03-C339_1.pep
PSVHKLDNYRRSFLPGTKGIHNCLSFEKILDPHITIRKLNAKEQAELWQNSIRKLISTEQAELRQNIDESLRCPADRTPT

SEQ ID NO: 33571 - protein, 78 aa, Sorghum bicolor
  Clone ID: SORBI-28MAY03-C33903_1.pep
FPNKIRAKAMALCMSVHWIVNFFVSLLFLRLLEQLGPQLLYTIFSSVCVVASIFVRRHVVETKGKTLQEIEVSLLQPQ

SEQ ID NO: 33572 - protein, 158 aa, Sorghum bicolor
  unsure (1)..(158): unsure at all Xaa locations
  Clone ID: SORBI-28MAY03-C3391_1.pep
SDFGLAKDGPGEDETHVSTRVMGTQGYAAPEYIMTGHLTTKSDVYSFGVVLLELLTGRKAVDKNRPPREQSLVEWXRPCLRDARRLERVMDRRLLHPTPTRAAHKAAGVAHQCLSVSPKSRPQMSAVVEALESLLALDDAVXEPFVYTAPAATDDRLT

SEQ ID NO: 33573 - protein, 154 aa, Sorghum bicolor
  Clone ID: SORBI-28MAY03-C33911_1.pep
FSQDKSFSFQSANEIGDDVSPTNIISKLSLLVLHFPRLRIIWSRSLHATAEIFMSLKTNQDEPDEKKATRVGVPSEDGIVEDDVRSENYNTPAIEFLRRLPGVTDSNYRAIMDGCNSLADLALLPVERLGELMGGQKAARTLKEFLDAKCPTML

SEQ ID NO: 33574 - protein, 82 aa, Sorghum bicolor
  Clone ID: SORBI-28MAY03-C33918_1.pep
SEREQIDLSWQLSLQKVWENLPNGNKGLNDANSGRTSSVFESLPLAIKWLRETAQQNQSIRFQVLVAGSLHLVGDVIRLLKK

SEQ ID NO: 33575 - protein, 124 aa, Sorghum bicolor
  Clone ID: SORBI-28MAY03-C33940_1.pep
LNDFVEMFRAKTSYRIVEPAHMELAEPTIKDAFGKCVQQGASRVIVSPYFLSPGRHWKQDIPALAAEASREHSNIPYLVTAPLGLHELMVDIMNDRIKYCLRHVAGDIDECTVCAGTGKCRLYS

SEQ ID NO: 33576 - protein, 156 aa, Sorghum bicolor
  Clone ID: SORBI-28MAY03-C33760_1.pep
ATKSHRLWVTDPLSPSSSGPPTPSHSATHLVPANTGSNSGTSPPMSPSASQSNLPSNSNLPIPVLTSHPVTSGGGLPPSLVPSIPASALPGARLSGRLLGVVSLTDILNVQARASGLSPADPTEHRNRRRRSSSSSVGVRRSGEIGRELFSRGFQA

SEQ ID NO: 33577 - protein, 83 aa, Sorghum bicolor
  Clone ID: SORBI-28MAY03-C33778_1.pep
LKEIHQIELSSRHLMEITDAAEFPLHEDKDVQVREAAQDLVHLCDTIKEGLDPLEREVRQMFHRIVRTRTEILDCLSKPHGTQ

SEQ ID NO: 33578 - protein, 99 aa, Sorghum bicolor
  Clone ID: SORBI-28MAY03-C33783_1.pep
LNKGAVKGFHDARDKLLVNFDPTTYFLRDLKCEFSKTFKLWYGSIGGDAVGLTWENPKKRGREEADETEPEPTSILKEVGDVGKGLVRGVYLVKAPKLQ

SEQ ID NO: 33579 - protein, 253 aa, Sorghum bicolor
  Clone ID: SORBI-28MAY03-C34014_1.pep
TRLENKENLKSMLKDALRGKSDVFNSENPEEDKVKLGEPGWRDRYYEDKFGARTPERMEEIRRDVALKYTEGLCWVMHYYYEGVCSARGFYPYHYAPFASDLRSLSQLNITFELGLPFKPFDQLMGVFPAASAHALPLKYRQLMTDPNSPIVDFYPTDFEVDMNGKRFSWQGIAKLPFIDEDRLLAEIKKVEHTLTPEEARRNSTMCNMLFVNGSHSLSPYIYSLTSKFGHLPDKDPRWNQRKLDPSASGGMN
